United States Patent 10,724,096 (METHODS AND COMPOSITIONS FOR INHIBITING AND TREATING NEUROLOGICAL CONDITIONS) - sequence listing, part 31

SEQ ID NO: 365 - DNA, 1220136 bp, Homo sapiens
aacattttattttgcttttattttttctttttgaaatacaaaatgtgcacattgagtttacacaaacacgtgatggcaaatttcagtgtacatgtattgtactactcttaatttctacactggtgatagcagggcagctttcaacatcctatctctacaccagaatagatacctgatttattgttgcaaagacagttgcaaatttcctccttctgtagcctcttggtctttgtgatatttctacaaaacagggacgatgtgtgtggctttagtaatgtggcaactttacagttttggctaagatgattaaaaataatctgaattatgatgagctaaatcatactgtaatctggattagttgttgagcacttattttctactaaatcttggtagtagttgtcaatgtaatggaaccactggtgctttcaaagtgaattttgcttgctaattttgcttgctgtttgttcttagtagacagtggggtagtcaaggtttctttctttgtccctgaatggcttgtaatataaataaacatgctgtaaggaagtcaggggaaagaggacagatttggcctttaatgctgttaggattacttgttattaagcattactatatactggaggatagatatcctgaccctttgcatatgtctgtaaacatccttgttttgtttgatgccttcttcaacttccacttaatgattgatactaatgattgatacaatagaaaacagcctgtaagaaagattgaacaaatccaaaattattatataggccttggctgtaacatattatggaaaattaaatgcttattaaaataagttttattaggcatatgctgatatctgataataaactaatttttaaatgtttaataatttttaaatgtttaaaaatgccagataaaactaatttctaacagaaggtgggaaggccatagaaactggaactatgtgtttttttaattgttgtaatcttgtttccttaaagtatataaatggaatttaaatggaattacagcattcaaacatgaaaattaatttaatttctggaaattaaatgcagatgtcactatattagaaaaccattcaaaatcctaggactgaatacatacaaatgagtagcaaaaaacactgatattttaaaatcactgatatgtgaaagcctcaataatcccatggctaaggaaccaataaaactatatgccagattctattacttttgaatattcacagagtatgaaatgagttagaccatcccctgaactcagtggcattatgaaaaggatgcaaatttataactgaaagctcaaatcttttggggattgctttatattaaaacaaagcttgtttgcataatatgcttcagtgtcaagctgagcaatctatgctaaaagtggtagctccaactttaagggtggtagaatagttcacatttgtctgttggattcaggatctatttgacaagttaaatcacattttcaaagagctgcatggagcgcattatgttttcatcctgtaagggagaaacacagagcgattaaattcagcatatctgcaaggaaaagtacactattttgcccctgagtattgcctcctcccatcaaccacctcaaccacctatgccaaaagctcaaatattaagtgtttgcaaatgtaaatgccattctattctatccattttccacatagatgactatgaaggacccattttatattttgtggagtctattgaccaggcattaaaccactttatttaaatctttacttggtattaatagaggatatttctcaaatcataatgccaaaatggaaactacagaggtgcagaggtgtgtcaaagcaaatgagaattttggcattctatgtagatcacaggccaaatcacacagacttttatacaggtacaaggaaaatttgtgtgtatgagccagcagttcatgaagattggaggctggcgcataggaggcagggtggtggattaagaggtaacatgtttgcagtaatcatctctctttctgtctgctagttatggctaaagctgcatggcctgaaggagcctttaaaaatgaatggtctctcaattacagagaaagaattggggagcagaaaccactgctcagtggctgtgttcagtttagcatattctttagaaatgagttaggggacagactttgggcattattggagcacttgtcagttgcatgtgaatagcacttactgagctgtttatggtagtggtaaatggtggctgaaccaataatggcttccactgctagaaaccaagtaacatcaccgtcaagcagcttaatgtcaccaaattaattctctcaaagaccactgcatggaaatccaagttgagagacaagcagacatccagaaaagtaagaacaacaatttaaaaataaagagaaaaactaaagaaacaacggatttctttgttttcaggattatttgaaaaattctttttttctttttttagttttgaggcagagtctatttctgttgcccatcattctggagtgcagtggcacaatcatggctcaacagggatcaagtgatcttcctgcctcagcctcccaagtagctgagacttcagccacgtgccaccgtgcccagctaacttaatttttttttgtagagatagatagggtcttgctatgttgcccacattggactcaaaatcctggccttaagttatcttcccgcctcagcctcccatagtgctgggattacagttgtgagctactgtaccaggccttaacaatttttaactgtggttctgcccacacatcaagtcaaataattctaagtaagctaacactggtttctttgataacaggctactacctggagttctcttcagagaaaattttccactgtttattttttgtgactgaagaccattagtgagttcagtcaaagagccatttcttgtccacatacactaaaacaatgacttttctcttagaaatcagatagaagcttggcctgttgtgatgccatacttggctatctaggaattctaatgctgtggagatatgatagataatatatgagtgatgctaagttttggcaaagagcaattcaaatctcatgtatgttttatcctccatgaatactctctaaggaatttgggaatcaacacagtacatgtacaacttttgtatccccagggtttcctccatagcctgactcagtgggcactctaaatgttgattatgtaattggtgcttgttttcagagtggtaggcttatgctgcatgttgtagaagtggtaaacttaggcatatgatctctatatttcgcccagttcatggtagctagctgctaatactcagtttagctgttatgatagctgaattgatagttattacactttcattacttactttttggcagctttcaatgaactcatctatggtaacaaccccatctttatttttgtccattttctgttcaggaagaaaacaaaaattgtatttagacttatcccttaataccctcacacctggaccaaatgagctgaagctgataaaaagaaaacctagctgcttatttatttcacgtggaggaactgtttcagagcaggaaccagcagttttttagagataaaaatgatagggccaaatgcttctggcttttcccttttcaatataatgtggtgaagatgtagagtcactctgtcctaggtaaaatcccaccttctagatgtgacagagcttgcgcaatttgctgaaactttcagagcttgctttttgtctcatctgtaaaatgagattaatgaggatttataggattcttgtaaaaactgaatgaaaacaaaacttgtgaaacatgagaactgtttagtgttgtatcttggatttagtgaatgttcaataaatgcagttatcagcattgtaaattcaaaaccaaagctattaaattaataggatgctaaatactgttttgtttcagtaaaaattattttcctttgctctcttttgaatcatcgtggtgcatggcaaacatcaggaaattttctcctaacttcatgccctcttgacttctgttttaattcctacctgaaaaaatgtttcaacgtgttgtctgggagcatcttctttgaggacaggatatgtacatttacccatcatatcgtatattgctttcattatatcaagcatttcctgaaaaataaaaggcactcacgtgaggctgcacacatgtatgaagaaaccagtctaagaagctctgacagatttttcctactcaattttaaatttttgactttttgtttgttggattctttgttagacgactgttggttgtcccaaaggaaaaggcaacaaacagctttctgccttaagagcagaagaatcagaatttaagaatgaattctgatctcttggtttcaaaaggaagcaaatttccatgtatctaccatagtcaggaaaagaatatgctggcttaatgtttggatttctatagactttaagtagactatgtttatttaattgcattatatatcttatgtgttgatcatcagtttccatctattgagaatcaaatatacggcacatcgtatattgagaaaaaacaccatttagaattagtgaaattaattggtaagtcttaaggttcattagggtttttgttgtatttttcctactgtggctttaacttaagtcacatgtgaagactagtcaaaaaattttgaccctgggaaacacctttaaattttgttattaactttttctctaaaacagtctaatttttgccttaccactttcattcttatgagagtaaaaataatctctaataacttaaacatttagatttattgttgcacatttgtttcacgtgaaagatctctcaattaggttaatacagagcgaatatatatttacttttaagagtattcaattataaatgatagagtaatttgtaaacaggtgaaaccttttaagatgttttaagcatagataagtagcaagtagtttgttagacacaggcagaattcttgagatgtgttaaacacagaggtaagaattgaagaacaagagatatttaaggtatcctaagtatctgggtaataaatattcatgatataaaaatatacaagaagcactatttaggatatgctccatatacatgaacacaatagccataaggtcttaatttggcacccactagtgatacctattctggccccaggtgtcctctgtgcaagaaacacaaatgaaacccattactacttatcaggctatactcgtgacctggcacacttgcacctgtgtctctccagtagcgcaagttcatgtcatttgctgttggccctgggcaccttttgtctgtggggcctcttgctcaaaactcaattctggggaagtctcgtgaggcaaagagagacaggacataggcacactgagaatgcccaggatttagggagtggtctttcaaccccatttgcagcctgtcctgcgtggttaacttactccatccctttctttacttctcgctgtgttttaaattggtttaataaactgtgtaatacgagtatcttaatttggtctgtgaaccttgtttcctggatagtctgcctcaacgtgcatttggagaccccaccattgcgtcaggtcattccacaatccccatgattgtaaaatttcatttccttatggatcacatgctgtggggaaaagaaaggcttcaggctaaatgttgaaacatgggttggatacattttctttctatctgattccaaccatgatctttattccattcacagtatttattaagatgccagcaggaaacaagggtgtaatctttatgtgttatatatttactttggagcttcaccataaactacttctatcccaagtttttaattgtacatctttcttccactacataaaatattttggaatttcctcaaaaaaacttttcaaattaataattgcaattaatattttaaagttaagaaatgaaaatggtccaaattactgtgatgttggtgaggcatcccttacctctttagtgatgtagccatctttatttatgtcatacagattaaatgcccaattgagtttttcttgtactgtcccccggagcaaaatggaaagacctttgatgaaatcctgaaaagaaataaaaattcaattttatatgacatttttaaaaaaacaaaaacaaaaaaaacaaatgatgtaagtaagggctacaaccctctggatcttgaacatttagcaaaatgattgatgtgttattggttgtctagttttcagacttctctgtgggcataaatcactccttagtcttaacattttcatattctaattggaaactgagttaaatcaatggtcatactggaaattgtaccagtgcgtacccacacagctagaggcttgagtataagtggtattggctttccactgcaagtgcacatgatttactaaaagaatctaataatagttttttcaaaaaaatacaagtgcacacataacacacttcaatgaaaaaccgtttgctaataagaaatgtggctgtccataaaagataaaccaattgtggtctttaattagaaatccagttataatttacatgtggacagtgggtaagagcatggaactggaaaggacagactgcctggattcaccctccagctatattactggatggctttgtgtcttcaggcaacttaacatccctttgcctcaattttcgtatctgtaaaatggagctaataatagtatctacctcttcacaattttatgaggattaaaaaagaggctgcttataacagtccttggcaatgacattggctatgtaagtttttgttaagtaaatggagccctcagtttgtatcctggttagattgcattgcagactggccagattaacttgattaaattcatttagtgtttttttttttgtttttttttttttttttgagatggaatctcgcactgttgcccaggctggagtgcagtggcacaatcttggctcactgcaacttccacctcccacctcccaggttcaagccattcttctgcctcagcctcccgagtagctgggactacaggcacccgccaccatgcctgactaatttttgtatttttggtagagatggggtttcaccatgttggccaggttggtgtcgaactcctgaccttgtgatctgcccaccgccgcctctcaaagtgctgggattacaggcgtgagccaccacgcctggccagatttcttgttgttatgtacagcagggttaacgttacaatgtgctgtattcagtttataatccacttttaggtaggaatgaaagcagaggggaaatccaaaagtcttctgggtgaatttgcattatatctccctttctcacattccttccttttatagctgtatttctatctgaatttctcaaaatgttttttcttttttaaataagtaacatccatatagttcaacatttaaaaattgtgtaagctgcctggtgaaaaatctttcttcccttcctggacccagccacctgttcctttcactcatagactactggcataaatagtttgtatttacttccaaggaatttttgtgcatacacaagtataagatatatttgttttactagctaacagacttctatacttttttttccacttaagcataaatcagggaaacaatttgagtttccattgtatatgtaaatacatcgtagtttatttaaccaaattgttcttttacattttttctcatcattatttctaggtattttaatatttctgttgctgttgtaaatgagatatttttttctatcatatattctaaactagttgtttgtatgtatgaaagccattgatttctgtatgataattttataccctgtcaatttgctgacatacgttggttttcttctgggttttcatgtgtgcaatattagctgcaaatggaattaattttacctttttttctaatttttatatgtttacttttttctaattatatggcctaatatatatagaacagtgttacataatgaaaatgataatagatattcttagttttttcttgaacttgagaatatttcaattcgcttttaagcatgatacttacttttatcatggtaaagaattatacaacccttccacttaagcaaatttatcaagaatggccacagaccttttttagcaaaaatgaaaaagacaaaaacagaaataattgtcaaattcatattgcaagggaccctgaatagcccagtcaattttaagaaagaaaaacaaacttggaggactcacactgcccaatatcaaaacttagtacaaagttacattaatcaaaacagtgtggtactggcataaagacagatatatagaacagtagaatagaattgagtctagatataaaccagctgtctgtggccaattgattttcgataatggtgccaagaccattcaatagctatggaaagaataatctcaatatatggtgctgtggcaactggatcaccatacttagtttgcttcccattggcatgaagggtagaatgtcaagtgagagaaaaacaagattccagagaaagccacaaggaattccaatatttggcaggtacagagaggagaagctggcaaagcatcttgaaaagaagttgctaaagaagtgagtcaggagaacagagcatttccctaggaaaggattgttcattttgctccaaggttggaaaaatgttcactggaccagcaacatggaggtcaccagcaagtgatagggaacggtccagtggagtaggagtgaagagtaatttttaatgaggagcactttgaatactgaagagaagaatctaaaaagagtaagagtcagaaatgggctgtgctcttgagaaggtggggaggatccagaacatgggtagatgggccgatctgagaagggagttgatacatgagacagaagaacatggtgtggatgccagcagctgctttgcaggtgggaagatgactgtgtttctgtccgatagctttagtgagtgtgagctgtttgagagtgaggagcctggtagaagaggtaagaatctgaggtttgaggagagaggcagaagctctgatactaagcagtaagatgacatgcaaattagagaaagggagacctccctcaaattatttccctgccatattttagaaaattatttatgacatagaatgtagtttagttaaaaggtaatgacagcccttggaggtatgagtgtacatcttgcacaaccagcaggctggggatcatggctcatgcctgtaatcccagcactttgggtggtggaggtgggaaggttgtttgagtccaagagtttgcaagcagcctgagcaacgcagccagatccaaattaacagcaagaaaaacaaattaactgggtatggtggtgcacacctgttgtcccagctacctgggaggctgagatgggaatcacttgagcccagaaggtcgaggctacagtgaactatgattgcaccactgtgcttcagcctggatgacagaccaagactctgtctcaaaaaaaaaaaaaaaatccttagctttttcagaaggcataaaatatacattgcagaacatagagccttattcaaggaagattgctgagcagttttgaaaggctagatgagattgattgttatcaatgtaaacgatatttttaaaaattcacagcgtagtaataatatgtcattaattgtaaggggagctggccacagggtctttgaaaacatgcttagagtattggttctcaaaatataatgtgcaacacagtcacctggggagtgtgccaaaagatttatgggacctactccaagaattatgattcattaggttgaagtgggaccccaaaatttacatgtctgacacattccaaggggaagcctgtactgcttccagggatcacactttgagaatcactggcctacagcactcatcactggcattgacctcaccaccacacaaaacagcagagaaacaatgaaagatttaaagatagcacttttggggaatccccccaagatggctacataggaacagctccagtctacagctcccagcatgagcaacgcagaagatgggtgatttctgcatttccaactgaggtaccaggttcatctaaactgggacttgttggacagtggatgcagcccacagagtgtgagccgaagcagggtggggcatcgcctcacccaggaagcgcaaggggttggggaattccctttcctagccaagggaagctgtgacagatggtacctggagaatcaggacacttcctgccaatattgtgcttttccaacagtcttagcaaacggcacaccaggagattatatactgcacctggctcagagtggcccacacccacagagccttgctcactgctatcacagaagtccgagatcgaactgcaaggcaacagtgaggctgagggaggggcgtccaccattgctgagacttgactaggtaaagcagccaggaagctcaaactaggtggagcccactgcagctcaaggaggcctgcctgcctctgtagatgccacctctgggggcaggtcatagctgaacaaaaggcagcagaaacttctgcagacttaaacatccctgtctgacagctttgaagagagtagttctcccagcatggagtttgagatctgagaacagacagactgcctcctcaagtgggtccctgacccccgagtagcataactgggaaacacctcctagtaggggcagactgacacctcatacagccaggtgcccctctaagacaaagcttccagaggaaggatcaggcagcaacatgtgctgttctgtagcctctgctggtgataaccaggcaaacagggtctggagtggacctccagcaaactccaacagacctgcagctgagggtcctgactgttagaaggaaaactgacaaacagaagggaatagcatcaacatcaacaaaaaggacatccacaccaaaaccccatctttaggtcaccatcatcaaagaccaaaggtagataaaaccagaaagatggagagaaaccagagcagaaaagctgaaaagtgtaaaaatcagagaacctcttctccaaaggaacgcacctcctcgccagcaatggaacaaagctggatggagaatgactttgatgagctgacagaagtaggcttcaaaagatcagtaataacaaacttctccgaactaaaggaagatgttcgaacccatcacaaagaagctaaaaaccttgagaaaagattagacgaatggctgactagaataaacagcgtagagaagaccttaaatgacctgacggagctgaaaaccatggcacaagaactatctgatgcattcacaagcttcagtagccattttgatcaagtggaagaaagggtatcagtgattgaagatcaagtgaatgaaatgaagcgagaagagaagtatagagaaaaatgagttaaacaaagcctccaggaaatatgggactatgtgaaaaggccaaatctacgtctgattggtgtacctgaaagtgacggggagaattgaaccaagttggaaaacacccttcaggatattatccaggagaacttgcgcaacctagcaagtcaggccaacattcaaattcaggaaatacagagaatgccaccaagatactccttaagagcaattccaagacacataaattgtcagattcaccaaagttgaaatgaaggaaagaaagttaagggcagccagggaggtcgggttacccacaaagggaagcccatcagactaacagcggaactctcggcagaaactttacaagccagaagagagtgggggccaatattcaacactcttacagaattttcaacccagaatttcataaccagccaaactaagcttcataagtgaaggagaaataaaatcctttacagacaagcaaatgctgagagattttgtcaccgccaggcctgccttacaagagcttctgaaggaagcactaaacatagaaaggaacaactgataccagccactgcaaaaacatgccaaattgtaaagaccatcaaggctaggaagaaactgcatcaactaatgagcaaaataaccagctaacatcataatgacaggatcaaattcacacataacaatattaaccttaaatgtaaatgggctaaacgcaccaattaaaagacacaaactggcaaataggattgtcaagatccatcagtgtgctgtattcaggagacccatctcgcctgcagagacaaacataggctcaaaataaagggatggaggaagatctaccaagcaaatggaaaacaaaaaaaaagcaggggttgcaatcctagtctctgataaaacagacattaaaccaacaaagatcaaaacagacaaagaaggctattacataatggtaaagggatcaattcaacaagaagagctaactatcctaaatatatatgcaccaatacaggagcacccagattcataaaacaagtccttagagatctacaaagagacttagactcccacacaataataatgggaggctttaacaccccactgtcagcattacacagatcaatgagacagaaagttaacaaggatatccaggacttgaactcagctctgcagcaagcggacctaatagacatctacagaactctccaccccaaatcaacagaatatagattcttctcagcactacgtcacacttattccaaaattgaccacatagttggaagtaaagcactcctcagcaaatgtaaaagaacagaaattataacaaactgtctctcagactacaatgcaatcaaattaaaactcaagattgaaactcactcaaaactgcacaactacttggaaactgaacaacctgctcctgaatgaccactgggtagataatgaaatgaaggcagaaataaagatgttctttgaaaccaatgagaacaaagacacaacgtaccagaatctctgggacacatttaaagcagtgtgtagagggaaatttatagcactcaaagcccacaagagaaagcaggaaagatctaaaatcaacaccctaacatcacaattaaaagaagtagagaagcaagagcaaacacattcaaaagctagcagaaggcaagaaataactaagagcagagcagaactgaaggagacagagacacaaaaaacccttcaaaaaatcaatgaatccaggagctggtgttttgaaaagatcaacaaaattgatagactgctagcaaggctaataaagaagaaaagagagaagaatcaaatagatgcaataaaaaatgataaaggggatatcaccactgatcccacagaaatacaaactaccatcagagaatacgatgaacacctctatgcgaataaactagaaaatctagaagaatggataaattcctggacacatacaccctcccaagactaaaccaggaagaagttgaatccctgaatagaccaataacaggctctgaaattgaggcaataattaatagcctgccaaccaaaaaaaagtccaggaccagatggattcacagctgaattctaccagaggtacaaagaggagctggtaccatttcttctgaaaatattccaatcaacagaaaaagagggaatcctccctaactcattttatgaggccagcatcatcctgataccaaagcctagcagagatacaacaaaaaagaattttagaccaatatccctgctgaacatcgatgcaaaaatcctcaataaaatattagcaaaccgaatccagcagcacatcaaaaagcttatccaccactatcattttggcttcatccctgggatgcaaggctggttcaacatacacaaatcaataaatgtaatccatcatataaacaaaaccaaagacaaaaaccacatgattatctcaacagacacagaagaggcctttgacaatattcagcagcccttcatgctaaaaactctcaataaactaggtattaatgggacgtatctcaaaataagagctatttatggcaaacccacagccaatatcatactgaatgggcaaaaactggactcattccctttgaaaactggcacaagacagggatgccctctctcaccactcctattcaacatagtgttggaagttctggccagggcaatcaggcaggagaaggaaataaagggtattcaattagggaaagaagaagtcaaattttccctgtttgcggatgacatgattgtatatttagaaaaccctgtcgtctcagcccaaaatctccttaaactgataagcaacttaagcgaagtctcagggtacaaaaatcaatgtgcaaaaatcacaggcattcctatacaccaataatagacaaacagagccaaatcatgagtgaactcccattcacaattgcttcaaagataataaaatacctaggaatccaacttatatgggatgtgaaggacccttataagggtgtgaaggacccttataagggtgtgaaggacccttataagttcacccttatgtgaactacgaaccactgctcaatgaaataaaagaggacacaaacaaatggaagaacattccatgttcatggataggaagaatccatatcgtgaacatggccatactgcccaaggtgtaatttatagattcagtgccatccccatcaagctaccaatgactttcttcacaaaattggaaaaaactactttaaagttcatatggaaccaaaacagagcccacattgccaagtcaatcctaagccaaaagaacaaagctggagacatcatgctgcctgacttcaaactatactacaaggctacagtaaccaaaacagcatggtactggtaccaaaacagagatatagaccaatggaacagaacagagccctcggaaataataccacacatctacaaccatctgatctttgacaaacctgacagaaacaagcaatggggaaaggattccctatttaataaatggtgctgggaaaactggctagccatatgtagaaagctgaaactggatcccttccttacactttatacaaaaattaattcaagatggattaaagacttaaacattagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaggaacttctgcacagcaaaagaaactaccatcagagtgaacaggcaacctacaaaatgggagaaaattttcgcaacctactcatctgacaaagggctaatatccagaatctacaaagaaattaaatttacaagaaaaaaaaaaacccttcaaaaagtgggcaaaggatatgaacagactcttctcaaaagaagacatttatgcagccaccagacacatgaaaaaatgctcatcatcactggccatcagagaaatgcaaatcaaaaccacaatgagataccatctcacaccagttagaatgacaatcattaagaagtcaggaaacaacagatgctggagaggatgtggagaaataggaacacttttgcactgttggtgggactgtaaactagttcaaccattgtggaagactggtgactcctcaaggagctagaactagaaataccatttgacccagcaatcccattactgggtatacacccaaaggattataaatcatgctgctttaaagacacatgcacatgtatgtttattgcggcactattcacagtagcaaagacttggtaccaacccaaatgtccatcaatgatagactggattaagaaaatgtggcacatatactggattaagaaaatatggcactatacagccataaaaaggatgagttcatgtcctttgtagggacatggatgaagctggaaaccatcactctcagcaaactatcgcaaggacagaaaaccaaacaccgcatgttctcactcataggtgggaattgaaaaatgagaacacttggacataggatggagaacatcacacacgggggcctgatgaggggtcagggggatgggggagggatagcattaggagaaataaataatgtaaatgacgtgttaatgggtgcagcacaccaacatggcacatgtatacatatgtaacaaacctgcacattttgcacatgtaccctagaacttaaagaataataataataaaaatataaaataaaaataaagatagcacgtttaagtcaagtgtggacttgtgttgtttgcctccctagccctagtaggtcccaaatttccatttggtgctccatgatgttctgtggaagttcacttcatctctgagtctagtgatagagccatgacctgggcgaagtcaggaagcacattttatccctttggccggacaactggatttgtggttgccatttgactaaacctagtccaggtctaagaatgactccccagactcagactcttgctaggaatggtaggacagagatgtgcttctttccttgctcaacaggagcaatgaatcatggagccaaggagctttggcctcttcttgcagccctacagggtcccacccttaggttgtagccagccccatctctggcctttttgttgctgtgaaccaatgaaattaccatttttttttgtcacttggtgtatccttttctagtatttgtgaacaaaagtatcctgattcacatggtgacatctaattcacatcttcttgaatactgtatatcctgaaacaatttacattaaaagatagctatggtcttagagcacctctctctttttatcctgtgggatgatatcagtaaagagttactcaaaacaggaatgatatcttttcgtgcaaaagaaaaatgagaaacttaatgtggcttataagacttttgctccgtgcttttctgagttgtaattgaagtctcaagtaggaagtgacaaacttaacaacaactctcaatgagtactttgcacaattactttacttgtaaatgtgaaaggaggttatatctgttccctaaagtacaaaaaatgataaaggggtggagaggtctgtaccgaattctggtttccattctcttattatcaaggcaaaaggagaaagacatagagatttgactttataatagcctagacttgttcagttgtggattctgttcatctgccaaacctttaatgagtgcctcagtgctggccactatgctggggacaatcctcctgactcccctgactccctgccaatcaaagactgctatggcttagaatgatgcatttgcatgtagttgccttactgggtaatgagatgaccaatgtcattattaactggctttgttagaaaaattcccccaactagtgtaaattagttcaaccattgtggaagactgtggcgattcctcaaggatctagaactagaaataccatttgacacagccatcccattactgggtatatacctaaaggattataaatcattctactataaagacacatacacatgtatatgtattgcagcactattcacaatagcaaagacttggaaccaacccaaatgtccatcaataatacactggataaagaaaacgtggcacatatacaccatggaatactatgcagccataaaaaaggatgagttcatgtcctttgtggggaatgaagctggaaaccgtcattctcagcaaactatcatgagaacagtaaaccaaacattgcatgttctcactcatagctgggaattgaacaatgagaacacacggacataggaaggggaacatcacacaccagggcatgtcggagggtggggggctaggggagggataatattagcagaaatacctaatgtaggtgatgagttgatgggtgcagcaaaccaccatggcacgtgtatacctatgtgacaaaaatgcacactctgcacatgtatcccagaacttaaagtataattaaaaaaaaaatcccccaactgataactgctatagttaacatctaataactactgagcacatatttggtgccagacacagagccaagccctttactgacattatgactttttcatttttacattatcttattaagtagctttgattgctgatgttttagcagtatgaatgctaaggttaagaaggttaagtactcagcctagggtctcagagccgctgggtggcaaaatggagattagatcccatcataccaaatccagggcccctcctatcatatttcttctgcctttcaggtttaagcaaattaagtggaaaactcccattaccctttatcgtagaatcagatggtctctctactgtacctctcagtatgctattgctattattcaaaatgtgttcattccctaaccatttctattttctagagatttcccaggtagctaatcaatttagaaaagtaactgcaacagcctagttttaaatttgattttcattcaaactttattaatttagccattagttttcatttaaaaggaaaggcattttaccaacatgcatatcatatataatcattacaactaatttcccaaattataatcaacgttcattgcaattactggtattttacataaatattataaaagcaatgttatgcatggttccatatcattaacaccatactaaatttacatataaaattggatataatgtgccctaggaaattggtggtatatttctgacacataagtaatttcaagtaatggagtcactaatagtttttgccttactcatcctctggaagccagctataaaagtttatattaggtgaactatattaggtaaaacctttggcttctatattatagataaattaagactgtgctggaattaaacttgtttctaaagtgaagcaaacacaaacacaacattatcatgaaatgaccaaagttactatcatggagtgacctaagctgccattagcaaaagaaacattgtggagactggtacccaggatagtcttcccccaaccatctcctctccctccactaactgcttctacacccaggataaacctgcctgccccatcttgacttagttcattccctcaccttagttcattccttctccactctcagcttttatttttctcttctcagtgctatttctcacttaagttatgggagatgaccttttgggattcctggcccagaatcttcgcagttgtggtacccagtctgcatgagcatggagtatgtgtgaggaggctcttgcctgccctgttcatcctgcccctgtggtgactggctggatgacattgcagaaagctgcaccctatttttttcatcttgactccacaaagccatttcacccagatagctgcctacgcccatatgaacttttcttttaaacatgacagttctgttggaatacaattctaccaattttgttttaatttcttttgaatttgtttcatgcttcacctccaatacctttactggagttcaggcttttatcagaccctgtctgcactcttgcaatacttagctgctaattacactccatgtttccaggaatatagctctgataaattcacatccctgccaaaaattctacaaaggctcctcatctcctacaagatagtccaatctcctgcctaagacatgtcaacttctggcctctatctccttccccaaccttcgctcttggctctccaattgtgtattctatcttcttgatgatttacacgtttcccttggttcccaggcctgatatactctgtccagcctctgccccactctccattgcttcccatcccattccaagcctttgttctcttaaggagctcctgactgtcctttagacagtccatcagttgcactgagcaggcttccctgctacagccccttttgtgccagtaccatttccttgctggcctcattcatcatctgcttccctttatcagagctctcatcaaaatttctgctcatatttaagatgcatccttcctcacttccaaaaataaatgcaccttccaaattttatatatatatatatatatatatatatatatatatatatatatattccataagtaaatataaatgtatatatggaaaagagaaactggaatcacaaagcaaaatatgtataatgctacttctgagaccaagcacaacccaatcagaatgtaacaaataaatgaggtatacatttctcacatattttccctaacaaaaataaaagccttcacagctgatcagagttcatgttgggtttattctcctaatgtttaaatcaatatactacaatttatgatctgctatttaccatttgaatcatatgaattacgtgtgtgtgtgtatgtgtgtgtgtgtatatatatatatatatatatatgaaatacatatataagctatgtaaatatctaggacattttattttactaggtgtttatacacagtagttcatgaaggaaattaaatactttctagctgggcgtggtggcacgggcctgtaatcccagctactcaggaggctgagacaggagaatcacttgaacctgggaggcagaggttgcagtgagctgagattgtgccactgcactccagcctttatgacagagcgagactctttcaaaaaaaaaaaaaaaaatacgttctctacagatcacttaaagtttgtaatttaaaaagagatttcctcgtagaattgtcaggctggtgaatgtagtctttttctacatttaatttcttgcctgtgtgccccacttactgagacttccataacaggacttttgactttatcatctttgtatttccaaggtctaccacagcaactggcccataaggaggtgtcagtaactgttagttaactcatttgccttccaggacttttcacatgtaattgaagaagtggactctccttgtatgagccgatataaagcattagaaaataaactgaatgtggcttgcaatttgtacatcttttgaaagataatttttggcaattacatgagagaaagggagtgtccttgggctttctttcccctgagcaaaaataatcatcaccaaactcacattttccccctaaaaagactaaactctaaatagtcaaatgatatgaaaataatccagagcttacctcgaaactcacagctccattgtggtctgtatcaaatgcattgaacagaaaatgtgcatatgttgtagagtctgaaatggtaaaaagggagtatcattaagtcagtgtttccatatcctacataagacttggatagcagtccaagcttcctttgatccagaagaattaactctgcctcctttagtttgtgctttcttcacaactgcttaccctctttctgtagaggactagagtttgagattcacaggaagaagcaacctacatagaggccattggtgacaaacattctctatgagtttctggctggcaatgctgtagtcttgggtgatgagattaacactgggacaagaaatggtcccataggtggatgtgaagattgagacttgtctggaatttgcttagtgtttggaagagaccatctctagaagtaaagtactaaaaatactaccaatgagacagagatgagttgctattattagtgtctctgtcattattagaactttcatcattgttacaactcagaaaatgatattgggaattagagaaggtgaaaaacatacccaaagtcacacagtgaagaaggagtaaatctgggacatgaacttaggtctttctgactctgagaaccaggctagccctcagccagtaccaggctagcccacaggcagtaaagttggctgatggattggggtcattggtgacttgggaagtttctgtggctgtgttggaaggggactgggtggtcctacatgttcctagttgtatgaagttgcatgaagtagggagcccctactctgtctgggtcctgggtgggattcaaggatctgggtaatgatggacaggtatgtcttctgaagtctaacaggtgttcttagtttgcttctattgggtattcttcccctctcatttttccttccttcctttcctgtttctccgttgtctccttaatctctgggctttctgccatttcatttaaaagtctgtattttttccttattgttttctgttctgagtgcctagctttcattccttagggtttctttgcttgacccttgataaaatttacattattattttcagtgttgcatctcatgggctttagccttttatcttaaccttttttgtcttttcaaaataaaatggtaaccttttagctcattggctctagccttttatcttctgttttaaatctcatctatttctattttataacttttaacctttattgggttttaacttatcattgatttaatttttactttatgaattgctttttataggctgtcaagaagctaagtcatagtaacaggagtacagaattgccctctgaggaggccatctaaatttctctcctggctctcagggctcacggcctccttacaggttgtttttcccgaatgcttcagtgtagtaattaacactactgaaggctatacatttcatgaggtagactgtacactcaatttctcaaaatgacagtggcatcttcgctcatctctcacctttttaatatgctatgaagaactacttatctttgaacacaggaattaccagcaccgttttcagtgaactaaccaagaaccaaaattgggtctaaataacatgtaacactgtgacatctagagtggatatccatccagtattgatacattgcaggaagaaattcttttgcatatggagccaggagtttaattaccataaacttagttctgttgttgggaagctccattatagagttatcaagaattggcagcctatttcaacttgcaaagttgttttactctcagcagtactttttcatgtacttcttgaactatatagtgccctctggagatgtgaattgatcgatggtgtgttgaactgattttcagaggaggaaaaaaaaaagagattttgcatattttataatgagcttcattaagcaagtctctagttaccctgttttcacaatcagagtaaatgcctttaccttagcaagcagtactcaccataaataatggctcaaaacaacgatgtttgctatttttttaatcaaaaagaaaaaagataacatgggtatatgataattactattcttctcaaatggagtttttctagcttaaagcttgatatgtgggaattatgctttcaaggtttacactaatgtggtacagaggacatcctgttcttctaaatgtgcctctgcagttcttttagaagttacagcggcttcccagtctagacaatctatgcacagaggttttgataatagcatagtggagtcagactgcctgaatttcaatctcagcttcaccagagattaactgcatgacctcaagcaagttgttttacctttgtgtggctcagtttcctcatctacaaaatgataacaatatcagtatgtacttcatagagttttttttttttttttttttgagacaaagtactgctcttgtcccccaggctggagtgcaatggcacgatctcgggtcactgcagcctccacctcctgggttcaagcgattctcctgcctcagcctcctgagtagctgggattacaggcacctgccaccatgcccggcgaatttttgtatgtttagtagagacagggtttcatcacgttggccagactggtctcgaactcctgacagcaggtgatcagcctgcctcagcctcccaaagtgctgggattacaggtgtgagccaccatgcccagccttcatagagatcttactaagtttaaatgagacactatttgcaaagtgtttagaaataatcctatatacttattaaaatttcagtaaatattagctattattatttcctaggcaagccacttttatttcaactaccttaaacacatgtgatcaaatcttttacaaacgtaacatcttttcaccttaaataacttgctgtttttgtaggatttctgttgtgtgtctaggtgacgagttctaatttaatgcaattttctgctcaataaaagacaagataattatgtcctaaaaatcaatggtccttctgatggagtttggatttcttctggcaagcacttgaagacagtggaaagttttaaagaagaggagtgaagccactggctttgactgggtgagagaaagaagcaaaggcaaaggaatgtccagctaggcagaaaactggataaaatgacgaaaagagaaactgtctacaaaagcatctatggttctggttttactcaactgtgttcttaagcactcaataaatatttgttaaaagagtgattaactgacttcttggaatctagatttcagtacagtccagggcttaaaagatataacaatgatctcccttctccgtctatgacctcttcgtgatcacattcctttacataacaaaaatagttactgagtttgttaagctgggattgcctcagtttcttataattttacttgtgaagctgaaaaataaatgttgagattttatagttgagcaacaaaatttacagattcttagggtgggaagacattttggatactatttagcattgtatttacattgaacaaaggtaaaaatagggacttgtagtgacatactgaggtcacctagttagttcatggtaaagttggcaatggaatcaagatattcctataccatctcttagaaatcgaggatactagagtagaaaaaacccctaggattcctttggtgtgactcctgcattttatagaggaacaacttgaggctaagaaaagtaaactactcgaggttacataccttggtggtggcagtctatccacaaactctgaacttagtccaaagttcttaacccaattatatcgagaacacagtgaatatagcaagtaaccctagagttcgttcttcatagtatttgaacaaacacacttgattatcatgccccaggtttgtagaatgaaatcaatctggtttatttctttttcctttcccacacccctactcccattgaattcaagcacgaggaatagaatcaccttcatgtatttgaatatacaattcatgacatcgttactatggtaagacaagttcatatgtgtgaatagtagcttctgtcaataagccctctgtaaatcaccctgaaaattgttagaaatactgtcctaggacaagaaggatactcagtgggtgaagtcttttttaaattttattttaatctttatgtctacagaactcatctgactcaagtgacttgcatacagcggctgcttaaaaaatgtttattgacagattattctgacttgagctcatttgttcattcattcattcattcattcattcattcaacaactgtttattatatgcctagtgtagacaacataagtgcattcctacaacatgagcaggaatagcccaggaaactatgatttttatgggctttaaaaatgtttagtgaactaaaagcttacacactaaagcttctgttgtatgtggagtttaagaagtttttgtgtaaccatataggcaatagcaccaacaaaccgtttcctctctgcttgccttacagtaggcatactttatcccctgccaacaagaggcttttgttcaatccagttttttctgacatccagctcaccaaacaagttgggtttgataaactgtttcacaaagcaatagagaaagctaacagcctgacacaatacaaattgcagagagttctgtagataagacaaagcactttcctggaggaaatggtgagatgttgtgatttatggacccatcaatgttactgttcataatgagaaaaactgttgcattcagaccatcatcctgaataaaggatgactccgtggaagtgtaaggatggccatcacatgaattcgcctgccatcagagatcacattcttccttaggacatttttccttttctggccttatgtaagaaacaatttgtatgtatgatattaatttttaaaaatgcaaagcaaatcataattctttaaaatatttcatttccttcagcgatgcctcatgtggtcagatttctgcattcaattaacatgaataatgaaataattgttaagagtgtaacagtaattttttctcaaatccctaatccctttggattttgtgataggaatcctttgcaaaatagatgtgctctgtttaagaagatgttctctaatgcagaaatgttatttttcaaataaagatataattttaatgtggagctctatccaagttttagtatgtaataacttgatttgaaatgattgaaaaataacttaaagattttcatctgcattggtgctttgatattaatgcctattaagatgttggtaggcactcagatagtaaatataatttttctttaaaaaatccatgggttttaaacaatttagaaaaacatgaggtagttaattaattccccaaattaatctctcattaatgcagacagtgaactcattataatcctggcatcaggtactattaccaatacctgtctgtggtttgttagaagggccctcccctctgcactgtagtaatgagatggggtgggagagttgtcatccaaagtatatccaaattcacttaataacagtcttcctgtgttttcttagaattctaatttaattcttttaaaagtccaccgaaaacaaaaatttgttttgacatgttaggcacaaaattgttttaaatccactaaactagctaaaaccaaatggattaaaaccccaaaggaaatctgacttttgtatgaaacaactaatacttaagtgctgtacacttttcaaagagccttttacagatattattccactgtacagtgatagccagccaccatgtgaggtgggtgtcattcattcattcatgcaaaaagcatttatcaagtgctattacttgtcagccactgtcccatgacctgtggatacaacagtaaacaaagtggagaaatcctctgttcccctggagctgacattctagtggagagaaagaaacaacaatggtacaagtgaaatatatattattggattgtctcgagtgccgaaaagagacataaagcaggggaaggggatggggaatgtttaaggtgttgcaatttaagatagagtggtcagggcaagtctcactgagaaggtggcattggcgtaaatgcaaaggtgatgagatattgagatagatatttgggagaagataatttcaggcagagggaacagcaggttcaaaggcccaggagcagcatcatggctggtgtgctggtgggatggcaagggggccactgtggctgggtggggtaagttgggtgggagaatggtagaggataaggcagagaagggacaagagacagtagccaccatttgtaggccactctgtaggttgtggcttatgttctatggaatggtatggtttcgaacaggcagtaacatgatttgcttgcattttaacgggatcactctgactcattttaagagtagaccatggttaggggaggggtcatcagaatcagagaagtcagtttggagactactgtgtttattttggcaggagataacggtggctcctttaagtggaaagtagtaaaaaaaaaaaaagtgttggcaaggtcaatggcaaagtcaactctggccataataacagagagaaacagttgtcccctatattgagtagatgtcaaagttgaaaggaagtactagatggttccctcttgtcttgagataaaaccttcttcctgaactcccgattcatggactccactatcccatcgcatcactatctttttcctccaattctgaatcctatttatctcttttcttttctatcctaaagctattaacatctccttctttaccagtcttccctgtgtataaacaatgtccagtcttttctacattaaaagataaagtcttccactggtatctacccagcactatgatcagtttcctcatcacttcactcttccagcaaagctttttgtaagtgctgtctctattggttgtcgctgttttcttctcatcgtccttttcaccctctgcaatttggcttctgcttgtgcgctccactccctagtagttcatccagggcacttgggctgtcctgatcatgcccaacaatgactcccatgttgccacatcccaaagagaccttctgatccttaccttactggacttcatcatttcatttctgaactatctatctctcttgtgtttatttccataaactgttcattctctgtctcctttgttgatcccttttccttatggttcttgacatgtgttctggagtttcatgctggcctcatggagcttgcaaccttttataattcccccagtaacctcatctacatcatggatttaaccactacttcttgattaataattctcaaatctctatctctttctctgacttgtcctctgagcctcacatttgtgccaacttcttgttgagtctaaatccccacaggcacctcagatgtaatttgtccaaaactgagatcattatcgccctattcctcctgtaaagagtcacctggtgtccatgatggaatcctggaaggtatcacaaactcctctcttcatctctttatgccacaaaaagttagttcatcactaaattcttccatttttgtcatctaaatatgtctgtaatctgtccccacttctcattttctcctatgcatatacttatttaaagaccttattgttttgcctcctacagcagtaatcttctaattagtctccctgcctgcagtattgctgacctcaagttaatcttccactgacctatcagtgaaatgtatcccaaacacaaatcaaatctgactgtaaaagatcccacttaaacttatcagtggctttgcatcacctcaaggataaagtcccatttcttcatatggcatccttgactctctaggacatttcaccctccattgtacactctctaccctagccacacccaaatcctggcaatttcctgcaaatgcccatcttcagttctatgctctgaccctttgtttacaccccatttgcctaaaatgtcatgtccctactgccttttaaagcgggaagacatcatactcagaagtgaacttctcctgagaggtataatgggagagcgaaagactatacactttggaaatggatcaaactctctgcaccttagtttccacgtgtgtatctttaaaaaaatgaggattataggtagggttgttggatggtgaggcatgccagggacaggcacatattagatgctttctgaatggcaacaacttcagctcaggttcaactcatctggagagtctctttttatgtcctctctgtcctgcagctaatttaatcatgccagcactgtgctctcagaatattattttttaactcccataatcacagttatacttgagtttgacattgtccatctgctacactaggtataacattcttttgggcagagattacatcctattcctcttaattccccctacgtgatcagcacctcatgcatggctaggcacaccataggctgtgggacaaatataagttgggcatctgttaggtaattgaaagaaaaactataaggtccaatggcaagaatatcttttcactcatctctaacatgcatgtattatcattacgctatccttgtgttttctttccaattaaaataatatctaggatggttttaattttctcagatgagggagcacagtaaagaattactgaaagaaagaggaacagcagaaaatatacaaggggaggctgcagaaaatctaggttataacccagatctgccactgagtcaatatgtggccctgagcaaaccatttaccttctccaatccccagatttcatatctataaattgaggataattacatttttcctaattttcagagttgggagaatcaagtgagacctacaatgcatgtgaatgagctttgtggcatttttgagcaccctcataatagtcagaaaacattgtgcatttgagagccacagtactgggcacacagtaatagttgtattaaactaaagagcagcctcttggatatttgataatttctaagtcgctggcttttatggtacattaaaaattatatacacttgcatgctgtgcattaattcttttacataacgattaaaaatgtagcatcatgctatgaaaaattaaactcaacactgcaagcataattgtaactctgatagtatgttaacaagtccacatttgtacttacctccctgtggaaagaactgcgagtaaatctctttgaaggtttcttcattaacaacaccactggggcattcctagggaaagtggcagagaagcaatatgagcaaagtgttcataaaactgaattttttttgcacattttgaaacagaactgtctaccatgcaaagctgcaccaagaaaattaaccattcatccattattacaaagggaataaaagcacactataaacttatgtttgttccagttctcacaagaaaaaaaaacgtagatgtaaatatctttgcatattgagtatcaaagtaggtgtaatgtattcagaaacacagtgctgcttttaagaacacatatgtttattataaagtaaaaggaaattgcattatttttcacacagcaagcatgttgcaagatgtttataatatagtctttggtgaatcttggttttgtcctttcaaggttttctgaactcacataatcttcgattcaatggcagaattactctattggcatctctagtggctcaagaagcttcaaccagtaatagatactaatgcttgttaacaggatgtctaggcatacccaagacatggttttgtaacaagtgaccttgggtgagatagaaccccatatttttgaacttccggaaaggagagtctgcaaagaaatggcctggcctgggcttaatagatccccacctttgtccctgggtcaacttgtcaaagaatgatggacattgatcttgggaactacacccatgttggacaactgacctggaggggccacagggcaaggttagccctctgagagtggttttggcatttttgctaataaaaaaaagaaaaaaagaaactttaaagtgtcagaagggggctgccttggtgcagaatataaggtttgagcaagcaaattgtcccccaatctctggaaattcctccattttttggagttataagaaccagtgtggttaagaatttaggcgtagaggccccttgagtggtggagactgacaatcacatgatagcccagaattgaatcatgtgagatattaactgtatggtgatcccttgttatccttggggcattgcttccaggaccaccgcggataccaaaatccatgcacattcaagtcccacacttggcactgcagaacctgcagataagagaagttggtccttcctatcctgtatctttgatctgcatttggcagtggatgctgaagctgcaaattcagaggggcgactatatttattgacaaaaatccacatataagtggacccacacacttccaactagtgttgttcaagagtcaactgcacattgtaagtggagaagtggtaagttctgtttagtctcttttagtagattctcatgaacagtcccatgtgatcagagctcccctgactctagttgtcacagcactcccacgccacctaacgtccacccaggactaagttcactggggaaggatgaatggtgtgctaactccccaacagacctgactttagacatgaatattctgtgtactctaaatttgatactgtttccagcatctttatcaatcacctatggtagtatttaaaacatcacttaacccttaaaatcattgttccctcactaataaacttactttctttattccagtgagtcagttactcaactgtaatgtgcttcacctgcagaattttctattttctcatttgttgttttgaaaggtaggacctttgatacataaacagtgttaacagtttcaatgtgaatttgtgtttacagagcttctcgatatggttttatcccatttgttaatgatgagcttaggtaggcaaaatagctgcattcacagaggcagaactggaggtgctgagtggcaaagcactttgttacacactaagccagtggggaagctggaatgtgggcttggaactctccaggtcatgacaaggtttcgtattagatgacccctgtggaaataatgatgacctcaaggacctaagagaattggagtaaagaaaaaaacaaccaaaaacaaatgagcaagcaagcaagcaagtgaactgtgatggttgattttatgtgtttaacttctctgggccatagtgtccaagtgtttggtcaagcattattctggatagttctgtaagggtgtttttgagatttattacattgatgcaaaattgcggcttttgctattactttcaatacatttaagctggtagactttaagtaaagcagattgccctccacaatgtgagggggcctcattgaatcagtttaaggcctgaacagaacaaagacggaccttcccagagaaagagtgttcttcagacatcatctgtaatattggcttcccttgttcaccagcaccctgcctttggacttgaactgtaactgttttctgaggctccagcttgccagaccccttcattagatatcaagctggccaaggctccacaaagtgtgaaccaatatcttaataagtctctttatactcacacatcctattagttccatttctctgaaggaccctaatacataaatgaattaacaaccaatagctacaactccaaaggtggtatgtatacagctaatctctcaaacattttgactatctatctagctgacaccaatggacccattttaagactaaacactttgcagttagaccctctcacacatggaaattgtgatttattggctatttaatgctaagccagttgcttgggatagtaaggagagagtaaatacctggctctctgccatcaggtggcaagcttgtgcaaagttagagctggaaagttgcctgggagttaaaagttgatgctgataaaggaagaggacttcaagcaaagggacctctgcatcaacaaatttgttagctgccttcagtctctagatatatttgatagatataatgtgaaatgaatttgtaaactgactatctgatatgcatgtgttttatgtttaatcacatatctgtgtcagaggaaaccttttctctgccaaatgaaaactactggccaagtttcagggtggaaagtctcaccagataaatttgtttttatccaccttatattcattacattagtttacatctctacaaacacatactgtatgcctattattccaggagtcttctaggaactgggactgctacaataaaccagtcaaaggtcttcccatcatggaacctctatccaactagaagaataaagactgtctttgttcaggctcctttaacaaaatgccatagactaggcagcttataaacaatagaaatttatttctcatagtactggaggctaggaagtctaagaccataggattagcagattcagtgcttgatgaggccacattcctggttcatagatggcatcttctagctgtgttcccacatagtggaaggggcgagctagctctgtggggtcttttataaaaggacacttatctaattcatgaagtctctgtccacctgatctaatcatctcccaaaggccccacctcctaatactatcacattgggggttaggatttcaacatatgagttctaaagggacacaaacattcagaccatagcaaagaccaataactaaatattaaaaaatcaaatccaagaatgatgatcttttatttattcccagagattttttattgaaactagtgcatttttttaaaccttcaggtgagaaaaagatgctagtgatttacaagatggtatacattctgtaactttttcttcacctcttctgtgcagtgatctctccataaaagtggtctctctacttctctatcaagaatgaatttggccaggctgcatgtgcagcaaagtgtaaaacataaacaatgtgctgtattagttaactcttgctgctgtaaaattaggccttcaaatgtcccttaatcaaaatgcttgggaacagaagtgtcttggattttagattttttgggatttggaatattcacattacactcagcagttgtgttagttcatttccacactgctataaagaactgcccaagtctgggtaatttataaaggaaagaggttaattgactcacaggtcagcatccctgggaaggcctcaggaaacttacaatcatggtggaaggcaaaggagaaggaaggcaccttcttcacaaggcagcaagaaaggagaagtgctgagtgaaaggcaggagccccttataaaaccatcataactcatgagaactcacccacttatcacgagaacagcatgggggaactgcctccatgattcaattactccacctgctctctcccttgacacctggggattatggggattacaattcaagatgagatttgggtagggcacaaagcataaccacatcaccagttgaacatacctaacctgaaaatctgaaatactccaatgagcatttactttgaatgccattttgtctctcaaaaagttttggattttacagtattttgcttttttggatgagggatagtcaacctgtataacacagttaaaaaccacgtagtatatttcttattcacataacaatcttgggtgagtgtacagatcagctgatggttcttctagggacagaggctaatgaagatttggtgactttaacatatggcgccaacagtctctgtgactgtgtcatccagaaggaggaaaagaacgctgaaaagagtacatggaaactttttatgggccaggtcttaaagtggtatacatcatttctattctcattttttttgttgttagagatcacttaatgtgtctaccccaaacaaaataagaagtctggtatggccagaaagaagacaagaatgcagatttgtaaagagtttggaatatctatccctgtggcatgtttgaaagatactccaagtgtctgtgttctgaaacagttctcccactgatgctttatttattgatttttattttgtatttttgtaaagatgggatctcactatgttgcccaggctggatttgaattccctgccacaagcaatcctgccttggcctgccaaagtgctgggattacaggtgtgagcccagcctcccactgatgttgtaacatgaagattatcaagtcatttagcagtataaattgtctccatttcccaggtgtcatttttaaagactgtttacttgcttcaagtaaacaagtacaatgaagcttaaatgtttgagcatgaattttttcattagatttttctaaggatccaagaagcagtagggttcctgggtttagggatagtaagaaatgcctcactcatccatcttctgagaatttgctgcaagcttctactaacccttatggttctgtattctattttctaatgaaattttgtctgattattagcaaatgattattccatgaaaatatgccctctatagaaaaaaattaaagaaaatgaaaatcacccataatctgactactgtaagagtatattggtcatttatataagcatatataccgtagaaataaagttttaataagacaaaattatagcattttatgttctttaactttaggaaatatcctgaacattttttacatcatgatttttagtgactgcataataatgcatccattgaacttaccatactgttgcatattgaggcgattttggcatttttgcactacataggaataatgatgtaattaatattctatgcatccttctgtgactgcacttgtggtttcttctttatgactaatcccagaaggagaatcgtaagaccaaccagtttaaaccattgaaagctctttctatgcacagtcatggtgctttccagaaacgctgcatccattcgtgctgccaccgcagctttatgagaaagtctcacaccgagaggagctaccgactagaatcacatgggaattggacacacacacacacacacacacacacaaccccatgaacaaacagcaataatttgcttccctcatgaatccaatcgtcattctgaaaattaccagtggacattgaggcgtttggacaggtccctccgaggcataaagcaatttgcctgtttttcacacagacagggtcgctgtgatggcactcagccggaccacatcaccacaatcacagcggtttattgaggataaaataaacaactccattccttcttatgcagaccattacttttaacactttcatcaaccctgaaaggtgggtattatttagacatgaggacaatgagcttggagagatgaagtcacttgtttgagtcacacaggttttgacagagacatctttttgctcatttattcaataagtagttatttaatgccttctaagtgtcagcaaatagttcatatgccttttactattctgggcactggagatacaggaatgagtttttaaaattccatttcttttttgctcttgtggaatataacatttagtggaatcagactcataactctgactccatgaattgcaatgctatcttgccttctggattattactttttcttctattaggactgaaaacatagtctcctggagagtcatctgtggaaatccttcttctgggaagatgtacacggtgtatttgtacccagaggcacccatcacagctgcgttggagagaggcatgtgcaaagggaagccatttcaatcaaaattgggatcaccgattaaaatttattgtgcattgtagcttgagagatttgaggaaagcaatctttttctttttagaaatctttggttttagtgtaacaagaacctccccaccttcctgtgtgccacatactctttactgtcattgtaaatggctagatagtaatgggctgaggaaaatgttctggtttttaggaccagtcaaatgaactgctccatccagtatttaggagctggaggtctctggttctgctggctggtatacttatctatgatgaccattgcatttctttcattgcctgtgaaacccttcactgtgatatgatcacaacacaataaaagtagaatgaggttttctttgcaatataactgccatagatttgtctgttggtgaagaaacagtcgccttttggggccttactgctgtgttccctgatgagccttttcagtcctctcaggccatgtggggacacatgtgagggtcaagattagttgtagatatgcaatgaatactatgctagtactaatatcaattttaataaggcagtattactattgtaataatcagcataaagtaatactttattggtattgatattttataattattaatgtgatgatgacaatgatgatactgatgatattaagctaatacacatgagcactttttatgttccaacccttgcattaaatgttttacatggattatctcgtgggaatagaaagatgttagtattaactccattttacaaatgaatgaactgtcttagagaggggccactgcattcccaaattagaaaatagcagatctaatctatagatcacagaatcaggaaacttgagagtttaaagcaactttagaggccaggcacggtgggtcatgcctgtaatcccagtactttgggaggccaaggtgggtggatcacctgaaatcagttcgagaccagcttggacaacatggtgaaaccctgtctgtactaaaaatacaaaaattagccaggcgtggtggcacatgcctataatctgaactacccagcaggctgaggcaggagactcacttgaatctgggagatggaggttgcagtgagccgagatcacgccactatactccagcctgggtgacagagcaaaactccatctcaaacaaacaaacaaacaaacaaacataaagcaactttagagacaattcaattcaatgtcctcattttgaaggtgaggggatagagattaaggaggttataggaactgaccatagatacacagggggctgctaagcctgacctcatgtctaggtttcctgaggtctaggactaagctttgatactgcaaatgtcttcgtgtccatacaatagctggtaatttttgtcaggtactatttagaggaatctagtgcagtgcttatattcttgggctctggagttaaatagaaggcctgggttgaacccctactctgccacttgggagctgtgtagcttcaggcaaactgtttaatctaagtctcattgctctcctctgtgaaacggggacaggaattgacctcagagagctgctataagaatgaataagatacacatattatgctattatcctagccctctaccttacacatcatatttggtcatttaatattagctgttagtaccatggtaatagtttaggatttggtaagcagaactccatcacgcaatgagtcactgtaacatcaatgccgatagaccaaggataaatcatatttatcaacgtggttgaatctagaataacacaggtctgaaatgcaatcagcttatgaagtatatatgaattacgctttctattctagtgttataagttgaatcactctatctaatatcatcagaatttaccctaaaagaaaggaatattgtaattgtaaatgatagcagaggagaataaaggccaccatcatggaaataaatgtcagtagaaacccaggagcctcttatttattaatttaaagttttccccagcgatgcttacatggtatgtttgaaatcatcatggaaagtgttgggaagggtgctttggagaaagatccatgtatgcataggaaattgctaagaaacatattttgtgagtgcttcaagagttcttatactttcaccttataaggaaacctttcagcatttcctggaaggttttcagagctctgttgaaatgcatgagaaatagctgcagtggtatgcaaatcacaggtataataacatcatataattataatattgtccactccaataatctttgcccactctattagctgaaatcttctcttcccctaaatcattctgttctgatatgtgtcttctcctcaggatcagaattgttattaaacatttagagacttcttcaggattaaaaaaaagaattacagtaagacatttcataggaaaaaaaaactaaaagtgcttgtgaaatagttatttggggatcctttcatgatacctgtaatgccacatctcttaggcatctgtatatttcaccaactctcacacccatctctggtgctaaggagaacatacaaggtagtctgctcggtctatcagttaaaatagtatttagcatgtagtatgacaattcagagattctctggcattctataattgcaggagaattttcaaaatttaaatgacacaatcctacaacctgtgctgctgatatcaccagattctgtggacttctctgctctctttagagttagtaaatacaaggcagggactaacctttacgatgtttagaatagggaatactaaaaatatttatgctgaatgaataaatcttcagtcagttcttagcttttaataaattagaaaatgaatttgctctgataatgtccttcaaaacttgggcctacatttttagaactcctaagaccaagaccaagatagtcatgggggttccgatatccccatgattgcccacaatgactatgatcgcagaaattaaggggagatggctaggatcaagaaaaacacttcttatttcaacataaaaagcttaacatagtcaaaaattggattctaaaaagctcatttaaaaattataggattaacctttcagttttcaaagcagaaaagctgatcattaagaactagagctggctataaatttctgttctaatatgcccaggtgtttgaactcctagcaactcatttattccttcttagtctaaatgttctcatctgatataacaggtaagtaatactaacatcacaggtaagcaaaagaaatgcaaactaaaatagacaatggatgaaagaaacccaaccaattttaaaaactgaatatactcaacatgttggatattttcttgtttccaaaatctgcattaactgcctcttccatttcctgaacacacttctggggtcaaagtggttaaataggcactgcagattaaaaaaagaaacagccaatggtgggaaaaggctgacctagatactatccttggaaaaggaatgagagctgggtgaccaagattcaattcagctgcaaggatgtgggcacattctgagccccacgagttctcagggtcacccaggatgaagcagaaatccaaggtactaggcaaaggttctctccccttcagttctgccctctaaccatatggaagaaggaaatcacatgagatttacagccaaaaaaaaaaaaaaaaactggctcaagtttcagctctactactaatgaagaaataattgaaaagttctgctttgagtcttagtctttaaaaatgcaggaaacaatagcatcttatagtaaagaaatgagaactaattggcattatgtatataaagattctagcataatactaaacattctacaaattgtacttatttttactattatctcttcaagtaacttaagttggttctgcaaaaagagattttccaaattttgtaggaaaaggcttcctgggattgggcccaattcctgaatctttagtggaatgcatgtagaattgtttgatttacggagacttttaaaaggattttcccaactttatccagaagacagtgtccattttgtcagggtcttttaaaaattatgatgtagtgaaattctataggcacccaaaaccatttagtggaaaaaaaagacaatggtgccctgggacaaagcctatgtatcagttttctattgctgcataaaaaatgaccataaacttagtaactctaaacaacacaaatgtatcatctcacacttctgtgggataaaagagtctgacatggcttagctgtgtgctctgctcagtctcccacttaaactggctatggttctcatctgggccttgcagtcctcttccaagctcactgaggttgttggtagaattcagcttctgtggttgtagggcccaggtccctgtaaccttttggctgtttactgggggcttctctctcagcttcattccatcttcaaaccagcaaagcaaaggcctgttgagtccttctcacactctgattctctctgacttcccctttggtaaaggactcgtgtgattagatcaagcccacaaagatcatctctgtatcttaaggtcaactgccctgagactttaattatatctgcaaaatctcatcacagtagtaccttgcttagtatttgattggataaccaagagacagggatcttgagtggctgcatttagatatctattaatacctcccacagcctgcttcttctgaacatcagttcattttggttttcatagcagtttttgtttaacaacagtcttttttttacaattatactcacaagtgtatccaccacaactcgcaactatatttcttggcacctgccatagtttaatgcgatttgaaaagactatattctgtcaaggctttagaatcagcagtgtaaagaccagctgtgaggccaaaattcaatattttttatgagtgctaagaatagtatcccatatgctgagtgttccccgtctagagtatgtctgcctatatccagagcagaaataaatttttttagattttactaattgattagatcactttcaagttggcatgatatcagcctaataatattgaccaaaaaaaaaaataccgagtaaagaattctacttaaaagaaacacgcagtgtttcaatcagaaagaataaaataaaatacagcaggtactccatatcgcagctgcagcatgcacagattcaactaactgtggcttgagaatacttgaaaaaataaaaattaaaaataaataaaaaataaggcaggtgcagtggctcgcgcctgtaatcccagaactttgggaggctgaagtgggcggatcacctgaggtcaggagttggagaccatcctggccaacatggtgaaaccccgtctgtactaaaaatacaaaaaattagccctgcatggtggtgcatgcctgtagtcctggctactccggaggctgagacagaagaattgcttgagcccgggaggcagaggttgcagtgagccgagatcatgccattgcactccagcctgggagacagagcgagactccatctcaataaataaataaataaacaaacaatatgaatgaaaaacaatataacaactatttacacagcatttccatgtattagttattataagtaatctagagatgatttaaagtacatgggaggatgtataggttatatgtaaatactacaccatttcatataacgagacttaagtatccccagattttggtatccatgggggagggttctgaacccagtccctcaagaatacagagagatgactgcatggagatgatggtatacacatatgttcatatatatatacatggttgtataaagcctttttattccctgaagatttaaaaaaatctattctctcccagtctgatttctgtcacctactaaattggctagattctggccccttgataacttcatttagactatgatttctggactccttatgtgagattacacattttcctcatgtgtaagccattttttattgatcttttttgttacttatagtcaaaagcattctaacataagctacaaccttcttgtccttgtattacacctttctacagaaagagaaaataaaaatgagttgagtttacaggttgctgacaagtttggtgaaatgtctgctggagaaagaggtgtcgtctatagattacggtggtgggtgcgcatatgcaggtccagatttttggagaacgtcttttaaagtctatccaaagacactttgagaaagcataggaattgggggtgaataaaactcactttttttttttttgagacagaatctcgctctgccgcccaggctggagtgcagtgctgcgatctcggctcactgcaagctccacctcctgggttcaagtgattctcccgccttggccttcctagtagctgggactacaggcacccgccaccaagctcagctaatttttttgtatttttagtagagacggggtttcaccgtgttagccaggatggtctcgatctcctgacctcgtgatccagccagcttggcctcccaaagtgctgggattacaggtgtgagccactgtgcccagctgaataaaactaaatttaatgatcattcgtggtctgctgggcactgagccatgtggtgtaggagatacatgttctcattaaatccctgagaagtagaaaaggtagatgttttaccacacaatgtttaagaaatgagcacagggaggtttaaagaactttcccaaggtcagtgggactgggatttgaacttgagtttgactgcaaatctttcacatcttcctaagcttgaaaggtgagtgcacctgcggggggaaaagttaactaaggggtaacttttatcccaatgtctttcaatcctattaatcactaaaacacaaagtattcgttatttgttcaacacgtattcatataccaagcacttgactacgcacaggagcgtaacggttaatcaacaagcatggccctcatccaaaggagcttactacggaggaagcagtcagtattcaaatactgacatcaataaatatattgaaaccctcagggcaaagcagcatgaaaacttgaattgttttttacaaataaattgaaatgtcccaggtgaggggttggaggataggacctcaagttgtctggtcatctgctttggtgaggcaggttcaggacaggtcagattcagctctaaatacattttatacattttattatacattttgttccctttctctctctctttctttcttcttttttttttcttccgagtttcgctcttgtctcccaggctggaatacaatggcacaatctcggctcactgcaacctccatctcctaggttcaagcgattcttcagcctcagcctcctgaatagctgggattacaggcgcccgccacgacgcccggctaattttttgtatttttagtggagacgaggtttcaccatgctaatctcgaactcctgacctcaggtgatccgtccacttcagcctctcaaagtgctggcattacaggcgtcagccaccacacccggcccctttccctttcttattgccattctgagaaaatactagtttgtccctcttgcacaagtttttccctcagtgagctaccatttccaggagcagccctgagtctctgaagttaaagaaaaaaaaaaaaagtttagtctgcttaattaagttcttgttgcaaaactttcttagttattactctcagttgtagcttttggaatctaacagcccctcgcttatgagccactcatatcacttactagcctggaactttgaataagttactaaacttcttcaagctggattttatcatcactcatttatgcaggacgtatttttgaaattgttgcaattgttgcaaatacttgagaagtttccaccctcctttgccttctcctagtgcttcttcagaggctatgaagggaacaattatcaagggtcacggtagctgcctaaaaggaacctgtgtctagtacttcagtgcttccgagctctcaggtgggacagtaaagcctctgtctcctctccatgccaggcaaaatgacccaaaaggaaactcccgggcctgttgactctgagcaagctggggcagaacgcttccgagggctctctggagctcagacggcgctcagcgtgagttggaccaaacattcttagggttgtatcatcataatgaggcacaagggggcagtagtgtcctccatgatagctagaaaagcgatttccagttctttttcttaagggattgttcttttcctaagcttggtgcctgtctgggtaaatttctttcaagaaggctatttcctttttatgaacggtgacagcctcattcctacattagataatttaaaaaattaactatttctgggaatggggcccagagactctgatctccattttggatattacatttggtgtacgtcagtctgaattcacaatcacttttttggcagttgggccacctttaatttagtcaccaaaaacttgtagatcttagaaaacaaataagcaagacaacgccactaaagttccaaagcttgagtctgaaaaccttctgaaattgttaagtgtatgtgggctctggagtcaaagctgcttgagcctgctttgctgtttaacaggggaacattttaaacctttaagatgaaaataatgatactaccctatctggaggttattatgaggcttaaataaagataacccatgcacaatgtctagcgtcgtgcctggatgtataaacacccagtacacattccccatggaggaaattatttctacaatgatgctcgttctgaacctgttagcttttgtcatgttttcatgtaatatgggatattatgtttatccttgttaaataccatctgcttatttaatttcagaggattttcagaatatcacaccagtgttccacttccttagttattactctcagttttgtagcttttagaatctaacagccccttccttatgagccactcatatcacttactagcctggaactttgaataagttactaaacttcttcaagctggattttatcataattaattaatgcaggacatgtttttgaaagcatattatatgtcagagagtgtaagaagaaatggagctaaaacaatcaagacagatgaagtccctcctggagtttgatgactatcagagaagtcacacataaaacaaagttctgtgtaaataaccattcagttacagttgcgataagtgctacaaaccaagtatggaaggtctaatttatagggaagacttccctgaggatgtgacatttaaagagggacctgaaggataagtaaaaactagcaggagatattgctggggaagaggcaaaggaaccctgtgtacaaaaacctgtgatgtgatcaatgactaaagagatggcaaatgtgcctggggagtgtggtctgagacaaggttggttaatttggggcctgctagttacattaagaatcaaggtctttgccattcacaagataggtatcatatacctgtttttcagagctctggagagaattaagagatgatttacatcaagtgcccagcacaatcccaatcgcattctaaacactcagcatccctctcttttctgtttactctaccagagttgaatttttacctctggtttattatttattcaatacgtaattatttagcgtctactgtgtatcaggctctctgttataaactgaacaaacaaaaggggaaaagcagacatggtcttgcctttatagaatctctccactgatgagctattatgttctttgtgcatatgaatttatttcaagggaacaatagtttcaacatatatggcgattaaaatcttgtgctcctatctccaaaaattaaaagtaaataaaagcaagcaagcaagcacacagaataaactcacattgccatggattgcaatgtaaataactcaagattatgaacttgtatgtaggagttacttctgcatgtttctttgcttttgctaatgattaataataacgagtccaggccagacacagtggttcatgcctgtaatcccagcactttggaaaaacaaggcaggaggattgcttgaggccaggagtccaaggccatcctgggcaatatagtgagactcagtttcttaaaaaaaaaaaaaaaaaaaaaagttagccaggagtggtggcatacaccttttgtcctagctactcaggaggctgaggtgggaggattgcttgagcccaagagtttgaggctgcagtgagctatgattgctgctgcactctagcctgggcaacagagagagactgtcttcaaaataaataattaaaaagaataatgatgattgtttttacagtatattcttgcacatggtacagatggttagaataaatctctgtactactgaaagtgctaataagtctccattatattatcttaggggctaagtatccttcaggagggcagaaagactcccagctattaggtgtatctaaaccccacatggctatgtttaccctgaaactgaggcagtctaactcttattcctttctgtttacctgttttaatatattgcatatttatctatttaatatatacaaatgttgtcttctgataaaggtccagaaattccaggcatataaaagagcttcaaatcccaacaattctaccacattcacttttcatttccatctgcacatttttcatttttagagctcatggatagtctagacatttatttgcaaatattatgaaggtattatttcaatcagcaagggattctcttcaaaacttatatgagcttatggtaacaattcttattctctctagtgaggcataaagctaaaagttttatgtttttgccccgtaaggaaggaaaaacaatgcatgtttttgtttttttctagtatctcacagatattttcatttcctggtttaccagttgttaaccttaatgcatcccagaaggagattaatatttggatttaaataataggagctctactttcggtttcttgttatctttgctgggagatgagaagtctggggtggtttattctctgtacaacctctcaaaattgtactatagaccaacatactgaggaagataaggagcaatccctccagtacttacaatgctcatatgaaaatagatgattttctgaaagaattagaatgctatattttattaattgtttctagttagactttaattccaacaactaatatctccttctttaagaatgatttccctaattctaccgttaggaaattatttaattctaccataattatgttttatttttttccattttatgccactgtgccaggcactgtccattttatgacatatttgtgtcagcttaacaaatctagctcatcagttcagaatcaacaatgaaccaaatattactgtagattatatgttaatacataggagcacagttattacatgtataactatttctccattttgtgaccattatagggtaattatgaatagatgaaggcatgattactttagatcaaaacacaggcaaaaaaaatggatcttctttggggaaatgttttatgctatagactgaaagtgtgtgtggcctccaaattcatatgttgaaacctaatctccattatgatcatattgggaggcggggtctttgggaggtgtgttagttcattctcaggctgctataaagaactgttcaagaatgggtaatttataaagaaaagaggtttaattgactcatagttccacagggctatagacgcctcagaaaacttagggcagaaagggaagaaaacatgtccttcttcacatggcagcagaaaggagaagtgccaggtgaagggggaaagccccttataaaaccatcagctcttgtgagaactcactcactatcatgagaatagcatgggggcaactgcccccatgattcaattacctcccactggatccttcccagaacacatggggattatgggaactacaattcaagatgagatttgggaagggacagaaagcctaactgtatcaggaggtgattaggtcataagacttaagtttttaatgaataggattaatgttcttataaaagaggcccaaagagctgctgtgcctcctccgccaagccctagtgacataatggaaatatggtcttccatgaaccaggaagagggactttaccagtaaccaaatctgtcagcacctcgatcctggacttcccatcctccagaaatgtaagaaataaatttctgttgtctataagccacccagtttatggtaatttgtgacagtggaggttgtagattacagagaaaaagtggaggttgtagattgcagagatgaattagtgtagtttatgaaaccatgaagtttgacgttcctgagggatatcccagagaagttgggaaaccagtaattagaaaggagtttggaactcaggtcagaggtcaaagcttacagctatcagtttgtgctcctttagcacataggtatagagatctcccaaggaaaatacctaatgaagaaaaccagggagctgaatgcacagccttggtgggaagctacatttaaaaaacaggaatgggataagcagtccatgaagaccaggataaagtagacagagaggtacaaggagaagccgtagattatatcaaaggaaccaaggaagaagaggcattcaagtaactcaaggcctccactcccaaactcagcagagacttcagttaggtccagagaagtcacaggagaaagtgttagtagcatagactctgaaacaggctgtgtaggcttgcatctagtctccactactcacactagctgtgtttcttaaattctttgtgccagtttattaatttacttgtgcctcacttgccttatctgtaaaatgggactaatagtatacttaccccatagagttaatacaaccataacattgaccaatatttgtagaaccttaaattcttaactcatagttagaattaaatatatttattgaatttaaatcaagcaattcatagatgtcaagattggaaactattcagtggatttgcaaatgaaatgtagttttgacacacacacaaatcagtacaaggaaaactggggaaatctgaataagatcagtggattacatcaatgtgagtaacctgatttaatattgtactgcagctttacaagatgatactactgggggaaatggtacctggtgacctccttggactatttcttactattgcatggcaacctattgttatctcaaaataacaagtttaatttaaaaatattggtagccatggaaaataaaggtggtcttgacctatgaaagaacaatttaaatgacatggtagaggcagaagccaagagttaagaaataaatgcagatgaggggttatatagactgaacttagacagctgttttaggaattttatgtaagagtataagaatgagacttgccaatagttagagagagctgtgtgtgcatgtaaaagttgttgttattgctgatttggaatgagtatgtcttctaatgcattttttaagggtgaatgagacttgactagcattacaatatgtaaggaggcagctaggaaaagaggaagagacagggaggaggaggaagggagggaggcagataaattataaagaggaatcaagatatcataggaagtgggattgaaaacactagggaaatggaacattcttttcttttatacaggaagaataagtcagcaaataaataccaaacaggtgccagctatacactggacttccttctaggagttaattaagcactgtggttttgattgaataatacagatcaaattcctctgtcccgtgagaaaatgagacagttctgtaggtacatttactgctggaatcagaagagctgtaaggatgtataggcatgttactgtaaatagatgaggagacactagatcatgaaaaagagacaagattatcaagctgagtgtaaaaattgctaattagtagtgactctcatatctggatttttgtttggttttccccagcaagtaatagagaagtggaagacaaatcattctctgaccctagagttcggtgaccccagagccatataggtatgtgacaggttggaaactggcttctcaaaatatattgataacctaatctctggaacctaccttacaagtcccccctgccccacaaccccccccccccacacaaaaaagaaatgaaaacaaaaaaaatttcaggtataattagtttaaggatctctataaggagagattatcctggattatccaagtgggccttttaggctatcccaattgtccttacaggagagaggcagagagatgtgacatacatacagaggaggaagggatatgatgatggaccagagagacatttgaagatgttgaccttgaaaattacagtggtgcagccacaagccaaggaatggtgacagctgccagaagaggaaggaaaagattctcccccagaatttctcaagggagcatggccctgctaacaccttgattttggctcagtgatattaatttcagactttcgacctctagacagtaagagagtaaatttttgttgttttaagcctttcagtttgtagtatgttgctacagctgcattaggaaactaatacatgcatgattgtaggacatggataaggaagtagggatgttcaagggtatttcaggaaatcaaccatatagtgcagattagtatggaacttgtgagactaagaagggctggtgatcccaaaggtcttgcttgcagaatcaatgagcagaatgtagtgagattgagggcttaagacagttgaatggatataaggttgtggtcaaaagggtgagaccatcatttaggatgtcaggaattaagtagtttcaggtaataataaagtccaagtgatatccatcagagtgaaaagtggaatggaaaagaaaataatggcatttaaagagtcaaaaaacactgaagctcaggtgagtggctggtaggcaggtcaactccatggatattactgtcaagccaatgaacaaagattttaaagtcagcgatcaaagtctggaatgagtatgatacagaaactctcccagtaataacatgagacgccctgattctggttctctgtgactcagctctgttagacaattttcttacttcaggaactgccaataccccatttaacatgatgctggtgaggcttttaatcccatttccatgggccacagggctaggtcaaatgatgcaggcttttccaggaacagttctccatcccccaggccaaaatgattggttcagtgtcatgtgactaaaactagttcctgccttgctggagttattagcacggagaaaaggtgagtaaaagagacagcatcctgatacactgttggagccttgatccagccatgcctgatgctgtaagtattcctatcttagatatgtgagtcaataaacctttaacttaagatactttgaatgggtttttgttacatgtactcaaaaatatcctaatttataccagaatagtattattttcttgctctttgttctttacagggtggctacaaaggaatcaatgtagcctcgtagtttctctggatggtatttcagtgctttgggagataaccaccacataaatgagagagttcctatttttctttgttattgttttactatctaaccccagctacaagaaaggatatattggtttattttacaaactttatcttcacaatcagaaggatgtgagctgtagagcattattttaaagaccagtcggaagatgaaatggtgcaaaaaataaaaaaagaagaaaaccaaattaatctgcaaacacattagaattttcaagatttaatttcactgttatttttgcccatttgaagcaaatctattcactagatctctattaaatccctactgtaagccaggtacaaataaatgagatgaacaatttgaactgatttcaagttgcaaagtaacaattatatgatgaatttctttgagaagcaaatgttggtatatcagtccattttcccgctgctgataaagacatacccaagactgggaagaaaaagaggtttaattggacgtacagttccacatggctggggaggcctcagaatcatggcaggaggcagaaggcacttcttacatggtggcagcaagagaaaatgaggaagatgaaagaatgaaacctgataaaaccatcagatctcatgagacttattcgctaccacaagaacagtatggggaaaaccaccccatgattcaaattatctcccattgggtccctcctacaacatgtgcaaattatgggagtataattcaagatgagatttgggtggggacacagagccaaaccatatcattcaatccctggcccctccaaatctcatgtcctcacatttcaaaaccaatcatgccttcctaacagtcccccaaagttttaattcatttcagaattaatccgaaagtccacagtccaaagtctcatctgaggaaaggcaagtcccttctgcctatgagcctgtaaaatcacaagcaagctagttacttcctagatacaatgggagtacaggtattaggtaaatatagccattccaaatgggagaaattggccaaaacaaaggggtcacagggcccttgcaagtccaaaatccagcagggcagtcaaattttaaagctccaaaatgatgtccttttattccaggtgtcacatccaggtcatgctgatgcaagaggtgggtttccatggtcttgggaagctctgcccctgtggctttgcagggtacagcctctctccaggctgctttcacaggctggcactgagtgtctgcagcctttccaggtacatggtgccagctgtaggtggatctacctacagctggggtctggaggatggtggccctcttctcacagctccactaagtggtgtcccagtagggactctgtgtaggggctccaaccccacatatcccttctgcactgccctagtagatgttctccatgagagccctgcctctgcagcaaacttctgcctggacatccaggcatttccatacatcttctgaaatctagacagaggttcccaaacccaaattcttgtcttctgtgcaggctcaacaccacatggaagctgccagggcttagggcttgcaccctctgaagccttggcccaagctctacattggccctttcagccacagctggagcagctgggatgcagggcaccaagtccctagactacacacagcatggggaccctgggctcttcccaacgaaaccatttttttcctcctatacctctgagtctgtgatgggagaggctgctgcaaaggtctctgacacaccctggagacactttccccattgtcttgggaattaacattcagctcctcattacttatgcaaatatatgcagctgacttgaatttctgctcagaaaatgggattttctttcctacagcattgtcaggctgcaaattttccaaacttttatgctctgcttcccttttaaaatggaatgcttttaacagcacccaagtcacctcttgaatgcattgcttcttagaaatttcttctgccagataccctaaatcatctctctcaagctcaaagttccacaaatctctgcagcagaagcaaaatgccacaagtctctttgttaaaacataacaagagtcacctttgctctagttcccaacaagttcctcatctccttctgagaacacctcagactggaccttattgtccatatcactattagcattttgggcaaagccattcaacaagtctctagggatctccaaacttttccacattttcctgtcatcttctgagccctccaagctgttccaacctctgcctgttacccagttcctacgtcacttccacattttcaggtatcttttcagcaacatcccacttctggtaccaatttactgtattagtcagttttcacactactgataaagacatacctgagactgggaagaaaaagaggtttagttggacttaacagttccacatggctggggaggcctcagaatcatggtgggaggtgaaagtcacttcttacatggcagcagcaagagaaaatgaggaagatgcaaaagtagaaacccctgataaaactgtcagatcttgtgagacttattcactaccatgagaactatatggggaaccacacccattatttaaattagctcccactgggtcgctcccacaacacatggaaattatcggagtacaattcaagatgagatttgggtggagacacagagccatagaatatcagttggtaacacactgaactagggctctaccattaagtaagcacacagaaatacaaagttcaaataaggataaacagggaatataaaaactattctgcttaataggaattcagatacctcttaattttttatattatctagtaattaagagtgagtgatattattgggaaaccataaaggatccatttcatcagcactgttttttgtttggttggttggttgttttgagcccttacatatatctggcactgggtaggctctgagaatacaatggaaaaatggcaggcctggttcctgcccctaccctttggttcctgtcagggtattctctgaggcatcacagggtttatccagttcactatttagtaaatgataaaactcacattcaaacactagtgtcctaaaacaatataagtctgtctctcctaaatgagctcattatttttgttttagccacctgagagtagagtttctaattcctatctagcttgctgttcaaataactgataattaatcccagaacattagtttgcttgaattgaaaaggcacatcacgttcaagtgcctcgtttttaatataaggcaaactgaggcaaagaatgttaaatgttcttcacagaacaagaggagaggccacttttcaccctcagcctagtgtttatctgactaaaccacaccgtgaaagataacagtctatgaagacaaaaattacaaggtttagaatcctctttccttctccctcagacaactgggaaataatattctttaataaagttgtggttattggactagcacagtagccaaatttaggatgacttatttattcttaaaggttgggactttcattctggaagtacttttaactgttaaagattcctctttccctttccttcttctttccttgcctccctcatttttcctacattccctccttttttttcttgtattatttcattacacaaatgatcatttattccatacaaagttatggaatgtgtagggtgggtatgctggatgcaagggatataaaattggcacagcatctttcttgctgtcagttggctcacaatcgagtggaaagcaaagatgcattcagtgaatcattacaaaacactgtgatgtgtgcattacggttcatcacagaaggagttttggacccttactgggaagaggagaattaagagctgggtgactgcgaaagatttgcaggggagaaaatggctggagagattttgaaataagggaagggcattcccccattccagcatgcagaactaccacttgcaaaggcaaatacgattttctgcagatcctcccctaaccccaccccagaaactggggatatatatcattgggaagagatacagtttaatagagaggaaacactgttggaccactctcccaacacctgtttctcaaatgtgaggcagggctagccaagcatcccacatcaagagaagattaggatgggggaagaggtagaagtcaggcaggaagaatgtgaaagacaagtaccagtctatgaggctggactggtaggtaggaccaatacttaattttctaaatgcatgccactttccctacagatcaatgactgctagcacttccctacttgcttttctttggatttttttttctttttttttttttttgctactgcatgcttctttgactactgctgccaaccttgggaatggattgatgacccacttgcttctcaaacagctctgcagataccacttaggaagctggtgttcgtgttctcagactgaggaggagcagtgtccaaaatcaattacctgggatggtgtgtgctgatccacctagcaatgaactcagatctttggagcttgtttataacacgtacattgctcaacataccctggttctaagatcagtgatgctatttcagagcacaatggggataatacattttacatttatttaatgtgaattttggaaaaatttgattaaaaatgccacctttggcttttttaaataaagaaaatcacaataaaggatagaaagtaattaatgatttttaaaactggttaaccatatacaaaaatcaactcaagatgtattaaagactgacattgtaagtccccaatctataaaactcctaagaccttggtggaaggatctccatttcttggtgggaatgtaacttggtgcagccactgtggagagcaacatggagatttctcaaaggactaaaaatagaattacaatttgacccaggaataccattactgggtatatacccagaggaaaataaattgttctactaaaaagacacatgcactcatacgtttatcacagcactattcacaatagcaaagacgtggaatcaacctaggtacccatcaatggtgaattgggtaaagaaaatgtacatatacagcatgcaatattcacagccataaaaaggaatggaatcatatcctttgcagcaacgtggatgcagctggaggacattaccctacgtaaactcacacaggaacagaaaaccaaatactgcatgtactcacttatacatgagagttaaggcttgggaacacatggacataaagatgagaacaagagacactaggaactccaaaagaaggagggagaaaagaggacaaggactgaaagactttctattgggtactatgctcagtgtctaggtgttgggatcaatagaagcctaaacctcagcaacacgcaattatacccttgcaacaaacctgcacatgtaccccctgaatctaaaataaaaataaaagccaaagaggcaagttattttagtgattttaaattttctttattatagtcttctatatttttccatatttctataatgagcatagtgttgtagttagcaatagatggaaactttatcagaaaaagaagaaaatcatcacaaccatcaacaaacttacctgggtaatttctgtcctgttctcttacgaaagttgcaaaaataaaaaagacaatttcttgctcatttagaatgtacactgtgctttataatacatatggccactaccaatttcttgcaagtgttttttttagactctgggaatatagtggatgggttgagagaaaaggtaccatttgttaaagagaaaacagtattagactagaaattggggtaggatacagttctttatctttatcaatgatatagccttgaacaactcccttaacatcatagcatgtgttttgttaacgtaagacgggcccgataaagtatctcccatctgccagacaggatgactggaaagaagtataaatattttgtaagctgtaaggtgctctatctatgtaagttgtttttgaggcgattattcttagtaataaataaaatactgcttagaaactcaacgtggacagtcttggtctagggacctacttattgtgcaattggcaaaggggcccttctgagatgatgcataggcagacagtttagatacaaataactagaaatggtcaaactgtaatatctgtcctttcccaccttttacatctcaaaaagcagttttcatgtttcatagtaataagggcttttacatctataaattccctttcaaacgcctacatctctcaacaaatttgctaccaccgcaatttattttttaggtggttttattcagatgaaaatagtttatttgagcactttggagttgctgtttgagaatgctatatgagtattaaatactgtattatatttctgatgctctttaaagattttcttttctgtctgcaatttaattttgtttttagaggttttttctcctcctcttctcatattgattttatttttggcgctattaaaaagtgctcaatgaacaacctttttggaatgaatgtaaataagtctgtatctctatgtatatgaatatttttaagtgcattaacttttagtataagacttatgtaatgattaatttgctcctcaaattctaattcttattcaatcaataaccattgttcacaattttaaatacattttattgatttttgaacatttaggtcattagtagtaagatcaatgttagccataattcacctttaaatttccaatgttcaggttattaaaaatcatttgcttttatttccagcataatttatttttaattgaaattcttccttgtgataatttttctttttaaagcaaccatgtcttctttataactgtctgagtgtccaattacattttcttacttatgaaggtttttaatatctaatcatatcttatgtaatcagtgggctattgtgtaaagtaatagttctttttctcccttatttatagggattttactacacacttccttcctccctatttttttctttcctgaacacctttcacctggtattgtgatagttcatttacttgtatgtattgctcactagatggtaaactctgcggggaaaggaatttttttgcatgtcatgttcgctacatcattcctgcatttagcatatgcctaacaaatagtagtctagcaagtattttaaatggattaattaaggaactctaaactacaagacaccaaggaacagatgttcagataaatacataaagatataatctacatgacaatgaaaaggttatgttaaaagtaaaaccctgaagtgcattagaataaatatttaaaaatactatccaggacatataacagttgctatttttctatttaatgaggtatattttggatcccagtcagcaaacaactctctctaccaaaagtagctgactatagcccagcctgtctttgcagttcatggcagaagaagagcagagaacacacagggctcaggtccagagttagctcagagaaaacagaaaatccaatctcagcacagtaaacatgtaggaattcagcatctcatagaggttactgaaagcaaagaatcaaaaataataaatggttataaatagtccatgctctcagagaactttgagtgcataaacaaaacctataaatcttcagcaaatgaaaataaggctctggttaataaaacaaaacaaaacagaaatggcctagtgtaattgttaagaagaggagaaaaacataccccaaagaattcagtatgtagttggtgaattcagagcaaacaaaaatggaaaattacaccttctcagccacacaaaagaaaagacttctaaggatttaaattaagagtatcacagtgaggaggaaggaggagttgattattgggcaaaatattttgcctctatcaaggcttgagctcatgagtaaaaggtgtgcgaggcctccttccatagtgtgcattcagtccttctcaaagaatccattcatttccacattaaattctcaagtaaagaaatcaatcaaacaaaaaaactcccacatgtgttattatagtttctacctggactatgtggacatgtcctgtctgtctatagcagttgcaatgctattgcccagagtggaaaaaaagaaaaagaaaaggagcttcccataaggtttatttctacatgttaaaaactctattgctaaaaccctaccacactagcttaggaatcacatttttagtaaatgtcaccaacattttaaaaatttggggccatttttatcctctaagaaatctcgaagagatccagaattcatgtatttaaaatttgtctcatataacaaataaaagaaaaataaagacaatgaacagcttcacagacaaaaaaagaaagatactccaggtaaagccaaaacaatacaactttctaaaaataatatagaaaaacagctttatgacttgaaaataacactagccattagttattagtattagattgcaaaaatagctacaaatgtctctccttcctgaatctatgcccttgggcagtccacttccatatctatgctgggcttggccctgtgcctgtctttgaccaatcacaaattgctgcaatcaaaggcctcgaaagcactaggtcattgaggtttgccctcttttgctgctctcaggacatcatcttaccactgccatatgaaaaagcacaggttagttttcctggctgccaacctgccaactattagatatttatgagacatcatcctagatcatccaggctccagctgatgtagctcagatattagctgagccatcaaaagcagaactgtaaatcatgagctgaatcaatgtttgttgtatttagttcctatatatgggaagggtttgttatacagcaaaagctaactttgtagaaattggtacctagaaacggggtgctattataactaaacttaaaacacagtcatgtatcacttaatgatggagatactttctgagaaataggtcattaggtgacttccattttgtgcaaatataagaaagtatacttacacaaacctagatggtacaccctagtacacatctaggctatatggtataaacttttgcttctagactgcaaacttgtactgcatgtaactgtaactgaacactataggtagttgtcacaaaatggtaagtatttgtgtatttatacgtatctaaacataggaaaagtacaataaaaatgtgatataaacaataaaaaatggtatccttgcacttaccatgaatgggaattgctctgggtgaatcaacaaatgaatagtgagtgaatgtgaaggcctaggacattgctgtacactactgtagaatttataagtaggctaccctaaatttatttaaaaaatatatatcttcaataacaaatttaactttaggttactgtgacttttcaaactttacaaacattttaatttttaaaagcatttaaactcttgtaataacacagcttaaaacacattgtacagttgtacaaaaatattttctttcctcaattttataagctttcttaatttttaattttttttttttactttttaaacttttttgttaaaaaccataacataaacaccctcattggcctaggcctacacagaatcaggatccctattatgactgtcttccacttccacatcttgtcccactggaagaccttctagggaaataacttattcaaaagaagttgacaaagccataagaaaactgatttagctggctggaaaaagggaaaaatggtcacctgcagtaagttggagaatagacaacatgtcaaatgaacctacagaccttgacaagttggtttgtaggcagaattttccaagtgccatttggattattttgttgcctaagataaaggaagaaaagagagagagagagattagccaaagaaagatggcttattttgcaagtagaattcagaaagaataaggagggacaagaacttgctaggttggaaaataaatctattgctcatccccaatcttctgtttctaaaatattctaaaataaagtatgttctggggccagatgaaaagacatgttacatatacaaggcaaactataaagatgacagtagttttttcatcataaataatgcaagttagaagacaatagaacaaaatctttccaaatactgaaagaataaaaatatcaaactaaaattccttatccagtaaagatatatttcaaaaacaaagacaaaatagacatttttagatgtcaacagctgaaagacataacttactacaagaaatgttgaaaaaagtcattcaagcagcagaaaactgatgtcagtagaagcctagttctacacaaagaatgaagagcaatgaaagtagtaatcacatgagtaaataaaatatttgtctttattatttaaatatccttaagagataaccaattatttaaagcaaaaataatgatgatttgagtttttatcatatataaacataaaatgtatgaaaccaatcatacaaaaaccaggaacaaagaaatggaagtacactcttgtaagatattttttttgcacatgaagaaatataatatcatttaatgacagactgtgaaaagttaaagatgtttgctataaaccctaaagcaaacgctaaaataaaacaatcaaactttataattaatgtgatgcttaagtttatatgttaagtttatatgttaacttggctgggacataatatctagatatttggtcatactctattctagctgttctctgaaggtattcttgaatgggattaacatctaaatctttgagtaaagtagactgccttccataatatgagagttcatccaatcaattgaaagccttaagaaacagattgacctctcctgagagagaagaaattctgccataaactgtctttggatgtgaaccacaacaattgccaccccaccagtctaccctgcccatattggacctactaacctcacagacatgtaaatcagttccttaaaataaacttctatatatacatctatacacgttattgattgtttctctggagaaggctgactaatactactaataaaaatcaagatagaggctgggtgcaatggctcacgcctataatcccagcactttgagaagctgaggcaggcggatcatctgaagtcaggagtttgagaccagcctggccaacatggtgaaactctgtctctactaaaaatacaaaaattagctgagtgtggtggagggcacctgtaatcccagctacttgggaggctgaggcaggagaattgcttgaacccgggggcagaggttgcagtgaaccgagattgcactccagcctgggcaacagaacgagactccatctcaaaaaaacaaaaacaaaacaaaacccaaagcaaacaacaacaacaaaaacaaatagcaatgcaacatatgtaaacccaaccatatcaataattatctcatatgccaatgggataaatgccacaaataaaaggcaatgattgtcagactgataaaaagcaagagctaattatatgctaccaacctactttaaatatagagataaaaatatgttaaaaggctgaaaacattaaaccactctgtgttagtcaaaagacagttgaagtggcaaacattagacaaaatagatttcaaagcaaaaatattgtccataatgaagatatttcttaataaattcaagagcacagaataatcttaaatatttatagatctaataatatagattaaacatatatgaagcaaaatatgataaaattacaaagagaaatagatgcatcaaaatagagtcagaaatttcaacttccttatcacaatgtttgatagaattttagaaataaattcagtggtttataggacacttgagcagtactatccaccaacttgaatgaaataacccaaatgttgttgaggatgtaaacaaactaaaactttcatgtacatctaatgaaaagaaaaactagtagaagtatctcatagaatagttggcaatatcttaaaaagttaaaaaatataccaaccctgtgatttagacattgaaaatatacacatttacccaggggaaaagatagtaagtatttatacaaaaacctgtacatgaatgttaacagcagcattatttgtaacatctttaaactagaatcgtcctaaatgtccatttacaggtgaatggataaacaaattgttgtatatacctataatggaatagtactcagcaacacaaagaaatgaacaacagtgatacataaaacaacatgaatgaatctcaaaggattaagactaagtgaaacattcatattcttattttataaaattttagaaactgcaaattagtcatgctgagacaatgtagatcaatggctgtctgtgaatgagattggcaaggaagggaactaaggaaagattagaaacacaagggaatatttaacagtgatggatgttttattattttgattgtattgatgatttcatgaatgggtatattcatatgtaaaaactttcaaggtgtatactttaaagatgtgtggtttactgcagcagtccccaacctttgtggcaccagggaccagttttgtggaagacactttttccacggatggggtgggatgcttttgggatgattcaaccacattacatttatggtgtacttgatttctcttattattacattgtaatatataatgaaataattacacaactcaccataatgtagaatcagtgggagccctgagcttgttttcctgcaactagatgatcccatctgagggtgatgggagatagtgacagatcatcaggtactagattctcataaggagcacacaacctagatccctcatgatatggtttggctgtgtccccacccaaatctcatcttgaactgtaactcccacaattcccatgtgttgtgggagggacccagtgggaggtaattgagtcatgggagtgaatctttctcatgttgttctcataatagtgaataagtctcatgagatctgatggttttaaaaagtagatttcccctgcacaaagtctctctctttgcctgttgtcatccatgtaagacgtaacttgctcctccttgccttctgccatgattgtgaggcctccccacccatgtggaagtgtgagcccattaaacctctttttcttcccagtctcgggtatatctttatcagcaatgtgaagatggactgatacacctcacatgagcagttcacagtagggttcatgctcctatgagaatctaatgctgctgctgatttgataggagtcggagctcaggcagtaatgtgagcaattggaagtggctataaatacagctgaagctttgcttgcttgctggccactcacctcctgctgggtggcctggttcccagcaagctgtagaccagtatcagtcagttgtggcccaggagttggggacccctggcttactgtatgttaattatacctcaataaacttaataaaattatgtactctataattccacttatataaaagtaaatacagccaatagtaaactatattgtttatggatgcaaactttggatattgaactgtaaatcaaagcaaagtagggataaccttgaaagttaggatactgaataactctaagatggatggaaagatttatcattgggaataacatctggattctagtgaagttctatttctcgatctctgtgtgggttatgcgatatttgcctaacaaaaaattgtttaagctgcacctgtattcatgttgcataggcatataagtgtggcttagggcattcagagcagtctttacatgatctaacaacacaacactgacctgcacattctctaagtgggacatctgagtttcatttctttgaaatgttctttaaaatttttgagaaaaaggtgttaacaattctgccacaaagattaagactggatttggttaatcttcaggaaagcagaaacttgtttgtaactacttgaaaatccctttctggtatttgagctttgtgggacttttgcagtaatttacagcttgattttaaccgggttgaactttaatttaaccagttgattgtggcaagttatgataaacagcatgaaaaagaaaaaacaatttctttcataactgataatgtacacatgctgaggagaaagtgggactctgaattcttttggtgatcagccattaaatcataaagaagaggtgtcttctttatgggaagatagaatagaagcaagatcttcttaggtatgtgatcctgggcagatgactttattatacttctgtgaaatggtgcctcagcaaccacttatattttggctgtgaaaatcaagtggctataaatgtattaaaatacatccgaagcctatagccctaaataatgtagcaactctcaagttgcttttattaatatcagttttcatagttttcattctaatttgtcatagttttcattctaatttgtttgctgatttcttatcattattctcagtaatgcagtctttctctgaatcatagttagtattcttgacccagtgactcaagtcagcatgtctaatttcttaaatctgaattgtctgcaagatttcatcttgattctatcttttgggttgcgctcaagccagtgtaccaatttcacaatatctgctaattggtacattgttgcctaccatctttaaaatagcctgctctataactctagtttttttaaggaaatcaaaacaatgccattattataaaagttaatgacatagcaataacagatctattgtcacagtgcttatccactgcaagtgtccaatatatcttactaatttttcagagtttagtatttccactgttgaagttctttttatttttcataagatggttcacaatggacacagggctcaacattacagaagaaattgtatcagtctttaacatcttatccataaataatggcattgtaaatacacacacacacgtcaattataattgatataccctcatgcaaaagcattattaaaatctacaatattgatataataataccacctacatcattgagttctgaaaattcaatgagtgcatacatgcagaaagtttaaaataaagactaggaaaatgtgtcggatgttttcttctttgatcttaaagacagagataaaatgtacatattttcttagtcgaaatctaacttagtatatatctattaagttaatatttactctgactctcaaacattctgaatctcttagtggccaatcacttgtctaatgccacccagttggaaggagctaaaattgcttttttgttttttatttgcttgtttgttttttgagacagggtctcactctgttgcccgggctggagtgcgctggtgtgatcacagaactggtttttaaccacgttttgggtaataatacttcacaagaatgctggatgattaaatgaagtagtgtgtgtaatgtgttggctcattggacagaacactgggtgctgagggatcatataggagtctgactctgcctaactcttcaccttgtttaataataacactctggaaagctcatttatctatacatgcctttaaaagcagacaaagcatttttattgcttttttttttttttttaccacttccatggcctaaaagaatcacttttgttttgaagactctaatttgcagagtaaacaaaaaagatggaaataactaagaaataaaacctccaaaagtttaggaccccaaataaaaatcatttgaaatgcataaaaatgcataaaataggtacaatgaatagtaatagatggaaaaaaacagattccatcataggtttgttacttgaatactaaactttttcaataattagctgttataatatccgtgttcaaaaacacagcactcagtgcagatcaaaattctaaaataaacaacagttactttccattttctcttgagtaagttatgagattacctctattgctctaatctagaagatatgaaaacaggccctccggccctaactgactctgtgttgtgtaataatatttcccttcaccaacctttacaatgaatataaaaattcaatttcagacctacaagctagaaagggctcaagtgtcaccagacttttctaaggggatattttctgtttttgtctacatttatatttgactcatttagtggagggaggtaataggatttttctatctgctatagaagctatttcagaagtacacagatataaggtcagaaaatatattttaaaatcacaaaagaaaacaaaatgatatgttggttttgaaccctagggtctttcaacattataatcaagcatgcctgagaatatctagctgtgacttcagagagaataatagtacacccttgagtctactgcaacagtcttccatggtatggtaggaaaagaatcctaggatagctcccaagacttacaagatacacacctcctggtgtgtatgccctgcataatctctgggaatgtgaatttaatggattttcctctgcgattaagtaaagctatgtacactatacagttgatcttaagacagagaatttatccaggtgggtgcgacttaatcacatgagacctttaaaagtagagcattttatctggctgactgaagaagaggaaaccagaaacggaaagcaggaaaagaatttgcatcactcttgttggtttaaaggtagaggggatagagagcaaggaaagtgtgcagtactccaggagctaagagcagtccctggctgtgggtcggcagggaattaggaaactcagtaatatagccacagtcaactgaaatttgccaggaagaatgatcttagacgtggattttcctccaaagtctgcagaaaagaactcagctttgcctatacctggattttggttttgcagtttctttggaagataacacagtgatggtgtgctggacttgacctacacaattgttagctagtaaatcagtgtttttagcctctaagttggtgataatttgctacgcagcaatagaaaacaaattcacatggcttggatcctacccaaatagtttttattatttcattaattcatttgttcatctctatatttatttctgaacacattcattaagtgcctatcatgtcccttctctaatcgttatgacgagtttttaacatacaagacaattttatgaccctcaccttaaagactatgttatcaggatactggaatgtaacattatttactgttcctaaacattatcaaatacacatactgcagatactctgaaagttgtgaaagctttaaataattcagtatgcagttttgtggctcatatagaaagcttgatgggccttgtgaaaagctgtaggcattgcccatgtctaaaggataaaagcggtagatgacagtactccatgtaattattttggctgtctcacaggcttattgaaatttccttggagtgacatcaacaagatggctatctagaagctcctagcatccttctttctaccacacacacacacacagacacacacatacacacacacacacagacacacaaaaaagctatgaataatcaagtactttttgaccaaaataactaaaggagagctctagagaatagcaaagaagcagcagaaatcctgtagagcatagaaacccaggatggctgcatagggaagggaaaaagatacctcgcctccgccactccatcccctcagttggaatcagctcagaaccagggaggactcctttctgcagggaaaaataaagacgaccccagcaattctgattgccactgcagacacctgcagcctttgttatcagagactcctacagtcctcacaagctctaaactcaactgagagagctccctagagtcacatgctgagctatattcagagaaggtgacaacactgtgccctggcctcacttctccccactgccccctgtcccctatcctattgcctgtactgctactgcactacaccattttggaaccagagacactactagagtgcatcctgctctgggggtgaaacccattgcaccaccctccattcctgagagtttgctgctattgcaacatgcacactccatagtgtgccatacctgagccaagctgctactgtgccctactccctagggccaatctactatatagctgctccatcctgcccattctagttgctggggcacctccacttaaggccaacatccagtgatggtctgccagcaggggatttcagatattctgcacaccagagctatcaactgcacctcaccttctagcaccacaggtgaggcagcttcctgaacctagagactctaataactctggcataccagactagttgtttgccccagcatcacagctgatacagtgccctgctccccaggcatctggcagccccactaacccacatagccatgctttctggagctgagaagacatagtacctgaagtcccaggaaatcacaggagctgtgccactaccatctccaggacaaagagccacagttcctgcatacctgtaactggactaacctccacccatctgagctggtgagatgtcccacctttccagggaatgaagtcattgctgtgctgctccaccaccctcaatcccaggcccaagccacagtggtgccttgccattcctgagtacttgctgttactgtacccaggctcacagagcctgggcttctgtcatgtcccaccatcccagggtccaaactccacactatgtgctatctcatccctcagatcctgagctgcttctatgtcctgttggttccaggatctgaattgtagctgtgcactgttccgtgaggatttagtctctggaaaatcccttcttctccagagctgcaccagtgctgtaccctgtttcccagggtcagaacatagctatattacagcctcctgggtttaagctgctagagtttgtctcaaagcaatagatcccagctttttgggagaactgcatccacttgtgcctgggaatgtgaacctgtgtctcaagtcccaggtgttacagtaatttcacaggacgccccactgtgggggaagataagaacagaatgattcccaaagttcttgccataataacatacatagccaccattattgccacaaattcctgtagcctagaccaccaaggtaccaaggtatgtcagtcatcactgacactgatcacaattgaagaagctgcatacagactgtatcactgggcccacacagaactacagccactgcactttgcccaaccagtaccctcaggcccaccttcggtgaaagcctacaaaagctactctgtaaagtttggaagaggtaactacacaatcagatgtgcagacatcaatgcaggaacacaagaaacacagaaaacaaggaaacatgacatcaccaaaggagcacaataattctccagtaactgaccccaatgaaatggaaatttacaaattgcctgaagaggaattcataataatattctttattattaacaagacacaagagaatacacataggcgattcaatgaaatcaggaatataattcattatctgaatgagaaattcaacagagagatataataaaaaagaacagaaatcttatagctagtgaatttaatcaataaaataaagtttaaaaatacaatagaaagcttcaatagcagactagagcaaacaaaggaaagattctgtgaacttgaagataggtcatttgtgacttggtctgacttagaggaaacaaaagaaaaaggaatgaaaaagagtgaagatattctttgggacttatgggatatcattaagcaaataaatatttgcattatgagattttcaggacaagagattaaaaaagggacaaaaatgcttatttaataaaatagtggctgacaatttcccattttgggagagatatggacattcagattcacttagctccaaggtccccaaacatatataacccaaagaggttctctcaaaggcacattatagtaaaactgtcaaaacttaaagacaaagaattttaaaagcagcaagagaaaacatcaagtcacatacaagggaatctccattagaatatatcagtagatttctcaacagaaactttgcagacaaggagacaattggatgatatattcaacatgctgaaagaaaaacctttcagctatggctgttatacccggcagagctatccctcagaaataaaagaggcataaaatattatccagacaagcaaaagctaaatccatcaccactagacccatcctaaaagaagtgcttaaggaagtttttcaaaaaaaaaaaaagaaaagaaaaaaggcattataattactgtcataagtatatatgcaactataaaactcactagtggaagaaaatgcatagtcaagttcagaatactccagtactataatggtggtatgtaaattatacatctgcttagtatgaagattaaaagtcaaaatggtcaaaataactacagcactacagctacaataagttgttaagaaatatacaatatgaaaagatgtgtgacatcaaaaacataagttatagggggtggagagtaaaagtctagagtttttgtatgtgatagaagttaagctgttatcagcttaaaatagctgattaaaactataagatgttttatgtaagcctcatggtaactgcaaaacaaaaaacatggcagatatacaaacaataaaaagaaaggaataaaagcttaatactacagaaaattataccacaatgatagacaacaagagaggaagaaaggatcgacagagctacaaaacaactggaaaagaaataataaaatgacagtaagtccttacctctaaatgataacctagaatgtaaatagattcaatcctttaataaaaagatggagtggctgaatggataaagatacaatccaattacatgccgcttgtaagagacccataaaagacacatgtaactaaaagagagcaagagtggctacagttatgtttgataaatcagacttcaattaaaaaaactatcagaagagacaaagaaggtaattatttaatgatatagtggtctgacaatcaagaagacttaaaaattgcatatacatattgcatatatatatgctatatatatgctatatatatgctatatatgctatatatatgctatatatatgctatatatgctatatatatgctatatatatgctatatatatatgctacatatatgctatacatatgctacatatatgctatatatatgctacatatatgctatatatatgctatatatatatgcaatatatatatgcaatatatatatatgcacacacacacacgtctccaacattggaacacctgaatacacaatgtaaatagttataaacctgaagagcaaaatagaaatacaataatagtagggaactttaatactcttttcagtaatgaatagatcaaccagatagaaaataaatgaggatataatggactcaaattgcacttttgaccaaatggaccaaacagacatatacaaaactgtccatctaatagctgcagaatacacaacttttttcacacatggaacattctccaagatagaccatattttaggccacaaaacaaggttttaaaaatttaagaatatcgaaatcatacctagtattgtttcagaccacagtagaaattagtaaccaagggaatcttgaaaaattaacaaaaaacgttgttgtggaaattaaacaacatgcttaaacaacaaatgggttgaagaataaatcaaaagagaaattttaaaaatatcttgaagccgagcgtggtggctcacgcctgtaatccggcagtttgggaggccgaggcgggcggaccacgaggtcaggaggatcaagaccaccctggctaacacagtgaaaccccgtctctactaaaaatacaaaaaatttgccgggcgtggtggcaggcacctgtagtcccagctgctcaggaggctgaggcaggagaatggcgtgaatctgggaggcgtagcatgcagtgagcagagatcgctccactgcactccagcctgggctacagagtgagactctgcctcaaaaaaaaaaaaaaaaaaaaaaaatcttgagataaatgacaatgaaattacaacataccaaaacctatgggatgcagccaaaccatttctaagaggaaaatttattgcaataaatgcctacattaaaaaaagaagaaagatctcaaatagatagtctaacattatacctaaaggaactagaaaaagaagaagctacaccaacgattagcagaaggaaaggaataataaaaatcagaagtgaaataaataaaatagccacgtgcagtggctcacacctattattgcagtgggtcatacctataattctagtactttgggaggctaaggtgggtggaatgccctgagctcaggagttcaagaccagcctggggaacatggcaaaacctcatctttaccaaaaaaaaaaaaaaaaaaaaaaaaaaaaaaaaaaaaattagctgggtgtggtgtcatgtgcctgtagtcccagctacttgggagattgaggttgggaggatcacttgagcctgggaggtggaggctgccgtaagctgagattgtgttgcttcactccagcctgggcaacagagtgggaccctatctcaatgaaagagaaagaaagagagaaagagagggagagagagagagaaagagagagagagagagagagagagaggaaggaaggaaggaaggaaggaaggaaagaaggaaggaaggacggaaaatagagaacagaaaaaccatagaaagaatcgagaatatatttttgaaaacaacaaattcaatatggaggccatttgatttatgagaaaaaggaggaaattctaggaccatgctgaatgggctctgatgttgagtctgccattttctagctgtgtgactctaagcaagttatttaatatctaagccttatctataaactaaggatagtgattacttaattcccaaagtagttgtgatgatcaaatgatataaattcagtaaaatattaaaagtgatggggtaggatagtaactcaagtgtaatagtgatagtgatactaacggtgactaatattagtgagcaaacatgatgttcccaagactgcacaaattattttccatgctttatctctcatttcctatggtaagtgcatcagataggtactgttattttacccattttgcagataaaaaccaaggcacacagtaatccagtaatttgctcatggtcatgtaaataaatttgaacccaatttcttgttagcactctcttctccttataatgttctttttatcccttcagtaaaaataagtaaaaatattaatgtgtatgttttaccacactgctgtactttagcatacagtagacattgtgaacattttaaggtcataggctgaatttccttcatagaaaagaaagattactttctttcatatatatattctatatagctctttttcttctaaaaccacatatctacaaccagcttggaatatccttacctaatatctttgtttctttttctcctccttctcaaaatctttttctctactagctctttcttcattgtttattaaacatttcttgcccttaagaaagcaccttttgttatactctctttctacttgattgggtgtgtattaatcagtacatactaggttgctagtgtcagaaacttaatgtaacttaggaaaagtagaaatgtatttatttacggaataaaacaattaacaagaagagcaggtctatagttggataacggaaacaactggatcaaaatatatgaaagtcatagggaatggaaacctcatctctacctttttctgatactcgatttaattttctctgattgcagaccagcttcctctgtgtggtggtaaatctaactgacacaattctagagcctcataaatgaacagtttcttctaatggcaggagcagagtcgtgattctggttccaaaatttcccaagaagggttctgattggtctgatttgggtctgtatcccacatgcttgctgacaagtaggtagtggtaggtcaggtaaaatccatttagctcctactaaaggcatgaggatggagaatgtaggcaaaaggaagttttcagacatcaggaaaatactaagcagaaaatatcatagatgcttccttttttttttttttttttttttttttttttaaagaggcagggtctttctgtgttgctcagactgctcttgaactcctggagtaaagagatcttcccacctgggattcccaaagtgctagtattacaggaataagccactgcacctttctgccttctcctcttaaagttgctgttccctttaatactcttcttctattgactaaattttgccaagctttgtaactgttctgagaaatttctttgaatattatacttgtcatctgttatctcttcaccagatatttttctgtctttttttcttatatagaatttgaggtttgggttggatatttgaatatagcaatatttgaccatatttatgagaaattacttgaaactttctgctacattcagcatagagaagagttggtttataaagcatctggcttattggagaaattttttccttcagtttctttcccaataaatgccatttctgctaactcttgattagactacaaactgatctctgtaatacacagacaagtcctataaatctgtctttaatggttctcattcaattaaagtcttttcattgcttaaatctttctttcctcagagtagtagaaaaatttcaaactgaacggatttcaatttcatctccttacctggttcaatagtggtattttgaggttggctggctgctcaaaagaaatttttgttcttgaagtcatgtaaatgtactagggtatgtttaatgttgaccatatgagtcagtttttcctaaggcatgctgtgctttgacaatatatagattcaaatcatctactatttcaagaatttgaaatactactatttctgaattatgtttttaaataataattctgttccattatttctagtttcctttgggggggctttctttaatatattctttgcctgttctacattttaattactttttccgtctaataactttttaaaaatgagtttctttattgtcactttgttttgttgccttttaagtcctctatgcaccttgctgtatttttccttccttatatgtcttctaattttgcctttaccttttttgagttttatttcttttacttttatttcctgagatctgctagtttccatttcatgcatattgctgtttcaccatctctcttgtgtgcttttttatttctgtactatgttcttgctttacagaggcaactacttcaatgcattttactcatttgttttaaaatttatcacaaaatatttgaccatagttttcatctattttgttgcaacttgttttcttttcaggatactttgccatttgaccttcttatttttttttaatttattttccattatattattatatagatcctgttcttccttgcttcttgttttactgcttattatcaaaggacatgaattttccccactagctatttgtaagcagtttatatagggtgggttgggaggtaaaacagaaccatgcttagggctaaaaattactcaatatgaactaaaaatctgaaaaacctgaaaatactcactataagaaaacaatttcaaaagatattaaatatctgtaaaaagttttcaaagatatctggtttggtgagttagtgtttccaattatgttagtaagcagcagaactgggttttgaaacaaggggtatggatgtggattctgcaatgtttacccaggtataagaccaaatgaaactagcaagttaaacataaacaaaatgacagagccaattgatatccaactagtaacattcatttaatctgataaattctgctgttttgctgaaatgaaattgcccttcataaggtgaatatagatgagaattctgctccatatggaataaactcacatcattgtgagtttatatggttctgtcatcactgtgggctgtgtgctgagttaattctctcaccattttttaaacaactgtgaaaccttcctttgtagagttgcctttatgacatttatgacatttggccaagtcatttagaccaagtatgtcatttacacttatactttggtcatttagaccaaatatgtcatttacacgtaatgttagtcttctttattttctcattagctcatgtcagtataaatggaactacttgacaccaacataaacattagtgcaaagacaagtgtgaagaccctgtaatcacatggcacttttcagaaatatgaggtcatccagtgattctacaagaggggttggcaaactgcagcttgtaggccacatccagtttacccctatttccataagacccatgagttgagaatagtttttacaattttaattgttaaaaaaaaagaatatgcctcagagacatgtgtacttctcaaagtctaaaatacttagtatctggccctttaaaagaaaaaggctgctgatccctgtcctagaatatacttatgtcatttttaaaaatggttattatgagatgaaagcacaaaatgaaaagcatcttttagaaagcttcaggatacttgggaatactttttcagaaagcagggaagaaaacacatttctacctactgaaaaatgtgctcagtaactcatccccaatatttgtgagttaaaagcacaaacagaccattacgtgggagaggcacaacaattcttggcactaagattaaatagaaatcactcccaggattgtcataaagaagacactatggaagataacgatgtcttcactggcgcacctacagtacatctaacaagtttcacagggcccttttaaaagacaatttaaaatatagcctgatgacaacattcctaaaaacaatgtagtgaaggcagttttagagaacttgagagtatgggtcagagattttcatttctattaatctgactccatgcaaggctagattgtagactctggacatatgaagaaactggaaacccttaggacaaatctcttttttggtaaaactgttgaatatatgagtagataccctgctacacaactaaaggtcagcttttctatgttgccagctgaattcatcatacccatttcacattatcattacagaagagcgtgacaatgcaaaattctggagataagatcaaacatatgaataacaacatttaaggatgccatgaaggctatttgagacaggtcctctgtccatgtgatgcaaaaatgacagaggacacatcagacataatttgtcacaacccaatgacattcatgtcagtaggtgctgagatgtaatctgtcatgttttagttagaggaaactgtatgtagctcttttgatggattgataagtagattcatccatccttatactttgaaagaacataattattcataattatttgcatgtagttatttataaacacaaccctttacattttatcagtaaatgtcaagagttgcctcactcggtgcactttatgctagtttagctaatttgcttaaattgggatgcccagagcccaagtatatcctcttgtgtcctgggaaacccacccttgccctttgttaaaggagtagcagttccatacgctggatggattgaggaatttcccattattgattaaaggtcaactatactctgggttctattaaataggtacacatgaaattaattaagatgaactagttaagacaggttcaccatttggagccactctcccccatctccacctcatcatgcaaatcttttttatggaagctctattcagcttagatatttaaatcagctctcagtaacttatctaccataaccgtttacttagttgtcctctctcactctcagcaaaatcaatgagctaaaaagattaggaaccatcattctttgtatttccagcacccagcccagtgatggtgtgaggacacatctgttactccacaccttctattctcagcacaccttaagctaaaacaacttgtgtttctggcacagctatcggagactttcagaggtgacaaactcatgctcatttatttagttgcctaatttctccagtgtcagtaataatctatattcttagcaaatcattgggaattggaaaccactctgacagattaaggccaggaaattttttaaagaagaaatgcaagaactggaaattacatatgtgaccttgtgccattcagcctgtgaatggtgtgtgggcttaaaaggttgttagggttgggatggtagaatatgtagagcttttggagaatgttttttgttactgttgtttgacctacttcattcccttcagactccgagaggtcataacacacgatataaagtgcaaggttaataatggagaatgtcgcattcaggagtttctctgcctagatgtggaattctggcttataggctatttctttctgtgtgtctctttctcttcactcttgaaataagttaagaaattctcaacgactggaatatatgttttccaccttttctggccatcaactgcgttatcaggatgaatgtcaattactgtcattctggaagtcatagggtgcattatcctgttttcctattataggggtatttgagtaataaacttactctcttgtaatatcatataaaattttattttaactgacatctaaaagcacgaaacctcttaaagtttggcttgccccatggaggtgaatgcagctgcagctcatctcaggagtctgcccttatatgaactgcttgttcttacctttctactcctcagcatgttgaaactcagaccacactcctaaatgagacatccaaaggctccggcctgctggagtgctgacaagcatgctgtttagggcaggtactcagaggcaaagtcagagaaacatgatctcttcagcagcacgtttttgcacatgaaacctgtgtaaactcagcatgactcactcaggccaaggtgagcactctgatgtctgtgaacgactgcagcaacttggcaactggggccagtgtgcttccctgtagcactcagcagagacagttcaggacttgaaacaattttcctcattgctgttgtcactggagaacaaaaactgcaaaagcgagccattgttcacactgaaagtcattttgtggagaaaatgagaggcttggaccagtctttttgtcctttattgtatcgtcccctctggcatccatttatgggtctgatttcatttctattttcattttgagacttttctctatgacctcaggtcagagacaatatcaaaggcaatatgttttagtgggtttatttgtctgagtcaacagaaaaagagagagggaagggaaatggaagagtacagggcaggggggaggaaggggggagagagagagagagacagagagagaccaactgagactaaagctatgtctgtatgaaaagatgactatagttggatctggaattctgaatttgcaactaacactgatgccatttacaatgtaacaatcagctttagtcttccatgtgaatgtagatattatatcatcatctcataacattttattccatatacatggtcaccaagatgaacagaaagagttagatctgggtggtgagaactgggagaaaaccagccatgagaataagatggattgtcttttgtcacagaaatagcaaatttttaagtgtatttgaaatgataaatacttttttttaaccttttgtaacatttcacaaaacttttaaatcaaatttcaactggaactttggtctgctttccttaaatgcagctgatttcttgctaaattccattgcatttgatgccttcagggatttgggaagttagcgtactgggacagaggcattgatgatacatatgacgtggacaaaggaaatgaactcagcatatgtgggaagtatagcaagtgttcacttgtggccagtgtcaccaaaaatgccaccaaggtaactcaacatagtcaaagtaatgaggcagaattgttcttcagttaacttgttaatagggaaactttttataagcctaactggtctagtgatatttggtccagttctcaaacctatcttagaggcttccctgtctcatttccatagggaaaaaactccctatccaattattaaatggataaataagtgcttaaaacgtgaaaaatagggaaattcatgctatttgaactagtttttgcttaagtatgatatggccatggcaccaaacttcagtgtgtatttaggatcaccttagatgcatgttgaaactatacacatacagcctaagctaatcctaatgaacctgcttaagttggtcttgagtgtggcctaggaatttcattgtaaacaagtatcccagatgattctgatgcacatagatgcattctgatgtgtgtgtgcatgtgtgtgtgtgtgtgtgtgtgtgcgcgcgcgcacgcgtgcacgccagaggggagataagggaaagatttcaagttaaaaatgggtttgggttactttgtgaaagaagttgaatggcatgctaaggagtttgtgtttttaaataaagaacaaacgtgatcatatctgtactttgagaagtataactctggtgacaggacggtttgaagagggaggggagaggagtcaagaagactagttaagaagtttttcaaaagatgagcacttccgccaaattcttcatcacacattgtacaggtaataaataagacatggttcctttcatgaagttgcttatgatcttgtaggaaaagattcaatgaatgaggcagagatggagaagtcagagaagtggcttggatgggcaggttggggctggacagattttgcagagctttaagaagcaaaggaagagcagattcccagaaaagaatataccctaagagacaggccactaaattaaatgacagtttgatggtgccacttttttcccccactggggtgtctggactctacagacttacataaatgagcagtgagaaaatgtaagtacagattattgattacttttggggacatgtttgcgtaaagaaagacagagctaaaatagcagcttgaagatatcaaaggctaaggaaaggcaatttttgtgttgttttgcttttgttgtgagtctgttgttctttataggggagattggaatatatttccaggaaaaagggaaagaaaatccaaaacctagagaagtgaatgttggtggggcaaagagaaagagagcaggaatgagaccaggagggcaggtgaggtgaagaattcggtattgggaaggaagagaccagaaagctgaagaggatggatggctacacgatacctttgagactgggaggaagcagcaggagaaagagataaagaacaatgagagatatgagttagacactgggatatgagttagacactagtcacatttcaccaagggaagagtccaagcttaaacatatttttcatgtcgcaatatgcttagggaaagctggcccctttccgaatcccggaggatgaacacgtgattgatctaaacacggcatagctatcccattctcttctattggagttcggtttggggatgggcaagtgaccaactttaggccaaatattaaggagatttcttctgagggtacttctgggaagtatttgcttcatgatatatacatttcctcccttgaacttgatagtataaaggcataatgcttgggatgagggaaccatcttggaaccatgaggtgcaaacttaaggacctaagttaaatactaaggataggggaggagaagaaatctgagtctaatgataaccttgagacagtgtggtatctctgggactgcgtacctccaatttcttgtttgtgtgtgagtgtgtgtgtgtgtgtgtgtaatcaaacaataaagaatatatgtatgttctttcttgtttaaatcacaactattttaattttgtgatatttctgttaaaagtatatgtaagtgatgttggaaaaattggtctccatctttttattaaagaggtagtcatgtgcccagaaggatggaggcccacctgtgatttagggttgggatgtgtggaaaatacctgaagctaccattgaagatactgagaatggcaggaagctaatgaaataaatcaaagaaaggcagcataaacagacctcaaataaagtaggactggatgtggacagaatgactttgcaacattgccaaacctcaacaaaggggcaaaaaaggatagagtccttgttgaggagggtttaaaattggataccagaacacagcatcaacccaaagtcaaaggcacaaaggtgtcattgaggggagcaagggcagatttaaatgttttatgaaggagcaaaatcaggattaggattggatagtgcttggacaactcatacaatatgtttttgcctcagttttgtcattgctaaaaagtaaaattaacagctagtgcttaggtttttgtgagggtaaaatgggataatgtataatttattttacatggtatctaacatatttttaagaactcaacaaatgtggtaataattagatcctgaacttctgtcaaagccaggcaggggggcactaaagaagctcacacaacagaaataatgtcaaatataagtgcgacatatatatttttaaaatcagcaagatgtataaacaattctcactattaatactagtaagtttcttcaaagttgaacttaggaaacaggaaaaaattggcacagaacatcctgtgtatcttaccaagataaattccaaataaattgcctgctggcagtacccattaattatttgccgacaatttttcagccagcacatgcttttttatttagctggtccagcaagtcactgcagttgtagttgttcatcttgtcacaggactgggtagaaagccaaatgcagaggtatgagctgccaagtaacccactatctgtgcagctgtggggaggaaccagaaaacctcaagacttcttgctgcttccattttcctagttttttttctctagaacctcatccacatcgtatggtgctgggaagggtcccacagcgtcagtgtcttctatgagtttgttaaaaatgcagactcccaggtcccatcccaggagaactgaaacagaatttgccttttgataagatgtccagatgatttgtttgcacattaatgtttgagaaccactgatatttaggacttatctgaagccacctcacaggataggcagagaatcgctgtttcacccaaaggccctctcatttccttgtcatcccttcatgatgctggatgtggggttcttaagtgagacctcatcttcactaaatctctcattgctgtgcccactgaagccagccttcagttaccagggagcattgccttagaccactttaaccagagagcaacaagctcaaggaaattgtatgaactcaggtgctagacgttcctgggtttattctaggctctgcctcatattagttgacctgggacaaattaactcaactctgtgattgcacctctccctccaagcaagagcctctgcagccctttttcgtaactgttgacccttttctgatggccatcacaggtgggaccaagggagtacactaggggatattagaggaggatccctaatacaagattggccaataagctttgcttcctaggacatctggatttggaaatcagaatccactagttgcctttctcagtgtttgagcaaagaagaattataggacgacctggagaaattatttctcagcaatgggctcagagatacagaaaaaaacaaagacaatatggctgtagaaatatcagtcttcatttctgatagttttctaattttggatcctgctgtctactgaagtctgcattctgcttctgggttccatccctttattcatctaataatttatctctctctctcgcccacactaaattaaattccttaaatccacacagtcctgacaaagcaataagctttaatgaatggtagttaaaatgattattattgctactactggctgatcaacttaatcattattattgtaatgcctcctatatcagctgttttttcattcaaacatagtcactgataattgatcctcaaaatggtaagaaaaccaatcatctgaatcactaggaaaaataaggaaatactattttcatatatgtttatgtattcactattgcattgatgttcaaataattaatttaaaatagaatgatgtctaccataattatagagcacagtggcagctgtcatttaagagcacattttaggcctgaacccctgcaccactgagggaaggaattgtctcagccttcaagcctatcgtgtcccatgttattactcagatatcacaggagacctaactgacatcaggaaggtaaactcagtgacccaggaaacaaaactgttaagttataaaatgatgttaagaatccttgattccacttgctgctgtgggtctcatataatatactcccctccaagcccacagagccttatctcagctggcagcgatctggaaacctacctgttacattaatcaaaacatcttactggaatgctaacttcttgcaaagttccagctcttttcatcaaaaccaattatgtatgaaatgttagacattgtccagtggaagatatatattatcaatattaatgataaaaatcacaactaacatttagacggtagcatgtatcacacccctttgaaaaacgcaacagtattttcagctagtcatcattttctacggttttgtagtgagacatgtgagacttttaagaggtcaaataactttctcaaggttcccagtttgcctgttgcaaattacacttctctgacacatatggatagctctgtccagtgaacactcttagaaacctttaagtaggctgggagtggtagctcatgtctgtaatcccagcacttttggaggccaaggtggatggatcatctgaggtcaggagttcaagaccagcctggccaacatggcgaaactccgtctctactaaaaaaaaatacaaaaattagtcaggcatggtggtgcacacctgtagtcccagctacttggggaggctgaggcaggagaatcacttgaacttgggaggcagaggttccagtgatccgagattgcacccctgcactccagcctgggcaacagagtaagactccatctcaaaaaaaaaaaaaaaaacctttaagtagaaggcagagcctttctcaacatgctacaccattaaaatgtcacatgttccttttttgagaggtagggagaacactttagggagaaattgtctcttcttcagagatgtggctggcaaaaaagcaaagggaagtcgggacactttccaaaaaagcaagctacgtagggcgcagactgcgggcaagacaaaagacctctccagccatcctgaaacattaaacccaatttccttatccccagcaggtatctggcacaactcgcatcattacaattttctagtgtactgagctggggaaatgtttccaaaggaaactgagtagttaccaaaggaagagttgaagacactttgccaattctcttttcttaaggacttagtaactcagactttttaaggtaggaaagattttgccttttgaaaataactagagtttttgctaccttgacaattttaagcaacactgaaagaaccgtggaggttgtataaaccatttgaatttttccgtcatagacctaataatcaggactctggaatggatttcatcttttcttatcaaaagggctgctctcatgctcaatcagctattctgtttcttttcaaaaccgattttgtgttagccatggggagtcaggcagtggattgtctaaatacttttatacagaaacaaaaattcatgcttgatgttcaggtcagttttacagagttgtaatttagaggcattcaagggagtttaatggagaaggaaaccagtcaatattttattcaatccaaacatgaaccaacattattaagtcgaggaatctttctgctgagaaaataatgtcacaaaggttcagtcaatctctgggagaggaaggagggttcataaaagactgcacagtttacatgtgttgtgggaatttaaattttagtaattcttgatgcagaattggacctgtggaattagtcccattttacctccataggaagtgttcaagccagctttctaagcagatttcaaattctgcgtttaattacatttcctaaaacccttagtttgcacacacagcccatgctactctggctccgatgtccttttcagttgctggttggcccttcttcatcaggagccctgttctcgactaaaacccagctccacgctgctcccatcctgctaggcatggtcatgatcatcccaatgcctgcaatgccccctctctgtccagggaatgctttctgatctttaaattcctgaatcaaatatcaccttcccccttttcgctcctcttatgctgcctaacaagcttaattattcttatttctctgttttacctttgctatcaccttattgccatttatcatggtggctcattttaccttttttttttcttttccttgattacaagctctttgaggatcttttttttttttctttcctgcctggtcagtgttcaatacttactgagtgactgaataaatatatatattagataatgcaattactatggattttaaaatctaagatcaaattattacatttgttgtataatcagatattttctttgaaaagttattctttctccaaccagtaactcctctgagcaagtggtgcaagcactgcctaacttcttgagcgtagagtatgaggagaaggagcagttgggtacccacaattgtcaggataccaataatctgaattgtgggtaaaaaaattattctttagagctatgcttttggattcatggcaagttgatgttcacagggttaactgaaaataaatgtctactgctgttgtgcactgtaaattgggtgcaagttatatggcctccactgttcaagatatatgatgagtcgatttctaatgattgcaatacctcatgagataccttacccactcagttttagagataggaaatttgaggttcagaggtgtcaaaatgatgtctccaataccaaatagctaagtaaatgttgaaactaaaaggggagccccctgccaaagacatcctatgagtagcaatagaatagccagaagggcagagtattggggtggtggtggtggtatcagttctcatgattttaacccaaaatgacagtctaagaaggaaagttagcatagaatattctggtagatatcatgaaactcccactccaacttatcagaagaaaagcagcccttttcagaagcagccgactctagcccttggtatgtcttgtcagtggactggctcagatctcataatagtgccatcccttgggggactttttggaagctgcaaacctcccgacagaagcgctgtctaatgagagcctcattcctccaagtgctaagggcaagagtctgggcagaaggatgtgtgtagtgctgttgtgagagaactggttggtactgacacctgaaaaatctccactagcttttctgcaaattataacattaatatgcttgagttcagccattgggaaattaaacctaatgtactatagataaaagattgtaggccttattcaaaataagattcagaattaaagaagactatgcatggtacctccagaaacactatgtataatattaagtattccagaataatcataagaatgcaactaacatttttggatatttacatgtgacaggcactatgctagtcattctatatatattatctcttttttttttttttttttttttgagatggagttgactcaccacaacctctgcctcctgagttcaagcgattctcctgcctcagccttctgagtagctggggttacaggcatgcaccaccacatacagctaattttgtatttttagtagagacagggtttctccatgttggtcaggctggttttgaactctcgacctcccaaagtgctgggattacaggcgtgagccacagcgcctggccttatgttatctcacttaatcctcacaaagaacttatgatatacacaaacactatcattatctcgttttacggatgagataacaaagttacactgttaataactaacagaactagcacacaaactatattatgctgatctactcattttccattcaaattaattgaggactgaagacccaaagatgaagggacacaacatctgctcccacagtatgatagggaaatgaataaaacaaaccaattgttcaatggaactatggcactatggcataagagagaggcagaaatggtctggtaggctaggggtgggcaggggggatttcggagctatctgagacttggaataataaaaggagtttctaaggtagaagaatcaaattataaaactggcaaaagaacatagcatatgctcagagaatgatgggttgttatagtttgaatggatgaggtccctccaaaattcatatgttggacctgaataatcaatgtgataatattaagagatgtggccttttgagaagtgattatgtcatgagtgcttcgcctcattaatgggattagtgctgttacatgagaggttgaaggaagcactctaggaccttcagctcttccaccccttctaccatgtgaggacacagcattcatcccttctggaggatgcacttccaaagtgccgccttggaagcagagagcaagcccttaccagacactgaatgtcagagccttgatcttggacttgccagcctccagaactgtgataaataaatttctattattgataagttacctagtctcaggcattttgttatagcaccaggaactgctggtaccaagcagtggggtgttgctgttaacaaatatataaaattgtggaacaagataatgcagagaggctggtagattttggaaccgaatgctagaaaaagtctctattcctgtgaataaagcattaaggcagttctggtgataactcaaaagagaacagctgtaggggaagccttaatcttacagactacttaagtggttgtgatcagaatgctgatacaaatatggatggtaaaggcaattctgatgaggccttagatggaaatgaggaacgagggattgtaaactggagaaaaagccatcctgtttataaagtggcaaataacttggctgaattgtctgtgtcttagtgcttagtcagaagctgtgagcaatgaactagagtatttggtggaagaaactgctaagcaaaatattgagggtatggaacagcttctcttgactgcgtatagaaaactgtgtgtgagagaaacaaattaaagatggaatttatactcaaaaggcaaaaagaactcaaaagatttggaaaattcccagcctggccagattgtaaagaataaaaaggtgtgttcaggagggaacaccagggtgtgatcaagtgatatttgataagattagtgtggatagaaggaagccagatgcaattcagcaagacaatggaagaatgaccctgaaggcatttcagagagctttgagggtgctcctcccatcacaggcccagaatgccagggccttgagagcagaatgggttcaaaggatgggggccaaggtccctgtgggactttgaggcttactacccagggccaactcaatttctgctccacccattccagtgcagtgctctttggctgctccagcatggctcaaacaggtacaggtttaatgcaggacactgctccagaaagcacaggcagtaaatcttggcagcacccacctggtgctaactgctggtgcacagagtgcccaagctgtggaggcatagctacctccacctaggtttcaaaggatgccttggagagcctcatagcccaagcagagaactgccacagtggtggggccacctcacagagcctctactagggtaatgcctgatagagctatggagtattccacccatgagagctgctgtgagggctgtgcccaactaagccatggacgggtcttccctgggttttgggtcccaacccccactcagtatgtcaagaaggcaggacatggagtcaaagaagattattatcacgcctcagaggtgaatgtcgtttgccttgtcgggtttaaatttacttgtgaattattacccctttcttctttcctatttctcccttttgtgatggaaatacctgccctgtgcttgttccacccttgtattttgtaagcatttaacttgctggatgtcacagattcacagctggacaacaatttgcttcagaatgaattgtaccttgagtctcatccatatccgagttagatcatatttacaggagactctggacattatttttattttttccttaaatagtgtttgaggtacaggtggttttttgttacatggataagctcttttgtggtgatttctgagattttggtgcacctgttacctgagcagtgtacactgtactcaatatgtagcctttgatctctcaccccctcccaccctttccccacaagcccccaaagtccattgtatcactcttgtgcctttgcctcctcatagcttagctcccatttataagtgagaacatacaatatttggtttgccatttctgagttactttacctagaaaaatggcctccaactccattcaaattgctgcaaaagacatttttcattccattttagggctgagtagtatttcatggtgtgtgtgtatgtgtgtgtgtgtgtgtatctatgtatctctctctctctctcacacacacacattttctttatccacttgtttgatgggcacttacggttccacatctttgcaactgcaaattgtgctgctataaacatgcgtgtgcatgtgtctttttcatagagaattcatgactaagacccccaaatcaaatgcaacaaaaataaaaataaataaatgggatctcattaaactaaaaagcttctacacagcaaaagaaattatcagcaaagtaaacagaaaacccacagagtgggagaaaatatttggaaactatacatccaataaaggactaatatccagaatctacaagaaactcaaacaaatcagcaagaaaaaaacaaataatcccatcaaaaagcaggccaaggacatgaatagacaattctcaaaagaaaatatacaaacaaatggccaacacacatatggaaacatattcaacatcactaattatcagggaaatgcagactaaaaccacaatgagataccaccttactcttgcaagaatggccataattaagaagtcaaaaaacaatagatgttggttggtgaggattggtgaaaagggaatacttttacacagctggtgggaatgtaaactagcataaccactgtggaaaacaatacgaagattccttagagaacttaaggtagaactaccattcaatccagcaatcccaccactgggtatctacccagaggaaaggagtcattttgtgataaaagagactctgaactttagaattttgagttgtcgctggaacaagttacaatctttgaggctactgggatacaaagaaacaatgcatttcgcatgtgagaaaaacatgaattttcacggggccaggggtggaatattattgtttgaatatatatgttcctccaaaatttatatgtcagaacctaatacccagtgtgttggtattaagaggtgggaccttttgagaagtgattaagtcatgagtggtccaccctcaggaatagggttactactctcataaaagaggttgaaaggagtgccctaggccctttttcccttctatgtcttctaccatgggatgacacataatttttcccctccggaggatgcagcaacaaggtaccttcttaaaaatagatagagagcagcgttcaccagacacttgatctgccagtgctttgatcttcaacttcccagcctctagaactgtatagtctgttcctgctgctataacaaaatactttagactgagtaatttataaacaatagaaataaattatggtttacccagtctaaagtattttgttatagcatcaggaacagactgaaaaatggatactatgtcctgtatgactggcgcatagaatgtgaaacagagagtgacagggcatcagagtggaatatgggaaaaggccaaatcctgaaggtccttgtatgtaatgcaaatgaaataaaattttatttaaataaaaggatagggagccattgaagaatgtaagtagagttggtatcaatagcgttgctatttatgatgatcatgttatggagtgaatgagtgtgtgtgtcccctaacagtcataggttgaaattctaacccccaatgtgctggggttatgaagtgggacctttgggaggtcattaggtcatgagggtgtagccctcatgaatgggattagtgcagttataaaaagacacaagaaagcttgctttctctctctgctcttcaccacatgaggctacaaggagaagcaaacaatctgaaccaggaagcaggttcttaccagacataggatctgctggaaacttgatcttggatttctcagcctccagaactatgatcaataaatttgttgtttaagccacccactccatagtattcttttatagcagtccaaacttacaaaaatatatcactttgatggagtgtagtgaatggactgataatggtgagactagaaataaggaagctaatggagatattgcaatagtcaaagccttaaaattgagtgggaggagtcggaatggaaagcaaataataaattccagagtatgggtagcatagaatagtggctaagaatatggcttctgggctggctacttaagcttgaaccccagcactgctacctcctagctatgtgttctttgggaacaccattagcttctgtgtttgagtttcctcatctataaaattcataataatggtatctacctcatagtgttgttgtgtatattaacatgacatttgaacatgttgctgaatattaccgtacagttatgcactttatgtgatgtgcctaagtgtctagcacaaagacagcattatgccagaggcatttgtgtctgtgtgtgtgtatgtgtgtatacaatctatatatactttttgctcatcacaatgggcaaaattatttttgttataaaattgtattctaaagtaaatttaatttacttaaaattatattcaggacaagtaggcacaaaaattagcctggtttagaatgacaaatatgtataaaaattaaaaatgtgattctttaggccaggcgtggtagctcatgcctgtaatcccagcactttgggaggctgaggcgggcagattatgaggtcgagaaatcaagaccatcctggccaacatggtgaaaccccatctctactaaaaatacaaaaattagccgggcgtggtggcatgtgcctgtagtctcagctatttaggaggctgaggcaggaaaatcgcttgaaccctggaggcagaggttgcagtgagccgagattgcacttctgcactccagactagcaacagagcgagactccatctcaaaaaaaatgtgattcttcgacatttatgtttttgaggtccttttaaagtcctatagttgcatggtataatgactttggagatagaatgtttcagaataggtaacattaaaggattgtcccatgtaactggattctcataattgcttttttctttttattactacttaatacatatcctagataacccagataacttggttttgaagaactactaaaacacaattaagtattatcttttaccctaaatgtggttagactctctgtttaaaattattgatttttggatcccatatgctctggaaattttagtgtgttttaaagcaaaatataagagaatgtgaaccgagggatattttactctttacagcatgttgaacccaaactctcactagtatctcatcgtatttcccaaaggtttgccaggataaacttcagaagcagacagggtgccttggctcaaggatttgagaaatttggtcttactgagagaaaatagagtgagtaaataattattttcaataaaggattgacctggtcaattttacgttttttttttttttttttttttttgtaagatctgatgttgggatgaggaatagattgatcagaagatagttgtatggagacaattagaacattcctaactacttcataagagagatgatgtaggcatgagttatggcatgtaggactggacttaagaggaagagaaagaactgagaaagtggtagaaaaaaatctcatagaacttgatggctgattgaatttgaatgactagggaaaagaaggagtcaagaatgatcccacatttctaggctgtgtaaccaggtagaggatcatgagccccaactgacagagaatgtggaagaaaatgtagctttggggtatggagaacagaacgtttagttttggacatactgaatttcaaaggtctatgccagagctaggcaggcatgaccagcagataatgggacacacagctccagtgagaggtgtgggctggagatactaatttgagatttattaccagaggtgggagatgagtcatgaacatgggtgtgctcttcttaggagaatgcaaattgcagagaataattggtcaagaacagaaccctaaggaacagaagtgcgtaaagaatttgtgtagaaatgaaacccttgaagatgaaagaattctggattagacatgtaggaagaacaccacggaaaccaagggagttgacaatagttttggggtagaagggatctattttatgttgtgaaatgtccaattagataaatactaaaaagtttccattacgtttttaaaatagcagactttttttttttttgaaaaccctcttattcagaacaggttcagtggaatgttaggggtagaagccatattgaagacagctgagaaactaatcctaggtaaagatgtggaaattgcaagacctcactttcaaaaagttttgaggagaagaggagaatggcaatactactgtagagcatactttgggaaactctgggaccacctgggtcatactttgggaccaggagaggcatgtgcctatttattggctgagaggaaggagcttatagaaagtgagcagtttaagataccatagagactccggccattgtggctcacgtctgtagtcccagcactttgggaggcaaaggtgcaaggattgcttgagcctaggagtttgagactagcctgggcagcatagtgagacccccatctctaaaattttttttttttttccaaaatttagccagacatggtggcacacacctgtagtcctagctactcgggaggttgaggtgggaggatgcttgtgtccaggaggtcaagtctgcagtgcgacatgatcatgccactgtactgcactccagcctggacaacagagtgagaccttgtctcaaaacaaacaaacaaacaaacaaacaaacaaaaatacaaaagagagagtgatggctaaaggaaaatgtatgggaatgaagaacattctagtactcaggtgccttaactttgacccagaagaaatttttttgtaatgagagcctggaagaaaagagcaaaagaagtaatggatactatcattgatagaactttcagcagagacgcagaaatttgtggcttataacattagatggcatcaatattccccctgagataggaaacaaggtcttctaaaagtgagaaggacagattatttaatacaggggctaaagagaagccccttcctcttgaataaagcctgtgatagatgatcttcaaagaggaccaccatcaacttcttcttcccctggaagcacacactgccacatcccacatcaagaggtgggatttgtttccccttctcttgaagctgggaagacgtgttattgcctttgatcaacagaatacagcagaaataatgttatgccagttccaggcctagctttctaagcatagtggagttccccttcttctctcttagaagccagctaccatgaataagaaattcaactactctgagatcaccaggctgtgagaaaagctaagctagctgaattaatttgctaggactgccatgacaaaataccacggactgggtggctgaaacaccaggaatttattttctcacagctctaagagcaaggcatggacgggattgcttttcactgaggtctctccccttgacttgcagatgactagcctcttgttgcctcttcacatgggaatgcacgtctctctgggaatgcacatccctggtgtctctttctcttcttatgaagacgcaagtcataccagattagatctcatcctaaaggccttatttaacttaaatgtctctttgaaaccatttttccaaacatggttacagtctgaggtactggatgttgggacttcaacatatgaattttgaggatgcagaattcagcatccaacactaaccatgtacagagatcatgagagagagggacaggacagatgggcaatgtggagattcattggtcagtattctgagcttatattttctcacataatcatccttcacataagtctctttaagcacatagagcaaagctgtatcaatttcatgctgcagttacacctttctatttagaattcacaaaacaaaattacccatccccctcaaaaaaaaaaaaaaacaaagaaaataacacatatacatcttctgatggaactaaatctgatatgtaaaatgactcaagaaaaatccccagctagtgagactgtgctactctctattagggtaataaaataacctgctaatatcactggcttctgatacaattgtgatgtgtaatatataggctgggagaccactgtggatatctatttttctctcatttttccttatataatttgggaagtggaaggaattggaaactacaatttcctcatgccttcataatagattctgtacatcctttggaaagtccacaaatctaaaactttaaaaagctacagggatcaggcgcggtggctcaagcctgtaatcccagcactttgggaggccgaggcgggtggatcccaaggtcaggagatcgagactatcctggccaacatggtgaaaccctgtctctactaaaaatacaaagattagctgggtgtggcagtgtgtgcctgtaatcccagctgctcaggagtctgaggcaggagaatcacgtgaaccagggagttggaggttgcagtgacccgagatcgtgccactgcactccagcctggcgacagagcaagactccgtctaaaacaaagaaacaaacaaaagctacgggaagtaaaatgttgtcagtttaattctatgagaaggtccatattgtgataagggaataatattaagtcatgtacagaaggctgatactcagatacaatagtgaccatctacattgcagggtggatttgaagctgtccatttcatcccatcctctgcaatggaatgggaactccaacaccttctccaaagctgagtcgctcactcattctctgttattctcttggttttctaagcagactgtgttccagtttccatttcattctgtattttcttatgcacattgtttgttgaatttttatatccacacagaaatgcacatccctacctccatacctacacacataaaagatttttgatgtatggatgctggatgcaaggactaaagaatcaaaagcccttggaataagagagtactgagagataggacaaacacattttttcaatgttcagacttgctggaaaggagaaaataccctaaagaaagtgtcagaaacccccctttaggcctcttttgttactctctctagcttttcaattggggacgtcagttttgctggtgatggcataggcagggcaaggcaaaattaatataaaattagagaagatacgctataaaccggcagaggtccatctttaaaccattgtgaacaggcaggggttcatctttaaaccattgtgaagtgtgtcttctctaagtttaagacgaaggtccagtcttctccagtggggccagaagcacaagtccttttattttttattttatttttttttttgagacggagtctcactctgtcgcccaggctggagtgcagtggtatgatctcagctcactgaaatctctgccacccgggttcatgccattctcttgcctcagtctcctgagtagctgggactataggcgcctgccaccatgcctggctaattttttgtatttttagtagagacagggtttcaccatgttagccaggatggtctcaatcttctgaccttgtgatctgcccgcctcagcctcccaaagtgttgggattacaggcgtgagccaccgcgcctggcccagaagcacacattgtaagagattctgccttctttgctttcaggccacaaaaataagaggtggggcctggtccttgtaggatttttttctataatatacttttagtttagctagtattatatttctgtgtacaatccatttctgttattaccatggttactactattgtttattatccttgataatcactagcttgaaccactgcgataagtttgaagctgatttaatagcctctactctcattcctctcactctgctctgtcagagtgatatttcttaaacatcaatgtgaccatatctgtggcttgtcctttcggtgatctcatccagtctcacggagataagtatgatatagatgttggtgtcatcagtatttatttcccagcctggacctctcctctgaactctagatttatatatatgcaactacttactccatagctctcttcggatgtctaagagacatcctaactctccaagcaagatgaggctcctgatcttcctctctaaatgtcatcctccctccctcagttctcctttcccatttcagaatgtcaatccattcttctgaatgctttagtcaaaaaggtcagagtcatctctgaataggaactgagatacataggctaaatgacatcatggcatcctcattacatgagtcagtaagtagcagcatcaggatatttactcggacagtgtaactccagagtctttgttctttacccctatgtttgactgcttctctaccttataaatccctttacaggtaatccaaaaacttcatatagaatctaaatgacaaatgccaactgctaacctcaaggcaagcttgctacatcaaagaactatgaattctggtctacctagctgtctgggaaaagagctgaaaattcccttggttgagggccaagatcttttgattcatttttctctctctttcttataccttctgcatgttcttatgggaatcctagattctgcatgttcttatgggaatcctaggctgtgattttgagatgggaattcagaagtttctgttataattctgtctcagctactaattagctatatggccttgggaagtttctaaactttttggtattttataattactctgccaaaaaatgacatgcatacactagatggcccagagtctatagcaataatacagaaaaaatgtatagagaaatagataaatcaaattacagggcctgtttgcttcttgagggaaagaatcacaagtttgtttactatccatctcccaagtgcttattgaagttacatcttcggcagaaactcagtaggtatgtgtgaattgctggttgaagattcatgatttgctatatggtacggacaagatgccttagaattccagaggcagtttggaatagtagaaacaaatctgaattgagaggcagacaacaggatctaatagcagagaaggcagagatgtgtaagttagttgacttcaggacaaacatctatcatatagtcaagacttttagtatttgcctctgtaaaatataaagagagtgggattggttgatctcaaagatatcttaagggagctgtgactgtataatttactttttccataaaacctaaaaagtgtaagcatgaaacatttttgtgtgtgtatctattccattggaagggctcagcaattgagcatcaggatctagcacatataatcatctgtttacatttcatttattttagaccccacaccaatactgtgaagtggataataatatctccatttatgcataaggaaattgaggtccagggaggcttttcaaggtaaaactcagtgtcagagctgggattgcaatccaggattaagtggctctcagtttcaattctctttgcattgaaccacacatcctccccaagtctctggcactagtgatgcacatcaggaggcaatgtaggggctcttcaggatataaagagggctcatgggtacaaacatacagtgaaaaggacatggccacacttcttgaaaaccaggttcatccaactctaacagaaagtgctatgattagccaaaaaatatattctagtcacacacacacaaaactaattaattagaaaaatctggtgattaactgcatgccttcattgttttcaataaatgtaacctgtccaataaatcagtaacatttattaatgataatacaaagtatattcagtaataggcttgccttccatgaggagactaatatggggttttatatggagtcccaaaagaaaccaaataaacattgttagcatttgcttcattgcacagattacatggtgccttgattctgctgctgacaagcagtaaattgctctgttgtgtgtggtgcttaaaacaggtttaatctgctattattaatagttccatgaagaatatgattgcctatccccatcccactttcaaccactgtggccaacatacgggaactcaggcaactaaaataattacagaccacaagctgtaacaataaaccacaaaaggactaatcatatcctttcttggaatttacttatttcaaatagtttgttactttttttttcatgaagagctccatattggaccacaattgtgatgagaagatctaacttggatttcagctgcagaaattatgctatttactttcttattacaggcactaaattgctgtttggattattattatttttttcctttctctagatagttcaacaaatagattttacggtctctttatgggacaaagcagagtatgatttcgaaaagtataaagactaaataactagataattgcctagagttgaagtggtgtattcaggaacttcactgggaggaactaaaaataatttaaaaataggagaaagtgtcattggcccatttatgcaaagccaatgcaaagaaaagctgaacacttgacttctgagaaattaaagacaaactgtggtgccaagttacagcaattcccttggcctaatttttggtaaatttaattttatcctttctcaatgttgtggaatctataatgtatattttattggtcatattatatgcatgtctcatgcaggtttccttcagaacttcttgaagatcaatagggaatatattaaaaatgaaaatagaaattaggttgaatattggcctacctacaatggttgaaaaatcactttagaaaaaagtggttttgcttatttccttgttgacctatttgaatgctttttatttaaaaaaaaaaaaaaaggtcctcagcatgaaggatttggtaggtgatgttttatctcactgtaaacatttctttttgctaatcaaggatctttgaatgacagaagggattttaaggaagacaacaagttagtcttctggagtaacattatctgctctagtgaactggtcctttggagttcggtggttttaaaggcatgctttcttttattatttggagattatattgtttaaagttttctgcatggtgaatagaggttgctaggggaacataaaactctacacagagacagaactatgactaggtccaggctctgtcaccaaatagcttgtgatgctgagtcagtctcacaaatgtgcagcctgttgtttcctcttccacaaaatgataatatttctcttcatgtggctttggcagtgatatgacctattacatgtgaaggcattttatgataacgtgcggtgcacattagacatcaaactttgttaacatattaataatatacctcatttggtgacattgttctttttcctttataatttttcaatgataattattaaaatctttgtcatcaacttagtgaaaccccgtctctactaaaaatacaaaaatcagctgggtgtggtggcacatgcctgtagtcccagctactcaggaggctgaggcaggagaatcacttaaacccgggaggcggagattgcagtgcgccgacattgtgccactgcactccagcctgggcaacagagtgagaccccatctcaataataataataataataatactttaaaaaaatctttacgggtcatatgtgccccctcccagttcaccaactttgccttctcactggatggttctcataacttaactctatttccacctacttttctaacacggtatttcataccatacaaattggtcctttacgcaaaataatttatatgttaatgacttggtcagatgggctcaatattaactttttcctcgaaggtgctagtttgttatcccacacacagtgcagttaatacactcataaatgtccttcaaaaatgtttctaagggccctgcagactgaattttagactccgtgctcatttttacttcagtaatttcattagtagtgtttattttataaatagtttgtaaagtgtttgaaggcagaaacatttttaaaatgtttatatatttttgttccaaagtattttgcagagaaacaaatccacagaagcacccctaaactgggagtgtggtgaagtggggaagagcccagcccagggctgcagatctcgggatccaagaatacatagcaggtagctcaagagggaatttagagtctaggcctgcatagaattcacctgaaaaggtggaacagagaccaggactgaaaccaggaccaaaacaaggaccaaacaaaccagatattccagagaagagtaagtggtttctattggtaagagttgggattagcagaaatttcctgaaacccagatgtagtcacagaagccctagagatcccatggccctgcctaagtgaaattagggagagggctcagtggggtgtcttgaatacatttacttgttcaggtgtcgaataatgcctattgagaagcaactatgtgccaggaaaagtacagggtactgggtatatgtgggtaagccagacagcagcaactctgccctcatttacctcccatctcagaaaacaataaacaaattcattaattattagagataatgataaatgctaagtaaggaacaaactggacacagcaggggtttcacctacatggagctgtgattaggggagatgatgtttaagatgacattggaagcatgagaaggaaccaaaaggtcctcagaccaggagaggccaaaagctcttctccatgagtgatttaaagtaaatgtacataaagagtagccagtggaggagatggttgttagcaccgtgatggaaaggtattgggaaatgctggaaaagcatggcataagggcaagaagggaaggtcacccaaaggcaaggttcttgtgggcttcccaaacctcctctgcttctctgcaggtgccagaatttggttatttctctgggaagaacttgtgtcatgaaattgaaagaagcccaagagagttgcgccatagagaatgaggagtgtttgtcagatatatagttgtcatttactgaatattgtggttctcatcttagtttactcccaagaaaatacctggaggctttcaggtgcttctctcttacgaggcctggtactaatgttttcattcaattctttgagcttccctagattcttttaggaacttcttttttttctcctgttagatcaagattctgttgcttaccatcaaagagcccaagctaatacagtcacctctctgtccttatcttgcttgtctgcttagcattcaatgcctgttttttgaaggactattgtctttgggtttatgtgataccacatcctcctggttttctttccatctctctggttgcttcttttcagtgtcctttgctatctcttccagctttactgatcctctaaatgctagagtccctcctgaccaggactaaatccttttgtctcttttaagtcattcttagtggtcaaaaaggtatgcacttaggtgctagggtaccttggttcaattcccagccttgccacttcctagctgtgacctcggagaggtcacttaacaattccttgcccatttcttttattattattattattttaaaaaaacctatttcgtagggctgctaagagaataaagagggttaatcatacctaaagtattttgggcagagctggttcattatatgcattcaatgcatgttatttttcttacaattgttagtaatcatcaattcccatggccttaaatgttacatatatgctggtgacccttaaatatgtattttcagccccaaacacccctcttagctctataaaattatgtatccaaccactagaatttatcaaactttagaagactaaattcaaattttgattactaattcttaacaccccccaatctcactcaacaatttccccccagttttctgcatcttagtaaatggtaagaatacctgcctagttgtttaagtcagaaaacttggaatcatctatattgttgctctttccctcctagccacattcaacctatttgtcaaattctgtcatttttatttataaaatatagattaaatactttcacttctttgtatctcaacaattaaaatttctaatccaatgtaccatcataacttggctagtttactgcaatatcttctttacccattctttatttttcctccatgaccaaatccattatttgccaaatagagttttgttttacaaacataaatttgtgtcattctcctacttaatcctttaatgattttgccctgtgcaatgagtcaaatccagtctgcaagactctgcttgacttgctgtatgtctacctggctggtctcatcttatatcaccttctccctcaatcatggtgatttggtcacatcaacctccatcagtttcttaaatccaataaaccctttcctgccttagggcttttgcgcttgctgtgtcttcaaccaggaataactttttccttgcttctttcattactggttttctcctgaggtctgccattaaaaaaccctcaacttcagaaaggcctgctacatcactcagatttctccagagaagagagatgattggatctatgtctatctatcatctatccatctgtggatttattttaaagaattggctaatgtgattatggggaatggcaagtccaaaatctgtagggcaggtgagcaggctggaaactcaggcaggatttcaacattatagtcaaggcagaatttctgcttctctgggaaacctcagtttttgctcttaaggccttcaactgattgagtgagccccactcacattatcaagggtaatctgatctacttaaagtcaactgattatagatgttaatcacatctacaaaatatcttcacagtaaaatatagattagtatttgaccaaacaactgggcaccctagtatagcttagttgacatataaaacttatcatcatactttccttaggtctcctgcatccacaggagtctctttcatagagttctctctttttttttttccattggatgtaccataatttacccttaagtaattctttgcttacttattaatttccccttcctccaccacactctaatgtctatcaggtgagaacgattcttttttgcatcaatatatatccaatactagcaaagtccttgggatatattaagcattcagtaagtagttggtgctcgatgcttaatatgtgtttgtgaaaacaattaacaaccacagggaacttgagatgaaaagttttgacccaatcttctaaaatttttatgggagttagaatatcagatgttaagcataatttactaaaatgtgaatagacaagaaaataactgattatttctcattttcttttgacacattctcctcccttgtattttcctgaaattaaattagtcaacacagatttaagaggacttagagtctcacacactcagcccaaatatagcattgaaaagacttccaaagctttggcaacatattttattttaataaagattcaaatgcctgcaggatcactggaataattgccagttacacttctattaatgaacacatttaaatggggattgtgaaaagcagaaaatgatctgattttatggagtacgtttactgccagcaatgtacagtgatgaatggtgccctagaatttaattttagttttagccacaaaacagccaaaattgcacagcagcctctttaacgaatatgtactgaacttgaaaaattatttattgagttctcagtgatatatatatatataaattatttattgagttgtcagtgctatatatatatatatatatatatatttttttttccttggagatggagtctcgctctgtcacccaggctggagtacagcagtgcaatcttgctcactgcaacctctgcctcccaggttcaagcaattctcatgcctcagcctcccgagtagctgggactacaggcatacatcactatgcccagcaaatttttttttttttgtatttttagtagagatggggttttgccatggtggccaggttggtcttgaacatgtgacctcaggtgatccacccatctcagcttctcaaagtgctggtaatacaggcatgagacaccacgcccggcctcagtgatatatttttgtgaaccaattagttacttcaaaaaataaagaagagtaatgctgttaaagttgatccacatagcagtcttattaccacccttgcatgggctctgtgctgtgaagactaggttctatgtgcaacaagttctattaacaagcctctttggatgaagctgcttttgaacttgatatgcattcagttctgatgtacagtgctaaaggaagtagaaaatctcaaagggttcataagacagagtcttagtactatttctaaatgctggttcttcaagtggtatttgagtttgaagtacatcagttcacactgctcccagactaaaacaaaaaaatgtcttagaaggattagctgaatctaaggaaactttttaggaatattaaccagaaaaattcaggagaagcaagttttgttgactttatcagaatgctgtttgttcccctaaatccaacttctccttttgcatttatatactgatatttagccagaaactacatttcccatcttcccctgtagctagatgatccctgtgactaagtttgagcccttaatgtgaataaaagtgatgtagagactcttcatgttatctttaaatccagactcacttgcccctggactatgactacctcactttccctcaggatctgaacatgacactgacccagtttataggatatagatggtagcaagggatagcaggacaatgtgttggaaggaacctgggtcgctgaatgacatcctgctagagcagagctgccacatcagcctggaccaaaccaactatgacttgaaagaaaatgggagctttcttataggattgttgcagatgaatcaatacagaaaatcttgaagtctttagaaagacttgtaatgaatttttatattatttagaggttacttttacataagttgtttttaaaaactacctacattttaatgttatgtctttaagacatcaaaaattatgctatctcttttgatttttgcaaaatcccagtgagggaatcattatgagaaagattatgttagcttctggaggaactcaagggacagaataaaagtaaccacaataaaggcactattttcagatttgtcctctgacaactctttgtagggctaagaacaaatctgtgttttctaactttttttagggaggtgactctcaaatctgtatgtgtgaatatatgtataatattaccattgcgataaaacttataaagtgatgtctaacaagtaagtcattagacatccagtgcttagcatgtacccaaattcaactatattccaatttgaataaagcatatatacatctatagagatatagatctatagatatagatatacatagttttcaaaaagcaaatatctacctatagacatctatctctatatatctatacacatagatataagaatatattagattcccctattttagattattcttcaaaaagcaagtagatatctatattgtataccatgtatatatctatattatatatatatatatagataggttatttttcaaaagcaaatttatatatatatatgtacataatgtgaatcaaagtttgagagggggaaaaagaaactttaagaaagaacttctagattatacaacacaattcagagtactggcatgataataatggtgctaatagtgataatgataatagcaataacaataatagcagctacattttgagtgttgtcatgagacagggtctgtgctttttgctttacattcattgtctttgcaaagcatctatgagatgttattcttcaattttgcaggtgacatatgaaacccagggagtatcttgcccaagggtaaccagaaccagaatctaattacattataaattttacctcaacatatatccatttttgcacagaaaagagttagcataacaggtgtgagatcactgtccttagaaaggcctgcttgcaaggctagccacttggatgttgggaaagtgtctaccattctttgaagcaaatggctcactgtgcttaaactgtgcaaacaatatggtttatgttgaacatctgctttgcttcttggagtctggaatttgggtacatactaagtactgaacgtctaatggcttccttgctagacaacattttataaatgctatcacaatgactcattgctgggagaattaagcacttcctgtgagacttcactcagaaagaactcttggaagcttgcctcaggtttcctccaaacattaccccatgtgccttttccctttgcagattttgctttgcattcttttgttgtaataaatcataaatgtgtgattgtatattgggtcttgtacatcccctagcaaatcttcaaaactagagacagtcttgggaacccctaacatatctatcttccatgtcattctctcatttggagaaaataaaattttattttctacctgagtacataggaagacgtatttctcagcctctcttgaaatcaagttggaccatatgactgagctctgatgggtggaatgtctgttagtccaaaataggcccatcaaatgccccacaccatccttctgctctcaactgaggaccagatgcagatgacccagtggaggaagctggcaccataggcaatagtggaaccacgagatggaaggagtgtcctcaataaatgagttgaacagaagtcccatcctgtccccaacggagtcacataggattaggaaatgaaagagaaacaaacatttttttgtcttaaaccactgagttactggagctgtgtgttacagcattgatccttctctgtctaatacatatggtgacgtgctggataccaacacccccatctccttccgctcaactttgaaatatgttgcaagagtgaaagggatttttaagccatagagatcccattactcatttgatagaataatatttgatgggcaaacacaggacacgaataatctaccagatggcgactcttgcaagggaatcaaaggaagttcttcattaccatttgagattgctcttaacatttttgagtagtacttgataaaacaaatagaaggtgttaaactactgggtgtagttcttttactaaaggagccatgctctttcactccccctattattagattatttttcaaaaaagcaaattaacagcacttcaattttactcagtagatgtggaaagaactaaaaagaagaaagtgagagaagataaaaattttattgggctggcctccaatctttttgtttggggtcattcatttgttcacatatatttattgattacctgtcatatactagacacagcctgaagggctgagaattttgtagtaaagaaggtgcagcacctgctgtcaggaagcttaaagaataggggaggagtccacaagcaaagaggaaacccaaaataagcactatgatgggagcacatagcagagtctccaaacctactttaggagatatcagagaaagcttttccacagacaagtctttcaaccccaaaactctcaagatagctgtgagtcctcctcagtttccctccccttttaatccaaaacatcacgacgtccactcagctcaacctccaccacatatccaagcccatcatttctctccttctctacttgctactaccctggtctatgccacatctcctttccgtcttaatctcttggaccagatttctagagggtccccaattttactctgatgtcttacactccattttgcttagagtagccctccagggccatcttaaaaaaaaaaaatcaatgctttgtttgtatctgaacttttaaaaactggtagttccccactatccttagaataaaatacaaatgacgttccaggttccagccactcttgctcactcttgcctcatgattttgggttgttctttatgcctagaaagtccttttttctaccttcccatggccgtgcccttcttgacattgcagatacaatgcaatgccacttccctttctctagccgccccatcgaaagaagctccctgctctagttctttgtaacaaatgtcatcctccttctactgccactagatattttcttatttaactatgtgtttgctttttgcccctcttttcactatcttcccccaatggaatacaaactctaaagaaaaattacctgtctttttttgtcagtgtatcctaaataccttttacagtgatgagcctgaactcagcactcagagaataagccatgaaaaaatatattgaaaggaagtctaagtatggatgtggagaaggtgtagctgttgtcctgatgaagaagggaattgtgggaagcagcatttctcgcaggagaaaaagtccaggtcaaggcccttcagaggggtgcacttcagctgcaggcagttccttctggctggagcagagtaaatagggatgagtgaggggtgagacgcgaaaagtcagcagaagatggttggtcaaggcctggctgatcgtgaactagttgggtcactgcagtatagacagcatctaacccaatatctgacttatagtagatgttcaagaaatatttgttggatgagcatgtaaggcaattgagtctctcttctaatggcaaaaaaaaaaaaaaaaaaaaaaaaaaaaagccagcaattggttttaagtaggaactgactggtttctatttgttctttagaaagaccttttcagctgcacagtggagaatggttcagaggaagacaggactgtaggcaaggagtctgggtcattgcagacatgcagatgagaggtgacagtgacagcagcgtgtgagaggcagggcagtggagagggaaaggcagaggcagatttgagagatacaaagactggagaattggctgagcttggagattaattagaaacaagaggttctgagggaagagcccagaaagacaactggatttacattttttttttttttttgagacacgatcttactgtcacccaggctggagtgcagaggcacaatcttggctcactgcaacctccacctcccaggctcaagggattcttgtgcctcagcctcccaagtagctgggatttcaggtggacaccaccatgcctggctaatttttgtatttttagtagatatggggtttcgccatgttggccaagctggtcttgaactccaggcctaaagtgatccagccgcctaggcttcccaaagtgctaggatttcaggaatgagccaccatgcccagcctggatttctaagtgactgcataaatgaaggtaacatttttgtcaaaataatctctccacacagatgtatgcacataaaatatacctatgagaataaaggagaaaactaacagtagttacctctagcaaggtgggatgagaagtttcctgtacctaggacacttcgatatttcaatttctaaacctctgtatgatttcaaatgtttagcatgacattttatgagtttaaaatttgaaagaaggccgggcatagtggctcatgcttgtaatcccagcactttgggaggtggaggcaggcggatcacctgaggtcaggatttctagaccagcctggccaacatggtgaaaccccgtctctaccaaaagtagaaaaattagctgggtgtggtagtgcacgcctgtaatcccagctactcaggaggctgaggcagaagagtcccttgaacccaggaggtggagttttcagtgagtggagatcgcgccactgcattccagcctgggtgacagagcgagactccgtctcaagaaaacaaaacaaaacaaaacaaaaaattgaaagaaacaaataaatcaagaagcatctaaatgccacagaatatattagattgatgcaaaagtaattgtgatttttgccattgaaagtaatggcataaaaacacaatttcgttcacaccaacataatgcataacataaactaatgcttaacatatttcaagatgacattactgagtcattatgaatttttaattacattatgaagtttagttacttttgtacatagaagaataaggaaagaactgaagggctctgatatcttttgacagcactcttaaagatattaagtaaaacatttctcatttattttcttatctacatggatattaatatcctaaatttttaaaggatagtttcatgtccagagaatctaagccattgttcaagctcagaaatggcagcggtaaggtttgaaccctggacagcgcttgcactatgtcagtctatggaagtcaaaagggaggtcgtgttaactgcataggcttataggcaatcttcccttcagaaagcccttctggttggaaatctgacagacagttctgctagggcaaaggaaatagcattttaactctgttcttaccttaattctaaagtacatgaataacactttgctcttaaggaaggccttttatctgagtctttcaaacactgaacaaaaccaattattacccaccctccttcatggttcaaagagaagattttaatccctaatttgctgacagagagacagaagccggcaggaatgaagtgatttactgagggtaacacagtctatgaaagcgttcaagaataaccctgagggcttgtgacaaaagagcaattgccttatgcaattagcagtgaattcctctgtcctaatcactgcatcttactgtttcccatgcaaagtttaagggaactaaacttctcctctttcctttcccaccataaatcggacgtagtgctttttatgtaaatgtactttgcaaaaatgtagatccctataattttaccttccatctgtttcatctgtttttaaagatcttactgcagaatttcccaaacactttgaatggggtggaaaagccccatacaagaactcagatgtcctgctggttcctttggctacaacatcaaaactcttgcagaaatgaaacaaaaaaaaagtatgcttctgttcttcatgaaattgcccaaggagggtgtctggataataagccaaacatggagggtggggattaactgcatttgagatgtgactgcagagcacattaagctgctttgctctacaggtgttgctgcttcctcacaagctccactgtgatggatacaacctatgtgacccccagtgagtcacacctttttaaatctcctcatcttgagtgctgagatgtgcagtgtaaggtcccctgagcaggctgcaccatggtcaagccatcatgacccctgtgacccacatgtacacatccagaagtctcaaattctgggagccagaaagtctgggacaacaggaaaaccactaaagaagaaaaatggctagtacctgtcttagctgattaggtaaccctgcgacattctaccattctagcatgctctaccctaactgatcaatcaacctagtgacactgtgctctatgacccctcccaccttgtgataatgcaccttgcaaccttcttcccctgcccacaataaatggcccctaactgtaactttccactgcttaccctaatctatgaaattagctccaatcccaccaccctctgctgactccctttttggactcagcccgctcacatccaggtgaatagacagtcttgttgctcacacttagcctgttcaggttgtctcttcaattagatgcgcacataacacagaggtgatgggatgagatgccacacccatgactgtactacccattagaggactagagagaccctccgttgttggctttgaagaatccagctgccatattacaagggagcttgcaagaggaccaggtggaaacggactgcaagtagcctctaggggctgcgtggccctacattgacagccagcaagaggggaatttcatatgtgcaaccacaaagaattgaattctgccaacaaccacaggagcttagaaaaggatccacgatccagaaagaaatgcagcccaatcatgattctaactgtggcctcatgaaactccaaccagagcacttagctatgtcatttctgaactcctgatccttgggacagtatattatgaatgaatgttttctaaatccatttagtatttggcaaattgttacacggcaacagaaaatgaatgtaaacatctttctattttagataaaaaaagatagtaacataacatttaatgtcaaaaggacattagcaggtattaaagtgatgccttaatgatatatttgattttaatggataattttacctattataatccagagcaaagaaagaaaaggaagcaggggaagattccatagaagaaggaaccagctgtctgaagcatagaggtctaactatttgcaactcatcctgtgccttaaaaatgggaagactaggttatatattattaattaatgacagaaaaagccaaagcagcattggcatcactatattaaaacttagtgccccactatatcatttacaaccacctaaaattgaactgaagctataactggtttcgaaagagtgcagcaaagcaagattatgaaacatatatattgatatttgtgtgaccttttgaccattggttctcaaatgaggctttctgttcactgtctgttataatgtaaaatatttttaatagattaaggacttcagattaaaaaaaagaagaattcctaaacatcatcccagttaactgaataaaaatcctcaaaaataagacctcttacctctctccaacccctacacacacatacgcgcacacacaacacacacacaccaaagacttcatgcgattccaatgtagctagcctagtcattggtatttgtcatgatagagctcatcactaataggtcatttctttttgtgctagaagcaccttgtatatgttatatatctagttcaatggttctcaatcttgcctacacaatataattacttgaagagctttataaatcctaatgctgaagctttttcccagagcaattacatcagaatcaccaagcatagtagccactatttttaatttgtaaagctccccagatggttgcaacgtgcatttaattttgagactgctgatctgtagataatagtttgcattttctgcatccttcctaatatataattatgtagtccaaaacccaaacactgcctgggaagtatgtaggccaaccacgactgtcccactttgatggaacatacaactgaggttgaccatttggggccatactataataactcctttttattgaacttcatgtttattatatttatttctttaaaaaagtgcaatctagttatcattatcccagtttatagacaaagacacatcgtctcctgagtcagagggaactgcccaaatgagtaacatgacctgaggctgagtgacaccgaagcttatgataactgcacaaaaccagtgattctcaaagtgtgggctccagaccagcagcatcagcatcaccttggaacttgtaaaaaagaaaatgcaaattctatgacccaatcccacctctactaagtcataatctttcaagatggggcccaggaatctgtgtcttgacaagcccttcaggtgattctgaggctccttataggtggacagtgtactgtattctgtctctatcagctgctcacttttgagactcagaatctggcaagagacctaaaaatgtgtgggagcctcagtgagtaagcctgtgtgagggaggagatatttctctcactatcttcccttcctctcatttccaatctatattaacaatctatgttgaaaatgctaggggatgtatcagagataccatatgggaaaaaattggtggagttatgctggtcatatttacttgcaggggtgcctggctatgttgagctactttcacacaagtgtgaccattttaatatgttgacgaatggtttatcctttgaatcacagtatggagagttttaatagtttcattaaaaatgaatatcccaactgtttccagggaaatgagtttgtgatcttaagggctttgaggtaattggtgtttagggaaccaaggcagttggtttgctttcttggatggaagctgcttcagcttactaccatgctgtaaaacccaagtgctgctgacctgcttagtgtatttcggctatgcttagggttcatttattagaattgtacatttgactagggggaaataaaaattaaaaggccacttgtgtttgatttatgagagatgtcgattaatattttctgagcaaactgtgaagtcctttcttttaaagaagtatataaaataggcctttggcatattcaggtctgatggaaatttgtctcatggggcagggtgagatgggagaaagagaaatcaataaagatagagaagagaaaaaaatagaggaagaggaggatggggaagagctgaaaggagacaataattcacaaggggaagagacagaagaggtgaaaaaaaggaaagcaaggaggagtgaagaaataagaggtggggtcagaaggattaaaaaaggggaaagaaaagagtttgggaaaatgggggaaggagagaaaaggaagaagagaaggacatatgggcaacaaaaaaaaacataaaataaaaaaaaataaagcaatgaatgcagactttggagcctagcaatttattgtgaagtgccacttgtattagacatgctgcagagatgctggctccaaagattaatgatggcagtaatcatgattccaatttatagcaaatgcaatgaaaggcagccagaccccaaacagagaaaccctacggggatggcattggaataataacatagcagcagtcgaggaatacagggatgctgagagattggattcagttctcctgtgttcaacaaacattctgtatctgatgtacaatccaatgttaaaaagaaaaaaaaagtctgcttattactagatctctgaattatagcaaagaagtttaggtgttcacatgaacacatttgaagttttattctgtgattcacctcctctgagcactgacttttggcccagattggtcttttacacctcctttcctttctgtccttgctgctcagtgtttttctgctgccagtggtcaataccactgtttcattgcaaatacctgctgtctctgaagcctggaaccactgcagaataggcataactactcatcctctttcctggttgtcaaaacccttttccctttatgcatgtttatttgtatgtattgtcttgatatattacctatcagattcctttaatcagtggtctgtgtgtgtggtgagcactcatctccattataatctcctctgcccccacctattgccacgaagtcctaggtctttgcagatgatcaaattttggagaagaaacaaatttactctgcataatagagggagaaaaacttagaaagcccagggcaaggagaaggggctgaggagcagaaatgggagaaagacagactccattcattcagacagatggtggaaacttgtgtgcaatgcgcatgcagaaaccctataaaaatattctgcagtgtcaactaccggtatgaattctctgagtaaattgctgttgtggattccaaagaagaggtagagattcatatctagtctgcataaggttggacaaaggcagcagttgtggtggtcagatgtgaagaggatggcattagaagaaatccttggacatcacagacttctacacgcactggaactggggttcttaggggctgggtttcaaaaggatcaaagcaatttaatttggatctccaggggtgcctgtagctactttggtttccatatgtataagaacaaactatatgttgggatgtgtatgctatttgatacataaacatttgatgcctttaaggatgaactgttttcagatagattcatgacagcaagttttctctccctattcagaccataagctccttaaggatagaagtgtatcttctctggcttttgaataacctgcagcatctagtttaacccttagcacatacaaagtatttggtaagagactgtgtctcatagtcagcctggatccactcactttctctcaccccaccctctggggttttctgggctctcattcccttttgaagatggttcacccaggagggagggtcatctgcacacctggattgcagagaaccaggtacagtgatgacctacagacacctgtggtttacagacattggcagcatggttttttaaactataaaagttacagtaattatcctccaattccaggaatggaatcccttgataggcctcaatctacattcaagattcaagtcaagcaccagcctgtatttaaaaactaaggaaacaatggaagtttaatgaaattatgtcattatagttgatgaagagaaaatatttcaaccaagaactgaattgaataaaactttctcagaaactctttgtttaatgggcaatcacagtatgccagcatgggtgtgccacagagaatcaaagtccacagatactgattatattcctatctgggaaggatcagtatgaaatatacatatgatggggctctcatagaatgggatattttcccccttttcctctcatttctcaatgctcctctgggaattgtgtgaaggtaaagtcaaaaagaaagttcttacattcttaaatcctctgtaaaggatctgaagctctttcttggtaaatttgctctgggcttccagaagctcaagggcttcaggccgatgcctgacggtggccatctccagttcatcttccacgctgtctgtggaggaaaacaagaaagagtcttaggaccagccactgctcaccgatgcttacacagagcaacaaaggaaaacggaagaacatgtctgctaatgtctgtgactgtccacagaggaaggaccctcacaatgcctataaggcctttacatttcccagtttaagcgtattaagctaaaacacttgtatatgatttttttgcatattcttgtcattaatgtagatattacaaccctagcattgttttaagacaacaaaaaagagcacaggaatttatttcagataatcagtggattatatgattacgtcaaacaaaaagtttaagtagcaatatatattactctataaatctaacagtaacatatatttcttttttccccaacgtttaagttcagaggtacatgtgcaggatgtgcaggtttgttacatgggtaaacatgtgccatggtggtttgctgcacagatcatcccatcgcccaggtatgaagcccagcatccattagctgttcttcctgatcctctccctcccccaacaggtgcccagcatgtgttgttccctggcagtgtccatgtgttctcatcaatcagctcccacttacaagtgagaacatgcagtgtttggttttctgttcctgcattagtttgctgtagagaatggcttccaactccatctatgtgcctgcaaataaaatgatctctgtcctttttatggctgcatagtattccatggtgtatatgtaccacattttctttatccagtctatcattggtgggcggttaggttgattctgtgactttcctattgtgaatagtgctgcaatgaacatatgcaggcatgtatctttataatagaatgaattatattcctttgggtatatacccggtaatgagattgctgggtcaaatggtatttctgcctctaggtctttgaggaatcaccacactaccttccacaatggttgaactaattcacactcccaccaacagtgtaaaagtttccctttttctctacaacctcaccagcatctctagcatttttaaggtatagttagaaaaacatagaagatcacaaatagtccaacctggaatttgtttctatataacaaccactagttataaacaatggaattgtcatttaataataatcagttttgtgccctatgtaaaatgcaactacaagatagcctctgataatgttcactaaggattccaatgaaatcagatattttgcacagctacttgggaggcggaggtgggaggactgcttgagcccaggaggctgaggctgcagtgagcagtgatggcaccactgcagtccagtttgggtgacagcatgagaccctgtctcaaacaaacaatcaaacaaacaaaaaaaatagaaccttagactctcagaatggaaggacatctgaagaaagatataaggagatagagaaagaaggaaacctccctaattcattctatgaagcatcaccctaataacaaaaccagcaaatgacataaccaaaagagaacactacagactgatatccttgatgaacatagatgttaaaatccttaacaaaatactcactagctgaatccaacaacatatcaaaaagataatccaccatgatcaagtgggtttcaaaccaggaatgcagggatggtttaacatacgcaagtcaataaatgtgatataccacataaacagaattaaaaacaaaaatcacacgatcatctcagtagatgctgaaaaccattcaacaaaatccaacattcctttatgattaaaactctcagcaaaattggcatacaaggcacataccttaatgtaataaaagccatctatgacacacccacagccaacataatattgagtggggaaaagttgaaagcattccctctgagaatggaaacaagataaggatgcccactctcaccactcctcttcaacatagtattagaaatcctagccagagcaatcagacaagagaaagaaaacaagggcatccaaattggtaaagaggaagtcaaactgtcattgtttgttgatgacatgattgtttaccttgaaaaccctaaggacttctccagaaagctcctagaactgataaaagaattcagtgaagtttctggacagaaaattaatgtacaaaaatcagtagctcttctatacactaacagtgaccaaacagagaatcaaatcaagaactcaacccctttacaatagctgcaaaaatataaaatacttaggaatatacctaacaaaggagtcaaaagacctctacaaggaaaactacaaaacactgttgaaagaaaccataagtgacacaaacaaatggaaacacatcccatgctgggtagaatcatggatgggtagaatcaatattgtgaaaatgaccatactgccaaaagcaatctacaaattcaacataatccccacagaataccatgattattcttcacagaattagagaaaacaattctaaaattcatgtggaaccaaaaaagagcccgcatggcctcatagaaaaagcaagactaagcaaaaagaacaaatctggaggcatcatactacctgatttcaaattatactataaagccatagtcaccaaaacagcgtggtactggtatgaaaattggcacatagaccagtggaacagaatagataatttggaaataaacccaaatacttacagccaactgatctttgacaaagcaaacaaaaacacagagtgggggaaaggacacccttttcaacaaatggtgctgggataattggctagcctcatgtaggagaatgaaactgggtcctcttctctcaccttatacaaaaatcaactcaagatggattaaggacttaaatctaagaccagatactgtaaaaattctagaagataacattggaaaaacccttttagacactggcttaggcaaggatctcatgaccaagaacccaaaagcaaaagcaaaagcaataaaaacaaagataaatagctgggacctcattaaactaaagagcttttgcatggcaaaaggaacagtcagcagagtaaacagacaacccacagagtgggagaaaatcttcataatctatacatctgacaaaggattaatatccagaaagtacaacgaactcaaatgagtaagaaaaaaaccaacaatcccatcaaaaagtaagctaaagacatgaatggacaattctcaaaagaagatatacaaatggctaacacacatgaaaaaatgctcaacatcactaatgatcagggaaatgcaaatcaaaaccacaatgcaatactgccttactcctccaacaatggccataatcaaaaaatcaaaaaacagatgttggtgtggatgcggtgaacagggaacacttctacattccttgtgggaatgtcaactagtacagccattatggaaaacaatgtggagattccttaaagaactaaaagtagaactaccatttgatctagcaatcctgctactgagcatccgcccaaaggaaaagaagtcattattcaaaaaagatacttgcacatgcacgtttacagcggcacaattcacaattgcaaaatcgtggaaccaacccaaatgcccatcaatcaatgagtggataaagagactgtgatatatttatataatggaatactactcagccacaaaaaggaaagaattaatggcatttggagtgacctgaatgagattggagactattattctaagtgatgtaactcaagaatggaaaaccaaacctcgtgtgttctcactgatttgtgtgagctaagctatgagaacgcaaaggcataagaatgatacaatggactctggggacttgcggggaagagtgggagacaggagagggataaaagactacaaatattgtgcagtgtatacgtgggtgatgggtacatcaaaatctcacaaatcaccactgaagaacttactcatgtaaccaaataccacctgtaccccaataatttatgaggaaaaaaagaattgaaggacatctgttcattttacaagtaaagtgaaaaaagaaatcagatattttgccttgggctacaaaataaaatgttcatattaggtgctgacaagggtaaagtaaccagcagccagttggtttcatgggtacatactggatggttgggggcctagaggatattctatttaggtccattttgtagtcaatagagtcaataggtatagagaagctttaaaatattgtactttgctttgtgaattatgtttacgctataatttctcaaagatgttttatgcaaaaaggaattttgtgcccatagatgtttggaaaatgctgtgaactttaatgtagttttgtcacaaaatattaaattatataggtttgcgaagacctgtaacaaggagtcttgtttaactttgcgtaacccaactgaccccaaaggtatttgtccatagaacctttcctggcccaagtaacatctggtaatatctgcacatttgccctagggtcatgtaagcacaagtctggaggatttggaaatatattagggttcaggtgcttgtgtctcaaatatcatccttcagtccagctcctttgaagtggggtcagatagtggcctataggaattctctctgttgtgtaaaccaatccacacctcagatgaggaacttagcaggaataaaaacatccaggctcagtatgaagccttggcttcccctttctatcctttcttcttgactacagattggagactcagagagaagggtctaaggataacagtcagctcctctcatcccagagccactaggaccccaatcccttgtcccatgggtcagttggaaatgtagtcctttttgccaaagtcgagccatttttgacactaatattgctgcctcttgctaacatctgttcctccttactactctgcctcactgagagcattgaggggccaaagctctcacttggcaaggaagagaaggtgagtggcaccctaatcttagcatatcttaattattgccctcaaggagtttacaaaaaaaaaattggtgatgaaacaaacacttggagtggctatatttgtgaaaatgagtaataggagatgaaaacaaacatttgctttgtactttttatattataataacttatctggaaagaatgaaatggaaaagcttcagaatagtgacggatgaataaaaataatagaaaaggacatggaaagatgagaaggctgacaaggataaaattgatgggataaaattgagctgacaaggataaaattgatgggaaagtaagtagttgtgctcctaaagtatgtgggaagagctcaaagtagctggaaaaaggcacctaggcattaacaaattgatctgggctttatggggaaaatcaaaaaagccaaaatccttcaattttctccttcattcatttgaacaaatgggttgattctattcaatgggtcctgagatagaaaagatgatggaaaatgttgcttttagactgctgttgatccaatgacttcaactatgttgtattattgtatttgccaatgcaggagtaaatagcatgcaatagacctcatgtaaatagataatatcgaatagaaagcctgtgctttcttgaacaatgtctgatgtaatcttcttttgaatcatttatagtgcaagttcttcaacctaaaatgttccactttccttttccacctgttaaaatgtatatatctttcatgatccaatttaaatataagtgtctcatttctgaagcctctctggattcccatactatgcaaaattggtgaccccctggtcatcgttcccacactctggttcttgtatagcatgtaaaacataacatcatgatctgctcatgtttgttttctccattgtgagttttttttgcagacaagatcaatatcttacatgtcttgtttatcctctgaacctaacaggaagtctgatactcctttgtcacttaagaataatctggtaaacaaaggatattcctgctcaactttctgatcctctccaatcccttgaatatttgctgccctatagggaaatatttttcagactgaaatttgtgggctgttggtggacctcaaatgtcttcttcagaatcactatgttctctatttattgtactgggaaatacagcaaaagtagaggggattttaattaaattttctgagcagtctttcagtcataacataaccttgtctagacctagtgaccctcacatgggacagaaccaaaacagcggattaaattctgggcctttgtatcgggcagcaatctgagctgtgctacaaatggagtttctttctctgcagatgcaaagtctgagacaaaagacacagggctggaggatcagtataattaagtgtgcgtgataggatgatcatcacatgcagtattaaaaaaaaaaaaaaaacgcccttgaagtgtctgcctgtgggctctcttgcttttccagctgtctggtaccttacttcttaatgactcctacctgccaaagggctgtttctatttctaggcgggtgacaggctctaaaaacataactgaaatcatcagcaatcaccagcatatgataagttaaaaaagcaacaccaccgaacccaatcaactctgattcttggaggcaaactatggggagcacggcatgatcccacgtaggactgcgaattctcattgtgactcagccaccttgtaagagcctgtattttgggtggttttaacccagtgcctaacatttattgagcccttgttgtatgccaggagatgggcaaggtgcttgattggcataatcctaatcctcacaataaccccagagtgaggtttaattgtttatttttcacatacatggagactgagtctcatggatgtgaagaaattcacaaccagaagtcaaatatgtgtttatatatacataaaaacataacatatatatctcctatgcatatatatgggtttccatatatatgcatagggacaagatttacacccaggtctttgatgccacagcttatgttcttcccacttcccactttgccacagtctcttttaataccagcagaaataatgatacaaataatgataacctctcctctcttattttgtcaaactcctcagaaaagttaactgtattcattagatccattttcttgctctctccttaatctactgcagtctgacttctggtcctatggtggactgaattgtgtccctcctcaaattcatatgttgaaggtctaaccctgtatttggaggtagggcctttaagaagatagttaagcataggccgggcgtggtggctcacacctgtaatcccagcactttgagaggccgacgtgggtggatcacctgaggtcagaattcgagaccagcctggccaacatggcaaaaccccccatctctactaaaaatacaaaaaattaggcgggtgttgtggtgggtgcctgtaatcccagctactcgggaggctgaggcagaagaattgcttgaacccaggaggcagaggttgcagtgagccgagatctcgctactgcactccagcttgggcaatgagagtgaaactccatctcaaaaaaaaaaaaaaaaaaaaaaaaaaaaaaagaggaagacacgaggaatgtgggcttacagaagaaaggccatgtgaagatggagtgggaagatggctcacagctggtaccttgaccttgaacttccagcctttagaattgtgagagaataaattcctgttgcttaagccacccagtctgtggcattgtgttatggcagccctagcaaactaatatatctacctatattcaaatgacacacaacactgataaaagcaggtcttgttatccacaaagtttgcacaatgagtgctgggcagtttgctagccaattatgtcatttaatcttcacaacatctttcaagagaaggattatcatccctattttataaatgagaaaattgaggcttggagagtctaagtaacttggccataacccaagcaactcttggccaaatggctacttagtaaacaagatgaagacaagtgtctccagcagcccaaagtccaggttactgagcactatgctgggaatgttaatagcaaccatcaccctatggagaacttttgctctaagcgtggttgtatattatcccattttaatacagacagaagttcagtgagatagctacattttacaagaagtcatgtagccctcattttacaaggagtaaattgggactcacatttcttaaataacttactcaaggtcatacagcttacaagtgacagggctgggatttaatccctggctttttaacaccaaagaccatgagcttagtcaatatgctactttaagagatggcaacaattaaattactttgttcaaaatcctaggggataaaagattttaaatcacaaactagctggctgctgagcctccaatgcctcaatttctttccagggaaaatatgccggggcaccttcaggagatcaccagaccagcagacaaagctgtgctgataagaaacacatggtagaataaggtacgaagtgatgggatctcagagctggaaggaacacaggaaactgtttgtttttctgcattttacccctgagaaatttagatttgggaaagatgaatgtttgtttgagacaaaaaccagaaccagatgggactctggcctctggagttatctccaggccatgcagacatatcatcactcaggtatcttgcagaagagccaattcaaatgcgcatttgcatcctgagataagcgaaatacaaatagtattttaattcatgtatcttctaacaaatttaattttaatcagacaacaaattcccaaacccagacaccattgagcttcctggctgtgtctttttgtcctttgttctttagatttcagtctctcagggctgagtttgtcctaagtctgactcaacagtcccctcaggccatgacacaattgggctagaaattggaattcaaatcatctaggaacaacagaatgcgttttaaaaatagtcatcgttctcctctttctcacaacttctcttaaaatacagtagaagcttggtacagctcaactcgtaattatgcaaatttgactctaagggcaaatcatgccatccagaacactactacggaacatcttgccttacgaacaaatatgagcgtgagtcctaccttttgacgacatgctttggaaacaagtcttctaatgcagaaaacaaataatattatgaagaataatgtcactttttgagaaagctgattcagaactcaggccatgtgtgcagagatgagtccttgcctataaagcatgaaacactgtgaggctgttgccttgttcttttatttaggtcctgccaaaatacgggaaggattatcttatttggcacactgaaggtgctccataagagaatgtgaaataaataactacttgaagcattccaagaatagtgagtgtatctacagcaggtcccatttcttttttttttcttctctttttttctttttttgagatggagtctcgctcttgttgcccaggttggagtgcagtggtgcaatcttgactcactgcaagctccgcctcccaggttaaagcgattctcctggctcagccttccaagtagctggaattacaggaacgccccaccacacctggctaatttttgtatttagtagagagggggtttcactgtgttgattaggctggtctcaaactcttaacctcaggtgatccatggacctcggcctcccgaagtgctgggattataagcgtgagtcaccgcacccagtcccatttctaaatacaacatgactcttctttaaaaataaatgtatccatttgtcattctaaaaagattataaatattgtaactttaaaattctatttgagctgaaattaatttgtctagacaaaaattcagcctgcttgacttatattgctttatctcattgataaaaataccctctgagccattactcctaatgtttacattttattaaattggccgaatagtgagttgatccatatggcaataacataatgaggatgatcactttctaatgatatcttatgtattattaaatatttagaagcttggtccagtggtggatattggaggaagatttccaatgctgaaagattcttgaccatagcattagatgctattcctgagaacttctaggataaggaggtgatgctattgtttgtttaatgttcaagtctgatacatcaggacaaagaaaaagctgcctggaggaagatttccaaagcgaattttcatggcactgatataatttatttccacccttcttttctactgcaaaaacttgtagagggatgacaacatactcaccattccattcctcggttccactgctcacaaagctcaaagagggtggcatgataatcagctgaggaaatagtttcttgggtggaggaatttgctgaagtctgcacagctgtgcagctgatgagtgtgggcacggggagccaggacctgccccaaacctgtctttccccttcctgttatatcatttgacctccctggatagagagtttaaactggggccaggccctgtaagcaactctttaaactttgacaattttaaatgctttattgcaagaatgcagaggtctgggaactcctttgacttttcctgtctttattactattcacccatccacctaccaagagttattttcaggtgcacatggagagtatagaagcaattaattccaagctgatcacacacaggctgcaagtagagagcagtcaatccatttgaaacactgtgggagtcctaggccttcccagaccaacccgagcaattggaatcctgatgttttagttagtttgacacgtatttctgcaaccctggccctgaatgtatgttagaaccaaaatacaaaaacaaacaccaaaaaatgaacaaaaccatttataattagtactttatcttacttaatatttgtatatcatattgaaaatgaacagttcttggaaaatggccatttagtttgaacatcttctgttacaggtacttgttggcaatgacattgcaatttccattctaggagaatgagaattgctttgcaatttcataattgaattcaatcacttatgaaatataacaacccagtggtgaacagctgaagctatttgccacagcacttatgaaatagattgtctctaccttatttacaaacataaataactcttcaacaagcttagattttaaaaaataatcacctaattggaatgcttattatcagcattaaccatattattactacagcatcatgaatggccccttatggtaggagttattattattattattattattattattattattattgagatggagtcttactctgtcacccaggctggagtgcaatagtgtggtctcagctcattgcaacctccacctcctgggttcaagcaattcttctgcctcagcctcccaagtagctgggactacaggcatgtgccaccacacctggctaatttttgtatgtttagtagagacggggtttcgctatgttggccaggctggtctcaaactcctgacctcatgatccacctgcctctgcctcccaaagtgctgggataacagacatcagccactgcacctggatgagttattattttttaggtggtagggtcttaattgatttttggtaaataagaaaaacaaaaattatactgccagtcattatgctcagacagaaaatctacaataggaatgctgagggggcagaggaaggaaacaagaaatttaattgaacttacacataaagacagaccaaaagagattgatatactagtcaggaaaggcaaaagctgagagggattatgagcaaagagaaaaattttaaaaagcaatggtatgtggagagagatgaagaaagcccagattagttcactaaattaaaaatgccctatcaaaggagtgcctcaaactttgatagattttctcttagttgtcctaaaaatcaataacaagacacacatatgtgtatgttcattacaacactattcacaatagcaaaggcatggaatcaacctaaatgcccatcagtggtagactggataaagaaaacatggtacatatacaccacggaatactatgcagccataaaaaagaacaagattatatcatttgcagaaacatggatggagctggaggccattatccttggcaaattaatccaggaacagacaaccaaataccgcacgttcttgcttataattgggagctaaaatataagaacacatggatacatagaagggaacaacagacactggggcctagtggaatgtggagggtgggaggaggaagaggattaggaaaaataactaatcagtactaggcttaatgtgactgtgcagtgggttcaccttacccactgcctagacagagccaatttatcaagacaggggaattgcaatggagaaaaaataattcatgcaaagccagctttgtgggagacccgagttttattgttactcaaatcagtctccctgagcatttagaggtaggagtttttaaggataatttggtgagtaggggctcaggaggtggggagtgctgattcgtcagtttggagatggaaccatagggggctcatagtgcggttttcttgttgtcttctgttcctgagtgggatctcagaaatggttgactcagattatcggtctaggtggtatcaactgattcatcaagtgcagggtctgcaaaatatctcaagccctgatcttaggtttacaatagtgatgtgatccccaggagcaatttggggaagttcagactcttgcagccagaggctgcctgacccctaaactataatttccaatcttgtggctaatttgttagtcctgtaaaggcagactggtccccaggcaagaagggagtcttttctagaaagggctattatcaatttgtttcagagtcaaaccatacactaaattctttcccaaggttagttcagcctacgcccaggaatgaacaaggacagcttaaaggctagaagcaagatggagatctctttcactgtcatgatttcctcagtgaaacttttgcaaaggaggtttcattaatacctgggtattttcgaccagacaaaataatctgtacaacaaacctctgtgacacgagtttacctaataacaaacctgcacatgcacccctgaacttagaagttaaaacgaaggaagaaaaagagcaaagaacaatcactaatatttatagcatttgttttgtgtaagctctctctttcatgagtgtatatgtatatatatacacacacacatacatatacatatatacatatgtataactagatatacgtacatgtaaatgtgtgtatgtatacatacatatgtatgtatacgcatgtatgtatacacatgtatgtatacgtatgtatgtatgtatatgcatgtatacgtatgtatgtatacatatccatgtatacacatgtatgtatacatatccatgtatgcatacacatgtatgtatacacatgtatgtatgcgtacatatgtatgtacacacatgcatgtatatatgcatatatatgtacacatatgtatgtatatatgcacacatatgtatgtacacatatgtatgcatatatgtacacatatgtatgcatatatacatacgtttatatgcatatgtatgtaaacatgtatgtataacatgtatatatgtatgttatacattttatatatacatgttatatatatataacatatatatacatacactcataaaatccccatcagcgtactataaatgctatattcttgttctgtagatgaagataccaacacagagagactaagtaacttgctcatggtcacaccataacagagtcagggaatggagtctgggaagtctggttccaggattcatgtaataactattcagctgttctgcctcccccagagcaggagagaggatgatgccccacttatctagaattcatgcacccaaataagaatcagaaaattagtagcaaaagggctctaagcagaaaatggaactctgtgagaattgaaaggggtattgagtccagccccttaactttgtaagttcatgtcacatacagagccttagctacagtggttgtaaatcaaaaaccattaggcatatcagtggcagaactgggcctaaatcttgatctttttcattcctactgcagcactttgtcagatgcctgcctcagtatcttttatggataagagtgtcttcatccttactgtacccacagttttagtaagcttccgattccacatcagaagcagatactgataatggagaaggagcatacactggaaggagtccatgagccacagttataatacctaattttcaccactggctcttcattatcatatctgagcaatgtgatattctgtgtataaatattgtcaccctgcttttatagataaagaaatcagggttggaagaaaggatgtaactgatgaaggacatagaaataggacgttatggagtcaggacttaaacccaagcttactgactctgaagactagaagtgactgcaggttgtctgagagtaatggagggaacataaagttgaaaaacatcataggcatattagagaaaagagtaatgacaaaagtcagtggctaacttattctttaagaataagttctaaccttattctttaagaaaatgttttattctgcttactttattttagaaggtaacagaaatgtgatacatttttaaatattattaattaaaattggcagcttattcatagtagccaaaatatggaaacaacttatgtccatcaataaacaaatggataaagaaactgatatatacaatggaatactattcaacattaaaaaagaagatcctactatttgtcacaacatgaatgaacctggaggaccttatgttaagtgaaataagcaaaacgcagagaaagaaaaatattgcatgatgtcatttacataaagaacctaaaaaaatgttgaatacacagagatagagaataaaacaatggttaaagtggggaggaactagggagatgtaggtcaaggtatagaaagtaacatataggatgaacaagtctagagatctaaattacaacatgaaaattatagttaatattgtatttgtgatctttgctaaaagaatagattttagatgctcttgctacatataaaaatgggtaactatctgagataatgaacatgttaatttgcttgactacagtaagtgtttcaccatctatatgtacatcaaaacgtcatgttgtacaccataaacatataaataacattttaaaacgtttatacaccttctgaaattgagtcagtaataaagaacctgccaactaaaaaaagctctggaccagatggactcatagctgaattctaccagacatactaagaagaactgataccattcctactaaaactattccaaaatatcaaggaggaggagcccctccctaactcattctatgaagccagcatcaccctgataccaaactctggcaaggactcaaccaaaaatgaaaatttcagacaaatatccctcatgaatacagacaaaaaaatcctcaagaaaagactagcatattgaatccagcagcacatcaaaaagttaatacgccacaattaagtaggcttcgttcctgggatgaaaggttggttcaacatatgcaaatcaataaatgtgattcactacgtaaacagaatcaaaagctggaacattatgatcatctctatagacacagaaaaagctttcagtaacaccctatatccttttatgataaaaacccttaccagactaggcatctaaataacatagctcaaaataataagagacatctatgacaaacccacagccaacatcatactaaatgggcaaaagctccaaccattcttcttgagaattggaacatgacaaagatgctcactctcaccactcctattcaacatggtattggaagtcctagccagaacattcaggtgagagaaagaaataaaaggcatttaaataggaaaggaagaagtcaaactatctctcttcactgatgatatgactctatacctagaaaatcctaaagatcctttcaaagggtgactagaattgataaacaactttagtaaagtttcaggatacaaaatcaatgcacaaaactcagtagcatttctacacaccaacaacgtccaggctgaaagtgaaatcgagaacacagtctcaattacaatattcacaaagaaaataaaatacttagggatatagctcacccaggaggtgaaagatctccacaaggagaacgacaaaatactgttgaaagaaatcaaagtgacacaaataaatggaaaagcatttcattcttgtagactgaaagaatcagtgttataaaaatggccatactgcccaatgcaatttatagattaaatactattctagtcaaactactaagaacattcttcacagaattagaaaaaaagtattctaaaattcatatggaaccaaataagagccagaatagccaaagcaatcctataagcaaaagaaaaaataaaacagaaactaagcccaagacatcacactacctgattttaaactctactataaagccacagtaactaaaagagcttggtactgctatacacacagacacctagaccaatgaaacagaatagaaaacccagaaataaagtcacacgcctaccaccgtctgatctttgacaaggctgacaaaaacaagcaatgaggaaaggactccctattcaataaatggagctgggataactggctaactatacacagaagattgaagctggacccccacctttcaacatatactaaagttaactcgaaatggattaaagatttcaatgtaaatctcaaactataaaaatcctggaagacaacctagggtatacttttctcaacatcaactgtggcaaataatttttggctaagttcccaaaaacaattgtaacaaaacaaaaatagacaagtgggacctaattaaactcaagagctcctgcacagtaaaagaaattatcctacacttgatcttcgtggatgaagctggaggccatcattctcagcaaactatcgcaaggacaaaaaaccaaacactgcatgttctcactcataggtgggaattgaacaatgagaacacatggacataggaacaagaacatcacacactggggcctgttgtggggtggagggagtggggagggatagcattaggagatatacctaatgttaatgggtgcagcacaccaacatgacacatgtatacatatgtaacaaacctgcacattgtgcacatgtaccctaaaacttaaagtataataataataaaaaaaagaagctatcaacaaagccaacaggtaacctacagaatgggagaagatattcacaaatgatgtatccaacaaaggcctaataccaagaatctatacagtagggaacttaaatcaacaagctaaaaccaaataaccccctttaaaaacgggcaaaggacatgaatcaacatttctcaaaagaagacacagaggtggccaacaaacatgaaaaaacactcagtattagtaatcatcagagaaatgtaaatctaaattacaatgagataccatctcataccagtcagaatggctattattagaaagtccaaaaacagatgctggtgaggctgcagagtaaagggaattcttacacatggtgggaatgtaaattagtccagccactgtggaaagcagtctggagatttctcaaagaacttaaaacagggctaccatttgacccagcaatcacattactgggtacacacccaaaagaaaacaaataattctaccaaaaagacacatgcactcatatgttcatcactgtgctcttcacaatagcaaagaagtggaatcaacccaggtgcccatcagtggtagattggattaagaaaatgaggtacacagacaccatgaaatactatgcagccattaaaaaagaaggaaatcttgtcctttcagcaacatgaatagggctggaagccataatcccaagcaaattaacataggaatagaaaaacaaatactgcatgttcttacttgtgagagttaaacattgaacacgcatggaaataaatatgggaacagtagacactacagactactgggaaggcgggacattgaaaaactacctattgggtactatgctcactgccaaggtgacaggatcctaattccaaacctcagcataatgcaatactcccatgtaacaaatctgaacatgtacctactgtatctaacatagaatttgaaaaagaagaacattactgtaaagagatagacatacaggtaatgtatttatgcaaaatatcatgcctaattcataagatgttactgtgttgccttagaaagtaggcagtacacagatggaattgattacctagtgagttaagcagagtttggataagcatagttataataaatttttgctggtatattagggggatgatttgcagctaatatcagtgatgacaaaagtattctgcactaaaacatttatccatctatgtttaaaaaagctattaggaaaactgagcagtgatctgggttttgttatgttccttctacttttaacctagtttcctccttggccttaattcccccacatgttcaatggcatagaaatagacaaaaaagtagttaatattatagaataaggtaactgtgggcattaaatgagatggtatatgtgtctggcacatagtaaacattcaattaatgatattgttgttcatataatgagtagtagtattagaaatatttgcagtaatatctagtgttaccttcaacactaggagcagaacagtgcctgggagtgctaattctgacaaattattcagttcctctgagctttccttcttgggtctatttcccacctctggctggacaatgtgtttaatgtttccaagccttaattttaaaatttataaactggggataatatttgtatcaatttcttaaagttgttttaagagattgaattactggcaggcagtaataataaattacagtaatgatgactattataattattgcatacatactaattgaggtgttattctagaatatttaggagtgaggggtctaacacagcactttctgagtttgaatcatttttctgactcttgttagctctgtgtgaccttgggcaaagtgcttagtctatgcttcagtttcttcatcaataaaaggggaagagcaatggaacctactataaaatgttgtcaggaggttgaaataaaataatgtgtataaaacatgtaaaatagtggctggcacatagtgtttaaaatacttattattatatcacttattaaaatgttctttgagataagtatgattttgcccattttcgatgggtacattgaggtacagagaagttgaataaactgtccaaagacacagagtgataaggtttggctgcgtgtgcccacccaaatctcatgttgaattgtaattcccagtgttgggggaggcacctggtgggaggtgactggatcatgggggtggatttcttccttgttgttcttgtgatagtgagtgaattctcaggagatctagttgttaaaagtgtgtagcactgcccccttcactctgtctctcccactccaccatgtgaagaagctgcttgctgccccttcacccgtccatcatgattgtaagtttcctgaggcctccccaaccatgcttcctttacagcctgtgcaactgtgagttaatcaaacctcttttcttcataaatcacccagtcttaggtagttctttctagcaatgtgagaacaaactaatacacatggcgagagtaattctgtcatttgaaaaaatctttgtcccctaaattgtacccagctgcttcattttgcaggcacttcttgctgttgaattgctaattgtgggatccactagaaaccacagctccctgaggaccttttatactcttcctgtttggaattgataggggaataaaaatcatcttttggaatagaatttgagacaataactgagctttatagtctctcatttcctcccacacaacttatgatttaatatcctgaatggtttgctattccctgaatgaagtctgaattgccaacttctgtgtttttgcttatcctatccccactaaatgaacttgccgttcttcctcctcaaccttctctgtctctattctctaaggctcatttcagtggggaaggggcttcacagaggagaggcctcctgagacattcacacaccctgtgcacttgtcacctctgatggctttgtatatcaatgatctctttgaatatctgtcatttcctctgtgatataaacatttagaggcaagagatctatcttggttatcttattaccactaatgcctagtatggcctgggcattagagacaatttattcatttattcattaaatattgattgagtgcctattatgacccaggcattggtcaaggtacaatggacattagaatgaacaaaaacaaccaaattctctctcccatgggcctgaaattctaatggaagagtcaccaattggacatcggagtggcaatgtcaagtggctggatggagacatggttctgaagttgataagcacagtctggctgaagatgtgaatatcagagtcatcactatataagtaatattaagaccatcaaactcaatgtgatcactaaggcggtatacattggcagaaaatataacagtaattctttcttttatggaatgaaggaatacatttaaaaaaaaaaattaaaagggccagggagtggcagggactccagagtaggaaagcccaaagcaggatcagcctagaaatgaccattttctaagaattacttttcctgtgggtttcctctcctggtggcatgtcacagagcttcctgttcatggtggtattcaccaacaagaaaataactgagcagcatggctgtatttaacattcattcaacacagacacagtttccacatggtctttacatattcttcatgtcttcaaacatttgcccagggataaacagtgtctctctttgagttcttttttcctcttagtccaggggcagcttgcatgtaaacatggcatccaaataatgatgcctaaactcatcttgatgtcaccaagatgtggcagtcatgtggcaaaaaatcataaaatctcccacaacattattaagtgaaaagagttggaagtgagttcagagaactcaggaaaaatgctttgcaaaacaaagcatgaaaatttactgtccagactctgctccatttctcccattagagtataatctttcatagtgtgtggtatatcatagcgatgaatccacatacaggatttctgtaatgatatgatgattttgacactgatccttctaacatctgctcacctaaagcattagtttcacactgctattgaaataaatgtgatttttaatatcctcaggaacactcaatgaagaatatgtccacctctaagcagagtctgaaaacactgtaatatgctatgggattgtttttctccccagcctcaaaggagaatggtttgctgaaagataaataaggttttatactgtcagttcatctccagaactcatcttttgttcttctacttcctctttttaatgaaaccttacaaataaagatggaccaatattaccatcaagaattgctgcctgtcacacttggtgcttcaaaacccttggcaaaaggcaatttgaaatgtaagaaggctaaacttgaaccctgcaatctaagcagataaaaaaacaatgctctgtattttatagacctggtggagtagaaaattgaggctctttgaagaattaggttcccatttcagcagaaaccagactcatcgaccagactcatgtttagctcaaatattactttttaggccaatgaaaatggaaaataggttgtatagctcctacgagaagctaccttggttaccattatgaaaatattacataaaacaaagaaggctctcatttatctaacagtctacacagtgttttgtaagtagtcatcattctacccattctggcccaaattaacagtaacaaaagtggaaaaatcaagtgggaagcaaaagacttaatcacataggtaacctgaaaaaaacaaaagatgcactaatcaaaaactaagcttgtttaattcttgtttcaaaaatttgtgttattcaagtatttaaagccaagatgtctaaaataaaactaccatctctccctaactgaccttcatggccttccctctatgttccttatcttgataaatttcaccattatcattttggtggagtcacttcatctctttcctatctttcactcaatatcacaaattgtttttcaatatttccaattacgcacaattccaccatgtgtttcaaatttatcctctcccttccaccacgattgccatgttttgacttttgtcatctcttgtaggcagggcagtctagtggtaaagacactaagctttggtattatgccattgaaggtaaaatccctgctttgatgtgtcataattgttaggtgctgggtgagtgatttaatttctttgtttagttttctcttttcagtggaggttgtaattgtaccttcctcacagacttgcagtaaatattaagagtaattgttcaggcttaaaatagcattatgctcaagtgttagctattgatactgtcttgcacagacttttcaagcagtttccaactaattttcttgtcgtctttctctttctctctcaacaatttgtcttctgacttatttttggtgttattttaccactgagtttcagttggttcattgattcagaagccaatatcccactaagtttggttattagttttgacacctgtctgtctcttgtcttcaaatattgttcttgatcctttgctagtcttttctctaacttcaagttcacatcatcccttctaaaatttggcacatatctagctccctctactcttggctgaccagccatccccaagtgccagacaagatgaaaaatcactcctcaacttaaaaacctaacttaaaatccccattgcctctctgcagagtgaatgcagcatagtgcccaggaaagttttcaaaatctggccccagatcactttgctggctgcttctctttcatacttcttgcccctcctgactggctaagctttatcttttgaagtacctagaatgctcctcctttttttcccctctgatgaaatgatgattcttctccagagggccctgctgaaatattaactctttgtgaaatgcacctaggtgagattgaatttcaccagtatcactacagtagttgtgatcatcgtagtagcaggagaatgacagcaaaaacagccaacatttagtgaccatgtattagccagtaactgttctaaacactttacatgctcattaatcctttgagcaaacttacagattatttactatcatttctaccttatggatgaggaaattgaggcccagaagggataagtagcttaactaaagtttctataactagttagtcacagaatgaggatttgaaccaaataggctaatcccagagttatcacgttcaactttttaactctagtatctctctagttttgcctctcacagcattcacagcactttacttgtattcgttgtgtcttagatctacatatgtgtctgtttatttcagtacaatgttagtcttcagatgtagtgatctgagtgttcccctgtgcctggaactattgcttttcaaatagtgttccataaatgtctgccatattgaagtgaaattcattaaatttgtcaacagaaaacaggtgtcctgacactcctacctctagctttcctatactaaaacctgtgaatgatttaatgacaacttctggtagatatataatggaccaggaaaaaaaacccgcaattttccttttttcactaagtatcaatgtgactttgggcaagccacttcatctctttttttttttttttagtttggaagatagagattataacccttgtgatctgccattatcaaaggggttttatgaaaatgaaatattcaaaagaaagaattttaaaacttgtaaaagcccatacacgtgtaagaaacaaatattctaataggtaaaacatatagccaatatctgaacgatagggccaattggtattacagcagggttaaatggagtttctaatgtttcccatgttctgcctttcatggacagtgaagtaccacaaaaggaggaaatctgtgttagctttgaaacctccaccatttgtcacagccagaaataatgccgtctcaatggctgctgcaatgctagatctggaaagagacttgggcacagtctctacttcttattcgtggatggtgaaaggcccagagagaaggaaaaaaaaaaaactcattcaaggggctaccaccatcttcctgcacaatatgtgctgtgtatgacggtcccatgttgagcaggtaagtggaaaaagatctagtcatatttttttgtaaaactgaccagaacgttgaacgtaactagagaattggtaaagtacagagactttgcagctccactgctgtgttcaatctcttcccctactcccatgcctcttgctgatgatgtgattcagaaattaaataatccctcatacctcagtttcctattctgtaaaatgggtataatcctgtccaccttacagagttatttttaggatataatgagttatactgtgcaagccacttaaaactgtaccagacacatagtaagttctaaatgtttgttaaatagataaaaataacatctgagggtttgaacatgacacttttagggcttaaaatgaaattgaatgaatcttgctttctattaagaaatacgtaaatattaaatttacatttaacatgggttatgcctctgttcttccacagattttcctgactacatgcctaggtcagagcctttagctaaattcaccaaggagttagcatgagattaattaactgtcagaggttaaacattaaaaaaaaaatcctggaggttactgttgtatttttaatgggcaacatgttggccattcaagttgctttttgcaaacaaatcctccaacagccaaatgctgatggtttctctgccaacagagcatctaaaaatttctatgatcaatatgctaccgggaaaaacaaaacacactgaaatgttatggtatatttcatgccaaaaacctgaaacacagttaggaaattatgttttgcagttatgcaaggcaatgtactgatggtggtttattgatgagtggtctagtctcaccataaccttgtcatattcatgctcccatttctgctcaaataaaaaacaaaaacccctggaatgaagctctaatttagtgaatcaattattttgattgaatgagggcactgagatagtgctgggtagatgttgttatgagttaaatttagataaaaatgtgaacacatacaaatatacagataatcaagtgttgaatgttttatcttttgtattatttcctgaccattatctagtaagtgcctttttgtcaaataatgtccattgaatgagtaaggaaaatgactactttattctttggtaaaagaactggggcatagagagataaagtgagttactcagagttattcaataaggagttatagccagagacttgacagcatttattctttctttaaaaaagtgtttgtgcttacataaagtatagtagctaggaatttcttgacattaagtcatccataaagtagctaaatcccttaatcctgtaaatagctactcaatatcaatgtacattcacgagccagctgtcagcctccaagatgccacggaattgggaagaaatctttttttttttgttctgagatggagtctcactctgtcgccaggctgtagtgcagtggcacgatctcagctcactgcaacctccacctcctggagtggagttcaagtgattctcctgcctcagccttccaagtagctgggactacagacgtgccaccacgcccagctaattttttgtatttttagtagagacagggtttcaccatgttggccaggctggtctccatctcttaacctcgtgatccacccacctcggcctcccaaagtgctgggattacaggcgtgagccaccgcgcctggcccatgaagaaatcttataagaggagtgtgactctaagtctgactgactcttagtgtgactgactctaggaattgtcgctgatcctgtagatcacaacacctggctcctaagatctacagactctggaaaacatcttccatcatttagcctccttctttctaaatgctactatggttctggaaggctgacctttgtggacaatattatctggactccttgcccttctggtttcccattgggtttggccacgggtgaagaggaaaagggagaggttgtggtacttatcatctgggctcgctctttggtgagttgacaatagctgcatttcttatccaaggaccagagcccttttttattgttacagctatagctatggctttttccaccttctagtaaccatcaacctagaaatcgtaactttcgttcttgctaacactgaatgtttcatagccttattggctcaataaaccctgcgcatacctttgcaaattgtcccttcattcaactatcccctgttgccctatttaaatatgcctttttttccttcctggaccctgactgatactgaatcatagaatttcagtgttggaaagtactggatttggagttgagtttctgatttcagatttttttcagaagctctgtgattttgagcaaataatctcccttgtctagtcttcagtttcctcatatgtaaaatagcctatattccttatagtaggctattattattactactattgttataatatgctgtaaatcacttaaaatgtgatgactatttctttaaaaaccatgtagtccaactggctctcctgggtgccaaccgtatgaaattttcttttcctctccttgaatttttccagtaagttttcttctatgggtatgacagtctcaaatcttgcagtcagacagtaagcgtatctgtatcactggagtaaggttcttttgggtataagtttttgtttattcaacttctcagttgtgggattctgctcaaatcattataaccttttcaggccacagctacctcaattgtgaattgggtaaaacctatcctcctgcaggcaaagggccagagctaatgttttctctctctctttttttttttccaatttaaagatttacattaggaaaaacagctactactctagacctataagagctccctcaatcaatatcagaggtcatcagtggagctcagcctgctaaagtgatgaagacagcaggctatggagtcagaattctagctctgccaactggggcatttgttttgtttctatgtgcctcagtttttttagtcattctatgtacctacctcagaaggtggttgggaacatcaactgagttcatacttgtcattgattcatgctcatgatatttcctatactaaatactttgcatggattattcccatgacaatccattttctgataatcgtaatcttttttgtctccaataaaccatggccctttcctccttctaggacactctctccagaccttcacattactggctttccttttattttaaggacttaaaagacatcttgtcaatgaggctttctctgagccaatcaagatatgtcccctgcatatattccctttccatcatattaccacaggtttacttctgctataacacttatcacttcccagattacctttgttttcttgtttattctctctcttcctacataagctccaggaaggtagtaaactgtgttccactcttcactagaaagtgagtgtctagtatcatgcctgccctatatggtctctaaaaatattgtggaatgaatgaccaaataacgaaattaagaggtggagaatttatgtaaataagtttacagtaataaacaggcattttgtttagtatgaggcacaacaggaattcaaacacatgccaggatgatgctaaaacccacaatgcccctctttgcctctttcaatagttcttggaagagatcataaaagtctgagctggctcagagctgtagcaaaagagacaaaaaaaagtgaaattaaaagatattcagagagaacactgaccagagtttagtagccattaagatggtgggtgggggatcattaagcagagagaagattccgacttcagcaactggacagctcttgatgccaatgaatgatataagacgctcagagtgagtgctacagagtgatggtgattaggagactacatctggctgtgcattcatccgcatcctgggatggaggttcaaagagctgcgggcaattgactgcctaggggatcgtgggatgggccaaaaatgtgaacaagacaattctttgttcacagccaaggtactgctgactctatccctgtctcatttcttactctggttgaggcgatactagtgtcaggtggaagacattctaaggcctaaattaattctcattagatgatatctattactcttgctcaactaccaatcaggtagctcgatgggagaaggccattggctatggcatagatctgtcacctcctgtcttgaagccatgtgtgttgcttcctggtacatttccaagacaatggcgctttttgatatttgtctgatagtcttctcaaacatcaaagtcaagatatgtggtttatttaacacagtagtttgggacttagaagttttgcctttgacattttaaaaatgagaaatacatttaattttcaaacatttaagaatgtctatggttcttcatgcagaaaatctttgtcatatgctgcttcttttaatgctttcgtttgaggcacaaacaccagaactaatagtttaaatctgtatttaacaaatgactataaaaggtatataatttcgaagtattaagaatattatgcctaaataacaacagaactcaagaagaaatatgtatgctttgctgaaaaacatttgaaaggccaatttgtggaaaaattttctaatataaattgggaagcttgcattcagataaatcagttcttttatccaataattcaaaatttaggggaaagtaattttaaaagcatagatagatatatacacaaagccatttatcatggtgctatttatattgagagtgggaggtaaaaagaggaaaactctaaatatccaaaggcagagaatgggatcaaatacaatatactagagttatgcaatgtagtattatgcttgccattaaaaatgattttataaaaagttttaatagcagggctgatatttatgaaagtatatcatgtaaatgaaataataaaaatttggtattgatatgacataattagtacatatacattgatgggaaaaaagatattactagttatttgtagttacttcatggtagcagattatgtgtgtgtggcgtgcacgtgtgtgtgggctcttatctttctttgcactttccaaattgactgtcctgaacatgagagacttttgcaaacatgataaaccattcacctttccaaccctggaggagaaggcgaaaaaggaagaggagaaggcaggagtcttatggggtccacaaatcacgagctaagtctagcgtaggttcagtatcagccagtactatacaatcccattagtatttaaagtgattctgatcatttttttagtattttctattttttttcctctcaaaacatccttttccctcacagttagttgaaaattgcattgcatcctctgtgaacatttatttgggggcatggctttatcagacgctggtgcagaagagtgctaacgagacatgacaattttctacttctctacgtgaatacagagatccatttgaaagttacattttacctatctacagtgtacaaatgactatattttcagcaaatatctaataaattggcaattttgattccaacctgaaaggagaaaagcaatgactctaataaccaacaatctttgacaaatagtggcaataaaagtgcctgcagcttcaatatcatgtaggattagggctctggcatttttctagattatggtcttccaggttgctgatgatgttatgttttgtgagatggtgtgcatgtgtgtgcaatgaaagaaaaaaatcacagcaatgtatctaaactataattttaatttttgtatgtgcattggcttagtgctaacgaaagttatttagttctgcctcctctccccacagaatataatgtaagctctaatagaagagctttctttgttttgttttgttttggtttggtttttaatctgttttagtcactgctccatctcccagcacaagaagcaggcagtgacatacaataaatatttgttgaatgaataagcaaattaattaaatcttattatgatgatatatcacctttggtcagtgccattgaaacaaattgctattctattctgggacttttcactgaatgtattatgttgtttgtggttctttccatattttctcatttgtgttgtggagacccatgacattttagtgcattcatatttttaaatcactaattgaatccatgagttcctacaaaatggtgtagcagtataaaaagcgagtaggtggagctgtgggttatagccccaatactcagggaattccacctagatttttaatgttgcattttctcactagcaaataacaccaccttctctgtctgattctaagagttgtttgatgcttgaaaaaaattgtgtataaaagaaagtttgtacacagagaatatttgtcaatgtatattctaagttatatagcatctttataaaataagctgaggatttcctttagatattcctctattttctactctttaagaatgccacaaaatagagaaaaagaagatggagaatgtgatggttaacctcacttgtcaagttcggcaggctatagtacacagtgatttaatcaaaccctaatctaagtgttgctgtgaaggtattttgtcgatgtgcttaacatctataatcagttgacattaagttaagcatagattaccctgaataatgtgggtgggcctcatctaatcagttgaggcttcctgaagaagaaatcctgcctcaagactgtgacatcaaatccttcctgaacttccagctgccagcatattctatgaatttcagacatgccagtccccataatggtgtgagccaattccttcaaataagtctctttacatatatgcatatgtacatgtgtgtatatgcatgtgtatgtatgtatatgatatgtatatgcttatgtgtatgcacatgagtatgtattggttctgtttttctagagaatcttgactgatacagggaaagaatcaacaaagaagaaaagtcacgtttatttaaatgacactttgtaatcttttttctaatctagtgatatttctgaatttgggcagtgtccactgggattatagacccagtggatgagagtcaaacaatgtacaaggtcatatgttaaagtgtccagctgctctgctaacaaggcaagcaataggaattcctacagttacttgagtccagtccccatcccttacatcaaacaaaaatgtcccagtgttttgcaggacaggctcctgtcactaagactgtgctgtcagtctgcaaaatggaaaatgactcctaattgcccaaatgttctcctgggtatttaggtaaacatgagtacatcaatagattgcttttgtagaatatactgattctttgtagagaacggcaatgcatgcaggcctaaagaaacgaaacaagagtttcggaggaaaaaaaaaaacaaaaaaacaaacttgctttgaatagcaggagacgacgttttggcagctgagcagggcaagagcttcatgagccgctctttaatgctgcgcttggtgctgttctgagcgtacaggaaacctagaagatacaggatcagttctgttaatgctgtctgcagagagaaaagggacgtgctgcagggtttatcagagaagccaggcaggaaggatcagggacgcagccatccactcaggcaatcacaggcagtgggttgggacccccgaaaggaaaaaaaaagtttgttttcttcttatttagttttgtttttatttctaaatgttgttttgaagataatgacgaacaagtgaaagcagaatcgtaaaatatatctattgaacggcaaaagattaaaaaaagccaccaaaaaaatctggtggtttttttttttttttttttggcccttagatcagggataaaacaagtatcactagaagagttaactggattgaaatttcaatattcaaaccagcgctaagggcccacatgacaattttctgctattgctccccatctttgattatagcagagatagatgcttcacataaatcattcacaccacaatcacctgttagtacctttgccttcctgaaaatgagaaaataaatgtccttaatatgcagcttcattagcatatactgacatgcccagagatgtgacaatctttcccattttttacatgtggacgctaatgaatggaactttttcaaacagactaattctggaagaagccagacaagcttgtcaaacattaacccaggaatagacggagcagtatgtgtgacagcagatacctggagatgactcaagaaaaatcaaaagtggctggacgggtgagcttgcaaactgctgaaacaacttttgatgtcaggagccaactatccaagtcagcatcaatttacccaccctgaggtctcagacacttggatgtcatgttaataggtaactagcctccccgagatcagcatgcaaggtgtcaaatataaagcatcagcgcagaaaacaatttaaatcgaggttctaccatctttataacaggaatctggcaaatgtatcacttgttccttttctagttcttatcttggaattataaaaaaattcctgaccacaagcctactgatttagtttcctaaatcatatgttgcacccaccaacagtatccactggctaaaactcatgtgtgtgtgtagagtaggatgacaaaatgaagtagtaaatacacaaattaaataagatcattcctctgattaaaagccctctaaaagcttcatgttgtttttctatcgaggacgccaagtatgatctggccctgtctgagtctctggcagcatttgcagccactctctctgctttctgggccatccactattggccacactaccctttttgcctttggtagaactcacaaagcaggccgtcctctggccttgacacttatgtggtatgaaatgtctcattcaactgctggttgagggtctggcatgtaacagaaggtcaataaatgcctggcaaatgagtaaataaattcactttggatatctaaagaagacttgattcatttcctagattagtatctaagtaagctttttaaaaattttactttaagttctgggatacatgtgaagaacgtgcaggtttgttacataggtatacatgtgccctggtggtttcctgcacctatcagcccatcatctaggttttaagctccgcatgtatgtgtagagtggggtgacaaaatgttataaatgtccttaatatttccctccccttgacccccaccccctgacagacccccgtgtgtgatgttccccttcttttaaacttgcaaaataaatctggtttacataaaacacaccctatattttgcttctgatttccatttctggaaggatgcaacgatttaactaccctctcctttgcaaactcctccaggacatgagggtcttactttagctccctacacaggcactctgctcctcccctttatgccatttcaaacctccgtgccaggatatgtgctgttccctcagttttgtcagctgttcaccaactctcaacttctgtatcccagtgcagccttttttttttttttttttcaagacagagtctcactctgttgcccaggctggagtgcagtggcgcgatctcagttcactgcaacctccaggttcaagcaattctcttgcctcagcctcatgagtagctgggattacaggtgcatgccaccatgcctggctaatttttgtatttttagtagagacagggctttgccatcttggccaggctggtttcaaactcctgacctcaagtgatccacccaccttggcctgccaaagtgccaggattacagacgtgagctactgcgcccagccccatgaggcttttaaaactcagttcaaacacaccttcctctggccatctttccctcttgtgtctccaacttgcctaaaagaagaaagacctcctccctcccctgcttcccaagctaactttgggagaaatttagcttatagtttaaatgataatggcccttccccaaaactaaactgcctttgtaaagctaatgaaagatcaccaggttaggaggatgagaggagcgtgaattctgctaaggtgtagccataagctattaccagccgttattctcgaggtcatgagattcataacttccccaattactcctgcagataacatcactactgtagaacctaagattggctttttgagatgtcttttcaggtttttgcatttctgacaatgaatggcttcgcccagacctgccaaccagtcctgtgaccctacccagaagccaactcagcatgaggaccattttccatatccctaggattgcaccccaaccaatcagcagcaccctttccattacccatcaactatccttgaaaaaccctagcctctgaattttcaaggagtcttatttgaggaataataaaactccgggtctcttgctcagctagctctgtatgaattaagctctttattgcaatctctctgtcttgataaatcagctctatctgggcagcaggcaaaatgaacccattggacaggttacagtatctgcttcaaaaagttaggatcagaggaaataatatataaagcacttatcacagtgacagccacataatgcagtccaaacaaatattaatcattttgtttcacttatttgagtataccctattccctactgtctcagggccttttcacatgctattatctgaatctaaacttctgctttactttctcttcatctggttaatgcctgttcatccttcagatttcagttcaataactttttgaggaaaaccttatagggcaaaccaactagattatgaacagttattatagatgcccatagttttctatgtttctccatagcaagtataattaaaacaattcatgatacaattacatatttgacacgtcttccctactgaaatggaagatggaagatgtctacttctagcctttacagaataaatgttactggatatgctataccactgtaaggaaccatataactggacaagctacatgagggaactctttccaagaattgaacaataaacaacatagaactgtgatgcttgagagaagaaaaatcccagaggtgtgcttcacaaatgccctggctcgcccctgcctggtgacatgttccttccatagttcagggaggtagagctcatagtcactgagctgaagtggcagagattagagttccaggctcctgaagtggctggaatttgtaggccagggttaagagagaattgatgtatgcgtgtgtattctgcaggtagctggtgggtgggaaatttgtgtgaaattaaatgtgggttattgactaagggctgggatatgcacgatatccaaggcttcccaatgcttagcaggcagggctgagaatggaatgaaataacacaagccacatagagctggaatgctgcaagttgttagagttctagccctgccagccttccaaagaagacttcactgagcacctctggcgttgccctgagaactcagaaaaaccactttgggagtaaggataatttcctagagtaagggccatagtgtatcactgaggtaatagccaaagttgactgatcctaacaaagaatagacctaaagctagaaagaccaaaaagagctgctgaactgtagaatgcttcgaaacaatattcaatatattttaaaagaaggcaacatgacccaaactccttacaatgtatcctaataacatcttttgtactataaaaaaattactagacatgtgagaaagcagaacaaatgtgacccataatcaagaaaaaagagaagtcaataaaaacagacattaggtagcacagatgttggaagttgtaagaaatgacgttaaagatagtcataataagtaaagaaaaaagttcagaagagaaattaaactacaaaagggaactaaatgaaaattctagaaataaaaagaaaattctaaaaggaaaacttcattagatggacttaacagcagactgagaactactgaagaaaggattatgagcttgaatagagatgaaaaggaagaaatctgaataatagaaaaagatttaaaaataaagagagctttactcatctgtgcatcatatcaaaaagtccaacataggtataattaaagaacataatgagaggtgagataaaattttgaagcaataatgaccaaaatattccacatatgttttaaaacacaagtgaaatctgttgaaccaaaagaagaaaacttaaagtataataaataaataaataaataaataaaagaagaatcacacatagctgtaggcaaaatgctgaaaatcaaaaatgaaaaaaggctttaaaatgaaaagagaagaaaaggacccgtacatacaagggtcaaataatgtaagaataatttttcatcaagaacagcagaaacaccagaaaacaatggaagagaatccttaaagttctcaggggaatacagagactatcaacccagaattttacctatgtttttgagaatgaagttgaaataaagatacttttagataaaataaacctgggataattcatagctaaaagccttgcattccaagaaatgctaaaggaatgtcctcaggctgaggttaattggcataatacggaaacttgactctacaggtagaaatagagagcacaggaaattgaaaatatgtgaataaatatattatcctgttttcctttcctactttctttgtttaaaacagcaaaaaagtattgtagagtttattacatttgtagatgtaaaatttctgacaataataacatgaaagttgggggagggtcaatggaattttaatgtatgatgcttacattttacatgaagtggtaccatatgaactcaaaatagtctataataaatgaaggagacatactgaaatctctagatacaagggaagcagtaaaaaataatataagaaggtatagtcaaaactccaatagaggaattaaaatgaaatatataaaatatttaattaatttaaaagaaagccagggaagaggaatagagggacaaaaagtagaagggatgagtagaaaatacataagatagtaaatgtataccccaccatataattaaatcagaaattgtattttttattcattactgaattcccagtatgttgcacagtgcttagtatataaaatgttcaatcactatctactgaaagcatgaaatcagactatatatcttttatgattgtctcagtatgtgcagatttgctacttgtaattagcagatgcatttagaatgtacatatatgcttcctcacagtgtgtgaagcgatccctaaatagatagctgtgtgtgaaggcactctcttaaggatgatactgacagaatgaggaggtgggactgaattccccagccaatcacactaaaagaaagttgatggtgaatctccaaactgccttagtatgtaggacatttaccctcacagagactaaacactctttgttttcattaatttattaagttaatatgtatcgccacctacaatggacagattcatatcttaaattaattggctacataaaccactgagcctaatgagagcattcaaaattaagtcaaaataatcctagtttacctcaaaatccttgtctttctccaaattaagggcctggccagctgtcataaattacatattccttttggtttttttaaaggttacatgttcaagagagtgaaaataagatgttctgtctaaaggctaccatgcctggtttgtaaatgaacctgttaaatgctgtatttgctcccacagcttactacagaatgttacttaatacaatatcatacttattacaatttttactataggagtgtaacaggtaaaattaatctctattttagtgggcccatgtttagtctttcaccatcctttaaattgctgtgaatttttttgtcatgacttgaaagcaaggatagagaaacattttagagatatctgggtttttttccattccagaacttgtgaggataatcatatttgcttcatatttatagtcatgaactcctaagctggcagctacaaccaagaaccaaaaaatggtgcattctgcttcttgtaattcatctctgctagtaaattataagaagcagggaaaatattttatttggatggtttctataaacaagggactataattcttgtacattatttttcatccttgctatttctttgagcagtctaatgtgccacataattatctaaggtatttgttttctataagaattgtttcacaagtattcttgttatcagagtagttgtattatatttcaaaatgtaagatgatttttaaaagcctgagtactgacctaagatgcaactgtatgaactctactctggagggcggggagggtgtcagtggaagtcgtaagacttttatttttttgtgccatcaaatacaggtaaaaataattgtgcaattctgctttttaaataggaactattggcctgcttggccctaaatggaagggctgatattttaagttgattattttattgtaaattaatccaacctaattctttttaatttggttgaatgtttttcttgttaaatgatgtttaaaaaataaaaactggaagttcaaaaaaaaaaaaaaacaaaattaagtcaactcccatacctctgcatctagaagtcaaaccaaactgctagtatactaacataacactttaaagaccataaaacaaagcaatacaaaaagagatgaaaaattacttttcatctcataaatatttgtccaaaaagcattctttataatgtacatattataagcattataaatgatgttctttgtagaactgtaaatatacagtggctacatagaaaaaaaatccctgctgtctagaatctaaccatctgcatctattataatacctatgacattgcagatcccgaattccctgaggggaggattctgtttgtttatgaattaactcatttaaaagcatttgttgaatgctaactatgtgctaggaactgtctcagatgctggcaataatgcaccgaatgagccagccaaaaaacttctattttagtggaccttacacgatatttaggaaagaaaaaataatcaacaaaaataaatagcaagttataaagtatatcagatatgaaggagggatggggcctagagacttctgttggtggatatggatatgggtaagaaataggacggggaaagacataattttaaatatggtggccagggaaggtttcattagagatatatttgggcaaaaatatctacataagatgaaaaggtgtcttatcctgtttcgattattaacaataacagtgtattacatatattaggtactaatatatatttgttgagtgattcatatcacttattaatttattaagttaatgtttattgctacctacaatgggcagattaataaattagttggctacataaaccactgagctcaatgagatcattcaaaattaagtttactcccatatctctgcatctagatgtcaaaccaaactactagtatactagtacttcaaacacgataaaatgaagtaatacaaaaagataataaaaagtaagtgtgtaaatatataggccattctaactgtgctctaactaaatgagaatgtattcatttttaccaattggaaaggttttatcttataatgcctgacattactgaaaacacgtcagcctatcatcatcttgattgctccatttttctggtcatgcagacctcagtggtggcatatgcaagtggtcattctccactggctgctttttgtgttacacaggaaatgccatcacatgtcagtgtcatgtgtcagtgctgagcgatgggccatgaattatgaattcaacaagtactgacagtggcaatgaaagtggtaatttcaccataatgagaactattcttatcttcctcctttttgcagtacagcagatagcaaaaacttctatttctcatgggttagcttggaaataatggctcgtactctattaattcacagtcccgatcagcttctattttgtacttttgaaacacggacaatgtttttcttcctagattttaagcctgtagaagtctggtggaagaaaatggcaaataatgtttctacagatctggtgtcttcccatgaatcaataactatgacaaaaattgggctgagcaaggtggctcatgcctgtaatcctagcactttgggagtccgaggcgggctgatcacgaggttggtagatcgagaccatcctggccaacatggtgaaactccatctctactaaaaatacaaaaattagccaggtgtggtggcaggtgcctgtagtcccagctactcagcagactgaggcaggagaatcacttgaacccgggaggcagaggttgcagtgagccaagatcacgccacggcactctagcctggagacagagtgagactccgtctcaaaaaacaaaacaaaacaaaataaaaatcaccaggagtttcaggggtactgtgatcccatctgtgttctttgagtcagtgacaagctgattcatcagtagtgtcatggatgctgggaatagggagtacatttttttactagttgcaaatatgaacttatttattaggtttgggcaaaagtaattgtgatttttaccattgaaagtaatggcaaaaactgcaattacttttgccccaacctaatactatgatgcctatttttaaagtggacttacagttcataaatactagcatgactacacaaacaaacacatacactcagaattcatttagtattttcaaattcattcctgaagatactaggccccagataacttggggttcatatgctggtaataattcttgcagaaaattgctgcccaaccatgcagttgttattggatcttgcagtcagccccaaatcattcacttttaagagaagtagcaacagtgttgctgactgaatatgaggaaaatacctacatttcattttttaactttttgaacttgggaggcagaaaatgaccttcctaattgacctgttttgttatgcttgattataaaatagtttgtgtatcagtttaaaagaaggcaactagaaggtgcttgaatttgctgaaaacgatctacagattccaaatgcaaatggagtaaatttgactctacttagagtggctacctaaatacacctgtttctcataaaattaatgctactctctgtcagcctttccatctctctatctgtctttctgtctctgtctcactctttcttagtctttgtgcctttgcttttatctttgtctctttgtctccctcttcttctctgtctctgagtttctctggctcaatgtctctctctgtctcattgttctacatctctgtttgtgtctctcctttatctttttctgctctgtttctgtctctaccccgactcagtctctctctcaatcaaggcagggtcctatttaatcttctttaccttggtgttgactgtgttcttaacaaaacatttagagagagttttggtcagttgagtgcagaataattattgcatgttatctgaggcaaatattagcaaacaactggatggtcaaaagctgtaatgctttctaaagccgcttctaagtgtgtttgtttttatcacctctctgctgtactggcagaactagccagagaatactagcagaaaacaacatggaaaaggcatcaattttccttgggatcttttaagattgaccaattgaacctcaattttcccttgctcctctgaacaatttgccaaaactacttctacagggctatcctttgtgtggggtttggaaattatctggagttccttataaatagggtgacaagaccttcgtttgtccaggatgctgccagtttatgggagttgtcctaacaccccatagtctgcacccccttttcatgttcaaaaatgttcttgtttaaatggtaaattatatgttcatgcaatattagcaaccagtatggtctgttccacagactaaggtacagtcattgactaagtgaatacttcattgcactgtaaacaatgtaaataatgcaatttcattttaaaaaatggtgttttaagaatagctaaattaatagagaaggtgaaataggaaactaaaaatgtttttgtgagcacattaaagctaacatttatgatggaaagatttggaactttagggttcagggagaactcatttgaatctaagcgctgccactttttgtttgtaaggcttcggaaaagtaacaacatcactgagcctctgtttttttttgtttgttttgagacataatctcactctttcgcccaggctggagtgcagcagcttgatcatggctcactgcagcctcgaactcctgggctcaagtgatcctcccgcctcagcctcccaagtagctgggactatgggcacacaccaccatgccccagtattttttttttttttttgtagaaatggggtcttgcgatgttgcccaggttggtcttgaactcctgggctcaaacagtcctccccactcagcttcccaaagtgctgggattacatatgtgagccacctcacccagccaccttgcctctttgatctcacctgtatatgaggtaagcagccaaagcaaaaaggaatttatcaaaaatgacagcagtatctttttggatataacctaaacctaatgtactatttcttttccgcaagctaacacaaataactcttatttatttttatattttttaattgagtttttgatcagtgagccatgatcaagctccatgctggagtacagtggtgtgatctgggctcactgcaacctccacctcccaggttcaagcaattcaccttcctcagccaccggagtagctgggattacaggtgcctgccaccacacccgactaatttttgtatttttggtagagatgggatttcactatgttggccaggctggtcttaaactcctgacctcaagtgatccgcacacctcggcctcccaaagtgctgggattacaggcgtgagccaccgggttgaagcatttttaacaatcaagcattgtaacttcaaacttttctttgggataagccaagcatgcctttaatatcggaaagcaagcgacaggtgagtaaggttgattcttctgatggcgagagaacacaaataaattgattcttaataggatttgggattacaaggtgtattttcgtgttggagtgtccattatacaatgaatcttctcctccaatgtcacccacagtaactagtatatattcttaggtattgtctaggctactctgttcattttatgactggcccatcacctgaccactgccttttaataacatatttgaagggattttcaggaaaaacagtcacttgtttccttttgttcattctttttattttctcttagtataaaatcctgcagaatctcatagtctactctaagagctttggcttctactcagagtgaaataaggagaaaacggaggaggattttttagcagaggaatgatatcatcatataatgttttattcaacaacattaattaagcacctatttggcactggcaaaaacatagtccttgctcttgtgaaatgtataatctaatggggaaggattaacaatagaacaagaaatgaattaaacaatagaacaagaaagtcctctaaatttcatcttgaacatgatcttgttctaagaaaagatgcagacaaataatgcctaagatgcaatgctctaacaacaataagaacaaagagaaccttctatgtgctaagtaccttacaagcatcatattatttaaccttcacaagagccccacttgtggaagataacattatgaaagccaaattatagcagaggaaattgatggtaaagatgcacgcagtttgtaagtggcagtatcaggaatgtgaacacttgttcatctgtctagctcctgggtctgacattctgacttctgtactgcactaacaatggctccacaaaatggaacacttattggatgtgtctaattgtgtagtttctagctgcagaaaatttgtttctctttgtggtatggttttaatttccttctctgcctctttggttaagcttcttaacccatcttgtcttgaatatagtcctgagagcatggtgtctttcattcctttgctagaaatgctacctctaattctatttgcagtaggacatccatcaaattcctggtggtattaaaaaataataatgtggtttaggagaaagctgcactaggagatccaattttttcatctgaaaaatggggctaataatagatgacactaatctcaaggaagttgggagatgaatgaagtaattgtttctgcaaaatgcttcaaatgccagaagaaataacatataatccattataatttttgatgtgagacagtactttcctttcctgagttcttttgtgtcactgtatttaattttcatcttttaacaatgtatttatattcaataaaagtctttattcattaatttaaccaataagtatttattggatataaggtagaccctgtgccaggcacccgggaagaaaatcaaatagaatagtcaatgaagcaaagtctttacaatcttgtgaatatccattacttggccatgattgctcattagaatcaccaaggtggctttaaaaaattagccatgcctgatcattccagaccaactgcatcaggtaattctaatgggaggccaaacctgagaaccactgttctgctttgggaaaatatgatgccagataggttttcttaagaactgtagacttttgatattgcaagctgattcctggtgggctagagttggagctttttagctcaaacactttttttttaaattaactgggccaaaaactaaaaatacacatattccacttagaatgttggatttctggcttctgaggaggaactggatggtctggcaaccttttgtctgcatttctgtatagcagaaattggatgggtctggtgaggagctgcccctttcacacaggacatgcatgctcggtttgccagtttcctctgttgcctatcacacccaacgctaagagacaagtcaagtgctattcatcttggttcacttaactcatttacattagctgcctggcccctgtaggaatttaacttttttactctcctctggttgtttacacatggacattgtaactggtttgaattgtgtctttcaaaaattcatgttcatctagaacttcagaatgtggccttatttggaaaatagaatgtttgcaaatgcaattagttaatataaagttatattggtttagggtgggccctatagccaataactggtatctttctggaaggagaagacagacacacagagagggaagcaggccatgtgaggacagaggcaaagattgaagggaagccagctaagagccaagaaatgccaaggatttcccgtaatgaccaggagccaggagaggaacaagaataggttctccttcagagcctccagaaagagcctaccctgtggagaccttaatgaagacttctggcctcctaaactgtgagagaatatatttatcttgttttatgccatccagtttgtggaaatttgttacagcagctctagaaaagtaatacacacatcagttaacagattttcaaaaacaccagagaaaataaaattaagccatgtccatatattcatcccctactgtatatagaacaatgtctgcacacacagaatcgccaaaatgtaagacaaggggctctacttgtagtgccttctcattagtactggtattttttttttttaattactgccaagctcactcatcccaggcaaattagtccaccacacactaccatggagtggatttctacttgtgtgaaattggcatgttctagattctgtactgctagtattaggtaaatatcagttgaggctgagcattcacaaagaactaaactaaaagtaaatattgtccagtttttgtttcaattaattaattaatcacatgtttattgaataactgatgactttccatatcactaacagccaaattccctaattagcaacctgtggacaacccaccccctccaacccaccgcccctaaatctcatctgtctcctcttctattttcctctaatttctttccttgccactgctggtcactgtgcctgaaatgtctcctctcaaaaatcttcaagatctctcccttacctccttcaggtctttattcccttgccaccaactcagtgaggacttctctcacagggcacttaaaactgtgtcctcacgaaactacttcctattctctttcaattttaccccataggttggctaatgttatagcctaaattgtacctgcccctccctccccccgccacccacattcatagtgaagttccaactcccagtacttcagattatatttggagataatgtttttaaagaggtaattaagttaaaatgaggccattagagtggggccctgatccaatatgattggtgtccttaaaagagaaagatatactgtgatgtctaagcccagaggaaaggccaggtgaggacgctgtgagaggacagccatctgaaagccaaggagagaggcctcagaaggaaagacgcctgctggcagttctgtcaggagatctgatcttggatgtccagcctccagaactgtgaggccagtaatttctgttgcttaagccattcagtctttgacattttcttacggcagcctatgatggtgaactttgtatgtcaacttgacttagctaagggatacccagatacctggtcaaatattctttcttggtgggtctgtgtttccagaagatagtagcattcaaatcagtagactgagcaaagaagacccaccctcaccagtgtgggtggacatcatctagtcctttgaaggcagaataggaaggcataggagggtaagttccctctcttcctcagctggggcttccatcttctcctgcccttgggcatcctggttctcaggcctttggactccagaacttacatcagtgcccctttcagactccaacttgattatgccactgactttcctggttctccagcttgcaggtggcctctcatgggactttttggtcttcgtaatcatgtgagccaattcccataataaatcaacctctttctgtttctctctttgtatacatagtctattagttctgtttctttggagaaccttgggtagacaacatagccctagcaaactaacagagctaaccacatgacttattgtccaacctggaacaccactaacaatgaatgaaggggatattattaataatgatatccagacacttggcataaactgtaacttcccatgtatatcaggacatttggtagccttatccatagtacctatcattataaatgcacaatgcactttagttagttagatgtttattgcctgcctctctccaccagatagtaaattccttgagggcagaggtttttgtgcttttactgctttatatctagcacctaagtatctgggacatagtagagtctcaattgaagaaactgaataaataactgtaaactgtaaggatgtggttaatgttcactgatctatctatatttatgtctatatctatatcgtatctatctatctctatctcatctatctatctatgaaactttctcaatgcgactaccaattattttgtacctgctattggctaagcaaggtactaggcattttacatatgttatcactcattttaacaacaactttgcaagctgcttatggtttctattttaaacttgacccaaatacctcagagattttaggtaacttctcctataccgctcagcatatagctaaagattcaaacttattgcaaaaaagatttttgtacattcttggcagttaaacaataacataaatgcagatttctagcttatcaaatttaatgatcaatacttaggatattgttaactgtacatgttgatgtgccagtgttatctacaaattatatcaatgtgggttcagaataaattgtattttttaaaaaagtgtgggtagaaagatctctaatgctttaatcctaaatcctctatcagcataacagaaaaatcagggacaacaaatcaatgtccctaagatggatatgagtagctcttcctgctaatttgatttttagtaactaattatttaggctggcacacaatgtgaaatattgtccttgaaaacaggccctgctgctcaacattttatttattagaaactgagccaggaaaatctagtgttaaaatttatcatagcagctgaggggttatgtcctgatgaagtaaaataatgccatgacaagatgatagatgttttctgatatcttcttatcactatcttgaccagaccaaaatattgcctaagaggattcttttgagttatgcaaagtgaagtcacattttgtatgcaattttgaaataggaccctataaataatcaagtcttacactatttgcaacttgaaaataatgcaatacacaagtttttgttacatttgtcaagaatttcataacttcaaagctggctggctgaatgaatggtgagctctttaggatattgtgctaaggtaatatcccttaaagcttgcagataaactctggacatccttattagccttatggaaaaatccactaagaccttaaactacttgaggtctccaagaacatattcttcaaatagaacatgatccctgtgtaattcactctgactaggcttcatcctaaacacagtggaactaaatttttaatcctgaaaatgctagcatcactcaattccattctacaaatatctgttgatgcttaggacttattaagtctgccctgatactttccccaaggatctcagggttttattggagacagggtgaacttgttaggcataaaataatcttaaaaatgacctcactctgggggctaatcctgtgcctaagtctgtcattcagaatgtgctactgtattgaatctatcagattctccagctcttccagatctcaatgaaatggaatatagggctccttaggaaacccaagaccacctattttagaaatatgctataactaaacattgaaaaaggtacattataagtgctgtcatatgtaagctttaaaagaatcacttataaaggaagaaatgaaacccggggatgatcagaagtctgaaaactaacggagtgtgtacattaacctggtagattactaaggccaccccataaactatgtttcattcacctttgtgtccccagcatcacgcacaaggcctagcattgactgttcaatacatatctgtttaatgaatgcatcattgttggttgaatttcaaaggagaaagagaggcaggcttctcttcataaataaatcatgactttttcaagattcccaaaacaattagttttccactaaagcaatctgaagtgccagatcctggcaaacctttctgtccctgggagacaagcacgttcagaaaagcagaaccttcaaacttgcagagccagctcatacttggtggccttctcaccttaggctactagttactgagagttggggaaagtggggaaggagcccagcactgtcaacagactttattggttgaagaaaacagtgttgttaaaacactcacagatcataaaaagaaaaaaaaaacacccaaggatataaaattgagaaaagatatctggagaaagcaatattgtgttctcgagctaaaatttcataggaagcttttgaaaatgacctcctgggtaaggaaaattatggatcctatctattctctgattgagcaaacacattgaattcaatacaatctcagcaccacatgtgcacagaacagagcaggacaatttgtctgataaatgcgtttatagcaacaatatttatgagatctatgtaggctttgagacattgagctgaagaagtttgagcttcatgttaacaatgatagcaacacaagccattttgttttctttgtgagtgctttacaaagcactatccaatttaatcatgaaaagaaaacagtcctatgagataagcatgaaaaagtttaggaaacagaaaatgttaaagctcaatcgcgtttagttgaaactcctttcttcagttcttcccatactgggtttctctttttctttatgtccttgttatttaaaatgtaataaggacattggtacttattggtctcatcagcctcacccggtagcttgttagcaatgcagaatcttctaactcactcttgagctactgaatcagaatttgcatttaataagattctcaggtgatttgtatgcacattaaattgtgaaaagcattatctacatggtgtcatattagtcatctggaatgcctgcttttggaatcttaattcattatgaatgagggataagtagagggcactgttataagaatatggtgtcaatctatgaatcttctcaaaacataatcagattcaaatattaatggcattggtgatacataggttaaagttatagactctgaatcctggttttgccacttactgtgtggccttgggaacactccttaactctttaagcttcagttcctcatttataaatgagaataagtatactaaactcaagaggttattgtaaaggtcaaatgaaatgagtacccagagtggtcacacagtgagtttgcagtcatatttattctttaagtatgacatgaaacagagattcactccagctgtctatctttccaagaaaggaaaaaaaaaaacacaaccttttaaagtctttcttttagattttcactaagtcattcctttgaatactatcatagagacctgctttgtgttagctttgatctttggaattctgcggtggtacaaggtcatgatgagcttccagtgaattatcccacaaggaaaccttgacacattttctggacttttcaccacagagattactcatgtcttctcatattctgattctaagaggccaaaattattagataatggggtgacttgaactctaccttttttggatacaagtctggcccttctagggttgatacacttcaaaaattcttcttaaaatctgtggaacaactgaaaagaagctcagataaattctcttttccaggagtcttggagacaaggggacagaggaagagtgatctgtgcagggatgctggaaaccacagggagactacaggaattgaatcctagaaaaaggagctgattacaggagggtcagctgaaaacaaggagccacggcatacccagtttagttctctagcaccatcctggcagcaccataccagccagcaaggtattaggttggtgcaaaagtgattagtattgcaccagcctaatattttatttttgttgttattgctattttttgagatggagtttcactcttgttgcccaggctggagtgcaatggcataatcttggctcactgcaaccaccacctcccgggttcacgtgattctcttgccccagcctcccaagtagctggggttacaggtacctgccaccacaccgggctaatttgtgtatttttagtagagacggggtttcaccatgttggccaggctggtcttgaactcctgacctcagataatccaccctccttggcctcccaaagtgctgggattacaagcgtgaaccactgtgcccggctaagcctaatatcttaaagaaaataactaataaaaaattaaatgactgtgttctctctggtatgtgtagtggcaacgtgaagatccgacttttgttctgagtgaaacaagaaacatggaaaatgctttatgaaaacatattacatagagatgacttatttaatattgtgccattgtttctcatatgggaataatttcctatatatgtggtgtgcaatttaaaattagatatcataaaccactagggtaaaaatatatgaggcctataccgggatgctgtttcagcatgcagaatcattattctttatagagctaacaaattcttaaaagacaggctgagagttaaggatctgaaaacactgcaaactatcaaaggcatacgaggaatttaacaatgcaaaatgaaatttaagtgaagtaccttagttcctcttcttgctttcctactgaacagcaaccctatgtctttctgtagaaatgtttattttgcaccattattttgacacgttcaaatatgacactttggtcatatattactgcatatttaagcatgagacatcaatcagatacatgtaagaaatatgttggtttggtccagaaaggcaggacaactcaaagctggggcagggtagccactataagacttcaaaagaaccttggtctccacaatcttttatctgaacctaaacgtttcctttctattgatctcaggtctttagacaaacccaaccaattgccaatcaaaagatggttaaatttacctatagcctgaagcccccactttgagttgtcttgcctttctgaaccaaacgaatgtacttcttaagtgtatttgattgatgtctaatgcctctctaaaatgtataaaaccaagctgcgccccaatcaccttgggcacatgttctcaggatctcctgagggctgcgtcacgggccatggtcactcatatttggcttagaataaacctcttcaaatattttacagagttttgctcttttcatcggcagaaattaatgagaaactagcaatgcctttaattgcctgagctggttacttgagcagactgtcatccacgcctccctcctctgaagccctacttgctgccccactctattagattatcaattttagatcaactgctgcaggtggtgcctggctctacttgatgggctcccctcagtttgccaaagatttataaaagcagtgttttaaagaatggcgtttacccactgagctaattttcctctcagttagaattccatcattctttagccttaagagtaaaaagtgaaaggagaatggaattaactagagaactgcctatagttctctatgtgactgttgtgttacccttctctaatagaataactctctgctcttatggtcaagttggtgtcatccagagatgagatacaagaatccagggaaattttttatcaatgattgattttatggggcattgatttataatagtaacaataatttaaaactatatatatgtatgtgtgtgtgtgtatatatatatatatatacagatatatagatatatatttgaaaccctaggaaagttatatgggcataaaaatttcattttggaatcatttgtcaattttgccttgaagattcagaagccttctggaattttctgaacacaaataattaaacagtataatttccacactatctctctttttaaaaagatgggtgcttaaatatacagaaaacaactttattattgatttttaaatgtaatacaaaacacctaaccaatgcacagcattgaaacaattcatcaatttatctggcatccttgattggagagtccttaacaaaatgctaatttaattaagccttaactgtttttttctgacaccctgattagaaaatgttcaactaataatataatcttaaataccaataatgttttaaatttttacaaattcgtgcaagaactcttgattcaaatttgatttcctttctgtctaaaccaatctatgaggtaacaattttacttgtgtttatccttggtcatctgaggatgtagcagtaaagaaacagtagtcagaaggtgtttttaggagaaggaggaggaggaagaggatgaggcatgggagtaggaataggataaagactagagtagttttggaaaaaagcatttaagagagacagttttttcagcccagttccaagacattagatgatgttattagaacttaaaaggaaaaacgttctgcttgctgaaatgacattttgcatataggaagtgtgttacgttgctagggctgctctaataaaataccacagaccaggtggcttaaacaacagaaatttatctcacagttctggaggctggacatccaagatgtaggtgtcagcaggtttggttactttcaaggcctctctttttgtcttgtatcgatgagcaccttctcactgacctcacatgcccttttctctgtgctagtgtctccctggtgtctttttctctttttataaggaaaccagccatactgaattagggtttcaccctaatgaccttattttaactttaatgagtaaaatcacaacctcacagattggtttagactgaaagaaaatctaattcgaatcaagagttcccatgcatgaatttcataaaatttaaaatattattggtatttaatattacacaggtagttgaacgttttctttcttttttttttttttttgtttgagatggagtcttgctctgctgcccaggttggagtgcactggtgcaatctcggctcactgcaacctctacctcccagtgtcaagtgattctcctgcctcagcttcccgagtagctggaactacagacatgtgtcacaacgcctggctaagttttgaaattttttttttttaaagtagagatggggtttcactgtattggctgggctggtctcaaactcctgatgtcgtgatccgcccgccttggcctcccaaagagctgggattatagctgtgagccaccatccctggcctagtagttgaatattttctaatcaaggtatagggaaaaaaacagttaaagcttaattaaattcgcattttgttcaccacctctttaaaggcttcatcaccaaatatagtcgcattctgaggtactggggtttagaacttcaacatacaaattttgagggacacaattccaccactaacgggtcaatttccccttcttcttctttcctttccccttccccttccccttctcttcctccctccctccctcccttccctcctttcttcctttcttttctttctctctttttctctctttctcttcctctctttctctttctctctctcttgtcgggcagcctcccaacagggggattttaataaatgtctgctgactcttgatggggcaaatcactatcagctgtgcctattgggctgctttttaacattgctgctgagctgttggctagtgaaacatgttaaggttcttctggtcatccgaagatccatgtgccccctcccttatcagtcccttaccccgtctgcactgaattattacaatagtattataactggttatgcagattcatctatgtctcacccttccatgagagcagtctgtctaaagcctagttctaacgaaaaagcccacagtccttcactaattcaggcaacacgtttctgccatgtctgccttgccaggaactccactagacataagagatacaagagagagcagtcaaaactttcatttgctcccccttgccttccagataaagtccaaattcctttgtataacatttagtatttagaccttacccacctcctcaaatgtccctatcctggaattcacaaagggctatttttcacctcctaaacatattttgcacattagagccaatataccctttatgctctctacttttctatctgttccccttcctatagaaaacctacacatccttccattccagctttagacccttgccattgcatattgtagtgagacttcatggatgtatggaatgaagaaggataatttaaatgtttctgaactgagtatctgggaagaatgaggaaggaaccattcaatagagacagagaaaggtgaaagacaagtaggatttgtaaggtttggggcattgagttaagttttagaaactccatgagaacacattgttctgatgtgtttattgttgaatcttcagcatatagaacagtttctgccacacagtagacacacaatacatatttggcttaatgagagtatatgtgtgtagtccttggtaagaaaatgatgctacctcagtagtcatgacccctttatttcaaaagacacacaaatataacaaaattccagcaccacaaaaaataacttgacccttgaggtttatgataatggaaactgagctttaaatgttaacacaggttagaactgaggaaatttattacggtgttttggaaattaagaggatcctccataggtgtttttggggtcaactaatatatattaatgtaagagttttgtctagaaatttagaagctctaactctgctactgttaattgctagatttgcaactttggttcagttattaaagttatctgtttaaatttctataaaatgtagacagataatctacctatctcatgggattattataaaaaatcaaatgaaataataaatatcaaaacatattcaaaactaaaaatatcattgaggtattacatataaccacactggcaataacagacatagtttttttgagtaaactgctatggacaacttcaggtaggaaataaattgttaaaaagcacattcattgagaacttaggagagattggtagttggataatttcaagatatgactgattatttactttggttttttgatttttgtgctgttgttagaaatgtaaatttttttattttttttctttgagacggagtcttgctctgtcacccaggctggagtgcagtggcgcgatctcggctcactgcaagctccgcctcccgggttcacgccattctccttcctcagtcaccggagtagctgggactacaggcgcccgcatgatatcaaattttcttgaacaactgaactattattaatcgtcaagttttttttagctaattccttatggacatttaatcataacaacctattctgataaaagagattcctgatccagaatactgcacattattgtaatgtccctgtgtaccaacttgaggtattaatctaattaaccaaatttcatgtacctgtcctcctatctctattgcagagcctgtcatcattctttttttttttttttttttgagacagagtctcgctctgtggcccaggctagagtgcaatggcgccatctcggctcactgcaacttccgcctgctgggttcaagcgattctcctgcctcagcctcctgagtagctgcgattacaggtgcacaccgccatgcccagctaatttttgtattttcactagaggcagggcttcaacatgttggtcaggctggtctcgaactcctgacctcgtgatccgcctgcctcagcctcccaaagtgggattacaggcgtgaaccaccgcacccggcctcgtcagtctttttgaaagtctaatagcttaaatactaacgattgccattacacacatcttaaactattaactatgctgaaaattcatttggatttgtttctttatgtcttgaagccatcctgtaatacccacttattgtaaagctggttaaaattcctctaaaatagatggaataaaattcatattgagcaagctttaatatgccattttcaaaagagaacaggtcaggcattattttgcaacagagaccaggttctagtgacatctactcagtgatgtttcccctgatatccctgttactgtgcagagttgaccatagttgtaatagctgttatttgtagaactcgatatagagttgcatggcttgggcacactacttatgctgctaaggctcagtttcctcacagacagagcaaggataataatagtacttgtctcatttagttctttgagaggttaaatgacataattcatgaaaagtgctttatttactcagtgctcattgtttagtaaatagcttgtaaatattacttattgttattattgagcataacaactttaaccacagtaaactgtgacaattggcaaatggaaacaacctcatgtcctccaatagggattggtcaaattcattatggtaactttagatgatagaaggattatgcagccattacataatctgttacagaggaataaatatcgacctctgaatatgctctagatctgctaagctaaaaagtaggctacaaacggtttgcttattgaatagactagaaaatcatatatgaaattgttactggtggttgcctttggaatgcaggagtttttaatttttttgttattttactttcgtgtttttctgctttcttcactgttttccatagagtgttatttcatagagcatattagagtgggtgatgttatatgcaagaaatgtatggcccttgtcactcagtgcaccacgcttcccatcattagatatccagttaatgatgaaaatggctatgcatatctctcttgcccatgaccccagcatcttgagattttataacacacacaactgtcgactgcattgcttatgtaaggccacacagagaacagactatcatcccccaaagcacccagtgaatgcttccattagggagcttggagcccactatgagagaaacagtcatgctcacatgttccccttagtcatttctgctgtttgggacacattactttggacacattaagacctacctatcccaaccttatttttttatgcctgcctgcactataaagattgaaaaaagttaatactcacttccctgtcttctttctattcaggactggtgaggtgatacaatgagacacttaccaatgtctatttcattttttttcatggatgggtgaaggcttatgcttttgtgatgacagtcatgactagtacatccttctctcttacttgtctagagagtaggtgcaattgagccactgcatttatcttacagccttaagggaaaggccaaaagattcccacagctgccagcaccgatatcactgagccgctaaatcaatgtgaacaaaaacttcttatttctagtcttctcattaagtgaggaaaataaatttctataggtttaagcagccactgggcagtttttcgatcactgtaaccccaaaatattcttaatagatacatttttcttaataccactgggatccagacctgatgcgtatctttttcgaatgttttgctataataatgattttcttcattctaaattagcttggatttctcctactggctcacctcactttagagtagtaaatctagcactcaaaagacttattttttttttaaagagggaaggaatttttgtgtgtgattatttgtgtgtctgtatgtgtgtgtgtgtgtgtgtatctgttacttgaaggggaggaagcttttaataataatgtacacctttgtcaacagtacatggccaagtacaattacgccctctcaagcatcattacccaacagatctatcacactgtgcctagttcactttttcctttgtcttctgcctagcctccttcaacaccactccaggatgaggaaagtgaaacatggggctgaacatgacaagaatagtgatcataatctatgtttcaaagaagaaatgaagcagaacgagcctaacggaaatttcagagaaagcttttagttctttttccctttcgtaaattctaacatctccctggtccttttgtccaggagttcagtactttcacggcagcctctgattcactgaaatgtacaatgtcttaccaaggttatccatccccatgttaaactctgttccaacataattatctccaataaaacttccctcttcttagtgtttgtaaagcaatctgatggcattgcactgaagatatagttatgcttggttttgcctagatcctctagccccgttatgcccctttgagtgtgacacagctcctagaggcagtctttggacctggttattaacggaagcttttcctcctcctttaacataagaacttcattttttatccccacatattaaaaaaagggatatcttcacctttaataatctgggaaactcacattgaagatttttacccaaaaagagaaaaaatagactccagtggaatggatatttctaacataagagaaaccataatcagacagattatgagaaaagtgaaacaaatctagtttgttttagctgaattgtctgtttcttacagggctatcctttcttcttactaaacaaggaaataacttgcctgactctgacaattacaaattactcttgtttgtagaaatgaccttattttatatgaccaacattacaatgtagcaagatgaccattatgaatattattcaataagtgcccagtttactgtcgtgtaaactgtgtttgcttacagcatttacttcctccatagtgttcagttttcatggttcattatttaagaaccatgcttacaaattttatataacagaaggaaccctaataaagtgtgagtagaaatagattggctttactgtaccatgtctagtggcttgagatgggttaaattaattttcaaagattatatacaaaggagaaaagggtgggtaaatttctggtaatagtttttgcaactttaatattttctgatcccattattcattttaaaagatgagtgcagtaaggctaaattgcattgttctaccgtcttcctgacatcttgatgacctaggttggcagggattaactgggggtttactccccaggctattccttttcgctgttataaataagtcagtgtagaaatggccttcactcattggattcacactctattttaaacccagaaaatacattctaacattttttattccaagtaatttataaacaagtttacaagtccgtcaaacagatttttgaatgactctattatccctcaggttgcagaaaccagaaaacttggaatcattatagaggaatttttgccttcaaataattgtccatgtggataccacactgaaatttctgaagcaataatctgatcactttttaatccagctcacagtgcatcaatgcttcctcagtacaactatgcttagtgataaggtcctctctaatttcgccccttgtttactttgcaattctcattttttgccatatacttccccaaagtaaggccttcataatcttgcactagtatggttacaagaaggcaaattattttacatttctggggctctgactagaattactcctctgcttatccttcaggttaagttctattaacagatatgtttttaaaactcagatttatccagattaaaaaggaagaagcaaaattatctccatttgcaaatgacatgatcttgtatgtagaaaatcctgagagccacacacacaaaaaattagagataaaaaatgaattcagcaagttttaggatacaagatcaatatgcaaaaataaattcatttctatgtgcttgcaatgaataattcaaaaatgaaacctaaagaaattcatttataggctgggtgcagtggctcacacctgtaacataacaactaggttttttatatataacaactaaagcgtaagtaagcaagcaaccaaacaaacaaataaattgaacatcgaaaaaatttaaaacttctgtgcttcaaaggacactatcaagaaagtgaaaagacaacccacaggatgggagaatatttttgcaaatcatatgtctggtaggaatttagtatccaaaatacatagaaaactgttacatctcaacaataaaaagacaaacaacctaattttaaaaatagaaagaaatttgaataggtttatccaaagaagatatgcaaatgcccaataagcacctgtaaggatgctcaaaatcattagtcattaggaaaattgaaatcaaaatcacaagagaccattttatactcatgggtaaggctataataaaaaaggaggacaattatttgtgtgggtaaagatgtgaagatattagaactctcattactgctggtgagaatggaaaatggtgcggccttttttgaaaacattttggaagttactaaaaatgttaaacatagagttaccatatgaccctgacatttcaatcctaggtatatcctgaagaacagtgaaaatatatgttcccaccaaaacttgtacacaaatgttcacagcagcattattcacagtagccaaaaggtggaaacaaccacaatgtccattaactgataaatgaataaacaaaaggtggtttttttcagccaaaaaaagaatgaatagtgatatgtgctaccacagaggtggatcttaaaaacaatgtaccaaaaaaataaaaaataaaataaaataaaaaagaagtccgactcaaaatgccacacattttagaattccatttatatgaagtgtccaggttaggaaaatccataaagatagaaagctgatgaatgttagccaggaactgagagaaagagggaatagcaagtaactgctaatgggaatggggtttcttttggggtgataaaaatgttctagaattagctagtggtaatgattgcataaccttgtgaatatactaaaaaccactggattgtatattttaaaatagtaaaatttatgttatgtgaattatatctcaatttaaaaataaattcagcttatctattaggttctctaggcaaaacttccttacttctaaggctactcccagcactccttctccaattacactactgcagctcatagttctaggcgatttagtgtagtggttaagcagctggacagaatgaatgtctttcttaaaattcctctgtagctgaccaattgtgagcaaattatttaattgcactgggcctcaacttcctcatctgtaaatgggataataatatacctcactcatagggttgttttgaaaattatctgaatcagtattgcaaagcacttgaaacagtaccaggcatggccaggcgcggtggctcatgcctgtaatcccagcactttgggaggccaaggtgggcggatcacctgaggtcaggagttcaagaccagcctggctaccatggtgaaaccctgtttctactaaaaatacaaaaaattagccaggtgtggtggtgggtgcctgtaatcccagctactggggaggctgaggcaggagaatcgcttgaacccgggaggaggaggttgcagtcagccaagattgcaccattgcactccagcttgggcaataagagcgaaactctgtctcaaaaagaaaaaaaaaagaaaagaaacagtaccaggcattcaataagtacttaataaatgtgctattaccattaaagcaattgttttatctattattatgatcgctataaacattcccctaaaattcatatgttaaaaccctaaccccaaggtgatggtattaggaggtagggactttggtaggtgattaggtcatgaggatggagtcctcataaatgcaatgagtgctctcataaaagagaccccggagagctcccgcatcccttttgcatgtgaaaatgcatcaagaaaatggccctcaccagacaccaaatctaccagttccttaatttgggacttcccagctttcagaactgtgggaaataaatttctgttgtttataagccactcagtttatgatattttattatatagctgcccacactaaaataattataattattatttggtatgtctctccagcattgtaccctactgtctatcactataggcacttagagatgtgttgtttttgaatggctggtcccagggtctaattgaagtcactcgtgcctcttcaggctcagcaactcaactatagtctggtaatgatatctttggccaaacagtatagaaataaacaacatggtgggttcagatcttaccaacgatccgaaccctaattagttgaaaacataccaagaatgttgcaatctgcttcttctaaaatacatttgctccaatgaccacagaaagaaagaaacctgcctttgcactagggtctttggaaattaatagaaagttctgagagacagtagttctgtgaaaaggcttagattttttggatgcctgaaagaatgcttacacaaccttgcagtaagagagtctaagaagaaaaacaagttctatcattgcttgtgttccctatcctgaagttttctctctccaaatgactgttttactcatcagtttataatcttctagcatgacatatatttttcaaagcgccaacaaacgctatttattctctacatgaacatttctcttacgtactccaggaaataaaatattatactcaaatgagttcagcttcttgtcctatatgccagccctggcaactgagctgtaagcaatactttttgaagttcaccctcacatctactcagcaggagtgcaaagcaagatgagaaagtggctcattactttttttgagggaggatgagttccagcaaaaaaattaaaaccacaaaatattttccttgggtgacatatactcagactcagcaaaagtaactaaaagataattttttggatatgtgtagctttacaagcaatctattaaaatattttgattaatacaacatattaattttgttctgcaaaataaagaaaatgcctatagagtcaccaggtttttctataacaataatctactaatgttagcttcaagccactctaggacatactgaattttcttctttcttcaatcaagggtttgatgttgtctaatgtgaaacaaggaagaaaatacatacaccttatatgtatatatataggtatatatacacacataataaataaagcaatagtatttgatctactagtcagtgaagaaatgttttatgattatagatacaatatttggaatatttgacaacatcactctaattttatcttctttacacagaaaaatgataaagagctttccctcagtttaacattgcaagcaatcaatgagattaaatgttgctttaatgccagaaaacaaaaacaaacaaacaaaaaagaccttggggcacattggagttgaaaggtcttttcaaactgcattcttacactctcccatttttcattcttttcccatatggctggaaaaggggaataaattttatgatgccccaaaatgcatatttttgagtttattcctgaagcagacagcttcagagaaaaaaaaatgaattagttcaattttccatgttcctctacctcctacagtccttcaagttactttgtggtcataccacaatcagctctgtccaccttcactcacaatctcctctcttataaaatgacccctaactctctcaggttctctctatgatttctgccccaaagagctctcttctctgacctccacccacatttcctgcccacgtaacctcagagtggctttttagaagtgtttacctctttgcagttgttatggtgcacttgcctcatcctgtaaaattgtggtgatgtggcctatttttctcatgagattttcagtagctttatgcactaatagaaaatatatgtgtggtttctgtgtgcaatctaggagaaaaaatagtaccattatgaagtagaggagtgaaacagtgggaaggggaaatgaattttccacgaacacatgaggttcaagagattttagaagttcattttaattggtagcccttagcatccactcaaaaaatcagaaataataatacttataatcacagcacattctggatggatgtagcttctgttagctaaacagaaatctagtttaaaattgcaaaaatctttttccctcccccgggcagttttgctcacagaaagcttggctgttcagctatcaaagccatttgttttcagtcttaactcttttgcagcaacagttaagccaaacccataatggaggaacatttttctaataacctgtgatatgattagcttctccaaagtcctaaactaaactattttagcttaatcccagttaacttaattgtggtcacactcattttatttttccttacctcccctcctgtcctttccctttcatattttttccttttttggttcttccaccattgaccatcttatgtttatatatatatatatatatatatatatatatatatatatatatatatatatatatatatatatataaaattgagatggggtctcgctctgttgccaggctggagtgcggtggcacaatctcggctcactgcaacctctgactccctggttcaagctattctcctgcctcagcctcccaagtagctgggattacaggcacccaccaccacgcccagctaatttttgtatttttagtagaaaggaagtttccccatgttggtcaggatagtcctgaacttgttatccacctacctcggcctcccaaagtgctgggattacaggcatgaaccacccgccccggccatgatttatattttttgaatgactcttacttcaactcttttcccgacaggggtcacacatgtagttatttaaatttctctgttttatgaaatgtctgtcaagcacctccatgctaaactgcttcaccctaaaatgggatagcgagcaagaccagacgtggtcctgccctcaggaagcttatggcctagcaaaagtgggtacctcattcacattaatcattccataacctcaaatgagacaatgtcctgaacgaaaataaataagatttttgagaaaaaattttttttaaaatgtgccaggactgagacactgaaaaaaagattgaaagcacagtctaagctgacatctcagggctgagtaggttactcttgagaaacaaatctggccaggtgtggtggctcatgcctgtaatcccagcactttgggaggcagaggctgcaatgcctgtatcaggaggcagagataaagtgtgattcttctgtgaaagcctcttctagtcagctagcgaacacatttgagtaaaacccaataacgacaggtatgtggaagagatcgccatgttgcagaccttttgttttaacgtgtccaacttggccttcctcaggattggagctaattttcacatgacacagctctaaccttttgcaggtaagaccttttcatttgatttttcctcctttccaagaaaagttttgagcgttattaaaggccaaagtactgaaactcttctggtggaatttttcttctttgtgaattacttacagtgggacgaatgattcaaaaccaatacattgcagagttggacggaatgtgaaacaagctcatctctgctgtttcctccagacagggctactctgctaaaccgtcaagcagatgaggtgttaatcttacagagctttctctgtaaaatgttctagggcctcacaacctctccactgggaagctgttcaacatcttactcctgttttgcactctaggtccatattcctctttattttaagtatagatgaagaactcttcacatacttgataataattggtttctctgatattaaaagaagtcatgggtactagatacaggagcagatccaagtctagatggtgtggattaatgtcaaaccaggcatatcttttttctcttttaatacttttatgggcttttcattttatttcctctgagaagatgaagagtactccataatcacaggaactctccatggttctccttgctctctcaacacataattaagaaattcctactggattccagatgccgtactaggaactggaattcggcagtgaacaagacaaccatgtttcctatcttcctggagcctgcagcaagagtggtctcaccctgccctcttctcctttcctctcctccctgtgtaatacatcatgggtttagaaatggaggaggtggtctattacccaggaatgcactttacatcaaaatcagggcctgtataactgagtccagactcaatccaaatatccacaagggaagtctagagagttaggaaaaccaaatctgtgagcaaaaatgtcaatggcaagtaggccaactgtaagtaagatataatctgggcacaggtgttgcagactaaagctcccttttgctaaggtgctaacataccaaaggggcctttaggcaaggcatccaggtataaaggcccaatggtaagaataacctattttcttttcttgttttttacataaaatgatacagaaagttagagtgattaggattattagcagggctgatgtgagaggaaaagattataatagttataacagcaacaggtatatcatgttttacaacttgacatgccttattcagtgtgtttcagtgaaaaggggtcaggcagacctgagtttcaatctagtagacattagcccttggagagcagaggctctcatgttctcatttgcattccaggctcctattattgaaccaggagcactgaaaggtattccacgaatgtgtgtggatgatggatgagtccttgctcggctgcctttgggcagtttgttagtagaagagtcctttctctcttcttactctcattttttccacattaaaaaaaaaagatagatcgggcgcggtggctcatgcctgtaatcccagcacttcgggaggccgaggcgggcagatcccaaggtcaggatatcaagaccatcctggctaacatggtgaaaccccatctctactaaaaatacaaaaaattagctgggcgtggtggcgggcacctgtagtcccagcaactcaggaggctgaggcaggagaatggcgtgaacacgggaggcggagcttgccctgagcggagatggcaccactgcactccagcctgggcaacagagtgagactccgtctcaaaaaaaaaaaaaaaaaaaaagataaatatgtatgttttaatattgtttggcgggggggagtcaaatgagaaagcagctggtacatggaaggtgctcaataaatgtatttctttaaagctttattattatctctgaatccatttacttaccatcaaactttagtggaactggcctcagaaacccaatttctggctaacacataaccctacattggtaattagaatcctcttctctttctgggtcttgctttgaagtctgaagaggacctgctcgctacttattttgactatggtaatgtttattgaatggctctaggccatttgaaatgagacaagtataaaaaatttaaattacagtattattacaccattcttaagtaattaaattatttcagaatgtaattttcatatattgaaatttataatatcaaattatatgcaattagacgcaatttctaagagatatgagggagaaatctatttaaattttctattttgccaaagttactcagttttaaaaccattcatttcacgtgattctttaattcttgtaggctaaatgactcactgaacaattcctggacagccctgccgatatggactaggaaaaaattaattgtccttgtatatctgtgctaagattttgaaatgattaaaatttgtataataacattaataatcattgtaaagtacagtacttctcatcttgaaaggctttcatttccatctttatgcaacccagacacattatgaacattctgcaaggagaggataacagcacaggctcacaatcatgaaaaggaatattgtggaaccatatgaaatttaaggtaactggggcaaaagatacacagtggggagaggcagggttgcagactggacttttgtctagtcatgtttttatgagacatgcacagtacatggagaagccaagtgatccctgtggacgatggagagtgagtgagaatgacaatgatccacttgcattttaaaaaagataagcttggggccgggcacggtggctcacgcctgtaatcccagcactttgggaggccgaggcgggtggatcacaaggtcaggagttcgagaccagcctggccaatatgatgaaaccctgtctttactaaaaatacaaagtaagccaggtgtggtggtgcattcctgtaatctcagctactcgggaggctgaggcaggagaattgcttgaacccgggaggtggagtttgcagtgagccaagtcacgccactgcactcaagcctggccacagagtgagacttcatctcaaaaacaaaaataaaataaataaaaaagataagctttgccacaggatagaggaggaatttgagtcaaaaagaactggaaacaggaatactagagaaggggttgtttctacagtccagttaagaggtgatgaagaactaaacaagaaaatgtactggtgatgggaaaaatagtaagacacctgactcaagaggtgttcccgaggcaaaactgacaggattggagatagagaattctaagttgacgccaatgtttaaaagcttgtaatatagggctgatgaggatgcagtgagagcgtggaggatgagatgtaggttactttggccgccatttgcaatttttgaatcaaaagagatccaccatggattattgatgagaactgttaatatgtgtttaaaatttcacagtactttcagatatattttctggttagagccatacaataactctgtaaaataggtagatatgcagataagagaagtcaagtcagttgagtaaggtcacatgggattaattgtcagattatttgtttattatgtcatgttactttttattaaacaaaatcagtgaaataaagctataggtaggaataaagctatttcacatttgaacatttatgaaatatctgctgtggatgcttaatatccattatttaatttaaaaaatagaattgcagaatttaaattatggaaaactgtgattgcaaataaattcaatgctaatgaataatatccttttgtgtgtgtatggttctgcatagaacattttatccttttgaaataaaagcaataatgaataagctttgttgaattgctaaaaacaactattaataagtctatgtgggtgatgttaacaagttgaatattaatgaagactatctctattatatttgtcatgaggccattgtctttacagtatgctagatttatgacatccataactataatagttaaacttaagatgaaaacattttttatctcaattaaaaatatgcaaatacatacataattgctcaaactcatttcagatgatgtgagcaaaaataaatggcaaaagaagcatcagttaaataacagtagacttgaatgcaggagacccatattccaagcccagctttgtgactgttaccagttttaggaccttggttactgtgatggttaactttatatgtcaacttgactggcctaagagatgctcagatggctagtcaaatgttccttctgggtatatctgtgagggtgttaactggaagagattagtatttctatcagtagactgagtaaagaagatcaccctcactaatgtgagtgggcatcatccagtccattgagggcctcaatagaacaaaaaggtagaggaaaggcaaattatttctttctttggagctgtgatatccatcttctcctgctcccagacattgtagcgtctggttcgtgggccttcagactaggagtgattacactactggctatcctggtttgccagcttgcagatggcaaatggtgggacttctagacctcataatagtgtgactgtctgtctgtctgtctgtctgtctgtctgtctatctatctatctatctatctatctatctatctatctcctattggttctatttctctggagaaccctgactaatacagtaaataaatttacttcatgtctctgaacttcagtttctttatctgaaaaattagagcatgaaaataaataaagaaaagttcttagagactataatgtactcaagtataaaatatggaatagccaaccaagaaaactatttggaaatatttcttgcaagatgcctacagcctaagatgtagaattcttcaaatgcattaaatgcttttaaaaatattgtttatagaatttatttttcaagttatgttcttctggtgtacaaaatatcccctccactgtctctaaaaaccttataaaaatacagttttttacagtttatagttaaacatgtgagtacgtgtgtgtgtgtgcgtgtgtgtgagacaacagtgtaaaaaagatggatttttctctttggattatgaacttcctcagtagataatttcaaagggagtgatttgtcaaaagactccagcagtgtcaccaaaatcagaaaatagttctttaaggtcatcatattaaaggccaagaatcatttacatgtagaaatcctgctgagtttgctaaaagtttgtctttgtttcacagtcacaagttgtatttctattcttccattttcttgcaagagaaaacactttaagtcacacctggcactgagctaacaccataagcaggctagctacatgatgatatttgaaacaaatttaaaattcacttaatgaactcaattattgtgtcagcttataaattttcacaccattcctaacattttcttgtcatttttttctgtcttgagaatgaggtatctgcagtggatactgaatcatcaatatcttctgcatggaactgtatctagtttcttcattgtactcacctatatagatgcaacacagaaaaagctcattgatacatagttcataatttgtaatagtgactctaagatagctttagtgtgggacagtctcagaataatattttgaatgaagcaaaagattatatactagagaaccaccaatgtatgagttaggactggtttccacctttccatggactatggtgacttaagcaaacatgcacttatttctacaaaacaataagttcagaagtacgtggtccgatttaagccttcttgtttgtcatgttaaactgtgacttattttctcatgctcaaaaatggctactgtatctttaggggaagaaaagagaatggaaagaagcagtgtctgacccactccactttaacattgcattaaaattttttttttcaaagttcaatggactccagttacactctaatatattcagtatatgtgtggtggcttgtcatgtactcaattacatgtcatatacccaagatcaaagacttactccatattcttcattgtttagctcctatcccatacagagagtaccacatatgatttatttttttctcattttagatttgaagtcattctgactcagggatatattaaaatgactgatacatcctaattaattttgagtatgtgtggcttgaattattgggacattgaatgctaaccacttgataaacagtcttgaagcttttgcacttggagccaaattactttgatctgattgagagcatgaaacagtccatattaggttttattatttctaggccattgcttcagtgtgagaaatccacatatcattctcactaccagaagctccatgtatcagtaatgccaagaatggaaatcctctcaatggtggtaccaagcctaagcacgatctttgtgtcagatgaactttgagatgctcatgatttcttccaaataatagtgtacatgtttatgtagtcagagaatcctccagtttcattcccctttatatatttttaatagagtctatttcaatatattgcaatataaaagttttctcttttctttctttttaacctatatcctacaatctagcacaagcccggaacatagtcaaaaataaatgttgaatgaacgaatgactttgcgccagtttctaagcctctgtaaactataatgtcctcattagtaagcatatatgtcaaaatgcttagcaatctggggtaataaaatgcattaacttggaatcagtttgcgtcccagatccacaatttatcatcttttagaaacttcaaaattaacttttaaattaatacatgcattcattcattaatttaactccatcgactgctctaaacactggaaacacataagtggaaaaaatgttttctagtagctcatagttcagtgtaagagacagagaccagtgcatgataaatgctctatttctttaccttcaggtgggttagtaatgcctgcttcccagatttgtatggactcagtacacaggaatccatgcctactctgccttaaaatatgcaaaaaagcacttttgaaatgttaaaatgatttgctaaattattttaacaacttttttgaaatgtgaaaatggtctgaatcactattttctcataaaacagggctagtaccatgcttgttgcataagagagaggctaattcattatatgcaaaggttacctgtgttgggagtcccacatacccgctcggtgagggtatttggatgaggattcacaagtcatatccatgactattggctatttgaatcagagcaactccatcctaaataggaactgggtaaaaataaggctgaaacctactgggcttcattcccagatggttagggcatttgaagtcactagataagacaggaggtcagcacaagatacaggtcgtaaagaacttgctcatcaaacaggttgcagtaaagaagccagctaaaacctaccaaaaccaagatggcgatgagaatgaccaaatgccatgacgacatcaggaagttgccctatgttctaaaaacaagaagcatgaataatccacctcttgtttagcatataatcaagaaataaccataaaaatgggaaaccggcagccctcaggggctgctctgtctatagagtagcgattcttttatttctctactttcctagtgaacttgctttcacattactctatggacttgccctgaattctttcttgggcaacatccaagaaccctctcttggggtctggattgggacccctttcccgtagcactaggacttattacatgcctatgatttattacatggttacaatttattattacgtggcaggaggacacaaaacaaaatcagcaaaggaaaaaggcacatggggcgaagttcagaggaaacagttaagcacagacttccaataactctttccgagtggagtcacataggactcacttaattctaccagcaacaaattgttacaacaccttgaaatgttgttcctgataaaagctcattagagacaaagtgcccaaagttgtttttggggcctggtcacataggtgctctctgcccaagatttgagactccgagaaggaaatcaggtgttcagtatcaattatattttttatacaaacatattttttatacacagcaaattacccttatcagacagcaaataaagtgaatcctcctgaaatccaggttcccaaatgccagacaatggtcaaccttgcaagcagtcctatctgtttagctgtttcaggcctgctctgttaaggctcttctacacaacgcctaagggcatttgattgaaaaagacacctggcctcttggggtctttgcaatgcttgctaaaggaaagtttgacaggtgagaggtgcaggaatagaatgcaactttttatcccctccccttctctgggcaaaaacaggtgaaagattggacaatagattaactatgtcatctgcttgcccacctttctgattttgctgcttatcacagtattcatcagagatagaacagaggtgattttaaaactctagtacattgcaagacaccttcagctgcattcatgaagagtgctgtttatattgtgtttctgtgctttgcatgtactagagcttacaatttaaaatcaaccactgcagaactctttggtaaagtgagaaatccatttataaggttcatttcttaagtcattcatcctgtaagttcagaattgaatgttttgagattctttaaggcacacttgtggggcactggagctttttacagctgagtttccacatgagtcactccaacatactgaactgcctggacattactgaatttagaaaagcttctcttggatttcttgttactatatggtatttgtgctttcaacttagtttctcttgctcaaatatttagtttttgaacactggatataattgcacagccaaaaataaatttttacacctctctaaacaaagcaagaaactgtaaaatccacaattagtatcatgaaatcttattgtaattttctttctttctttctgttctttttttgagatggagtctcgagtctcgctctatcgcccaggctggagtgcaggtgtgatctcggctcactgcaacctccgcctcctgggttcaagtgattcttcctacttagcctccggagtagctgaaactacaggtccatgtcaccacacctggctaatttttgtatttttagtagagacagggttttaccatattggccaggctggtcttgaactcttgaactcgtgatctgcccaccttggcctcccaaagtcctgggattacaggcatgagccaccgtgccctgcccttattgtagttttctgaagatattcttgctggtgttattttaggaatgtggctaaatggcctttatctgagaaagtgagttattattttagggagtggcaaaagaaaaagaagtgtgtgggaataaaatgtttaaattgctgttttcttagcagctataatagtgcatgcagctgccaggactacaatatttagaaaattcaaggatatttatctctaccttaaaatattttgaagactatactcgcttacatttgcagttctttgaaatgtgataatggttgatcaaaagtaaaaagatattttcttgattcaacattaatcctttcctggagtaactttacccccaaaaaattaaaataaaaggcaaaaaatatttttttcttgctagaattttaaattctggagtaagatttgagactgaattctaactgttttcagtatgtggtacagtttaaattaaaatatgtgtcgggtttagtcataatgtccttataccatttatgttgtattcaactgaatagtaacactgtcatcataaatgctacatttatctagattttttaagtgtatttttagagccagacaacaatgcaacagcatctatcccactatttttgtctaagcactgctatattaaaaagcttattgtttctagggcttgttaatcttgaagacatgatttatttctatgggactaatttattcaattcgagcagggatgatagaaaatactagaataaaagcaaattactttatggatatgtgcctgtgtgtgtaattggacacaaagaacaattagaggcataaaaatgttcaaataaatgcattttttcagagtatgaaaaatatatggcatttttaatgtcacctataaaactacgtataatctataaattatattatccttattgggactattcattgatcatctaaacagaccaatacaaattttctaagatagtttctttttttttttgtattttattcttcctattctaccttgatttaccaagatatgaaactacaaatcaataacatggggaacttggaaaatccacaaatacatgaaaattaaaccacatgctcctgaatgaccaataaattaaagaaaaactcaaaagggaagttaaaaaatattttgaaacaaatgacaacacaacatatcaaaatctatgggatgcagcaaaaacagttctaggataaaggtttataacaataaatgcctacattaaaaaagaaggtagattccaaacaaatagcctaacattatgcctcaagaaactaaaaaaaagaagagcaaactaaacccaaagttagtggaaaaaagaaaataataaagactagaatgaaataaaagggagcagaaaaaccatttaaaaatagtaaaaccaagaattagttgtatggataggtaaacaaaattcacaaactcctaactacctaaggaaaaagactcaaataaataaaatcagaaataaaagtagaaatattgcaatggaaacttcagaagtaaaaatgattataacgggctattataaacaattatgtgcaatatttaatcaggaagaaatagaaagcttgaatggaccaataaaaattaagagattgaaatatgaattcaaaactttgcaacaaagaaaagcccaggacgagatggcttcatgaatgaattctactaaacattcaaagaagtattaccaatatttaaattctcccaacaaatagagatagaagaaatacctgcaaacacattttacaaggcaagcatcaccttgatccctaagccaatgacatcacaaaaaagaaaactataggccaatatctctgatgaacattgatggaaaaattctcaataaaatattagcaaacaaaattcaacatcacatcaaaaagattatacatcatgaccaataggatttatccctagcatgcaaggctggtttaacatacacgaatgaaacaatgtgacacatcacattaacaggatgaaagataaaaaacacagaattttctcaatcaacacagaaaaagcatttgacaaagttcagcatcctttcctgataaaaactcttaacagtttatgtatagaaagaaaatttctcaacataatataataaaggtgatttatgaaaaatccacagctaacataataatcagtgggaaacagttgaaagctttttcactaagatccagtgcaaagcacaaatgcccacttttgctacttctattccacataatattggaagtactagcaatagcaatcagaccagagaaagaaataaaaagcatttaagtcagaaagaagaaaaagtaaaattatctctatttgcagatgatataatcccttatgtagaaaaccctaaagattccacaaaaaactgacagaatgaattaattcagtaaacttgcaggatacaaaatcaacatacaaaaatcagtagcatttttatacactaataacaacatatctgaaaaagacgctttaaaatcccatttatgaaagcataaaaatagttagaaataaatttaaccataaaggtgaaatatttgtataccgataactataaacctttgataaaaaaagttgaagaagacacatataaatagaataatattctgtgttcatgaatcaaaaaatttaacaatgttaaaatgtctgtattaaccaaagcaatatacaaattcaatgcaatttctatcaaaatttcaaggatatgcatcacagaaatagaaaaaaaattcttgaaattcatatggaaccacagacacataaaaacagaataggcaaaggaacaatgagaaagcaaaacaaagcttgaggcatcacacttcctaagttaaaattatattgcaaagctacagtaatcaaaaacagtatacaaatggcatgaaaacgaaaatgtggaccaacggaacagaatatagagagccagaaacttaactaattttcaacaagggtaccaacaggacaccctgaagtaaagatagtttcttcaataaatgattctgggaaaattggattgcaacatgcagaagaatgaaattggaccctaatcttgcaccatatacaaaaatggactcaaaatagataggagacctaaatgtaagatgtgaaaccataaaactcctagagaagaacatagggggaaaaattccttgatattggccttggagatgatttttggatatcacaccaaaagcttaggctacagaatcgaaaataaataaatggaactacatcaaactacaaagtgtctgcacagtaaaggaatcaatcaaccaaataaaaaggcaacatacagactgggaaatatattttcacacagcatatctcctaagaggctaatattcaacatttgtaaagaacacttacaaatgagtaacagaaacaacaaacagcttgattaaaaacaggcaagggacctgaacatacttttctccaaaggagaaataatggctaacaggatatgaaaaggtatacaacattgctaatcattagggaaacacaaatgaaaaccactatgagatatcacccttcacccattaggatggctattataaaaaaaaaaaaagacaagaggttactgctggtgagagtgtggggaaaagggaaatacagtacactgttggcgggaatttagatttgtgtagtcattatggaaaacagtgtggaggttcctaaagaaattaaaaaatagaccagcaatgacccaacaataccttttttggggattgacccagcaattcctcttttgagtaggtaaccaaagatgataaaaatcatcaccttgtaaagatatctgcactcccatgctcattgcatctattcacaatagtcaacatatggaaacaacctaagagtcaggttgacagatgaatgtataaagacaatgtggtacacacacacacacacacacagacacacacacacacaaacatacactgaatattcttcagccataaaaaaaggtgatcctgccatttgccatgacatggaggcatgggtatacctgaaaaatattatgctaaatgaaataagccagatagtaagaaaaatagagtcatgtatcatttaacaacaaggatatgttccgaaaaacgcaacatcatttgctgattttgtcatcatgtgaacaacacagagtggacttacacaagccgaaatggtatatactactacacaactagtctatgtggtatagcctattgctcccaggacacaaacctgaacagtgtattactgtactgtactgaatactgcacacaattgtaacacaatgggaagtatttgtgcatgtaaacttatctaaaaatagaaaatgtatggtaaaaatgtggtattataatcttatgggactaccatcatatatgtagtttatcattgattgaaacatcattatggggctcatgactgtactacatgatttcacttaatgtagaatcttaaaaaagaaggtcaaatatgcagagatagacaataagtggttcccagggatggtgggtgggggaaaaaatgagatgaaggtcaaagtatatgaagtagcagatatataggatgaacaggtctagaggtctaatgtacaacagaagatgataatagtctataagagtctaatattgtagactataatagtctataacagtctaatattgtagactataatagtctataacagtctaatattgtagactataatagtctataacagtctaatattgtagactataatagtctataacagtctaatattgtagacaataatagtctataacagtctaatattgtagactataatagtctataacagtctaatattgtagactataatagtctataacagtctaatattgtagactataatagtctataacagtctaatattgtagactataatagtctataagagtctaatattgtagactataatagtctataagagtctaatattgtagactataatagtctataacagtctaatattgtagactataatagtctataacagtctaatattgtagactataatagtctataacagtctaatattgtagactataatagtctataacagtctaatattgtagactataatagtctataacagtctaatattgtagactataatagtctataacagtctaatattgtagactataatagtctataacagtctaatattgtagactataatagtctataatagtctaatattgtagactataatagtcttctgtattaggttaaggctttttgttaaataagtagattttaactgccttttccccaacccccacccaaagataactatgcgagatgatagatacgttaatttgattcaccatagtaaccattttactatctgtagtttttccataacttgtaaacctcagatatacacaaggaaatttatttttaaaaagtgtacttgtcaaaatatgcttaaatacagattcaactttcagtttttaaagattttaacataaataatttttaactattttgctataatatacattaatataaagaaacaaatgagaaaaaaattgtcaggccattatatagttcacttatatgacaaaatgaagggtttcctttcaaaattatgtgtttgcatcactggaatttagagaaatcctcatagcttaagtattggaactattgtttataaaaatgcagagtagaagaccaggcacagtggctcacacctgcaatcccagcactttgggaggctgaggtaggtggatcacctgaggtcaggagttcaagaccagcctggccaacatagagaaacctgtctccactaaaaatatgaaaattagcaaggcatgatggcaggtgactgtaatcctagctacttcgaggctgagacaggaaaatcacctaaacctggaaggcagaggttgcagtgagctgagatcatgccattgcactccagcctgggtgacagaatgagactctgtctcaaaagaaaaaaaatataaaaaaataaaaatacagagtataaacaagctaattgtaccagtgtttatgaaatgtctagtaaacatataagttgttaaataaaatttcctattttagtcatggatgcatacaagtaaatagatatttataacataatctgataagtaaatgttctaagttaatgagaatactgtggaaatccatagagtagcacctaaatctaccaatagaaggtgttaaatttatgaaggctttccaaaggggtaatacagaagttggactatcattacatggtttcacatatatcacactttaatttgtgattatccacaatttcttatattttaaaacaatttcaaagtaaaatctggcatactcagcattagtaaatgttcaaaatattagtccaaacaattgttactttaagctaaaattatatggatttgactcttcatttccttcttttgccataactttagataccacgtctagctgaaaaagaaaaaaaaaaaaagaaagaaatttagccagtactgaattgaaattacttcataatgttcacaagtagggtggctacccgttctggtttattcagggtctcttggcattttatcaaacttccatgtactggaaaaaccctaagttccagcaaaatggatggttggccattctacccattggctcttctcaatcaatgtgatatatttccacacttctatttgcatgtgtgcattgaagtgaaaaaaggttttggtaaagttatgtcacctcaaggatcagaagcaggtactttattcaagtaagtatgaaagcatgcacaaaaaagatatttcctatataaatagcaaaaattatagaaggcaaatctaggagtgatgctataattgatgtgaacttttaaagtgaaactgaagttcataaaataattttacttggatttcttgtcctccaacttcctcctgtccatgtttttctgcctcataaacacacgtacccacatattcagtcagctcctcctatattttatcaaaacaaaacaatatgttctttaacccaatgtcatgtagcatggtggccacctcacctatgaatttctctcttaaagtttaataagacattctatatctattatcaatttactagatcattccacatcatgtgccactggagactattcttccttgaatttctcccctctcttgatttattgacacaataccctcccagttttcctctttcaaatccttggcaactttttgcctatctgtttttgggcttcccttatttcactcacccttaaatttaaatatttatattcctgagagttttgtcattgatttgcttctctctttaatccacacactatgcaagcattgcagatacaacagtggatttttctaaaaagataaaaatttctatcatcatggagcttaagttctagtgaggagaaataaacaaaaaataagtaaaaaatataaacagtttatcatatggctctaagtgctatgtagaaaaataaagcaaggaaggaggctgtattatactcatagagctgccttgacaaatgaccattctcttggctatttaaaacaactgcaatttattctctcacagccctggaggctggaagtctgaaatcaaggtgtcagcagggacgtacttcctttaaaagctctaagggaaaattattctttgcctcttcatcttctagtgactccaggcatttcctgactttaagcaacatcactccagtctctgcctccatcttcacatggccttcattcctgtgtatgtccacctttccatgtctccatgtctccaaatgtcccttgaggacacagtcattggatttaaaacccaaccaaatccaatatgacttcatcttaacttgattgcacctaaagagactctatttccaaaaaaggtcatactcatagggtctggatgaacatacatttttgagatacactattccactaactagagagactgaaaaatgcttgttgcagtgattgatggggaagatgaggaagtcagtggggtatctctaaccaaatagctcataggcatttcaaactcaacatgtccaaaattgatgtcatcatgacagtctcttaaaaccagcttccaagcgcttgccaaatgctgttccttggctagaaacatggggataatcttagatactcaaactgtctccatttcccaacaaactcgaaaccctgtcaatcctacctcttagaaatgtatcaagatatctccatacctaattctactacctctctctaggccattcttatttctgtccaagttttccaccccaattctctacactgccttaaaggaaacttctaacaagaataatagtatcatgtcacctctttgtaaaatatcctataataactctccaatatttgatataaaatatggtttcccttacaagtaaacagaaattccacccagtttttcttagcagatgcaactaaagaagctctaatgactcaaaagtctttttctgtggcttccataaacatttttcatcctgtaccaaccaataatctcagttcttctcctactacatctatccaaacttcctcaaaccagctatactcaaccagcttctactttctagccagtttcagctgccatcatcatcactccctcctcttcatgagcatcaacaatgtatctgatagtgtttaggcactttgtgaatgtaatttttaattcacttaacaatcctaatgatagaggtcttgtgattcccaggttatacatgaaaaaactggaacacaagagcttaagtttctttcctgcaggattcttaatcatatgaaagatacagttttttttttaacttacaaattggagttaacagtatctactctattgaactgttattcaaaggattaatttaacaaggatcactacactttataatcttttcatagaagacaaagtggtggtgaaagcaaaggggctgtctgtcataaagttggtcctgagcctataacaggattaaagaactgcagtttccatcctggcagaccttcagcccttagactcagtggggactacctaacacaaccatagtatagaaaacgggttcatttattcatttagcaaacatttattccggatctttcatgtaccaggtactaagattaaaagatatgttttttttttctaaaataaggccccgtcctaaagatttcatcatgcatacaggtacattgctatattactctatttataaagcaataataactttactccttctacaagtactgaatatttactctgagtccagtaccctagtaggtattaaaaaaaattccaaaattctaatctaccagggagaggtttacaatgtccatactcagactgtacaatactctccatatcctatgagtcttcactcatcccttcattctcctgtattatttgcatatgtctgtatcctgagctcatccacaagcaacaggatggaaaaaagcgtgcttcttgtttatttttcaatccctcaccatgtcccacagagcacaaagtaaaatagaataaaatttagccaaaggctggtacctgaaaaatggctagcaataaaaccacagttattaaagacagagtgcaggttgcaaaatgaataatagttactctgcgcatctgccctgtggctactctgggccctcagaactgtctagggcatgatctcaagcaggtagatcagtgtgctgatctgttggctgaaggaaaaaagcgtaacgttcttggtgtccgttctactctccagtacaggtttggcattatgaaaggaaagaagaggggtagaagcctccttaggaaaaagagctggcttttggtgctgaaacacctgcctagagtgtttgaccactgctgtgacttgtagcaaaggtctttatttagtgctgcataatctcataaacacatacttagggcatgagcaaaaggtgcccccaaggagtcttttttttttttttttttttttttttttttgagacagagttttgctctgttgcccaggctggagtacagttgcacgatcttggctcactgcaagctccacctcccaggttcatgccattctcctgcctcagcctcccaaatagctgggactataggcgcccgtcaccatgcccggctagttttttgtatttttagtagagacggggtttcaccatgttagccaggatggtctcgatctcctgacctagtgatccacccgcctcggcctcctaaagggctgggattacaggcgtgagccaccgtgcctggcccccaaggagtcttttgaaagcttttgatatttgatactggaagaaaaaatgtgatcataggaaaatcagaaggtcatatgaaatttttgtctttatcattaaaactgtttctcatcacataagaagaaagcaccaaaacctcttcaagttttaagacttgaaaaagttttcacatggcccaactttaagtaaaaattagagtctgctttggatgaagctacctcttccacactcggtcagactcttccttatttacagcccagctataagtctgtccagggcatttcagaaataagtaattaggccataattatttatgcaaatttataaagcctagtcataggtttaactttctttcttcaattctcatgtttaactataatggttattttacagagaaataattctattttttcccttgaaagtactatacaatgactttagagattctagaataggtgactctatcttgtttagtcattatcaattttaaattacaaccaaagaaacagccaagcaaacatgaacagggtttctcataaatatacatctttaagtttcaaagagacagagctaatgaaactgtcactttgaatgctaaatggagctcttgatgtgcttacgttgaatcttctctagattttctcatacacgaaattttgctagtttttttttttttttcagcatcagttcaccactcaattaaaggttggtgcagaatcaggagaagccaaggcaaagaggagcccagaaaagctcttgtaaacacaagagcttttggtattggctgactcagagaccagctatatttcatgaagacaaaaccagtccagccagggtcctatgactgtgcttgtcacctcttaataacctgggtcaccactgatccattttaccagtctccatcactgctctgtgttgatgactagcatccttgatcagctgaagcatcaaaatgatcgggctttaagtcagaatatttaagagcaggtatttccagtcatgtctcttacgtgtactgttgttggtcattgagcataaaactggtccttcccactctttgattacataactgcctctaaactgcctagactgagcccctcacagcttcacaaacttctccaatgcctccctatcaaaccctttccattgacatttctgaggcctacattttatcataaaaatgaaaacaaagaaacaacacctcttacatattctccaattgtatagaacaatctttctattgcttatttttactgacacatggcttagtccagtcccaaataaaagacacacatgcctctgaagactcctgtcctgagagctatacttcaacctctttatcctgaacttcacatagaaatttttgaaatattattttatgcttacttctatttctcatttctcattcactatgcagccaactaaaaatgattttaccctttatcactctagcaaacagtctttgatacacatatctatgatcacctaattttcaaattcagtgactcatttttcacatttttttttattggactgttctgttgcattagacactgtggaaattctgaaatctctaagctttcctgatgttgctctaaatctctcaccattccttcctacccttcctcacctttaaatgtagatttgattcattatatcatccttgatctcactccataggtttcctggagctattgcttcccaactctacattcctatttgctatctccttgctgaaacttgctcatctcagcttgcttggctgattcttccagatttccgatgcttccctcattgctagatgttaaactttcagcccataatctttttattaatttattatttatttatttattttttgagatggagtctctatcgccaggctggagtgcagtggtgcaatcccagctcactgcaacctctgcctcccaggttcaagcgattctcctgcctcagtctcctgagtatctgggattacaggcatataccaccatacccagctaatttttgtatttttagtagagacagggtttcatcatgtaggccaggatggtctcgatttcttggcctcatgatccgcccgcctcagcctcctaaagtgctgggattacaggtatgagccaccacgcctggcctcagcccatgatcttttacactaaacagcacatacatctgtgcttcttatctgaattgactataccactttcttacccagtcacccacactggaagcatcttggaccatccgcaaccaggctttcaacaaatcaccaaatactgcaaattttagctttaaaatatgtatagaatctgatgttttccacttcatccaaagaccagtatcctggtccaagcttttagcaatgtctgaactcctgaaatagcacctaacttagttctcaaccttgagccttattcttctcatatgtaaactcctaagcaatgctctacgaagatacaaaaatgactacgtcattccactcctagacttatttcttacaactgcctgacttgtactttatgtagatctctcaatccatcaaccatttcgcaatgatgtgcctctggttttgtggtggtcttctccacctaggatgcctttctgttacttctacttgcaatcagctcttcttcatctgtccattaaggcacagcccagtcaacatttcttctaggaaggctccctgaccttcccttcttgcattagatgcaatttctcagtcgttctaaaatgagtaattattatagctgtcacttaactattttgtatttatttgatcttatgtctgtctcctcaacagcctttgagttcttcgaggaagatggctgtatctcatttatctaagtagtgtcagcatatgcaagttgctggacacaaaatagtcaataaaactcttaaattgacaacttaggaagtgatccaattttaattttctttcgttcatgaaaagtagggataaactgtgtttttcatgttcagagattgatgaaattcatgggatatttctgaagatctttaaacattcagcatataaaaattatgaaatacatttcttgtgtagtaatttcctataagggatattctgactgttggctctttcttcagaaactaaaatttcttagaaaataacttatttggattatcatctaattcagactttctttcaagcagaaattttatccaggctacaactattgatccagataattattcttatcattacttcttgtatcagtctttgaactacctttgtccatgttgttctgcttctagcaaagactaattaattagtagaggagaacatgaacatcagctgaaccgctgctgtaagaaggtagagaaagactgtggagaaaatatgggctcagagatagacacactggattccagtctcaaccatttaatgcctgagtgacaatgagcacatttctcagccactcttggcccatttcatgtttttcaaaatgtgaataacagtgttactcggtataattattttgagacgacatgagttaatgcttttaaaatacctggcacaataatttgaattcccctttccccatgagagttgacatgcacctactggataggaaagcctaaaagaactaaacacatgtttcagtatttaactatttgcatgctctctaatttctattcacatgtataatgacaacaggtcttctcaaaagatgatttctcagtaaaataaaattaaggcaagaatgacatgaaataatttttccaacgttagtagtgaacttatttctgctttacttgactggttgccaaagtttttccttgactatatgaaagaaattgggtaaacttttcttaattggcaaaacaaatccactccgaagtaaaagttacgaaacagatgttttctgcttcttaatagaaaagctagtacagaaaggaagttccaaatggaacattctggtggtgccaaaggaacggagaaagaaggacaaaagaagaacttttaaaggtagaaattctcattatgatgattgattatttaaacaaggttaatttttcgaggcttatgaacctggtaaatttaagacggcaaacaacaaaatgctactgctaattagacatccaatgaaatgccatacagaaaggttaactattttaaaaaatgttatgtaatcttctatttcaaatgtcattgttattagttttgtaatagagctcactgacaaaacagacatgaatatatcttccagagagtgaggaggaaatattttattagttgtccagtatatagagaaatgagaaaaatattacaataaattttcatccttcatttgaaatattcacatttaatcatttctgtaggaccggagttattttgctttgggcagacctgaccctaggcagatttgaaaacaacaccacaatatatgcattgagggcctactatgtgctaagcactgaggaaataacagtgaacaaaacaggttaaggtttctggccccacggagggattctagtaggggaggacttgaaatagggaaattgtagtgtaatgtgatgtccagtagtaacaaacactaggaagaaagaccgtttagagattgttattttcctgaccacccagcatagcaataatggaaacgtttggctggggttccctcaatgcattccctggccactgctgcaatgagtgagagattaagtgagtgtgaggagaagaattacatggtgagcactggataatttccccatcttaaccaacctgtaaggcagcctgaaccatctccatcctccagataaaacagctaggatttaggaaactgaaggaactcagcccaggtctctcagctagtaaactgttaatgcagtttctctgacccaaagtctgtgcaaatagaacatctccaaggatgcagaggcagtgaatcacagaagtagctgcattgcttctcctttaaggtgtgaataataagcaccaggtggtttgtgcgtattatcttctttggtccccaccacacaactatgacgtagggccattattatccacagtgctcagataaggaaactgacactgagggagggttaaataatttgttcaaagtgatggtaggtctataatacaaactaatctctgctatttccttcttttatttttatttttatttttatttttgagacagagttttgctcttgttgcccaggctggagtccaatggcacgatcttggctcactgcaacctccgcctcccgggttcaagcaattctcctgcctcagcctcctgagtagctgggattacaggcgcacaccaccatgcccagctaatttttgtatttttagtagagacggggtttcaccatgttggccaggctggtctcaaactcctgacctcaggtgatccacctgcctcggcctctcaaagtgctgggattacaggtgtgagccaccgtgcccagcctctgctatttcattctaaggagcttatgtacttttccttgaggttgttgacttcaaccatgaatcaagatcaatatgtttgattaagaatgcattgatcaaaataaggaaatcccagagtacagctgcagaatgtataaatgcaggcattgcatttttttattcaacctataattatttatgttgacatttattactacatatctttaaaaatataaccaactgaatttggtgaggaattcagtgatgctataatggtctctgttcttctgaagatgtgtggctgccaggatagtggtttgtggagcatcagctacaaatgctcttagaaagcagcagtgtgcatgccaaccagtttatagcctataagactgtattctcttcttatgaaggttgagcatctattaatagctgaagctaccatttgtggcagaggcaatattttaatgcttaagagctgggtttcaaatccttgctctgcaatttactacaaattacttgctgcccactgaagctttttgttaaatgctcattatattgctgaatgcttattatgggccagggactattctgtgcactttaaatttaatcctcctaataatcccaggatggatggctaaccccattttatggaggaggaaactgagctcagagaggaaaaatgaatcatgaatggctgtacaattaataaactgccaagctggttttgaaccccaggtgtctctaatagtttcctccactacatgacactgcaggaccaatgagaaacagtattgagactatataagaaacagagtcagctttgtaatcagggctaagcatttagatcccatactagctcaacaaggcactgtttctccagttctgtcaaattattgacaattttgatttgtagtccaatctagaataaaatgtgcaagggacatattattgagagcacaaggaagactatgaatgtcagagagaagaatggaaaggttgattctgagagtctaaaatagggaatgggttagctaggttaatcaaggtaatcacaggaggccttgaccagttgctctacctaaaactcagtttccttcagcttctgtaaagtagaaataatcatacctagttcattgggtgattatgatcaaaagtgtgaaaataagaccagcccctagctccattcctgtgcatgcacacattgaccatagatagccctcaactcaaccccacgttgatcatgctccatttttctcagctgcagtgcccctgaaagggaatctctggccaccatgagtgatctggaggagcagtttcatgtctatgctgagggtgatttccatccatgacatggtcatgagaaggacaacagagacaccttgaaagggactggagttgcatttccatagaccaaagactaatgagccactatccctttcactcaaggtgactactgagcaatcagctatgattacacacccctccatgactgaggattctgatcctaacaaggcataatggaaaattcacttgtgcttcacttcacacatgatgaaaaactaaaatacaatgattggttttctctttgtcagccagatgggttcttcctaaatgcaaatccacagaggctgccccactgtgatgaggctctgcactcatcatggcagagacaaagaaggtttgcgggtttgcctggcagcttgcccgaggctttgcatcggctttgggaaaaccagaggcctatctaagcctcaggctatccatctgctgccaggtagccctccctctgccttcatcctaaataaatctgttttggaggagccaggaagctttggggacaagatctattcactaactcatatgtaaaaatgccacctacatctggcaaattcaaatttctgttttctgagcacgtgtttatacttatttattgcctctcttaggtacagttagatctccatgaaccagttcaatcagacttaataacttccccaatgatcctagccaaaataagaatgtacctgggaagagaatcttagcctcagaactgcagttcagaagagcagctcttcttgaattctaccacatgcctttgaatctcaggagatctgggccatcaaaagtccatttggttccaatgtctcactctccagagtgtggttgatgaaccagcagcttggacatcctttgggagctgtgactaattcttaaaaatgcagaatagcaggtcctacccagacctactgattcagggcagcaatctaacaagaatccaggtgacttgtgaacacactgaagtttgcaaagtactggtttggaggtcattcaaccatcttattttccagagagggacactgccaagtgactttccagaacatcccacagcagggtccatttagaattccaggactcgaattcagttgtgttggcaagaacatttagccctatcttgaaatcttctgggcctttgtttccgtaacactaaaatggggacattcacaactgccttgcttccttgttggtatacaatgtcataatatatatgaaagcattttatttcaaagccttatgcaaacaaatatgtctactgttatatccaaccaaactcacttgaatcttaaaagatgtgtacgtgtgtgagtgtgtgtgtgagcaggagttctaggtatagaactgggccatatatgacaaattttgccctactttagaatgtaacctaattctcagactgcttgccaaaaaaaaagaatcctttctcctctaactctcaaaacggttcttaaaatagatgggccccccagggactccccgacatgtttccactgttagagttcaggcagcctgagatcaacgggttttatttcagatgatgttcgatttggggacatgagctcaggaggacacgtaacaggttagaggtgagcagccctttgtatttttaactttaaatcatggcagtcgctcaaatcaactatagtttagtagacaaagggaatgagaaagataaatataaggactgagagaagagaaagaggataaacgtaaggagaaggctgctgttgatagtatccactcattaaaaaaatactgagaagtttatatatgtcagacactgctctaagtattttggacacggtcatgaacaagaccagcaagggtcctcactgtgtatggcttatgttctggtggtggtgggtaggaggacaaattgaaaagcaaacatatgtccaggaaaacttggggtaggaaaacatgctttgagaaacctagctactgcacaggttctgcctatggttggatagccagagtgactactctgagatggaaattcaaatgaaaccttaaggagaagaagccatgtgtagataagggggaagagcttcccaggcaatgtgaatgctccgaggtgagaatgagctggggagtttcgagaaacagagagaaggcctgagtggtcagatggtggtgagcaaatgcagaagacgagttagcaaggttgagctaggttggatcatgcagggcctgtgtgtacacttaggaatgcggacacctgtctgagtgcagtggaacgtcattgctagctcaactagtgatccactgagatgtagaaattggaatcttggaatctcagcacgcagcacaggttaatagactgaaagcaggaaaatggaagtgtattttctcattcttctttctgtccttgatcttttcctcccttcaggtttttatcaaattcttattatgtgtcaggcaccgtgtcttagtgagcaatggactaaccttcttatgaagttaaaatacattcattggtgtgagttagtacaggatacctattccaatctaataaaatgcaggcccctaatgaaatggggtcctaatctgtgggcccccattgccaacagcagtggctcttaattgcagattgttacagtgaagaccttgttgcatgcaaaaatactaggattccattcagatgtattgaataagaatctttgaggatgagcctgcctatatgtatttttagtatactgcataagtgatgctgccagctgtgaacgtcctcttcttgagcctctctctggcatacctggcataccttctttgctcccctaagctccccttagtcttgagggatcagtgcaaagtctgtttcctctgttatcatcactctaacttacgtgactttgcctgatattcctagtttttgatgttttttagttttagttttagttttgagatggattctcactctgctgtccagggtggagtgcagtggtgccatctcggctcaccacaacctccgcctcccagcttcaagtgatcctcccacctcagccttctgagtagctgggattacagacatgcaccaacactctcggctaatttttgtacttttagtagagatagggtttcaccatgttgcccaggctggtctcaaactcctgccctcatgtggtccacctgcctcggcctcccaaagtgctgggattacaggcatgagccaccacacctggctgatattcctagttgttaagccctcaccaatcactcgttctcagctagaggtaagctccttgaggacttgagctgattccttttcatttcatcctcctagtacttagcctactttacatgaatttttaatatgcaaatgattattgccgctgattaaaataacctaaatacagagaagcctgaaagtgtaaggaagctccttaactttattttggttccttctgagataaggagaatgaatcataacaacaacaacaacagtcaacactgacgttgaaattgttaatatgtactgaacacttaccacatgcacatactgggctaactacacacggcagctcctaatctgttattcctcatttacatccctacatgcagttccctgcatgtgaccctaagaggaccagcttggtgggaaatgttctcagtaaacttggatcccagttccaactcatcactgattaatggtatggtccctttcaatctctctgagcctcagtttacacatgtggaaaatgagatggtaaactcttgccttttctcttttccagggttgccatggaaagccaacgaggggatacagtcagtgctgtgaaaacacatgttaaatgaagaagaagaaagataactcctgcttctgaggcaacaccagaattccagaagcagcagaccattgacttttctgctccagatttggaccttattcatttgcaatatttccaagttgctggttaaatctgaacttatctaagaaacaggtagtaagtgaaagagaatgtgagtcaatataatattggatgcctgaaaagtgcagcaaagcaaaatttaataagtattgacccaaatctttcatttctagttcaatttgacaataacctttatttttcaattaattcagccagagtttccctgagtcaaataccaggctggactttgcaggacctagagctcagccattgcctctgctcctatctttccagccagctttgagggggctcttatccgggagaggagagatattacccaccacatgtggttggagggagcatcttcgttacactcctgcagcatgctggctgccagcaaatggcctcacattctgtgggaaacaggctttctgcctggtgcagctttgcttaagcacaccgttcaggacgtggcctgggagtctcccaaggaatgggccagtatcatttgaatggagtcaataaaacctgttagtcaccttatcaacaatatcagaatcactgttgttcaaaaactgtattattggagatgactccctttgttttgttttctcctattattaaaaaaatgataatggtcctatccccaagaatggtaatatataacatattaatatcatgttatatgttattaccatataccatgtataccaatgtttaccaattggttcctttttctcacaagaaggaacttatgggcctttacagaatacatttcaagccatgtgtaagaacctttcactgcaccatttaatggaatccctgccaccccttttgtatggctggaactgaaagtcaaggatagggagtaactccctataggtcacaccattggcaagtggccgtgattttttgagcacatgatttcatataaatgtggcctttctcctgctattcctcacagctcttctgaataagtgagagtacggtaacagcgactgctcgcatgagagggagaggctgagatttaggccactttgaaaaaaatcctttgcaaatactgacgcatagtcacaatgttttctgtagcatcttgaaactcttgaataaaatgtattatgcttgtgctagtttaaaaaatagtaccagtacccctacatattactctaacagattctttgcagcagagctgatgatagggttatcccttcagactttctgcctacaagctacattaattggatgatgcaaagattggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttatcgcggcactattcacaatagcaaagacttggaaccaacccaaatgtccaacaatgatagactggattaagaaaatgtggcacatatacagcatggaatactatgcagccataaaaaatgatgagttcatgtcctttgtagggacatagatgaaattggaaataaccattctcagtaaactatcgcaataacaaaaaaccaaacaccgcatatcctcacacataggtgggaattgaacaatgagaatacatggacacaggaaggggaacgtcacactctggggacggttggggggtggggggaggggggagggatagcattgggagatatacctaatgctagatgacgagttagtgggtgcagcgcaccagcatggcacatgtatacatatgtaactaacctgcacattgtgcacatgtaccctaaaacttaaagtataataataaataaataaataaataaaaaagaaaatgaaaaggaaaggaaatcatgaaaaactatacaattttacaaagcaatcatgaatatcacaaaatccagagaaataaaaatattttttaaattaaaaaaaaaaaaaagaaaatactggttcttcctgtgcagagaaaggagaatacatgccttccttaccaggaagatctacagctattagctagcatggaaaggagaatacatgtcttccttaccaggaagatctagctgtagctagcatggctcactattatcttagctcattagtctttttaaccttttgcctttgcccttgactttgagtcatgatgttgagtagaaagtgaaaaacttgccgaggggttcatttgattccgttgttgtggatatttcattctgtccacttttcctgggcagaatgaataagcctgagttgcttttaatccctgttgctgttctttgatattgaaaaacattctactcacagtcgatctgcaatcaaaatccccaagccactgagaagagatctaaccagatttctggtggcaatttaactccaagttgatgcaatcagtactctgcacaggcaagtgtgatgccattaaaggcttttccccctttgtaggttcacaaacttagcttttgcaagcagtagagaggcatgcaatgtagaagccaatgagattatagcctctgaatcagatttcatacttattaatgcaatcatagccttttgctccaggacttttacaaaaccaacttgacttcttcaaaccaatttgatgctgaaatggtcaaaaagaaaagtaacattaaatgcagggtgcactctctgctgtttttgcttacctttttttcttcccccattctccattttaaaatacgctctttcacagaataccactctaaagttacgtgggcatttgctttcccccaaaattcatatattgaagccctagcccccagtgtggctgtatttgaagatggagtctctaagaaagtaattaaggttaaataaggtcataaggttgggacactgatctaataggattagtatctttataagaagacacgtcagagtgctctctctctctctgtctctctctctctccctacgccctgccccacctatacatgcatagaagggagatcatgtgaggacacagtgggaaggcagccatcagccatccaggaagagagccctcaccacaaaccaaccatgctggtaccccctggtctgacttgcaggctccagaactgtgaaaaataagttgtttaagccacctattctgtcatattttacagaagcccaagttgactaacacactgttaatccaggaaattctaaatattttaagaaatttggtagaagtattagatgaattattcaaaagtccttggaaatgggattaaatgataaaataatactaacgagaaaaagtttgatcctctagaaatgattaagtaaaagatattttttaagtcttaaatgagaaccagcagcttctggtcatgtagtttccttcttaataaaagactaaatgctattccccctccccacacactcccatgtgcacactcatatatcttttttgaataggtgccatctaagtctgtttaaaggtagaaatgtttctgtacaattgagacctaactaacaatatattctaagtgtttgagtgttggatctggactactctgttttactgagttaatgaatttacttttcttatggaagaaagcaagaaaatgagggaagaaaaatctgggtttacttaagtagttgaagatagcacaatagattttcaaaatgaccagtcaaaaaccatgtattctaaagggcccaggatggctggcttcctttcttttcttttctttgtttcttgttttagatataaagtaaatttgttaaaaggcaaagttggcctttctccaacaacaataataatatacgctttgcttactgctacacctcttccaataacatggtgcctagcacagagtgggtacgcagtaaatataagtgaaatatttataagcgatatatagatgaaaaaatattatcaaggaaaaatccagctggattacaaatacatttaacaggaaaaattaaaaagtgacttctgcttttattattgatctacaataaaacttgcagtacaagagattgatataatattaaatatttcaaccataatctatatcaaggtatttttttttctcaaaatgatggtgactcacaaaagaagaaagtaaagaaacagattatatctaggcacttctatgtatttaaatattcaaagaacaaagggcatttaattttatccagatttagaatgacatgttcattatctcaaaactcctttatataacagcaattctgcattcaattatcacaatgtatgtactaaagttattaccatacttattctttccctctgaaatacaaaattttactatctagtaattgataccttgacaagatgtaaattttgctgaaacaaaactatatgttcaaagtcataagaaaccatgtaaggttgagaaatattaagagactgattgctcattataaatgatttatattaatagaaagcataacttttcccatcacctgactttataccacttttgaataactggtcataataatttcatgccagatttaaaaaattaattattaatttaatatgacagcattctttggatgtgaggactctgaaattgtctaacttattgtcttggtttgtttaggctgctataataaaatatttttttgaataagtaatttataaacaacagaatttattgctcatagctctggaggctgggaagtctaagatcaagtgctgggagattctgtgtctggtaaggacctgttgctcatagatgacaccgtcttgctgtgtcttcccatggtggagtggctgaataaactcccccagtcctcttttaataagggcactaatcccatttatgggaatggagccctcatgacttagtcacttcccaaagcccttacctcttaataccatcattttgagaattaaagtttgaaaatatgaattttggagggacacaaacatccagatcatagcacttgctaaggtttcataatgagtctgcatttgaatctttgtctgtttgactcaactgtctttccttgcagtcaagtgtgagttacctgttcctcctctattatccactctaacggcttctgtgtctctcttcagggaacctcagagtggcttcgtcactgattgcacatttacctttttgtagtatctgtctgtttgacttcataatgactaaaagcaacttgagacttctatatggttggaacctagcacagtgcataatattcaataaatggaccgggtgcagtggctcacacatgtaatcccagcactttggtataagcctccaaagtgaggtgggcagatcacttgagctcaggagtttgagactagcctgggtaacatggtgaaatccgatctgtactaaatatacaaaaattagcctggcatgatggtggacatctgtggtcccggctacttgagaggctgaggcaggaggattggttgagcccgggaggcagaagttgcagggagctgagatcgcactccatcttgggtgacagagagagactccgtctcaaaaataaataaatattcaataaatacactgtaatttactgaatgaatgaatgaatgctgttagtaagggccatctctgcattttgcagataaacatgctcattctcaccttatcaatattcccccaaactcaagaactcttctccatgaagagctatcaaaggagagtcattatcaaaaatggaccagccctgattcttcttcttctcctagaaatgtaatttagcctttgccctactgagagtgggccatgcaggttagcaagtagagtcacgggaaacacttccctgtgtttttctcaagaaacaggtatcctttctgtgcaggattttttttataaaggcatcgtgcaagaatcacaaattaacatccctatttccaagctatgggcatatgcattccatgtgatgtatgtctctgagcaaagttatcttcaagaataagtattacctcaagtgaacacaagagctcatgatcaaaaatgatggcaagaaacctggagaagctcaaagtaataaacagagttcacaatccaaaagcaagcacaccttctaaggtgttcaaaatcaacttcttagtattctgtacgaaagaaacatgttattttcatagaggagagttggaaagatttcttaaaatcctgggtctcactcagcctgagaccatgaaatcaatgtggttttgtgcaaagtgaacattacattagtgtttgttgatggaataattgaaattttaaagtcaaatcaatagacacttatttaaggaatatcaagtactctgcagggtgtagagatgattaaaatcacaaataatttatagttcaccttagtcaagaaggtataatcatcatgataatgtaaataaatcgatcaaggtataatgaaacaacaacaagagtgccacaagacattacaaaataatctgccaagcgggtcaggcagcaactgattatagaatacatgaggcattcatacaactctgatagcttcatgcccatacttctggcagatgtcactaattagtcacagggctttatccttctgggcccaggcgcatcctcaaaatctttctcaattttgtgagtttggcagccaattagctacagctggctggcaagataaagtctatttgtcatccctgccttatgctattcctcacatgccatggtttgggtcgtgtaatcctattatgtgccaccctcttcgatttctgggaaatgatctgaattgactcatctttttcaacctccgtcttcagggtcatcctttattgcagagactggaaagtgaaacactactttcaatccctttgcaggtagtattctggatttcagctccacttgaatttggcatggaggggagagaggcaggcccagggtagaggaagcatagttctgtgattgtaactcctggggatggagggttctcgtattgcagtggcagcttccttgagcatggcagaggtctggtggctgggggttgttactagaagcctcacctgcagcctattcattcagcccttctgactagcttctatgccacttaaactgtggtaatacaaccctttcttaaacacggcaaaatgtgtctactgtctgtaactaagtcctaataaatgtagcgcttttccctcaaacagctattaatatgaagtcttcccagaacagagtacagtgggtctctactttcctcttatctagaaactaggtatctgtgaacagacactgataccctgttaagtattggaagcctccaatcatcaattctgcaactaacagtctgcccttgtgtggttccctcatgccctctgagtctcaggttcttcatctgtcaaatgaagggattggttctgattgatggtggggccacttctatcttgagcactctttcaacttgataaaatgattttccagcaagtcccattcaatccaaaatactgaaaaatctacttatcttctaagaaactttcttgaatagagtgaaaaaaaaaattgagtagacatagttgattacctgagagaggtaagttgaagctatttctgagatacaaaccttacagtttaaaaaaactttaggtattccaatttcatttcatagatctggaaactggacaaattatatgcctaaattcacacatctatgggatggcattcagttcttttagttccatattaagtaatatcctccttttattattttaattttacttcagagcaaatgggaaggttatagtgcttattattggaatggaataaagaaggtaaatggcaatttacattatttctcagcaatgctcattagttatgtgaccagcccttgtgccaagccttcttgtgtattcttgacacttactgaccttctaacgcctatcacttcacacctatgtgtgattttctaaatttgattagaccttttttgacagggatctatctttcactcttaggaatcctctatgtgccttacattatatgggcattcaataaatgtttaccagtattcaattgaattacccttaggagaaaataaactttcacctctgtaagaaatcagatgtataaaaatgcataatgttttttaaacgttttctcttgggaggctgaggtgggtggatcacgaggtcaggagattgagacaatcctggctaacacactgaaaccccatctctactaaaaatacaaaaaaattagccgggcgtggtggcgggtgcccgtggtcccagctacttgggaggctgaggcaggagaatggcataaacccgggaggtggagcttgcagtgagccgagattgtgccactgaactccagcctgggcgacagtgcaagacttccttccaaaaaaaaaaagttttctcttactttattattattgcatagttatggctttattcatttcttgccactttatttaaggtgatgttcaaaaatgtactcactgcagaagaataaaacaatagattaaaaatgagagaggaatctaagcaagaaaataaaagcaagttaaagaaatgtattctaaatctttttatgattaataaatatggtttttaaatttgactttaagcatcctaacagccaaggcaagaagtaaaacaacctcttacaaaaaaccaatggccgctatttacaaatttatgagatgctggacaggatagcttttaatagaactgaatagaataatatggtgaaaagaacatgtatcagaagttagaataacacaaataactgctagcatttgcatagcatctattatatcaaaacatttttatataaagttcacttagcctcacaattctgatgtatatagtttgattagtagtgttacaatttttaaagaaagaaagaacattaaagagaaggaagacaaggaaaaagaaagaatagaaaaagaaaaagtggaagaaaagaaagtaaaaagaaaagaataaagggagaaaagaaaaacagacttactggggctaaataactcactcagcaaaacagatgcattaagtaaaagaccaagaacgggtacctcggttttctttcttcagattccacattcttccttcagattccacagtgaccctcttgagagtgagggttctatctagttcttgtcactgacaccactgttgatttataatcatattaatatagcttattgaattgttacaattagcaatgtgtgcttgaatcagacacactatactcattatctctggtcttaacttcataatgtatgatcccattttatagttctggaaactaaggttcagagaggttgagtaaagggtccaagacatacagcttgttaagtagctgatcaggaatttaagcctaagatcttatatctagtatatggcagagagatattatttcattccaggtttgcttggcttcaaagcctatgtcctgctgctaatctgtagccttctcaccaaccaaccatatgacttggaacgagctgtttacgctcattcatttcagtgcccatgaccttcagatatgggataacgagctgtgctttatctgccatgaatgcggtcaaataaggagaggcatatggaagccattttggatactattatagttattttaagtacactaatcacactgtatattaagaacattaatacttgtaatttaatcaccaaactgataaaatatagaattatctaaaaataatggtataatttgcatatgttataggagatatctttggctcttctcatggtattctctgctttctggcctcacatcccttcagaggtgcaggcttgatacagcaaaagacagaaggcaggtgtttggcctggagccctcttaagagatacttgtgaaatgagtcttaactccatcttctgagaaaatgattcaaatcatcgagccaggcaaggattacatttgtaaattttgttaaccttgatatgaattgctactacctgggtctcttgtttccttagtaaccttcctcaataagcattcataggaaagtttcttataggaagtgttatagaaaggactcctgtgaaattcaccagactgaggagattgacttttatggctcagaggatgcagtaggcaaagttcctaatggccagtgaagttcctctttcagagaacacaaatccaaagtgaattctgcaaaatctaccactgtacttattccttcattgagaaaatggggtgctttatggataaatgcatggaaaagtcagacttcgaccaaagtcaaagggcaatagaaaccctttgcattctttctaatgacttcaacctgtggagtttggaaagttacagattcctctggagggtaacatatgtacaggcttttttccctatttctttataataaaaattgatgaagaggaatacgtaaagtgtggtttccctttaggcagagttcagtggaagtagcattatacatagaagaactttcagctaaacttagagagaaacagagacttttaggccaatcattttcctaaatgtcactgattttgtgggagtaagtaatagcatctttcctaggcgtttgttacagaaccacgtaaagagctctactatttgggagatatgcaaacctctaaaataatctaagctaattagaaaatatctgtagctgacaagaagctttgtatctctgacatcaaacagtgcctggaagaggtgtgttggttttcaccagcatgaataccagcagtggcagacaccttcttaccaagagagtaaactgatggacatacacagcctatgaaaaaattgacattgctgagacagcgctggggattaacctttacagctgtgagatgtcaagcaaaattgaaatccaaccattgtggagcatgttgaaatcagtgggtgtatacaaatctctaaattattactttggccagatggaaaaggttccatttactgcctgctggaggaggtttagtcggtaacactgaagagggaaggaagattgaaaatgaggtatttttcatgtgcactaaggctgctatccaagagtagcataagagaggatagtcacaggccaaatgggtgacatggttcacctcttggccccctactacaggtagccaaaataaatgactgtactttgaaataattgcctttagcagcacgtgtttactgtcttctgttattacaattgctaccctataatgtacttagacagcatttaacttgctatggtttcagacagtgacacaggtttaaggcttggctccaaaatgctgaaattgtacacaagtttaaggcttggccccaaaatgctaaaattgtatctgcaagaaagggtatggatgagaattgttgaaagctagtatatgctaattcacagaggagactgattattaaaattctctctccttctatcctaggtatttttcttctttttctacttggaaaactgttaatcatccctaaaatctcatgacacactcactctctctctgatgcattccccagctccagtaaacagttagttgctctatcttttgttttaattacaccactatcatcgcattttatgaggtttctgtttgtgtatctctcttcccaccttgaacccttcaacacagaaaccttatctttaacggagttcaatgtggttgttaataatgagctctgcaaggagaccatgtatgctcaaaccctgatttcacagctgtgtaaccttgggtgcaatccttaacataatctgtaagatgaggaaaatgggaatatccacttctttgaattattgtaaggattaaacaagataataaaatacaaagtgctttgaaaagcaccaagcaccaggctcagttaagtgtttgccattatttcatttttaatatcaccattgtctggcttaatatcaggcatagagtagacagactgtgcataaaaaaataagaaaagttccataacaaataaatacgtcaacagtgtttattttttgcatatttcttccttagttcttcagatagttaggatgaaatgaggagcacatatgataaaagcatgtgttccaggactgagtttgaatgcccccttgtcccaaattggagtgtcttcaataagcctccccttattttcttaaagtattttatagggagtcaaaagtatttgtaagcatgcttatgccctccagagtttttaaaaaagaattcaagcaagaagaggtggatatggttggccaggtttctattaaatgactttcttcagaagcattttgacaaaattaggcacagccaggaaagcagcaaaaaatctgtcgtttctcatttgctgaaaacgccattagctgcctcttctcgccttctgctcacggacacttggctcttgttcctgctctgccccctgtgcccagtctggcagataatgcaccagaaaatatttcacctcatgcacagggagtgggaactcacacaaggaagtttgcaaggaatggaaatctgtgcaaggcaatcccctcgtcctgagaaggaccccatttagcaggggcgaatatccattaaactctgatgaaaacatactcatgcattcaataaatatgcagcacctacaaagtgctggtgttttaggtgctaggaatccattagtgaaccagaaatgaaaacaacaactaaatggatgttaaacaaaatcagtctattagaaggtaatgaggtactattaagaaaaaagaaagggagtcagagggtcctgtaagaaggggcaagaggtgtgcagttttaaatggaaagattaaggaagtctctaataagacattggagactgatcatgagtaggaggcacttatatcagagtttttgcagtttcgaaaatgcattttgcactttggtgtaatttacttcacaaacaagggatgctcttaaatatttgcttatttaataactttctgaatactgagggatattttcctattgcttttccacttcataattaaatatgaatttcttggacaaaaacaaaaggcctaaggaaaaggaaaatagaacttaagagctcagtaaaaaatgtttattttttctatcttttcaaaaataatatgcaaggcaaatcacaaaatgtgaaagaacaaattacttttatttttggattacttaacaaacaaaaggaaaaaaaatctctggtaggtagctcaaataaagaaaacatcctgaattaaaaagctatctaactttatccagccaccatcctaatgttctatcacagatcatgcctctgtgcaaaaaggcctgatttctgagagtttaaaagaatcttatggttttgagaaatgaatacactgatctcttgcgaagaatgaaaaagccccaaaactcagcaaaggcaacaattcaaactaccacaggaaatgaaaaagagtgtgcatttggaacatacacagagttttaaaaaaaacaaaaggaaattgatatagataactcaatttccattagtgtttcataaatttaaattgccttgtgatcaactgagtgcttgtataaactacaaagcgctggtgtggtcccaagatgagaatgtaaaagtataaccagaaaaattaacataggaatcaattaccctgaaaattctgatctcagaggtccctggacagaaaacagtgctccctggaatgacatgaaaagaaatagacaaaatatccatatccacttctatataaagagatactaatgcactgtatacacaacttgggaatatctgcacatactttgattagaagtgagtttataatgaacaatgctcatgtgcattaactcataatactaacactttttactggagattatcaagaggtcagtgatagccaaagacaccttttctcccaccccttcagtttccatgactacgtatctttcctaaaccaccctggcatcacttgactcactttcttcctccttggggaggaatgacttttctgatgggtaaatttaggaaggataaatttcctgctgtgctcaatttctttcctgctttgctcaatttctcctctttgtccttctgggagcaaattgccaaagaagcagaattctccactgcttccaagcctaagtgtcccctgggcaggaccactctcccctacaccgtgaactggggatccatccccatcagcatcactcctgacacctaattgcacacagcgaattttgtgactgtcagcatcactcccgactgggaggctgagtctgcctaattgtggacctaacctgcaggttcttgtgcttcttgcactaaccaaagcctcccacctggcttccatcattaacagagaccttttcttctcgttgcccatgtttctgttttagtccttatttgtacagaactgagtaggggtaaaggtgatgttatttactggctctctctgagggaccctgatagtcagaacaagagatgttgtcaggtatacatacagacatcacagtactaacattgggcatggatggaagcattaaaaccaacaagccaggtttgtctatcccatttacttcaaaaacacaccttaaatttttacttattttatcattttgttcatttgaaagtaaattaaaaaacataaaaatgcacaccatcaaatgacatgttgcagtgctgaaaaatatgtgaagaaaaatgtatagatgagcgataacaggatttataactcagtgacaatctcagctttacgacatttaaattgtgaaatctctaaaagccctaaagtgttgttcaactcatgtcttatccatttcagtttggcttaccataaagtataaacatctagttagaatattttgacagaagaatattggtgagtcattcaatttctctaaccgtcactttgtctgtaaaatggggataaaaaattttttctcttaagttgcacaaaattgaaatgggagcatgatttccgaataggccagacatggtggctcacatctgtaatcccagcactttgggaggcgaggcaggcagatcacttgaggtgaggggttcgagaccagcctggccaatatgatgaaaccctgtctttactaaaaatacaaaaaaaaaaatgagctgggcatggtgacacacgcctgtagtcccagctgctggggagggtgaggcatgagaattccttgaacccgggaatcagaggttgcagtgagccgaaattgcaccactgcactccagcctgggcgacagagcgagactccgtctcaaaaaacaaaaaaaaaaacaacaaaaaaagaaagtataaataataaaataacacactattacaaatgatcatcccttttgtgaactattattattcctattatatgaacactttttttttaaaactcagggagtcatgtaactctgctatatgtatttcttcaagttaaataacaatgatttattaatgaactcctacatgctcttaggaaaggtgctatgtgtactatggattaaaaaaaaagtagtgcatgtttctcacattcaagaagcttttatttaagagaagaaatgcaataaacacagtagaaactaagtaaaaagaaattaggagagtggattttgtgcagtgaaagaggaggttaaaaaataagagggcactagacatgattttaaggataactgagctcagatggatgcaggagagcaggctggtgatttcaggggaggcgaataagtgggaaatattagacgagaatgagcatggtgagagcgctggagtagaggggcaagttgattctctactctctgtttaacagctctttgagctttgttatatttcatcaaggtaaaatatatatataaaaaaaaagatgggtgccaacctctccacatggtgtttggttagatgtggcaaaagtgtggtttttaaaatctatgtaaagaactccatgaatttccaacttattatactctaagtataaaaattgctgaatatcaatgattatacactacaaaagaattgccatttatgggctttattaatgttctagaacctataagtattttacatacttatttatacatgtgaggtcctcagcccttaagacaaccttgtgaaaattggttgctgttttacatagagaagcttgagtttcaggaaaatggaatcactcatgagagaacacagaatgtgtaaatggtggaacaagaattcaaacccacatctgacttagaggcttacccacgatgcagtcaacacctgaccatagtatccaatgacaggggtggaaattagattttgacatgaagttaaaaacacagttaaagtatgtggttcaaatatttaatcattctgggagcatcattctttatgggtgcaatccacattctctttagagaagaaggatattactgtggcaacattcaaagaaagtgcacttcagcctgaagctcagcaagatcgtcttttttgggggggaggtggtaattaactgagtgccctggccttcatccacttttctgatgatttccccagctactcagggttaagcttctgtcacaaaaattattctgagccatttgtttagcctgtttgatgttcactacatttattttccttaggcagcagcattgtgaatgttgactatatttaacatgcttagctgtaccagggaaataatcatctttggcttatttaaaatatccaattttcttagcctttgaagaaaatctagagctaatatggagtaattggtgatgagataggacagatccaagtgcaatttcaaggctcctaattttcacctacagagtaagatttctttattatgttagaaaatgttttggagagattttttcaattaggaggcacattaaacaaatactggctagtagtgtacgggttcaggaagaggggtaaatctcttagttgcttactttctttcaagaaaaactttaaatgattctatttaaccaaagagaagatggagagaaggcaacataagaatgtaattaagtttaacttttaaccttctgtttgggatttgcctctattctttcccaccatagttaagtgtgaagatagtcctcatccatatttagaagaagcctcaaaaagaagcaaaggaaggaaagaataaatagaagtattcactgtctatcctatattcctgccaatatctgggagtggcctcaaaataatacccttgctatctcagagcctatattgcttttgatacactagcagtacttctgtggttttcacggaacacataagccaagtccatgactgaagaccatggcaccataaggaaatctcaccactgacaccatttataatgaaacaaatgggttttctaagaggaggtaactcatggtataactgtcgtggtacaaggtctcaggccaggccttcccacttaaaaaatttccctccatttccaatcttagcaattttacaaagaaactggtcaactttccttaaataattattccaggacttaacttgtgccctaaagaatagacatattctggtctctctggagtgtggagaatgagaagatttgttttcatggaaaaatgtatctactcattttagacagccattggcaagaatagttcctattattgtaaaatgtgtgtatttgaaatatattagctaggcaggtcaactctgaactttacaaagattttgcaactatagaatttctttgctgattttgtgtttttccttaaatatagccataaatgctgagctatatgttagttttattgttgatgcattgtagaagagagatacaataatactgaggctaacttactattttgagctttaaacttttagtctaaaatctcatctgtgcaaattcttaatgaggtacattttcaaagagagctttagctatataacctctgttgtcatgaagaaatgcatttggctaatttcctctgtgtctccttgaaactttacaataacaggaaaaagttaactctgacttttcactcaagtaatgtttagaagtttctgctaattccaacctcaatgcaccagagatatttagggattgctgaatattgggaagatagatgtaggatttggatgtttgttcaggtgcctcagtcttctaattattttgtcattatgcattttcccctgtaatttgtttaaatttggaatcacatcaccaattacttcattgctgtctggtcttcaatattctcttgtttattcattagagaatttctgtgacaggccattaataactatgcatttgctgacgtataaagtcacatatccttaattatgttcaaatatctgtctggggaaagtacttgattctaaatgtactatcctgatcttactaatccaggtaccttagtgtatgtcttcacttaccatagagatttagaaaataaaaaaagaacacttagtactaaaagtaagactagcatagaaaaaacttgagctctaacttcagaagactgtggttgattccaattctactgattgctagttcataatgtagtcaagttacttagcaaatttgaagaaatttccttatctataaaaatggaaaatacctatggactatctcatgtgtaacagaactaagcttattataacttacaaaagataaatattcaaaatcagcataaagaaaattatgtttttggcaactctattcacaatgtttgggattcttcctacctatagttatgtatgaagaagtcacactaaagtaaccattagaaaatctgggttacaatactaggcacttttaatgagtgcttaccatttaatgagtactaggtatgtggcttgtctcaaaattattctgtgtctcagaagcactctgtgaagttggtattatgatgattttcatcttatgggcaggagaactgaggttcagacaggtttggtgatttgcacaggaccacagccagcagcatttctggaaaaatttgacctgtgtatcttcaaagctcagtgtgtcctaaccttagtaccattctgcttctacaactaagttctagtattaagtcataaaaggaccctgggcaactcattactttatcatgacctatatcttagggaagtttgaatgagctttcatgtcttcttgctcaaagtatgcatgattattggtcttaaacttcgtcacatgaacacaataccccacacatttacttgagatgaacatgggcctgcctcttatgaaagatattactctctcgacacaagaaatggaagaacattccatgctcatggataggaagaatcaatatcgtgaaaatggccatactgcccaaggtaatttgtagattcaatgcaatccccatcaagctaccaatgactttcttcacagaattggaaaaaactactttaaagttcatatggaaccaaaaaagagcctgcacagccaagacgatcctaagcaaaaacagcaaagctggaggcatcatgctacctgacttcaaactatactacaaggctacagtaaccaaaacagcatggtacttgtaccaaaacacatatatagaccaatgaaacagagcagaggcctcagaaataacaccgtatgtctacaaccatctgatctttgacaaacctgacagaaacaagcaatggggaagggattccctatttcacaaatggtgctggtaaaactggctagccatatgtagaaagctgaaactggatcccttccttacaccttatacaaaaattaactcaagatggattaaagacttaaatgtaagacctaaaaccgtaaaaaacctagaagaaaacctaggcaataccattcaggacataggcatgggcaaagacttcatgactaacacaccaaaagcaatggcaacaaaagccacaatagacaaatgggatctaattaaactaaagagtttctgtacagcaaaagaaactatcatcagagtgaacaggcaacctacagaacgggagaaaatttttgcaatctacccatctgacaaagggctaatatccagaatctagaaagaacttaaaaaaatttacaagaaaaaaacaaccccatcaaaaagtggtcaaaggatatgaacaaacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcaggaaacaacagatgctggagaggatgtggagaaataggaatgcttttacactgttggtgggagtgtaaattagctcaaccattgtggaagacaatgtggcgattcctcaaggatctagaaccagaaataccatttgacccaacgatcccattactaggtatatacccaaaggattataaatcatgctattataaagacacatgcacacatatgtttattgcagcactattcacaatagcaaagacttggaaccaacccaaatgtccatcaatgatagactggattaagaaaatgtggcacatatacaccatggaatactatgcagccataaaaaaggatgagttcatgtcctttgcagggacatggatgaagctggaaaccatcattctcagcaaactgtcacaagggcagaaaaccaaacactacatgttctcactcataggtgggagttgaacaatgagaacacatggacacagggtggggaacatcacacgctggggcctgtcaaggggtggggggctgggggagggatagtattaggataaatatctaacgtaaatgaccagttaatgggtgcagcaaaccagcatggcacatgtatacctacgtaacaaacctgcacgttgtacacatgtaccctagaacttaaagtataataaaaaataaaaataaaagtaaatagagatattactctctctactgcctccctgctatttaaattcatctaagtaaactacatctactactaagtcccaggaaatatttatttgaatatgcatagcaataattttatgcatgccaattttcctcctaaatacagacccaggaaatacttcatctggtacaaaagtatgttattttttctttccatgaataatctaatgtctgcttagtaccagacttgatggttaaaatggatgtgataattgagaaaactgttagcccttttcataaagggagtgcatctggattgacaacaagaaagaagaacaggaaaactagtttcaagctccagtgagaatttcatacttacagaaaattaaaattcctaatattggtttaaaagccattagcattccagccctaagacaaagtttcttggaatcaccaacacccactaacactgagcttgccaacatgtcattagggctcaccttccaagtgaatcctaatcaatagcctgtcctgacactgcagtgacccaaacccccggttactcctcacattacagtgggacaggtaaatttgtgtgtcccttttgacatgcaaatttgctgcgtgtgtgtttgtgtgtgtgtgtgtgtgtgtgaaaagacctgaaacagttcattctcttgtcccattaattccactctatgactccatcctaagaacataattctaaatatataaggaacttcacacacagataattcattacataattttccaaatactaaaaaaagaaattacttattctaaaatcaggattagtaaactatattacacacatttatagactataatataggtattaatttatgaaaaatctgtaatctaatgtaaaaatacttgtgctctaatactgaatttaaatctatataaaattttatagtaatacaatattattaagtttaagggatcagatatacatggagaaaaaaactgaaaataaacaaatgaaaatattatcagcagtttttttttttttgagacggattcttgctttgttccccaggctggagtgcagttgtgccatctctgctcactgcaagctctgcctcccgggttcactccattctcctgcctcagcctcccaagtagctgggactacaggcgcccgccaccacgcccggctaattttttgtatttttagtaaatacggggtttcaccgtgttagccaggatggtctcgatctcctgacctcgtgatccacccacctcggcctcccaaagtgctgggattacaggtgtgagccaccgcgcccggccagcggttattcttagaatggtgggactgggggtattttcttcatgtttctttcttttctatttatacattttcctcaatgattgtttattacctttgtagtagaaaatcatatacttccccaacactcaggtttcatttccaataattttcagtgctttgatgttttcaaatttaaatttagtttgtaatttatgaatgcgtgtatatataaaggcttacaaattgtgtttggttatacctcaactctatggttctcaatgagggttaggggagtgatctcacctaccctgcacccactggacatttggcagtgcctcgaaacacttttgcttgtcacaactcccagaaaggtgctactggcatttaattggtagagaccagggatgctgtcaatcaacctatagtgccgaagacagcacacaactcaaagaattatccagccccaagtgttcatagtgccaaggttgagaatccctgcctaaaacaaaatgtttaaaaattattaatatattaattcaagcctgttgtgcaaattctgagtagcctattgtattaccagagcctctgaataaacttgcctgtccatgatctacctaacagttcactcactcccacagggcattgaggatggaaagataagtgctctacatatgcggtgcttgaaatttagcaaaagagaaagacatagacatcaagtgtttaatgcagtttgaagtgctatgaaacgggcacttgatctaactaggtggttcaaaggaggctttctggaaaaaatacctcctaagctgagcttaaaggataagaaggagttaatcagaatcatgtgaacacctgagagatgtgttctagaaggaggagcattcatacttcaaagaaaggcatgaagatgaaacagtttagagtgtttggaaaatgatggggagtttgccagcactagagcataagataggcacagaagaaagggagaaggagccatagaagtttcagagccagagcctctttttttctgcctgagaaagtcaaagtatacttctcagtatggggatgagattgagatcagacaagtatgttgatttaaaaagcatgttgatttaaaaggacaagtatattgatttaaaaggacaatctattaaagatgcaattgaagaacccagtaatacagccatacctcaaagatcatgtgggttctgttccagaccactacaataagacaaatatcacaatcaagcaaaccatacttttttttttgttttcctgtgaatataaatgtttacacaatactgtagtctattaagtgtgcaatagcattatgtctaaaaaacaatgtgcaaactgtaatttaaaaatactttactgttaaaaattgataacaatcatgtttcttcagcaatcttgcaaaaagattagcaagtataatatttttgctggtagaactggccttaatgttgttggctgctgctgatcaaggtgatagttgctgaaggttggagtaattgtggcagtttcttaaaataagacaatgaaatttgcctcattgattgaactcttcctttcacaagagatttctctttagcatatgatgctgttgacagcattttatccatggtagaacttctttcaaaattagactcaatcctctcaaatcctgctgctgctttctcaaataagtttatgcagtattctaaattcttagctatcaattgaatgatgttcatagcctcttcaccaggagtcaattccatctcaagaaactgctttctttgtccatctagaagacactactcctcatttgttctagtttgatcatgagattccagtaattcagttaaatattcaggctccacttctaattctagttctcttgctatttccaccacatttacagttatttcttctaatgaattattgaacccctcaaaatcattcatgagagttgaagtcaactttttccaaactcctgttagtgttattttaacctccagtaatgaattgtggaagttcttaatggcatacagaatggtgaatcctttccagaaagttttcaatttatttcgtctagatctatcacaggaatcactctttatggcagctatagccttacaaaatgtatttcttaaataataagatgtgaaagtcaaaattactgcttgatgcaggggctgaagaatggatgttgtgttcagaggcataaaaacaacattaatctcctatacatctccattagaactcctggacaagcaggtgcattgtcactgagaactaatattttgaaaggaatctctttgtgaggagtaggtctcaagggtgggtttaaaactttcagcaaaccatgctataaacagatgtgttgtcattcaggctttgttgttccacttacagagcacaggcagaatagatttagtatagttttttttaaaagtagtgcggacccaaagagtgagcaacagcaagatttattgtgaagtgcaaagcaataaagcttccacagcatggaaaggggacccgagcaagttgcctgatttagcataatttttaagtcaggcaaaaagttgacttcaactctcatgaatgattttgaggggttcaataattcagtagagaaagtaactgcaaatgtgatggaaatagcaagataactagaattagaagtggagcctgagtatttaactgaactactacaatctcatgatcaaactagaacaaatgaggactaacttcttctagaagggcaaagaaagtggtttcttgagatggaatcgaatcctggtgaagtctaggttggaatggtaaatgagtactggcttcaacttaaaatcatcagctgcattagctgctaacaagagagtcagcgtgtcctttgaagctttaaagccagacactgacttctcctctctagctatgaaacttttagacaacatcttctcccaatagaaggttgtttcatccacattgaaaatctgtttagtgtactcactttagctagaccttctaggtaacttgctgtagctactccaatagcacttgctgcttcgctttgcactcttatgttatggagatgacttctttccttaaacctcatgagccaaactctgctagcttcagacttttcttctgtagcttccttacctctctcagccttcacagagataaagagagttagggccttgttctgggttaagttttgaattaagggaaggttgtggctggtttgatattctattcagatccctaaaactttctccatatcagcaataaggctgttttgctttctcattcttcacgtgttcagtgaagtagcacttttcctttgagaactatttctttgtgttcacaatttggctaactggcccaagaggcttagtgtttggccagtcttgactttcatcatgcgttcctcactaagcttaatactttctagcttttgatttcaagtgagagatgtatgactcttccctttacttgaacacttagaggccattgtaggattattaattggcctaatttcattattgttgtgtttcagggaataggccggccctgtggagagggtgagagactggggaatggccagtcagtggagcagtcagaatacacacaatatttatagattaagtttggaatcttacatggatgtagttcatggtgctcctaatctgaactcgattattcctgaggtatatggtataaaaatttctctagtaataccaaagatcactaaaatatatataataataacgaaaatgtttgaaataccgtaaaaaattccaaaatgtgatacaaagacacaaactgagcacatgctgttggaaaaatggcaccaaaaggcctgctcagcagggttgccacaagccttcgctttgtaaaaagcccattatctgcaaagcacaacaatgtgaagtgcaagaacacaaggtatctgtgttatgcctgtatcattgagcctgggtaacacactccttatagctctggacaccgtgaaaatacagggaaaattcaaactgtactaaggtacagtgttctctcttgttcagctggagagaaaatgaatgaacacaaattaagtaatttgagggacagtgcatcaggattcattattaagtgtgtttgctgtaccacgtacatcaggagtaactgaattcagattagaaagaaagggtggtataaaagagagggtgggtttcacttaaagctgaaatggaggaagggtggcacttgtataggagaaggagttctaggaataatataagccaggagtttgaaactgagatcaacatcaggtgttcttggaaatgctaaggtaggttttttcaattgccagtggttctcaaggctgcttgatgctcagtgctaaaagtgttgctcagatgcagctcaaagatcacctctttgagtccgttctgatgctctccactttctaaataggattggtcagtctttcttttatgtccctctaaaatctacatagacgtgaggcccaggcaatttactaaactaattttttggtatgttcatttatatataaacccaatgtagccaaaattatgtctttatgttctcaatgactagtacagttcttggtacacagatcacactcgaaaacctttctttcctggatgattgaatacatgattatgctaataataggtatgatgactatgcaaagcaaagacagcaatgatgttaacactgcaaataatacccaatatttattgagctctgtgtgataggcactgtgctaaggagaattttaacaagtatcatttcatttaaatttcaaaataatgtcatgaggtagctacgactagtactccattttacaaatgagagaactgaggttcaggtggttatatcttcaccaagatcacagccagtaaaaggaaaagctggaaatgaactctaggtctgtctcacttcaaagaccatgatcttatccactacttatagatcttttatttttaagagagtgtagacttaaggtgattttattttattttttaacatttgttcattgaatgtatgtgtcctagactcgaaaggctcaatgtagtgcaacagtctgaatagtaatgtaattttaaaaattaaaatgggtctttaacaaatctatgaaataagagtttgcaaactcaataaaaagagtatattatcaacttctctaagagacaataataccgaaaatgaaaaccaataggacagggcactcaggcattgactcattgtatgacaataccaggcagatggcttaatttatataacaactatctaagttggtccagcagtgtgaagttaggggaaaggaagtcattttattgaaaaaacgcatgtgttaattcaaatcacttgacagtttggcagacaattccaccaaccgcctaaaaagagactagacccccatcccctcaatagtacagaagggatagaaaaacctagttaaatttccaaaaaacaataagtcatcaacctgagacccccttctcaatggttccctttattgccaactctagaacaagggctggcaaaatacagtggtaggccaaatctagtctattctcaattttggtatcacctgccagctaaacattgtttcacatgtaaaataatggttaaaagggcagacattaaataaatatattgtgacatatgaaaattgtatgggattcaaagagcatctacaatgttttattagaacatggccacacctatctgtttgcatattatctacggctgcttttgtgctacaacagagttgaggagttgtgacagactgcatggcccacaaaacccaaaatgtttactactgaaaaagctggctggccactgcttgagaatcaagctcagcaggtgtcagacaacttggcacagaacacactgcagataccatgggtttggcctttccaacttattacctaactcaatggttctcaaagtttggcccctggaccagcagcatgatcctcaagtaagaacccattagaaatgtgaattatgaccccaaccccagatttactgaattggaaactccatgggttgggcccaacaatctgtgtctaacaggtcagctaggtgattctgaagcattcttcagagaacggtagtcaaactcaagaaactggaacatggcaactgttgtttcaacacaattacaagaaaggcacttattggctcctatttgtggatgaagaatggagctagatattccacttatattttagtattcctacaataatcttcaaagattgggattattaaccccattatatggaaaaggaaattgaagcttgggaagattaagtaacttgttcacagttagtgaattaggacttcaactcaaatctgtctgctttatagcctatactcttccctctcgccttattctgccttctcccttattatgtgagagaaggagaaaagcacctgtgggcccctggaaggagctgagctgatttattagttaggtcttggtgttttcttgatgattataaaccatttcatagaatatgaacatcagaaaacaccactgtggacccatggttgatcaatataacaacaagagcactctataatcatgtttgaacagaagcaaaaagatgaactttttctcttttttttgagatggagttttgctcttgttgcccaggctggagtgcagtggtgtgatcttggatcactgtatcctccacctcctgggttcaagcgattctcccacctcagcctcccgagtagctgggattacaggcatgcaccaccacgcctggctaattttgtatttttagtagagatgaagtttctccatgttggtcaggctggtctcaaactcctgacctcaggtgatccacacacctcggtctcccaaggtgctgggattataggtgtgagccactgcgcctggccaaacatgaactttaaaccacaaaataatcaaatacctcctatcccagctaatatgagtaacagctgcttctttacctattacagcttttgtctctgtctagtcttcactacttgcagacacaagttacccaatcacagcatgactctggcttcttgacagcttcctgtccaggtcaatgtcttgctcacttaaaccttctccaaaggcaccaaaatgagctcaaaccctgtaataagtcctaacactctctgagacattccccgtttctctgcagcatgtattctctctctctgcaatgaataataaatgaaaattattcaaccacaggtgtgtttcctgatgatatttggctggagggcattccccttccactcccctcactgcccacttaaaattatagctctcctcttccagcctgggtgaggcacaagttaccaaagtaagtaaaaataattagaactggaaaataatagtccccagactaatcagtatcaagcacattgccaggtccaagcagaaacttggtattttaaataattaatgaaattttcagtgccaatctgattacaaaaatgatttcaggaaactgcctgtcttttaaaaatatagttcaattttctgcttttagtttctagtctctacctgtcaaagttttggatctctcaactcttgagatgtaaaatgtcacttatctttttgcagccttccccaaaatcttctagatggctcctctctttgagttttctaaaggccttactccctctcacaatactttttcatcttggattagttattcatgagctgtctggcctctaaccaattcggaaatttcttgaaggcagtaaaacacctgactatcctcccttcccttccacacagtaatacatatttgttatattttggcaataaatctaaacgtttttccagttacagaattgaaagtgttgcttttccatcaaaccagagctcatataagcggggactctgcaactcattgttggttatcttaattgaaattatctccctggctcaggagttctaacaaacatatgtgtttggtgtgcaggtatcttcactttgccaggggattttgatgtgaaatattactaacagaaaaaatatatatataacaaaaatcttaatcaatgaatcaacagtttttaggctactatggaaacctgaaagtgatactggaagttacttattatgtgggataaatagatatgaactggcactattcctgtatgaaagcaaatggcattcaggtcataattttcttcagtaacttctatttaccaagcactgtgctaaacagcaaggataactgtacaattaaggagaaggagtaaaacagtcaactcctatcctacattttatcgttgttccaggaatttcacgtggtgtatcatggccctgtgcttgtacatggtgttacctcacccagcgttttacatacagtacttggataagcaccattcttatatatcaatcttatacacttctcttcatccataaaagccaggattagaggtcacctccaccatggagtcatctctgattgctttcatctcctctacttggacttaattacctaacattcttcttggattttcttgtactggtctatttaccatgatgtattatattttttatttgttagtattctttttcttcttatgcaactgagaatatcttgaaggcagcaactatctttaattgatctctatattctggagcctagcctagtgcctgacatcctgtagacaatcaataaatatttattaaatgcaagccatgtgaaaacaagtgccaaagtactggtaattattaaagttagataatgaatatatgacaattcattacacttttttctataccttgttttatgtgtaaaatttttcaaaataaaaagtttacaataatcgaggaccttgtaagatagcggattaatctatccaaagttttaagttccttccactatacctatagctatgatctctgcgtactccacatttctttcttttctcataaaaaagatatttaataaagccaaacaaagttgctctgaaataaagtataagtatattgtttccaaagagcttcatgtcatggatatcattaaataagaacttctggaaaaactggaaacggacagttctccccaagtattttattgaggagggaattctgtggatttttgtccttccaatctgccatctgaattgctacaaaagcataactagtatctctgcttccactttctttctttttttttttttttttgagatggagtctcactctgtcgcccaggctggagtgcagtggcgagatctcggctcactgcaagctccgcctcccgggttcacgccactctcctgcctcagcctcccgagtagctgggactaccggcgcccgccacctcgcccagctatttttttgtatttttagtagagacagggtttcaccgtgttattcaggatggtctccatctcctgacctcgtgatccacccgcctcggcctcccaaagtgctgggattacaggtgtgagccaccgcgcctggctctgcttgcactttcttacctgtgaactcatcttcacctacccccaggttgacctacctaaaacatggatctgtcccacttgctcccccaaagttgaagtctttaagtcaatggctcttcaatgtttagggaataagtgtgcacttctagtgttgaaccccaagtaacttgtccagccacatattttaatgttcttagacccatgtgcaacgagccatatccaattcacggtcctaatccatgcaagccacccactgtctgtgcttagattcacagctcaatttccttgctcagcttggaatcttcttcctggattttccaatttgggaaacattctcccactccaaggtcctgtacgactagtttttcttctccattaaaccttctctggagtcctttccagaatgaacctttctacctgtgcttctactggccatggcctgggcctatgcccagcattattttctgctgccttgtttagtaagtagtctcctttaccagaatgtaagcttgttgagggcactttaatgttcatcttgcactttcccaccctctcagtcaatacccaacagggtaccctgcacacgttagaattcaatatgacaagattacaaactaaagtatgaaatgatgagcttaatctcatgagtgttctttctccttccgcttactaataagtggatatgtgcaaaatttcaaatccctatagtaaaatcacactggttgttttgatcttctttacaaattgcttttgagtcctaagtcatgaatttcaattaaaactttttttaaaacaagactatcgaaattggaaactaaaacaaataactgtttctcttaacccttttctatctgtgtctaattctagtcaacattagagatgaaaatattaaggcaatactgctttatctcaacattaatatgggccctctcattcaaatagactcagaagtactttctaatgtattatacagaaaatcacactggagaaaatattccatgatggtaccattgaggtatcactgcttcctgaggacaacatgtaagctcaatgctgcctaaaagaagctcaaatttctactctgggccttttcaccttcacttctccaccataaaaaaaaaaaaaagaggctaattctctggactattgtgggtcatattttctaggtggtgcaatcttagtgaagagtttagcaatttgcattgggataaccctgtcaaccttcatcattttcagctagaaagaatgaaagctctgataatctaattttttatggtggtttgcactttagctgcctttttttctcaaacctttacttgactactgatcaaaaagtccaggttctgtttctgcttagacaatgtcatagtctaaataaacaggcagcaggcctaggatagaggtgtcaccttctcattggacttcatcctcagactctgcttgaactggacattcatcatgattgaatgtaagtcacatttggtcaaaattcagtgcagatcttagatgtctgacaggggctgaggagaccacttggcttgcttttgtcctaatcttgcctctaatctatgacaaacatcagtggtctggcttagctcatttatatcccatgcttgggtcccattcctgggttgaggtcagagccttgtagaaattacatgcccattatatgattttcttttaaatgcatttgccgaaaatatttcacatggtattagccaattcaggaaaagactcaagaattccagaaaattcccatgtgcattttcatttattccctttctcaacattaaggaagatgtataaaagtatgttgtagtaggaaaagcactgtgtaggattcagtagtctttggttttgatcctgcttctgctcgcagttacatttgccttatgacaagtcagttaactttactggattgtagttgtctcctatgcaaaataagagttggcccaaactagtatttcctaacatgtatttcagaggaaaaagggactgactcaacaagtatatgtgggtcttccctcatgtatggtgataacctgcatccttgtattttaacatgatcatggattctatattgaattaaaagtttctccagcttactgaacatttcacataatatctataaatatttatgtacatctctatgtgtatgtttgtgtgtgtagatatagaaatatagattcagatatggataggaatatgatttagatatctctcccaaggaagacttttcagaccaactcaaaatttctatgattctagttgggggagtcaggtttacaattctaattttcattttgttgaaactcaaattcgaagtttgaatctgcaaaccttcaactttaagtgatatgaaacagacattgaagaataaaagctgaatcgttgcccggggccttacacttgggacttttgattttaaatttctacattattaactttgacaatataagaactgtgcgctatcctcataatgctgtgaaagttgacttcctcaatacatttgtggaggttgtcctttagaacctaactctgaaaccaagtcagctccagtacaatgcactgaagttgggggctgtggctcaactaagtccagagaaccaaaacgtggtgacaaaacagaagcaaattattccaatcatagaaattgaaattgctagtactgtattaagacaccagcatttagtgcattgaggcagaaatctcaagagaatgcaaaattgtgtaacattggagaaacctgcttatgcattgatttccttcaggggttaaataaaattactgtgaaatataagaaaaggaaaaagaactaaattctgaggttttaatcccattacagtattatttgtattgtgtctaagcagaacttattgagaataaagaagatacgaagattacaatagaatgtatgttcttatattgtctaaacagttagaacctaatgaacttactttgtagaataaaaggactttctgaagataagatacattggccatcattaacatattaagagaaacaacctgtataccggatcttgtttgggatgatgtcatcatagctatcaggtcttagctcctatagttagaaagattacagaaagcataggcaagtttaaatatttccatctccccacattaaacacaatgtgagaggtaaatattcattacttggcaataaaatatcatatccatatctggaagaaatattagcaagtatctcatggacgtcattctttcacttaggaagaaagaggagattgcatgtagaattgatatcaaatgatttaggtttaaatgattcaaaggctattattttagtaaaagcattatttcataaacaatatgtgtgtgtgtttgatacatacatatacattcaaatagttaaagcaaagttaattaacttcttaaaactctccaatctttgaataacaaaactcattttggatagcaagagtaaaatttatgttagatggatctaatttttattgatagcaacagtcctgtctcgtgtgtatgagttcctactcaggacacacatgagcaatgagactcactggggaatgcaaatgaaacacttgcaaatcaaatgttcaaagcacatttttgctgagcacccattaactcaatttcatatcaaaagcttacccattttatatcataataaaccacccgggttcacccccacacctcctaactaatgagggacacacagatattctcttcacaaatcaagatactctttcataggatgaaatcactaatgacattaaggtgtggtaaccaacatgaacttgacaaccaaataccaacccatattatcaccccataggagagagtcctaactccccaccttagaaaaatatttaacccacaaaatactaaacccaagtagatttcaaatagaaagataatggtacaatatcccttcccttctaatatcaaatatctagataaaccaaaatgaactgtccagccactaggatgctctatgccaaacatgcatattttaaaacttttactttgagtattaaggcttcttaacttctgcagcatctgtatctacttctaaaccagacctgcccaacagcacagactggagcgaccactttaccttccgaaaaatcaatcagtcccagcaaatgaagaagcttcagagatgcacatataatcacaacaatacccactgtttgcagtccttcggactcccactccagagtcaacatcctctgagctggcagagcatcccagcctccagacccctttggagtggagggagttaattacagaatcgtagcaacgtcaggcttggaacaaagacttgcaaggggaaaaagtgagcagctcctggcagatgcaccctgcaaagccggcggccccccggggtgaggacagacctgggctaaagtccagcttctcatgctgatcctggcatttggctggcggggcttcccccctgctaccacagcgcacggacctctccactctatgctgcagccagcgggcgagtacttcgacttcagagctgcgagggaaacgtctgtcggagaactggagactttgcagtgtccgtggcgagaagggacactcctaggaaacttgcccgggagaacaccgcgcgcttccctcgctgaggacgcgaggctgggcagatctgtctgcgcgctagttttctgcctgagaagcttgcgaatggcccctttttgccaaagctgctgctctctcctcccagagccgcctctggcagagagctcagctccctctctgaatgctaggaaacaatcagttctggtggctggtgcctacaggcccttcctgaaagcccccgtggaagtctagaggcagcttttccagggagaaaagtgcaggagcaaagctccgtgattcaatgactttgtcaaacgagaacacctgagcctcccccgccacgccactccttgttctggtctccgctgtcacgtcgggcgcattatcagggagattgatttagtccttatattatatttacaaaggtggacggagggcgtggcggagcagtacccggtaacaactaagatgttcataactgccccctggaaggtgtgtaccaccatcgtcctttaaagtctggcctcagcctttctcaaagtttcacaaacttccctgatgataaaaacaacctggggttgtttattaaaaccacgctcatcagaggagcctggagtgtgtgttattaagaagcccaggtgactcttatcaactgggaagtgtggacagcaccatcgcaaagatgccatgaggtgtgctagtccaaaccactccaaacagaccctgttctgtgccaggaccacactggctgaatcactttgttggttatctccagtctactgaagcccaacctaaaaacggagatgaagagaatcaacagggactctgtaggtgaactggaaatataagggtttgtgagtaatatctcagacctccagggtcatttgcaagttctgcttctttcttgctatgtgatcttgtgcaagacacttaaccactctaataacaggtcctattctatgcagtcaagatcataatacttcatttaaagttctccatttaaagggaattatgggaattaaatgtgatcacaataatagttaacatgtactaagcacttactatgtgctcatcaatattgtagtgacttttcaacaacttacttatccctacatctctacgtggtagacaaattaatctaccacataagtggcagattataagttaattctaatcattttaactttgtaggtgaggaaaacaaagcatgaagaggttaactgacttgccaagcagtgggcatagtgactggaaggcaacaggctttcattcattcagttattcattagcatttattaagctgctactatgagctataaatggtacatgaatgatcaaatgatgaataatactcagctctgtcttttgggggcttatagtttaatgaggaggcaggcatgaagtaaaatgtgaccaataaatacaccaacacttgaacagatgtctgcgcggtacagtgggaaaacaaggagggaaagtcaactctaattgggaaagggtttagtggtatcaggaaggagactttatagaggcggtaactgtccataatggtaacctgaatcattactagaagtattatagtataccatgctcaagttttgaggttggtagacctgggtacaatcctagccttacccttgcttgctccatgaccttgaagaatacactccgtctctgaatcttggtttaaaatgggaatgctactgcccctttctcatggttgatgtaagaattaactaagtctgcggggagctgagcccagtccctggggtcccctgctcacatatggtagttgtggggttatgacggaagttccaactcttcagaggctctgcaaggtctccttggatgaaacgactttgcttttccctggtcctgccacccctgctccaaggtctagtttcagcgtttttcccatgaagacctgctgatcatctcaacccacagtgtggtttctttcccttgagtcctagaaataagttggtcctgccaaaggtgcttttcattttgaataacatatttataagagatatccttgtatccacctgcccaatcacccatccatccaaacattttcttctccattatatcagcaagcctgtggcggggaagcaggttttagtaattagtaggaaaaaaaatattttaggtaaccattttctgaaatttccaccaacgtttagctacagaaagtcaaaagttaaaaaaaaattacagaaattaattaggtcaagttaaatgtaaacatgtcttttaatcctatatcataccatattgtagttgaaaacaactaaagtactgagagggggtcacatggttagaaaacccagaattcaatcattgctttgtctggcttccaaattcacgcttttccctttatttctatcagcagatttcagcaaatatttgccaattgatctcttagtttagagagttggtaaagtattttaaaattgccacatctcattttccaggattgaaattcctatcttttttgaaattcacataaagtcccatgaatatgattttgttggtttcagatagaatttcccttcaggacaatagcattctctacttagaatgtgccagctgattggaggtccagccctttcctatctgcattagttacatttaccacatgctttctgagctgtctctcagctgtggctaccggatcgaatctgctggctcccaagtatgcgggggctctttcacatgcacccccagctgtgagattttgtaaggtgacagcaccataagaggagtttcctgcttcatctaaaaagtctagggaagcaggggacatctggggaatgatgtttatctagcgccactcttggaaagaagagttgcctgcatagcgctttgggaggcttaggtgggaggataacttaggagtttgagaccagtctggggaacatagtgagactctacctctatttttaatgtttaaaaatttaaaaaagtaactccagatcacggctcaaccattttactgcagtaacttgctagccccaacccagtttgttatattaaaacatcctggctttctccctcattcactgactcacccctttctttacattgtaatgagtcctccagcagaggtctgtctttcataccaaagaagggaataccaaaggtacactaaaggcttttacccattgattctaagccaggcaccatactatgtagtttacatgtataaattagtttcagctcaccccaaatcaataggttaggtgttattatcactatttcaaagaagaataaaaactaaggcgcattgggattaattaattttcacaaaattacattcaacaagggacataaccaggatttatacctgatttactccaaaaatagtagctaccaacatttatggagaacttttaagtgtcaggcactactctaaaatatttatagatattggccgggcgcggtggctcatgcctgtaatcccagcattttgggaggccgaggcaggcggatcacgaggtcaggagattgagaccatactggctaacacggtgaaaccccgtctctactaaaaatccaaaaaaaattagccgggcgtggtggtgggcgcctgtagtcccagctattcgggaggctgaggcaggagtacctcgtgaacccgggagacggagcttgcagtgagccgagatcgcaccactgcactccagcctgggcgacacggcgagattccatctcaaaaaaaaaaaaaaaaaaaaaattatagatattaactaatttaatccttttatagttccctgaaataatttggtttcaaggagaaaattcaggctttcaaaggttaatccacttgcctgaagcctcatatatggcacttggtagaactgggatttgaatgtgggtatactcggtaccaggttctgcctactttatcattcaccacctcactctcaggcccctctgcaccatgttgaatggttctttaactggggccgtttaactggttgagagactctgaaaggaaagtattgacagaaactcttaggaaagtaaaaactcactccaaggacgcatgtccaaatcaattgaccagtctgtgaaagagagagggtcagtagactttacatttccttgccccaatccattgtgatcctttaaataatctcaaatgggatgatttatctaaaacctgaaattgatcatttttccttgttttttatagcttcagtttgaaatttcaccacgtgatagtctcggttaagaaatattcttcatactgtttgttgacattataataaatgcaaaaataagtgtagcaagattgagaaaaacgttaaaattcgatatatttacaatctacctgttctctcttcaaatacatagaatcacaatgtatatagaaactagttaagtcaaatttaaatgtaagattattagcctatgaagggaatcagaaaatgttactccaaaatatgtcctttggcataagggttattttcgattgaaggcaactgaaataggagactcaggaaaaactctctaccttccccctctctgcctcaaggcaggggatagatgtatgaatttctctttgtaaagtattcccttctgctctcctgtatgagaaggatgaaacaactataatcactgggcagaaagtcggcaccagtgggatttgtgtaagaaaccttacaaataagccttatattccattagtttcccctgtatatttttcttcccacaatttaccaccctagaagcccaaatccttttttctttgtcttgtcacttcacaatttatcaccctttgttaggatgattatataagtccccaattctaagcacccctttgagttactcttcattgagttctcacatgtatatgtgctctgcacgtgtaaataaactctattaatctatttttcccatcaatctgtcctttgtcagtttaatttacagggtccaactactaaatctaagaaggaacagagaaagtttttttcacccctacatccatattcatacaatcttttaggaatcatttaaagataaaataatatattttttaaaaatttgcaaatgcataaaaaggaggtatagagagcagagttggcttgtttaaggtcagggacttggaagtggacacaggtggctttgaatcctctagcttttcataatccttgacttgcttagtataggaaaaatcaggatgatacactgaaaagttaaaaagaagtaaaattctagaaggaaaatttcttctctcagtcaatagaagctaagagaagcaagccatcaggatggttggcattatccggaaggttgcattgaagagagaaacctaatctaggtcattgaaaatgagtttggagaggagcagtgactttcccaggaacataaatgggcacacacaaagacagcattggccaggcactgtgactcatgcctgtaatcctagcactttgggaggttgaggtgggtagatcgcttgagttcacaagttcaagaccagcccgggcaacatggagaaaccctatctctacaaaaattgcaaaagttagctcggcatggtgacatgggcctgtagtctcagctacttggggagctgaggtgggaggattgcttgaacctaagaggcagaggctgcccgtgccactgcactccagcctgggcaacagaatgagaccctgtctcaaaaacaaaacaaaaacaaaacaaaagacagcattcacgacagtggtaaagccagattgagacctccaagccaggcgagaaaaatgagattggatagttggtgaaagatgccacttaacatcaggacttgatggggcaagtaacaaagacaaggtcagtgtatgacccttcatgtctcttcacactgtaagattttctcaccaaaatgatgaaagttatctacccgcaggtgccctctactctaccctcaacatcacctccacattaaagtatatcaagcctttctatcttggggtttctcaattactttgaaaattcctaaatgttctccagatgaactttctgctcaaacatgatcagactcaagcagtttcacttagctgaaggctcattctgaaaggttagtaaatgtgtcttgaatggacttctttaaaatatgtatatggatgtccattaaactattaagtaccacagccttctgttttgaatgccctattgaatccacaaggtcgattggattttcaaatagaaagctgagggaaaaaactaccttccatcctaagacacttccagcaatattgcactaatgtatcttgaaaatagtcctcatgaatcttatgatcaaagcatgtatagtatgtaatcttcacataaacaaatgagtagactatttggaagtccaaccagaaaacttgcattagaatataagctttccttagtaggatttatgacatttttgccataatttctttttcccagcctttgtggcctaacctgaatgagttcctgggtttacccatttaatccagtatgcaatttgtggctctcctgtcatatcccttttgatgtaatctctctgtaataggtgtctgtcacatcccaccacactgggctggctttaaggccgtgattctccaggataataatgatcattatcccttttatatattatagtttgtagtacaataatactgaattcctaccacgtgacacacagtgtgctgtgtgcattacataaactgtctcattgagttgtcgcaatatctcaatagaataactaatcattaaccccattatatagatcagaatgctgagatgcaaaagcttaagtaacttgcccaaaactacagtgttagcagttgaggagctgggacttgacttcaagaattctcactcaagagccagggttcttacattggaggggaagtatgtgtcaaagtcatcatttttgttttgttttattttattttttactgtggccccattacacaaagagacacaagatttaaaatgcgaatgaccttcagaaaagtaggatgtgacgttaacctcatagtgaagtgtaaatattcagtaactagttctttcctgggaacaaggttaagagagcaatgaaaacacaaatgagatgagggaaggagctcgggatagaggtgagaggaaggagaaaagatgaagggaagggagaagagaggaagaaaagggaaagcgagaaatgagaaagagaagaaacaggcaattctttactccaggcactgagaaatctgaggatacatagatgaatggggcctgtgttctgtttgtgagattctcatagatggccagggagacgtgatctaaaatgaataaaagagggctccaggaaagggccgatcaaggggctatttctccttcaattaatcctacctccgtggtccaccagtctatgcgtctcttataactagaaatacagaatatctcatcagcttcattttctcagccacagcttcagatgaccttggaaatggaacaagtggttttaaaagtatgacaaatggcatctccatggatgttgtagccatggctggggcttggtcctacttctaggtctgttcctaggccctgtcataccttcctgctcatttgggccagggccttgctgccatagatataccacttcatcagcttgatcctcccagttcttgggcacgagattccagagactgacttgggtgtcctcagagctgcgtaagctcatttcttgcaccacaacagtacttgggaaacagaacccagcaggctttggcttaaatgctttccaattctgaagagaaactgaatgaatatttttagcatattttgttgtataggagttgtagagactgtgttagtccgttctcatactactatgaagaaatactcgagactgggtaatttatgaaggaaagaggtttacttgactcacacttcctcattgctggggaaattcccatggcctcaggaaatttacaattatggcagagggcaaaggagaagcaggcactttcttcacagggtggcaggatggagtgggtgcaagcaggggaaatgtccgtcacttgtaaaaccatcacatttcatgagaactcactcattatcatgagaacagcatgggggaaaccacttctatgatccaattacctccacctggtcccgcccttgacatgtggggattatggaaattatggggattacaattcaagatgagattttgggtgggaacacagccaaaccatatcaagattatatggaaagaatatttcatatagttcccaaaactctcctccccaaataattccatgtgctttctcctgtctccctccctttctgcctctcccccaccccacatacaattatcacccggatcggatcattttccttatctatgagattagaatgggtgaagtctcaatgacttggaaatccccttttcaccaaccttagagccctgaacattctcaatggatgatgaacaaagaaagcacagagtaggccgaacatggtggctcatgcctgtaatcccagcaatttggggggccaaggcaggtggatcatctgaagtcagtagttcaagaccagcctggccaacatagtgaaaccctgtctctactaaaaatacaaaaatcagccgggcgcggcggtgggcacctgtaatcccagctactctggaggctgaggcaggagaatcacttgaacctggggagtggaggttgcagtgagccgagatcatgccactgcactccagcacaggcgacagagtgagactccatctcaaaaaaaaaaaaaaaaaaaaaaaagagagcacagaataaatgtttagagaatgcctaccagaatgcagggcatgggtcatggtaggccttcactctctaagggctacctatctgaggtcatggcacaggactgggagccagacatgtagcctggtttttggaccattagtccagttctctttccactgcaacagggtatgaagatgtctatataatagctaagttacaagcaaaaagggaatatgcactatagaagagatttcttatagtgagaagatcaggaaaatcccagagaaagagaagacatatgaactggtcatgaaggccaggattaatatgacctgtgtccatattactgttcatgaatgcaaactcttgctagtgctccctaaatcagaagcatctatgaatagcttccaagattcattgtaacccagcaatcagtgaagctaggggtcacatcccaatgaatcactttgacaaaagggactaagccctcttaaaagaagtagaggaagaagaaaagtttcccctacctcagcttcaaatacagaggcccagagaactggaaacaaaatcattcttctgggaatgagttttcctagaactcacagtcagtgttgcagcttatgtgcctgagattgcttattttctgttattgtacccattactataatgctgaaatcagtttgtatttgtttcccgttgctgctatagtaaattaccacaagcctggtggctaaaactgacacaaatttattatgttacggttctggaagtcagaagtttgaaatggttctcattgggcttaaatcaaggtgttggcaggaccacgttcctattggaggatctaggagggaatcaattttcttgccttttccagcttctagaggctgcctgcatatcttggcttgtggccccttccattgttagtgccagcaatgaccatttgagtctttctcacattccattgctctgacactgacccatctacctccctctttcttttatccttgtgattacattgggcccacctaaataatccaccatacaattcttattttaaggacatctgatgagcaaccttaatttcattcacaatactgattaccttgtgtcacataacccaaaataacacaaatttactatttcacaattcctgggtttaggatatggccatctttggggtttttattctgcctactatatagatgtaatatattagttatttttaacaggaaacactctttaagaagaaaaaagataacataaactgaagctcacgaagacagagtccactttattaggaacaaactagttgaggtaagtgcatgtgagtgtgagaatgagtgtgtgtgttttatttttaacatacagaaaaagaactttgtctttgagaaggaaagggcagctttaattagcattcctatttctgaactaattgtcacagagaaaggactttgaggaaagtacatttcaaaatattaaaaagggaacactaaacaatttagagtgtataaactaatgatcagaccgagggacactctcctttcattttaggtgcaagcccagacatgaactaggagttacagggatagaaccctacagtacccagaactgggatgtgttcttcccacaaagaatgtcctagaggattacaaaagaaaagagaggagaaactactgcataagtagagaaaggcattcgcatgttatcagtcccatcagctaattcagccttcttaggatggataaaaccaaaaatgaactaaactcttcagctactgagtttttcatttttagttcaagtgtgcaatgctctgaacatgagaaagccatagagcatgactttcaaagacatggtagcaattaaactctaggaaatggggggctttatcctttgaagagccataagacactttctcctaacactgcctttaaatgtgcttgcatcttatacatttcagttaaaaatcagctctaaccccttctgaatgtctacttttattcatgattttcctggagtaagtttacctatatttacacttttccaggctttctctcacttgttctttaccgtaggctattttaaaatgagaaaactgagactaaaaaggtttgcatgatctgaaatcaaaaatggctgcaaaacagggttaaaaacaggcattctggctccatgccaattttagattttttttcttttctagtcttatagagatctttttctctgttgggtgctgtgggaagtgctttatatcagcgacttataaaatggggataataaaagcatctatctcacagtgctgtcaggggcaatgaatgcgttaatgtagttaaagcattcattgcaggcacaaagcaaacactctgtttctaaaagtaattatttttttagtagccatctctgaggtatttcgattattatgcccatttgaccaataaactgtgatccagaatggttaagacacttgttacaaagctggtaagtgaagctggaactcagtcctgctatgagaacccgttcccatttgcacaagccacactcacattgcctctctggtttcaaagaaccactctcagtcactcagctagttcttggcttccaagcaaggcagagcctaaactaactgagctgtattattatacttcatctgtttgacaagatcctcagatttcgatgccatcgctcagtaatctcttctttatctgaggactttgacctttgcataatttccacctcactgcatttgtgcaaaaaaatgttgacaccggttatgtaccatgcaaaatatgcaagggactgtggggcatgaagggtgtgaggaagcttacagcccagaagaaaagggaaggaatgcacataagttactaagtccaaggaaaaacattagtgtccatgagaaaatgcgtttaaagtgtggtaggatttcaggggcaggagaggagtaagaaagtggaagggtgatgttagtcagggagtgttgcatggagtctgagcttgaccatgagtggcagctcaatcattcctttaatgagtcaattaacaacacttatgtctgctatatgctagaatatgcaagaccctaaacaaatccaatcaacaaatcccattggttccacctccaaagtacattctgtatctgaccaattctcactaaccctgctaacatagccgtaggcccaagccaccactcagcaaactcctgtctaattttgttactttcgctctcacacccctaaggtctatttttacacagcagccagattaaagagcatatctttcatataatttccctgcttacagtccctcaatagctgtccattatattcgggataacattcaaacttctcgctgtgttttgagtcctcttggatctcaattcagaccaatgtaatcctgtcccacacctcctcatcacagttctctgcccacatagtctttcgatttattaaataaactaagactatccctgccactggtctttgtactttgtgatccccatgtgatgttctttaccccaagattgtccccttatttcttagactgtctccttattcttttctctttcttgccactcacttctaggctcaaatgctgtcttctcagagaggcctttcctgaccacactatcagaaggattctgtgtttttgtcaccactccctggttcctcttgatcaaattgctgtttttttatttaattttctccgtagcactcaccaacctccctgaacttcttttttttaaatgcctcttagcacgttcatttcctatctcatcccacttgtgtagatgctcctcacatgtgggccctttaccgacctcattcatctcactgtctccaggaactaggagagagattgtcagttacaggctttctataatgatttgttgaatgaatgatggcataagacagggttctttcctcacgcaggcatttgaatctcatgaagtgcatcagcaaaatcataatcagagactggcaagtaattttattaagtagtgcagtgggttcaagggagaattcattagactaggatggggggaaaactacgaagacctgcaaatatctataagagagtggaatgaggaagatttaatgatcatttcaggcagttgacaggcatgatcatggcagtatctggtccgtttcatctggtaatagcgcaaataaaagcaaccacaaccatgaaagaaaagagaaaggaaacaagagacaggaaaaccagtgagtaggctgttgtaatggtctataccagatgtcctatcagtgggcagaaagggactggacacagaaaccagcaaagctgcaaagctgaacccagcagagcatggtagcgtatgtgaaggctgaggcttcacatgtcctcagaggctgaggacaggaggtatcaaaggtgatcttaactgatggtgaaacatgttggacgtattcttcaacatttcactggctctgactagtgaaataattaaaaggtattgtagggaatctgggataactcattaacacgaagaaagaactgcacaaccaagacttaggaagggctgggaaagaggacgctgtgaatgacctgcagcaggaacttgctgacctctacctgagagggctgcccttagcatgcttctctctgggtgttcttgaccatggcatctacccaactcccagtcttcaagtttcaaacatcaacgaggaagattctgtatgtaggtcagacgaatgccgttggatcaatctgttattgtctggatcaatctattattgccaagtacaaaagagcactagggacccgctcctaatgactggggtccttttaggacaaagaaaactcttgaagggccatacagctgcttcaagtcacctcgggtgaaattgaaaacaggaacgtgtagagaggtgaagataattgaatttttgataaagttgttcttgagaaaccatcaggtaatccaggtagagctgttaagctgataacttaaaatgtggagctatgccttgggaagagggccagagtgagagagaagataatctgggattcatccacataaaggagataattgaagtgacagtagtgaatgagatattcagggaagagagatagaaagagaaaagagcaaataatcaaccttccagaagaaagggtagccaacagtgccagagcaggattagtaagtgagatgtaaggagaacctagaaagtaatgtttcatgggagtcaagagaagagagagcatcagagacgctggatcattgagttcactgtagaagccctatcaatcccaagtgaaagtttcgtcccagcaccaattagctttaggcaagtgtgtgtacaggggccatttctatgtgtgtgtacatgtccagaggactgaagggcaggggtggaatataaaagataatagttaaaaagatttcaaccataacatgtgatctacaataaaagtctatagccacactattgattacctataagggaaaacttccataaggcaactagactttgcttttacattattttgacaaggttcatgaatagataagagaaagtagatctgaggtccattggtctactgaagttgtcttcaagtctgaaagagtgaagggctgaaattttaattcacatctcattccttttaatagtctggcttaaaaataagaaaacacttgtctcttcatcagtggcagaagatgaggacagggtcatagatctgaataaggataatagttctttgcaaagaagtactccaaatggaggatgactcaatgtcttgacaccagtgagaataaattgcacagtcggtgcacttaattgtaaagttcttatgcttttttattcaatccaagacaattcaacaagtattattgagcatccagtaagtgcccaacattgatgcaggagttgggaatatgataggtacaaatgagccagctcttctttcttggagcctacagtcaaatgggaaatgcagaaaaataaagaggcagttattaaatattatagtgagagcaaaggtggtttcatcctgggagctcatttcacagacacttaactcactcttcattctagacaggttttctgacaaaaagacatcatctgaacagagctcttaagtatgagcagggtcagacaaagataggaaaaatctgttacttatagagcaaacagtggtttcaacagcttggaacctagagggagatcatacttcatcttagacataggcaagagctcagtttcctgagtgagtgtgtttgggtaggaataacacaaagttgatgaattagacaggaataaatcatatttcaagatacagggctattaacgtaaacaggacacagatcacgaagggtctttagagcacccaaaaaagagggtttttgttgtggtggtgttttttttttttgtttgttttttgttttttttttttttttttatcttgagagcatgagagagccactaaaaggctataaacagaggcacacagcatcaaatgtgtccttcagaacgatcaccgtggttgctgtgtggacaagtgattgagggtttgggggaagagggtggctggtctaaaggtaaagggactaattaagaggctgtttcagaaattcagggacagatgatttaggaatgtggcaaactgactggagagacttgaatggatgtgacagatacagacgtgatgaaatctatagatattgaaaaccaatgaaccactagggctggagaggaaaagagtacaagatgatattcaagttttcagaaaaaaaaataccatttctagttgaaaattaagaggttatttgcaaaactaattacagtataaaagactaacaaagtgtgcaaagctctgaaacaagaaggaaacagaacatgcacgttgcaacttagaattttctggtagaggcaacttaaccttcccagagtattcatctccacgtttggggcatccagccattgccaaggaagggcggaaaaaaaagaattgagaatatgtgccatgtgagtgtttgttcatgaccatttaaaatcagatgcttctgcagtgtagacccttcctacgtcccttgtcttagaatggtgaattttccaggtaggcatataccatcgattccagcaggtgctaagcagaaggatctgcagctaacatgcaaatgattagcaaaaaatttggctaattctcagtaccactgccaactccagaccaaaaccaccatcctctccttcatgactcctctaataagtcgtctcagccgctgcccttgtctccccatattctattctacagaaaaaaaagatagagtaatattttaaagcatagatcaagtcatgtgactcctctgctcaaaaccttccaatagatcttactaaaaaaagaaaaaaaaaagacacggtggctcacgcctgtaatcccaacattttgggaggccgaggcaggcagatcacatgaggtcaggagttcgagaccagcctggccaacatggtggaaccctgtctctactaaaaatacaaaaattagccaggtgtggtggtgcatgcctgtaatcccagctactagggaggctgaggcaggagaatgacttgaacccgggaggtggaggttgcagtgagccaagatcgcgctgttgcactccagcctgtgcaaaaagaacataacttcgtctcaaagaagaaaaaaaaaaagataaaatcccatttaaaatggggtatgtgccttttatgataactctttgattttttgtctcactacacaccccttactcactccagctacagcggtctccactatgtgccttgatcatacagacatgcttctatctcagggatattgcacttgcagtttcctcttcctagaccttagtaagtacagcagctaccttctctcaaattacatgcttccactcccaattcttcctcacctcttccaaacccttttatactttttagcaattaccactatcatataaactacatattgtttttatttatcttgtttttcccactaggctctaaacactattaggcagaatttttaccagctttattcatgattcccagcactgagaacagatttgacatgtagtaggaggttgataatgagttaatgaatgttgctgaaatatctaccgaaagcaacaaacatttaccttcatgaatacacatggtttccccttaattaacatacatagatacaatacatcacccttaaatattttgtattgttatgttaatagagaaaaaagttcaatttccccttgggagaaaacactatgaaattgcttaattgcttatgaagaaactgaaaatgtaataagtaactaaagttctaaaaaaatttgagtgaccacaaaacccctttaacctgccctccaagtgggtcctgaaatggaaagctcttaatgtttatttgggtgataagatggatttggccagttcattttggatttgaactgggcgaggctgaattgccctgcctaatagaggaaggtgggatttgaagtggcctacctcctcctgtttcctgggtggagctgacttggttctgtggatgaaaaaagggatgaaaatgaagaaacaggaaccagagaatgcactctccttaagcaatgacaacagtaatttattgagtgcctactctgttaaagatacggtagcagagtcctcacatatattatcccacttaactgtcacaaggactctgttaggtgtatattatctgcacttagcagataaggaaattgagagaagttcaaagtgctttcgtttttgcacacaatttattggtgctgggattgaatctaatctgactgctgtaagaccctctttctccaccaaatgacgtttatttgttcttggaacctctcgttccttctcaccacaaagtagaaggcatttttcttcagaaataactttaggaataataattttgtttccagtaagttcattaaaaccctttgtaacttataatacagttgaaaggccaacattgtttctaggaaatgtgagctgggagctttaaactgcagacttaacaagtcaactttgttatagtctgtttccctcttcttagaggagataaataggcagcactgttcaattactcaaactcattctgtgtttcatctttccagatagcatttagccttgctttattttttcccaccattgaagtacaaaagctgcctggtttttcactgcacaaagtaaatgatgagcccggagccaatttctcatctcagacactgcagttttcaatgtgcattctgaaagctttgaatatgactataaacacatcaaccaaaacaaactgtaatttttataaaataagcctcagagtatgttttgctgaaacttaacaccttttgtctaagggaaaaagcagaaaaggcagtaagagcagaatactcgtactccattcactggcagtgctgaatcccatgtaaaatctggtagtgcataatcaagacatatggcctcatctttctttgccacttcccaggagtgaggtgtttaagaaaactgagaactcttcctggccaattcagaacggggttgtctgcagcaatgctgttcgaagtgtggcatcagcaatacgtgggagagtgttaaaaatgcaaattctcgggcccaccccagacctactcaatcagaatctctggggtgggtgcagcaatctgttttacaagtactctggatgattgcgatgcaagctcaagtttgggaagtataaactaaagggaaggaattccacctgaacgcagaacaatgggattcaagtcactggaacatcaattgacagagaattattctgagataagtcctttaacctctctggcttctgtgtttcttatctttaaataaagaaattgaaacattttaaccctggatcacatcttaacctattatcagagcatatcatggttacctgacactggtataaacatccctcacataatgaaagatttgagtatcattttctgactgctcttattttttctagctagcatcataatgacaatcacagcaacaacatcatgggagggcctcctgtgttcgtgtaccatttcccaagtttaacacgtttgatctgctgatgtcctctagtagtaatatctccagtttaggactgaggaaacagagcttatgtcacttcctgaaggtcacaaagaaagtaaattacagggctgaaatttgaacccacatctgatttcaaaatctgctcctccctttctaccaacgtctatcttcccggaactggtaactttcattaatgagaggaagaaaacaaaacaaaacaacacaatccataaggtggggctaagcagacctcatttctgtgaacagtgtgattccttgaagtatgtaaggcaattactttgaatacatttaacacacgtattgatttcatataaaagccactttacctaagagtgatcaataaacaacaaagcttacttgtagttgtactaaactgctgatttattgacaactctgagatattttgtccctggtgaaaagacacaaaaaatagaaactggagagaactttggaaagcttctgccttaaagaggttaccataggcaaaaggaaatttagaactagagaagcctagcaatttatttaaggtcacatggctggttagtggcagaaatatggttggaatgtatcttactgcccacctgagttggggttattgctgatattattttattaagtgaaactggatattgtttcagaggaagcttataaagaagtgtggtagtgcagattcttcaatgataagccagaattactcacaccaataaagttaagatgctaattctgggcagaggcaacagcctaaagcaaaggtatggggggtctggaatcgcatgatgtgtttggggaacgattagaaattccatattactaaaaaatgaaaaagtacaaaccaggaagcagttggaaatgagcctgagaggtatggagtattgaggttatgaaggactgaatatgtcatcccaaggcatttgatgttcataaggggttgctaaagaattggtgcaggagaatggcatgaatagatttgtattttagcttgctttggctatagtatggatttaaggggtgaggaaaggaggaagatacagcatccaagactaaaaaagtgagatgagttgggcttataatattccaggcagcaaatggtaaagtctgtgcaatgtcaattttacaagcaatgaagtagaagaggaagactcaaaagattttttgagaggtaaaataaccacaactcagtgctcgattcaatgagaaaggagagagtatatgggcgactcccaaatttctaacttggacaactgatgaatggtgatgacatagggagaccaaagaggaatacattgggccaagtggaaatagtaaaactagtattgagttcactgtatccctgcaccatcgctgtcaagatatcctggagagacagtccacacagaggtgatggtccataccattgcaatgtgtgagactccccaaggcaaaagagtaacacagtcaaggtgagagtcttggagaatgttacagaagaggaggagcctacaacaattactgtgggagagaacaaaggagttggaagcagagagggaaagccttgtgtcaaaagccaaaaataattttctttttcacacttcatgaattataattagcttcaaattcatagagttccacggaagtcaaaagtgacttcatttttgcaatatgggtgtcactggtacagaagatcagtaaggatggaaatgcaatcacatggagacgttagctgcagaattgaaacaggtgtgtttctgttttacgggattcaaaaatgctaaaggggagaggacaggacataggaacaaagtggtgcaagcatgacatataaacatattgaggagcaagcagagaggaagaagtgaatgtagggagagaggagacaagtgatagaacatctctgaatgtggagggaccaataaggtgttatttggctttggcttagaaaaactgagactcatgtgaatagcaaaagtatagaccttttcatataaaatattgtactattacgggagttaatgcttatatgacaggccagaggttccttgtaaaaacaaacaaacaaacaaacaaaaacccaataaaaacaggggttcccagattataatgttagctgcagatcagatgtttggaaaggccacgagtttcccctgacatccacctggtcacatggagtggctcagtacacaggcagagctggccacgtgttttccctgctttggtaagccagttacctgcttctcaaataatcaggagaatataatctttggcagtgtgggtatcatgcagataaaactaacaagtaatcattggggccttctcactttttcccacttattgaagttttttctgaataaataccaaaaagcctaatcatagaaagctttaattggctcaattctaattaatatacagatgattaagataatttatatttcatatttatttattacgtgaacttccttaaaacacagtatctatctaccatttttttttctacatataacctgcctgagaactcagaccaaatgagttcccaaattatgctggacagtaggacaagtttgatgaatttcaccataaatatggtttggcacaactttatttgaaaatagaattatagaatttaagaggcctcatatccggaatgcttatatagtttgaatgcagagtgactttggttatagtgaaggaggaaggacaggccctcagttaggtgtctcaaataccttcttatttaattacagcagcatctctaccagagagtattacgcaattatttttatcctaaaacatactctttcccctgacatttgcattttttctgaaatttgcatgcaaactttggttgatctactcattaaaaataatgtttattcttcgcacctcatgcccttaaaagtatttatgtcaataggagagcaatagagagccttaaaatggaggcgattgaagcacagagagactacgcatctcaacaaggtacacaaaccagaattagtagagccagaatttgaactcacgtctatctaacttgaaagctggttaagagcaaatctttgctatgtagatgaaggcactatgctgggtcctgataaggcagcacctgcccttaagaaacctgcatgcagaggaggaaatggacactaaagaataaacaagtagataagagaaatttagatgctccataaattctacaaaggaaataaaacagggtaaggtaatagaggcagattggggagttgcttcttgctgtcctcttccaagaggtaacttttgaatttcttcccattcttgtaaaattgggcaacagcacataccatgtaaaagaagaggacttgcataagccgtaagatagaaagaaacttgcttttgaccaactgtaaatcagacattgccactcctcattgtaagctctaggtgtctctttttaagggaccataatctactggggaaaacagataagccaaattatatatgatgttgttatacatcaagagctataatggagatgtgttcaagattctacagaagcatggaagaatggaaatttgctgtcggtagaatgagtgtttcagaagtaaagatgggagttaagttggtcttgaagaaataggattttgcccaggacatggggcagggaatgggtaagtgcatgccgtgcctgggagatgtgtctgtgtcatgtaacacagcatggaagtctgatgaaggatggcattggcagttgtattgtcatggcggacctaacttggggtgcagaatggggcatgacaggggatgttctgaacaagatgtagcacctggaaataattaagcttggcaaggtctcacaataaattctctctgttcttgaggacaaatgtcactgaaaatacttcaagtgaatttcctggcagtgcctggctgactttccaaggtctcttgctgaataatgtagagggaacactgtttgagtcagtggttctcagtagaatcaccagtagaacttaaaataatatgaacacaaatttaaaactttaaaaaaatacccttgaataattaaaatcagcaggtctgggaatggggattgcacattggtgatttttaaagatcttcaagtgaatgtaatagtcatccagcgttgaaaggcactatttctagaagacttggaagggaaactgagttttcctgaaggcctgagacaccgtatatggcggaacctgtacagaaagaagtcatccaagaaaagacaaggaactgacagggactgatcttaggactggcagtgtccatgttccagggtttagaaaaactcattttttaaactgttgtgtttacatagtagatgtatatatttatggagtatatgggatatttagatagactattgtcaccctgtcatgctttcaaaaactagatcttattcattctttccaagtttttttgtacccattaaaccatcttctctactctgcccccgacccacccagcaacttcccttcccagcctctggtagccatctttttactttagagaaagtcattctgaaagcaaagcaagtgaaagaaatgtaatctttaggcaaccaagctctgaagtctaatggtgagatccgaatttaatggcgctctgaatactcctcagtaattatctcagaagaaaacaatggcgccaaagggaagccctgattttgaacagtcccaggtgacagtaaatgagaagtaatctgactaagaaaccaacggagagtcatcccttgactttcttttccataatgacacctgaagcacacttgtttattctgtaaactttagttaaacaaatttaccctccaagacactgggggtttgccagagaacagttagtttaattggagctcatctgtttttgttcctaatgagcctcccatttcatagcctgctcctagtttgaaataaaatgtcccccctgtctgggatgattaaaaacctggttaagcatacaatatacagtagctgccaaaatgtttccaccaggcaatactgctcagaactgagacctgcaggcaggattagaagagagaaatctgttgattttttccagctcaaaaacaaacaagcaaagaaatcacatccaattatctgagttatattttattaaagaatccaccggagaactgcattcacttctcaagatttgctaccaaaccgtctccccattctgtcttttaaacactcctccaccctttttgttctctagttggtttgtaatttagaaagtgtgataaacaattttggggagccattaagttttaccagtgtttctgtctgaaattaggctactatgtttgccaaagagctgctctgtgctataaaatctttattaaaaatacaattatttacaaaattattaatacttatggattagaataaatgtgacttcatcttgcagctatgggcattttctttttgtttttgtttttgtttttttttgagacggagtctcgctctgtcgcccaggttggagtgcagtggtgcgatctcggctcactgcaagctccgcctcccgggttcacgccattctcctgcctcagcctcccaagtagctgggactgcaggcgcccgccaccacgcccggctaatttttttgcatttttagtagagacggggtttcaccgtgttatctaggatggtctcgatctcctgatctggtgatccgcccgcctcggcctcccagagtgctaggattacagacgtgagccaccgcgcccagccgggattttctttttaagaaactgtaaggtgctaatcattgggtatttcattaggagacacatttaaaaaatctgattctccaagcactttgttcttagactcccacatccctttcaccctcccccaaattcaggatcacaggatttcttctgtctgccttatgtattttgcaagctaactattgcactagaaaaaaaatatctttcacaaataatacagaggcagatgttttctggatcataatgatcaaatagagtgagctaaattgctcattgatctgtgattccttgtcatttgaaaatccgattaaaagtgtagaacttttagaaaagacaaatatacacacactattacatacatcataacactaagcgtgaggagtgggattcatgttatgaatacatagcatttgttctgggaatagcaaaaggttgatactcaatacatacttatccaatgaataaatgagtgaataaaatttcaggatggatttggatggctttgcaagtgagtgtcaataaaccctgggttcagagcctccattatgaacgaaataattatgaaattgaattctcctgatttcttttggccttaaagactttctttcctttactgtgttaagggttgaccatctccttcctttccaaacaattaaaatgtatggagggcatatatgtttgattaggttttcatgtagagaattacagttacttccagcctgtctcatgatttccttgatgggatatttggttgttcctaaactcctctgtagtgcatttaattactatctcatagttttcctaccacatgtctaatgtaatgcattttattcttacagcttcattctcaaaagacatcatttatccctttatttccaagttcctagggcattttagtacatgtcttgacaaaggacatatcccttctctgctgctggaatgggctgccgcctctgagctgcttcaggcacgcattctgaaaagacgttcacacagggaaaaattccgttcaccttccttctcattcaaccgtcctgattttgtctgtgccattttaaaagacttgtgtgcctactttctttgtcagctacatctgccataacaaaataccaaagactgggtggcttaaacaacaggtatttctcacagttctggagattggcaagtccacaatgaagatgatggccagtttagtccctggtgagggccccactctcatgacctaacccaaccctaattacttcccaaaggactcttcttcaaataccctcatactcgaggttaggacttcaacagtaggtcacacacttactgctaattaaggatgtctctgaaagctgtagggggtcacagatgtcactaacaccaaacaatgaaaaagcacaaggcgtcttctttgattcgttgttataggaacatgtccacacttccctccctccccttcgccagtcactgaaagaatacaggatgtgactataaagtgatgtctccaatttttaacatttaaaatagaaaagaaattgtacatttaaagaaaatatggtgccttttcaagaagtcccttggggaaccacactcttagtctaatgacgcttctgaatggcagagcacctttttttaattccccaaagaaaatgcctgcagactttgtggcgtgttctttcgaacgtccgctgccaggaaaatccctgacctttatgcgatgaatttgattttgggaaatagcaaaattgcctttggagacaagttttgcaatcaagttaagtgatcacaccagagaattctgcttcaggaacaaaactgggacagataatagactaataagatgccttcaccaccaggcttgtaaaacttgtcttgagaccaattacaatatagaccttttcaaacttatttttagcaataagagcatagtatggttagtgtgtaaattaaggtaaaaatattgaaacacaagatatatttgaaagcctaagtaatcctattttttagtttaacctttccaagactgtctttgcacacttggatttttatttgaaaataacaccaatttgaaattcatactaattgatgctaccacttcaagagttcatgaaaccaagcagtttcaagtgaatttgcgttggatcaccctgtcctgagagttaccttttggaaaacataacctgcacatatgtctcatttattctactcaatgcctcccgatgaaatcagtagcaacaatatatgcatagtagcgaaataattgggcaaaagatgaatcataattttgattgtaattgggggcagtgagagaggaggaggaaaatacagtcattaaaaacatatataagtaattggcttctttgctttcttgtgaaatatgctagccccacaacatgattcttactcattaactttagaagtgctgtttctaccgtattcacttcctagtggcattgcaggagatccgtttgcaatttgtgtgactgactcaagatttcatacaactcttgtttctgaaatgtcttctgatcactgagtcataagagtaacacttctcaagttgttattgttctgaaagtctttgaagggtctgggatacttggacaatattatttccatcggtacttttccatcctcctgtgtatggtattatttccagccaactttggaaaaatagcatttcaacagctttgcatatccacattgcacctgcttctggactataaatgattacgtataatttaaatttatagaaaatgttcacaggaaccagatcacagggcacatatgtgactactgattgcttctatttcttattttccaagtataaaaacatatttataatgaaaagcttatacttgctttatctccaaatcaacaaaaattaaacctctttgatattagccagatagactactctttcaactttgaccttaaaggacaataatgaatctcattaaaatcatatttccaaagtggctttcagaaagtctcctactcttacactatccccaggttcaacaagtttatttttggatgcacttaatgctttcgtttcttcttttcagattctgatttaatcacttagcttctgtggcataatcaagacaagttggatgaattgtctcctaactggattataatgaaagaagctctaactggtcttaacgtagtttcgatgtttggagtctttcacaaagagaaacaaaagcatgataagaatgtgctaagctaattcgaaagggaagcaagggtgtcacaattaaacaagggtgtccaattatattgttcccatacatcattccaccactccaataggacatgggcttatagagaacagagtcaagccttgtggttcctgttgtgcccagcacacacagcattgtgcttggtatatagtaggtgctcaataaacatttgaatataatttaatctaggctctcccagggagaaaatatagtttagggttcaaggtaaagaatctcaacatggccagcacagtggcttatgcctgtaatcccagcgctttaggaggccaaagcaagaggatcgcttgagtccaggagttcaagaccagcctgggcagcataatgagtccacatcttcacaaaaataaaaataaaaaaataaactggatgtggtggcgtgcatctgtagtcccaattaatcagattgcttgagcctaggaggtcaaagtttcagtaagcagtgatcatgccactgcactccagcctgggtgacagagtaagaccttggctcgaatcaaagcaaaacaaaacaaaacaaaaacctccaaaacatttaaacattagattctccagatatatgtatgttttgtatatcgatcattctatgccacaggaaatgttcaaccaggatctgggtaaccagattagtgtcacaaagaaggagtttgtagatcacctaggaagtagaactaagttatatctaagcaaccttacaaattgaaaatctatcagtctttgaaaacatatctgttctatgtttctcacagtcttattggtgatgggataatgaccagttggccatgatcttaacaggaaacgacaatgtaatatgctagcccttctaggtaacatatttaccctggcacagaatgccttaattccaaggtgtgactcactgtaatcctgagaattacagtaatttgggggtggaatattatggccaaaggcaatgagcacagaggaaacttctcactgcgaagctgagaatgaactgaaatgatcaaaaattgaatgcttgaagtcttttaataaattataggtagaaggtaaactcagctatttctggacagcaggaaagggtctaaacagaggaggtagcacagacgcagcaatggaatgtgaatgagtcatatttccacatcagtagggctatgaggagaccactctgagatgatatgacagatagtggctgcattcttcagccctaggaaaaatgaagattgcaggaattaggttaggaggtgaagactttcagggaggtagagtgggaaccagaggccagggagagtgttgtcaagtatgctgaccacacagtgaacacagaggatacagcttgatgctcctgaagtcattacaggcagggttaaattcccctcagtgacccactgacccccagacaccaggcatggggtcgaccagctctctccagttcttctccaccactacataagagaagaagccttgaaaatgccaccaagcttttgggctcagaatgaatcatgatggaagctactgcagccttgacactggaaggcatttcagttctgtcaactcttgcctcaaaggaatgttcatttccttttacacaagataaagcttctttgaggaggatttgtgtcaggtaaagaggaacactgaataaactgttgtggtggatgtcagtgtctattctgtgcctgaaattggaatttgggcttagaacttaaatacaggatgtgactcaatgaacagagaccagagttccagtacaagatataaagagactttgttttgaatcagttctagtatttctagaaattcttgttatatttgatggagtgaaatcggtaattctttgaaactctttaccttgtcagcttccatagtactctgctgtcctcattatccctttacttctctgagccttcacagaatccttcttatcttcccaacttacataaatgttgatgttccccaggaatccattctcagacctcactttctctatatgagctcatccatgctgcttcctccaatcatcaaccatattctgatgacatctacatctttacctccagttcagactttggatctttaaaatcatataattgcttctaccttctaggtctgactatctcacagataagcaaatgcaacatgatcaggatttatcttcacatccaagaggtccttctactacaagaccaccacatgccccatgaaagtcatactaaaaacttaggaggtgtcttgaattctcctttcccctcaaagcccatcatatctactctgtcaagtccttttcacattcccccaacactattcatggatgagtctcatcttctccatctctggaatcacctcgccttaaaggaaacatccaaatttatttttaaaatggaaatgtacccctatgcctgaatcacaggaaagcaataataataactgattaatatttctgcatcacttaaagaataacattcaaaatcacatgtcttttattatggaaatgcaaatcaaatcacattgagatattatgcaatacctcttaggaaagctgatatcaaaaattggaaagcatgaagtgttggcaaggatgcgtggatatgggaacatgagtgcatggctggttgaaatgtaaagtggtgcaactgctgaggaaaatggtatggtagggcctcaaacagttaaacgtagcattaccattgactcagcaattctacctttacgtgtgtgcccaaagaattaaaagcaaggattcagatatttgcacagcattgttcatagtagcattattcacaatagcccaaacgtggaaacaacgccaatgtccattgatggatgaagggataaacaaaatatggcataatatacatacaatggaatattatttagccttaaaaaggaatgaaattctgacatatgctatggcattgatgaaccttgaaaacattatgctaagtgaaataagccagacacaaaaggacgaatgttgttattagtttttctcagattacacatatttgaaatatcttagaagaagcaaattcatagaaatagaaggtaggatagtggtgataaggaactctgcggagagaagaatagagaatcagtgtttaatgggtagagcttcagtttgagatgataaaaatattctggggatggatagaagtgactgttgcacaacactgtgaatgtaattaatgccactgaactgaacacttaaaatggacaaaatgctagaaatatatatattatatatattataaaaatggagagacagagagagaggtagagagagcagatgagaaacaatgatactctatttttttcttctcacaattccttataactaatattggttatatatataaccactattctatatatcatggttatatataatatatatattatatcatataatatataaccatataatatatattatatataacacattatagatagcacagatgcagctatatataatatataatatattatattattataattaatataatatagtatattgtattaatataatataatatagtatattgtattaatataatataatatagtatattgtattaatataatataatatagtatattgtattaatataatataatatagtatattgcattaatataatataatatattaattatatatatttttatttctagatatatattatataatatgatatataaatatatacaatatacatttataaatatataaatatatataaatatatactatatataccatatataaaatatatacaatatatacaatatataaaatatatacaatatataaaaatatataaatatatacaatatatacaatataatatgtttaatatataaatatatataaatttttttttatatattaaaaaagagagaaagcttacggcatgtcaggtactatgcttaaaaaataaaagagtatataaatatatatatttatatatatctagaaagaaaaaaaacaaattgaaattacatgccatctcctacttcacacctcgggctccagcagctctatcgtcacctatgtaatcttcatttgcacgatacaccctgtccatatgaattgacagctgactgccactctaggacccttttctgcctccttacaaactggatgagggcttaggtcgctgacaatattccaaatatacccttttattttttaagcatggtacctggcatgctgtaagctttatttcttttctttttttcttttttcttttttttttttgagacggagtctagctctgtggcctatgctggaatgcagtggcccaatctcagcacactgcaagctctgcctcccgggttcacgccattctcctgcctcatcctgagtagctgggactacaggtgcccgccaccacgccctgctaattttttgtatttttagtagagatagggtttcaccgtgttagcctggatggtctcgatctcctgacctcgtgatctgcccgcctcggcctcccaaagtgctgggattacaggcgtgagacacctcacccagccaagctttcttttatttttatttttatttttttcggatggagtctcactcacacggttgcctaggctggagtgcagtggttcaatctcagctcactgcaacctccgccttctgggttcaagcaattctcctgcctcagcctccagtagctgggattaaaggtgtgagctaccatacccggttaacatgcagtaggctttcagcaaacactgagggaataagctcatgagaagcagctatttttacaaatgtaaaatattaaaattggaaggaatcttaaagtttagtctaaattcttaagaaaagtgctattttgacatggtagacaaaatggtgccttccagaggcctaatttccattttaaattaaatagcagcccccttttttcttttccttttgccaattgattctaccattttatgaactcatagaagggttagatctgaatcacacaattcattatgtcaagtgttttccaaacttcaagaaatcttatcacatcttcatagtgcttgctctacccatggactagctgttcaaatgttcaaataagttcatcttcatccaaagcaatactgtcaataaaatataaattattttatcttattttaagttccaggatacatgtgcaggatatgcaggtttgttacataggtaaatgtgtgccttagtggcttgctgcacctatcaacccatcacctgggtattaagtcccacatgcattagctatttatcctgatgctctcccttctcccaaccccctgacaggctctagtgtgtgttgttctcctcaatgtgtccatgtgttctcatcaatcagctctcacttataagtgagaacatgcagtgtttggttttctgttcctctgttagtttgctgcggataatggcttccaattccatccatgtccctgcaaataacatgatctcattcctttttatggcagcatagtattccatggtgtgtctgtaccacattttctttatccagtctatcatcgatgggcatttggcttgattccatgtctttgctatcgtcaatagtgctgcaaggaacatatgtgtgcatgtatctttataatagaatgatttatattcctttgggtatatacccagtaataggattgctgggccaaatcgtatttccagttctaggtctttgaagaatggccacactgtcttctatgatggttgaactaatttatatgtccaccaacagtgtaaaagtgttcctgtttctccacagtctcatcaacatctgttgcttcttgactttttaataatcgccactctgactggcatgagatggtatctcattgtggttttgatttgcatttctccaatgatcagtgcaaatcacagttttgatgtggtgtttatatatttttagtacattaaaataaataattaactagtacaataaaaactcacggatgtaccacctaatgtcattttcttgtactacatggtatgtaaatcatgctttgaaaaatcaatttgaatgcatgattgactactttcttgaattatcctccagggtcctgcatagacaactctgattcctcaacaagctttcacactctctaaaagcaactctctaaactctctcttttctttgttgtcatcgttttatgtttcttagctccttgacgtttgtcaagctctcaccgtattcaacaagtatctgttgaatagatatacttgctgcttctgagatggtatatattatcttcccttataaagtgaaagctatttcataaggttataaaattggaaggtgagatgtccatgagattgcaccttgcaaacattcaagtacaaggaggcaattgaatctgggtcgtggctcctgtactcctgaatgtttgcactaaggccacacctcccacagactctttcaaccaatgactgaacctgtagaggatgcgatggaaggcttctctctaggcaacatggaactcctctcatagccaactttggtttcagaactccctgaaagattgctgaacctattgacactgcacggtggtctagatcacttccaccaacttcccttccccctctccttcacttagggtcagacttgcatcataatttgattgattgttctcccactctttctctcctcatttttttggagggattttttcttaataaagtccctgtatatatagcgctgacatgcttcttgggatacttggactaacatagaaagtattagtgagaactacataaatgttagagatatttcaagctgaatttgtctatgagagtttggatagggttaattctgaattcagacagtgttgagttaaatttctgaattacttagttgtattagtttactagggttgccataacaaaataccacacatcgggtggcttaaaccacagaagtgtattttctcactcttctagcagctaaaaatctgagtttaataagtgtccccagggttgatttattctgagggcttcctccttggcttacagattatgatcttcaccctgtgtctacacattgtcttccctctgtgtgtatctctgtccatattttctattcttttttgttgttgttgttgttgagacggagtcttgctctgttgcccatgctggagtgcagtggcgtgatcttggctcaatgcaacctccacctccctggttcaagcaattcccctgtctcaacttcctgagtagctgggattacaggcgcatgccaccacgtccggctaatttttttgtatttttagtaaagacggggtttcaccacgttggctagactagtcttgaactcctaacctcaggtaatctgcctgactctgcctcgcaaagtgctgggattacaggcgtgagccaccgcgcccagccaataacctcatattaacggaactacctctttaaagaccccatcttcaaatacagacacattctgagttactgggagtgaggacttcaacatttgacttttagaggaacacaatttagcccatagcaccacctgaataactttgagccagtcacttgactttacagagccttagtctgtaaaataggggacaatatctaccatattattttgttcaaatcaaatacagtgacatatataatgccactggaacatataaggcaatcgtcattaaaaaaaatcctcccaatttactaaaatcattgccattactttattagaattaatttatataggggttctattattcgcagtatgtctcacagctatataaagtagcattatatgataaggttgaaaaggaagaggaaagaagtatacagtgtctgattgcatagcttcatgtttatgatatgacagttctatgattctgagcctggcatatttatttaagctatacaccagagttcagaaattgatagttaagaggcacatttggcctgaaaatgtctgtgattttccagagagtattttaaaaatcagaatagaaatgcctttaaataaagcatgcttctgctgttttccacagtttttcatatccctaacacatggtcacattatacaggtataatacttatctagcccttaaaagcttttaaatggacaatctttgaagcacagaccacaggttcagaatgtactgcttctatgtccttgactattctcaaaagaacatattttctaccatattatctaaattatctgagaaagacacaggtgctgctacattgttatcctctagggatgctcacgtttcttcaatatccacaaattcctcctacaatcatctaaggctgctccccattccaccagtaaatattaatcaacaaagtaacaaatagtgcgatgtgccaagcatctttagcgatatgcaccctcaacttcaaacagaaactatttgggatgatactccctcttctgcctgtagataggtaaacaccctctgcaccctagatttaccaaacttcatgacgtacccaccctaaaaggacacgatcttcagggtacacagagtttttctctagatgcttgacgatatcgccattcttcggctatatgagcttgctttttaaaaacaattacttcaggaatctggtatccagaagaaaatagggtagttttcaaactttcattgcattatttttcatgatcaagattataaggtaaattggaactattatcatgattcactcttccagatggttatgcaaagattgagtgaatgaatagagacaattttaaagaaatgaataaaataacttgtatggttaagtagcaaagccaaggagaagttgggaggaagagttcccaaattgccttcctgagactagacaatttgagtaggtcaagaatgagaatctctacagaaacttgctaagacttttaaatgcagtcatgctttgcttaaggatgaggatgcattctgagaaatgtgtccttaggggattctgttgttgtgtgaagatcacggagtgtacttccgcaaacctagaaggcataaccgactacacacctacacgatgtgatatggcttattgctcctaggctgcaaacctgtacagcatgttactgtattgaatactataggcaactgtgacacaattttaagtatttgtgtattttaacatacctgaacatagaagaagtacagtacaaatactatctaaaagtccaaaaataatacacctgtatagcacatttactgtgaatggagcttgtaggactggaagttgctttgagtgagtcattaagtgagtggtcagtgaatattactttataaacattgaagactttataataaacattgtacacagaggttaccctaaatttaacttaaaatttctttgttcaataataaattagcttacttgcaactttgttactttttaattttttaaaagcattttgactcttgtaataacacttagcttaaaacataaacacattgtatagttgtacaaaaatgttttctttctttatattcttattctataaaattttttctattaattattttactttaaaaagaaatttttgttaaaggctaagacacaaacacaacattagcctagacctatacatggccaggatcatcaatatcactgtcttccacctccacatcttgtcctgctggaaggtctttaggggcaataacacctgtggagctgtcgtattctatgatgacaatgccttcttctggaagacctcctgaagggcctccctgaggctattttacagttacctcccttttgaaaaaataagtagaaggtgtatgctctaaaataataatgaaaagtatagtatcgtatagtatagtatagtatagtatagtatagtatagtatagtatagtatagtacataaaccagtaataaagtcatgtattatcattagcaaatattatgtattgtgcataatggtgtgtgctatgctttgatcagactggcagcacagtaggtttttttacaccaacatcaccaaaaacactgagttatgatgttatggcggctacaatttcatatgtgatagtaatatttcagctccattaaaaccttgagaccaccattgtattttcagttcattgttgacccaagcattgttatgcagcaagtaagtgtgtatttaagctgcttaaattaatttcaattgctgttccaattttcttagtcattccacattttgttatgacactcctgaccatagaagaatgcagcaaaacctcacaattcataaaatcacatcagctgtgcacacagatgatgtacatttattctgtgtaagcatcttaaaaacaaactcaaacccattcttttttccattgcataacctttaagcacaatccaaacatttcatttgatgctattaaaaagatctgccgatgcaaaaccatattatagccaggggtggcgggttaatacttcaagtattttcaagataacttttactgttttggctatatacaaggtggtgcctttgcactgattttgtcaccccttagcatgagatgaaaatccacaggaatttaaatctagaattagaacatatgagcaagaaaatttgatttctttctgatgcatgccagaaatagtatattaacaataatacaataaaggaaattcaaaaagtattcatctaatccttactaaagttattatcaatgagttctaaactttattttgtcctttaagaatcacaaattatttgtttcaaatgatcctaatcatcatctaatgtgtcttatactgctatcctataagtttttttgtttttgtatttgtttttgttctttggagatggagtcttgctttttcgcccagtctggagtgcagtggtgtgatctcggctcactgcaacctccacctcccagattcaagcaattccgcctcagcctcctgagtacctgggattacaggcacacaccaccatgcctggctaatttttgtatttttagtagagacagggtttcaccatgttggtcaggctggtctcgaagtcttgactttaggtgatccaccctccttggcctcccaaagtgctgggataagtttttatcccataattaccccataaaatttgaataagaaaatgaatgcctcaggaaaggcaatataaaacaatgaagacattaactagtagtcattataaatatagttaaagacctaaatgaaatcatgcttatagaaatagagaaagccatgacaacaacgtttcagcaaagagagaatatcaataaagatatagacattattttaaaaagaaccatctggaaatgcttgaattgaaaaatataataaccaaaataaaaaattcactagcagaaagtgaaaagacaacccacaaaatggggaaaaatttttgtaaatcatttatctgacataggacttttatccaaaatatataaagaatttctacagcttaataatcaaaagaaagatcactcaattgaaaaattaagaaaggatctgaatataaatttcttccaaaagtatgcaaatgaccaatatgcacctaaaaagatgctcaacatatttaaaccattaggaaaatgaaaatcaaactcacaatgagggccaagcacagtggctcatacctgtgatcctagtgctttgggaggcccaggcaggaggattacttgaggccaggaatttgagaccctatctctacaaaaaaattaaaaagttaaccaggcatggtggtgcacgcctgtaggtctagctactcaggaggttaaggtaggaggatcacttgaacccaggagtttgaggttgcagtgagttatgatcctgccactgcactccagcctgggcaaccgagtgagactctgtctgaaaaaaaacgaaaaaagaaaaatcacaatgagttagcacttcacactcagtaggatgaccataatgagaagcacagaagaacaagtactgggaagcatgcaaagaaattggaaccctcatacactgtgggtgagaagggaaacggctttggaaaaccttctggtaattcccagttaaacaaagagttacccattatctagaaagtaagtgattttatatcatagtttctgctgcacaattttaattcatttattttactgacaaaatttaacaaatttattttagtgataaaattagacaacttaaaataatttgaaaccaagtaaagtaatgctttttcccttgcgacgtcattagctagtacaatgaatttttgagtatcaatcagtagtagccaccactcttgtcaaccagagtcctctctttagccaattctctagttcaaggcaattaatgtttttgaggttgacatgggagtcaggcatgactctgtggttccttccaaaccatcagtgaaatgtttaattatatttagtaccatgttttatgaagtcattttattcttggaattttggcaaaccttgaatcgtacttatagtcattccccaacaactaaaatatctgatttagtcttccagatattagagtttacataaatatttttaaagcttacattttcatatgtatatatttccaatgaaacccctatatgtttgaaccgtttctaaaattgtcattaaacacccagcaataagtctattattctctgtactaatttgctatacttaggctgtgtagaaagttttctttaatggtctcttcaaaatttcaactccgcccgctgacatttagtgaatgtcaagatgcttaatacagggctgtgctttctgcttttttcaatagatcctattgttattgacttatcctgatgagaaaataattctatctcaaatcttagaaaatgtatctttggatcaagtaagtatgttagtttcttaaagtgtccaacccttcatcaaatttttttcattgattaattttacaaattttaagaggaaagggagaagtgatcatcttattttatgtaatatgtttatttgtttaaatatgtagagcttattgaactacattaaaatagaatgaggctgtgagaccacatagaacctgagaggagatttaccagtaggtcaaagaagcttttactttaagaatatcaataatttcccaaggcaagaaaaatgtaagattttacatgctaaagtcatatagtcagcatcatttaaactgccaactgtcacaatttatgatttgtcatttagggtttgtctgacccccatacaggtgaggtaggggaggaagaagagagaaggtaggtccagctcagatgcctgctcaggtggtcagaactcaggagatgaaccatactgagtagctggaagagttaagaaacctgtgtaaggatgggccaattgtcaaagcagttggagccaaattctattcttagtccaagtgtttagcaagtgacttagagagacaaaactgctgccagaagtcaagtgaacaccattatggtgcatgtagtgaaaacaactgagagagagagagagagagagagagagagagagagagagagaactgcaaaaaggtcactcattgatactgttttttttttttttttttttttttttttgagacggagtctcactctgttgcccaggctagagtgcagtggtgcgatttcgcctcactgccagctctgcctcccgggttcacgccattctcctgcctcagcctcctgagtagctgggactacaggcacccaccaccacgcccggctaatttttttgtatttttagaagagatggggtttcaccgtgttagccaggatggtctcgatctcctgaccaggctatctgcctgccttggcctccctaaagtgctgggattacaggcgtgagccactgcacccggcctgatactggtttttaaaatttattttaatgatttaataactatttactgaattctttcagtatgccaggcctagattaggcttcagtgatataaacgtaaacaaaactggcacagtctttgacatcatggaacaccgattctaagagaaagagagaaatattagtctaatggccctgaaaataaaaacaagttacaatcatgaagagtgtaataaaggacaaagttgctgtgataacccataatgaggcaacttgacttctcagggtcccttgccttctggtttctggtcagatttgaccaatgggaggtaccagtaccagaggagacagcagagactgagatctagatattgtttcctctgcctcatgccaattatggctttctagttctcagagaagcctgtacatctccagcagctctggccatattctctttatggttccagctctcgttattatagctcttgttattgttagtatctggatggcttgagattaaagggtccatgggatgtcctgctgctggcagtggctcacacctgtaatcccagcactttgggaggccaagttagtttgctcggttgaacccaggagtttgagaccagctggggcaacaaggtgaaaccccttctcaacaaaaaatataaaaattagccaggtgtggtggcatgtgcctgtgatcccaactactcaggaggctgaggtgggaggattgtttgagcccaggaggcagaggttgcaatgagctgagatcgtgccactgcactccagcctggggggacagagcaagatactgtctcaaaaaataaaaataaataaaaataaaataaaaaaggatccatggtaacatcttcattaatttctttttagaatctgattgggatatagccttctttttcctgcaaggacaatggctgagagtcagttaggtgaaaactgggtaaaggcagactaagaatatgaaacagcatctgaggtggaggtgacaatggccagtcatagtcacgtgagtgtgtctggaacatggaacacaaccagtcttgcatgaggcaggagacctaggcaagagttggatgatgcaaacctatgggtcatttgggggttttgtctctattataaaagcatttctgaaggttttcagtcagacgagaactttatcaggtttcaattttcaaaagattattctgactgtgttgagaaaaacatattggggaatatcaacagtgggtgtggatagatcagtttcttaagagctttttgaacagtttgacatagagctgatgattaattagactaagatgtcggtaatggaggtagactaaaagaaattgaaaggtttaatcggggtcaacaaagtatggcctgtgggttggctgtcattgtaaataaagttttattggcacatggccacacgtatttattatggattgtctatggctacaacagcagagtagagtggttggaacagaagctgtgcggcccgtgaagtcttaaatacttactctcttgggctttaagaaaaacttcgtcacccctgggttaaatcaagagcatttggcattagattagatacggggctgagggaaaaaaagggaggcaggagagtcagggacgaaggagacgaggccacagaagctcttctttgacagtgataatcttattttaggtgcataattttgggatttataatatacagatatataatgtatgttatatatattataaatatatatattatagatacaaaatatgaaaagatatgtaatcttcttgtctttgtcaccaaatcatcccattgctgaataagacttcttctattgttcttttgttttaattgcaaaagtctagttttccctttgaagaaaagaagtagagaaaacattaattcacaagggaaaggaccgtttgtctaattttgttagaaggtctcagggctcagttctcttctcttatttatgtatattcactcttctttgttttttaaaaaaatcttatctaacctcatggctctaaataatttaacatgatgacaattcacagtttatatttctagtctgaacctctaaaattccagacaaataattaattaccttttcaacatcgccacttcgatttctaatagacatctcacaatcactgtgtccttaactgaattcttgacttccccttaagcagatctactcacagttttcccatttcagttgatgaaagtgccatcctttcagtcattcaggccaataccactgggaccctccattaggaactatgttgcctctaccttcagaacatatccagaacctcaccatctctcccctcccccccaattgtcactgtcctgatcagagatgtcatctttcctaggctgaatttctgtaatagcttcctagcacgtctacttgcttctatccttggcctacccactgtagtctattttcaaagaagtagagtgaaccttttaaaatagaagtcagatcttgtcacctctctactcaaaactctccaacagcctctgatttttacttgctcagacaaagtacttaaaactgcacacatgacctcacataatctggcttccatattcctctggcttccaatatgttttattcactcctctaaatcatagagtctccttgaattaacatgttcctgatccaatgtactgtagtaaaggagtgaaaagtaaacatgattcccagaggcagttagtgagatggttgcaggtaaccattgcctcccacactctcttccttccttccatcctggcataggttatttagcaaaatacttagtaccttctaatatgtgttacatgactgctagatgccagtgataggaaaatccatacaacataggaacacacaatctggtggggaaagatgatatggaaaccaaccaatgcaagacaatgcaaaaagtgcaggcatagaatgatgggctgtaatttttaaaaactcaccatgtctaagttgggaaggatagagattctatatgatggatgcaagatcattccaaccaatgtagtttggaagaaacccaaagcattctaaattatctagtgaacttcatgttgctctacctaaagtatttccatagtaaccaggcctgtgctcttgtgtggagcatgagtggctaaccactgaattatattccttttgtcacagtctaagagcaatataaattcctctttttttcaaaatgcttcccaacttgagacacaaacattctaccaagaatagatttgacttaattatctatacgtttaaaatgtaaatgcagcctttctaagagaagcctacatttgttaaatcaatctatgagatcaccttctttctaagatgagggtaacttcaatattgaagtgaagacagtatagagacactaagaaatctacccaaggacacacagctgatcaggggctctgacttaatttttttcccaaacattaggtttcctgagtgcaaagttgttatattcgttcctacctcataagattgctctgagcagtagaagtgataatatctgaaacatgtaggacactttctatgatgtactaacagtgcagtaattgttagtttctccaatgtcccacagccaacctatgctactggctgcaaattctaagttatggactattaaatgatctggtcaaaactggatatggataaaaatgcactttagaattacttttgggaagtagaggttgccaattaggtgggtggaaatgctttctgtcctgtaaagtccaagagttgtctatcaccaacgacaccattggagggaagctgttgagtgcactacctgccatctgggcctctgttgttggacactacttgactctttaaaagaggttgctgtcagcatcatgtctatttgcactggttgttgagcatcattatggaaggtgagtggcccatgttgacctttatgctcctacaccaacttgagagcctttaactgcatagaggcctttgacttaatgtaataaaataatgactctttccatttcaatgtttccattggtgttttacttgaatccctactatacaaaaaaccttagtctcaatagtttgaacagtttcttctatgtccaaaacactcaatattgagttctcttgataaaaacaaaacttggagttatttaaaaaaatagttcagttggagactccctttgctatctaaggcaggggtccccaacccttcggtcatggactggaacctgtcagtggcctgttacaaactgggctacacagtaagaggtgagtagcaggcgagcaagcaaagtttcttctgtatttacagcagctccccatggcttgcattactgcctgagctctgcctcctgtcagataagcagcaccattagattctcttaggagcgtgaaccctattgtgaactgtgcatgcaagggatctcggttgtgtgctccttatgagaatctaatgcctgatgatctgtcaccatctcccattaccctcagatgggactatctagtggcaagaaaacaagctcatggctcctactcattctatattatgtgagttgtataattatttcattatatattactatgtaataatagcagaaataaagtgcacaataaatgtaatgtgcttgaatcatcccaaaaccatccgctgctccccacgtccatggaaaaagtgccttcatgaaattggtctctggtgccaaaaaatgttggggaccactgatctaaggtgtttaacaaactgtttcttacttttaatcaaaccataccacactgattgacttcagaaatgctttgtttaactagaagtgttcaggacttacgcatgttgcttttatcatcatcatcattataacttataacactaataataacaataaattaccagactttgagaaaaatctcagaagctcaatgaagtgtatagttcataatcagtactaaattgataggcttgtggtttagaatttgtgtagcggaacgaggataaatcagacttcagtatgatttgtgtatttgtttactgtagcagaaatatgatgtcctgaccatgtccccttgacccactctggaagccatgaaagatagtctcattcagagctacagctgtccatggctctgcttgagggtgttccccaggcccagagaaacaccttcaaaggagagagcatggcatagaagcaaccctcatccaacaaaagataggaattgtccatttcagggtcaggttccatcttccatctggtctccaagagggtcctcaaaagactacgcctcccatgactatacaaccttccttagctttcctctcttccttgttccccattcccacttcttcacatggctttctggaattacttcccaagttccttgcacctacgtgcttgtcatagagtctggcatgccttaatgaaacactcgttaattttttatttgagatccattgaatcctcactctgtgccagacatctttcatttatgaaatagtagcttctatttttgtacccatttttgtgataaattaatgtttagagagatgttaaataatttacaaatcacagtgagtggcaaaacctagtcaatttccattcttcagttgcttctattgtttgattgctatcttttacctttactccatgaattcagattggtaaaacaaacaagagactaaatgctgttatactgtgacattctgtaaaattcaaatctctgggtgaattttgatctaagggatatagaggtgtgtcttttttgttgttacacatgcaaagaaggcttctctccactgtacaatatccccttggcttggctgtgagctcatctgctctcatttttgacttcagtttcctcaaatggaaaatgaaatgccttgggctaaatgaattttaggatccattgaaaagctaacttcatacaaattcgagttatgtagtctggtccctccggccaactctacatcgctagctttttgttttatgctgaattctcttgataacaacttctaaagcaaagcttttctataaaatgccagatagaaaatattttaggaattttgagctgtaaggtatctgttgtaatttctcaattctgcaatgtaacacaaaagacaatatgtaaatgaatgagtgtggctgtgtcccaatgaaattatttatgtcaacaagcagcaaagccactagacgtgctcaatgttgcacacagagaacagcctcgaagggcctcacaccaagacatggcagatgaggaatgacaggaaaatttcaaacattgcttgtatcctctgtgtaactgtcctcctggaaactttaaagatatcgctcactcacatagcttctcaaagaaacaaaggataaagaaagcttttctatttctttcttacatgagcccggatggcttctacttgacatggactgttttgtgttgtgtttgcgctgggcttagaggctgagaagagtcaatacccaatgggggtgttgtctggagagctggggaatatataaatattgcatttggaatgtactttcctcttgaacaatcaacctttctgcacaagtttgcttgctaagggtctgttattggcatttttcttataacccctctaataccaagccttttcaaagaacatatgactcagagcaaacattcttttgaggttgaatctggcattcttgatgttattcaaggaatatatttctttgtataaacttttcatagaaaacttcctgaacctgttttagagagcccagaaagtcctagaaaaaaaattgctgcctcatgcttaagcttctagtgggttttgtgaactgagaatgcgtaaacatggtcaaacattatttctgatcccgtttgtactgaaaatctctcctgggctggtgatttgtaattaatgatagttcaggaaaccttgacaactatcttagagttggggaaaagtgatacaggctaagcaacgagctcgttgtcattacatgtaatcaagcagaaattgaacagccattcaccaatgatgctgttcagagatttcacatcaggtgagactttaagaaaatagactctgcagagactcacctccctacctgtgagggagaagcaagggaaggagtggaacaaggtctaaggcagattctatactctcccttttctcctctctcctctttgaactggaaaaactcaggtttacttttttagatattagacagttaggaggctttcttaggaagaaagtgttctactactactaataacaaaatgaatgaatgaataaataaataaataaaatttaaaccactggacaactgagatcttgaattatgttaatcttaagattttaaattttctacaagtaggctttgacccattccacataagaactcatccctgtctatcttcctcttagtatctctctgatctccacaaaacaagtatgaactctttttatcctagatacatttaacagctacatttgatagaagagtagaaaattcttcataggttttccatttacaaggaatagccatcaggtttagaattttgaccatcattaataagtaaactcttcaaaagtcaagcagggctatgttttttgagaactcagccctttagggataaaaggaaacctttagtaaatatccatcggtctattgcatcttggccctaggggcatgcatactcttcgtgttatgtcctcacataacttttatagctgattctcttaaagaaggatagagtcagaggagacagtgaaaaccatgaaagtatgaacatggaattcagaaaaggtgacaatattagtatcaaacatatgtcaggtatggtaggtacctgataaaaatttactgaatgaatgattgaggccatgattatagacactctctatataaagtcttctataaaaagaagaattttgaagcaactatcatttaatttaaatattgggccaatatgtattttaatggtaatgttggaaaactatttccagcaacaaactttatagtaataagcaagcattctgcttatatgaaaatcacaaacagtggaagatattgacttgtacttattgtgcaggttctgaagaaaaccgcatatggtctctctggcaaaagctaatgaatttatgttaaaaatatttttctgcgtgtattgcaagtgttatatacacataattacatgataaatataattctatttgattttccaagtaattaatattttaaatatttgcaaaaagggctatagcacacacaaaaaagagagagacattgaaaaatctgttttaagtataaaacctaagcagttggcagaggagaaaagaaagaaattttttacatctcattattaggattcagtgcacacttatagaagagttccttccccctaaaccctagaattctagcagagaacagagccaaagtgaattatatataaccctgaagcttcatcaagagaatcattggtatttgtttacagatcagtattgaaaacaaatcagcctggagggtttagctgtatggaaggatgtagtttgcttcttaaataacccaagctgtgttgaaaatgttctttctggcctccttatgttctttctgttttgtttctcctttcaaatgcagagtgaatatgattggaatggtctttagcttcagccaagatctctaatgccctatgactggggcacccttgtcttttcccctggtcttccttagcatggtagcctgtgatacttcccaaagttgagttctgggtgactggggacagcctgagaaatgatggtcgaatgatggttgaagtgatggtttctgtcagtcaccaatgaaggggcccattaattttcaaggcttagtgtgagttccatctgttatcctaattgtttgtggagattacatgccagggaaaagagttactgaattaattaaaagtaaatgtcgcttcctaaaactcagcccggtaaacacagcttggggaaatatttccttttgcttgaatgacagctcttggagttaggtaacgtggtgctttcagacatggtttacacctgcagaaacgtacattgctggacagctgtcctgccccctagggtatggatcactgacagttctttcttactgtcaattttgcagagcccagaggcagatgcctacgtgacagcactttaccatccagcatgattgataagacaacccaataaggatccaaagcaatttccttctcttatccttgcctctcaactacatttgcttttaatggacatgagtccaggctggcagttgtggaaagattctgggatgcaatgttttgggggagagcaccaagcttcatttctgatctaaattgctagttggttcttattttaatcttaaatacactgaagaacagttgcctttgatgattttgtcagaactgctagtttctaacgcatctttggcattgcctgcaatttccaaggctaattttaatatatatgaaaaatattttaggattagaatgtgacatcctactaatcattcaaatgaaaaagtagagtggttgaagtcaccattgttctctgtagcaacaataacaagcaattgttatctttactagctttgtcctaccactcctgtgtggctctgagatttacagcaatctacaaatacataacaatcttcgtttcacaagttatggctcatgtttcatattcctttgggcctagcaaattttcattgctggtgaggtctagccattggacaaccaaaaattatgccatttttgaccttgagtcttcattaactaggagacaagtatatatgacatagtggagactgtttaggaaaagaaaggaaaggaaattcatatttattgaggctttataatgtacgattgtagtgggtactgttggtgctctgctcatattccctgagattcctgtttacattttctagtgccttttgctgccttgctaagctcttccttcatctaatggcctgcatctgtggctcagcttgggagcaaggatggcccttgcattgatggaacccctgtgtccaagaggcagagagtgggacgtgcttgagagtttacagcttcataatatcttctagccagattgattagttgagggaggaagacagcctagctctcttgccttaagtcacaacaaaatccagagcataattggcacaagacatttcctttctgcaggatcactctgagactgggactgtgcctgaaattatatccttgcttgacttttctccacactctgttactcctttctcctgggaacactttctcaataaatcacttgctccataatctttgccacagagtctgtttggaacatacttatgctatgccttctacatatactgtattacatatgctatgcctttatgaatactgtatatttaatctgcacaaaaattctgctaggaaattcatgatcagagagatcaattaacctgtccaatatcatagaaggattaggtggacttgaactcaagtcttatcccttaatttattacattttatgctaagcacaggcaagggatatggaatacgtagatccaatttggggaataaaggcatttggagatagattgctcctgcaaactagacctgaataccaacttcttacacaaaagacatcatttgagaaggaaaagataagtgcaggtttattttgctgaaaatatatcaagcataaagagtactctattttggcactggaagcaaatgagtcttaaaaactgctatgtgattagctgggcatgggggtgtgtgcctgtagtcccagctacttgggaggctgaggcagtacaattgcttgaattggggaggcggaggttgcagtgagccgagatggcaccactgcactccagcctggggacagagcgagactccgtctcaaaaaacaaacaaacaaacaaacctgctatatgtcttgtttcatgacggctttttaaaataaagaatactcatgcaatgcataatgatgctttggtcaacaacagaccacatgtatgatgatggtcccataagattataattaaactaaaaatttataccaccttagtgacattgtagacctttctgtgggacaaaatgtggaggtggaagatctgatgatcttggccctggggtaggccttggctaatgtgtgtgtttgtgtctttgttttaacaaaactctttaaaagtaaaaataaagaagtaaaatgaaaaaaaaatacaataagaatatgaagaaaggaaatatttttgtacagctgtacaatgtatgtgttttaagctaagtgtggttattatgaaagagtcaaaagtttaaacaataattgtttataaagtaaaacaattataattagctaacgttaatttattactgaagaaaaaatattcttataaatttaatgtcgccaaaatgtacagtgtgtataaagtctacaggagtttacagtaatgttctgggcctaaactttcactcaccactcccctggctcacccaaaacaacttccagtcctgcaagctccactcatagtaagtgccctgcataggtctaccatttcttatcttttataccacatttttactataccttttctctgtttagatacacaaatacttaccactgtgttacaattgcctgcgatactcatacaataggttgtctatttccagtatagcaatgggctatatcatatagcctaagtgtgtagtaggctacaccctctaggtttgtgtaagtatgctctatgatgttcacacaatgacgaaattatgtaatgatgcatttcttataacgtattctcattattaagtgagacataactgtacttgcgttggaagtggctagatccagtatcacacgcggtctttgctagaaacaaatgaatgtttgtaaacagtaaatcaatcaaatcatcctttgccattcacaaaggaagttaagaagcttggcagaaaaaggtctcgcaaaccctcaacttggatttttttttttacagcaaattagtttaaatcaatgacctcaaatgaagagaattattgtcagcatttagcttgatctttctcattaatgacttccactgtgtttctcccataattagttttataaactagcccaaaaaacaaacatacaaaatgctgggggtttttttttgtttgtttttgtttttgtttttcctttgagacggagtctcgctctgtcgcccaggctggagtgcagtggagcagctcactgcaacctctacctcccttgttcaagtgattctcctgcctcagcctcccgagtagctgggattacaggcatgtgccaccacgcccagctaacttttttatttttagtagagaagggttttcaccacgttggccagatggtctcgatctcctgaccttgtgatccacccgcctcagcctcctaaagtgctgggattacaggcgtgagccaccatgcccggccaaaaatgctttctgtaacttccacaatgaaatattattctcagattatcactaaatttaacccaaagattccattatctcttgctttttttattattattacctttggtgcttggggagttcagagatgccacagatgcaggacagtttatgactcatagcagaagcagtaccaacagtctcatgaggctgtgactggtagcctggcctccttctcccactttcctggagcatccaggtcatacacacagatacttcccagttcccctttggttgaaggagggcttcgaatcccttcactaacatccagcaacagcaatgtaggcaaacaaaagtcctaaggtctgagttctagcaagcatttggaggaatgacttacaaggaattaaagtctcagaaaataggataagttataaatattggctttccatatgtgcattcaactagcacacattaaattccaagtattttacaaatatctacgttatgaggaaagatattttaatccatttcatagaagtctgaggttgagagggattgttaatttgctcactccagtaagtgaaagagttgagattcccagctggaatctccaatctaaactcagtgttccagctccttcacagtgttctgttgggctcagaggtccacagtgaaaaaagcatcctgtgaaggctggcatccacatcattctcatgtttttgagagttcactgcaggcagttttgtcaacggcaccagattgagagtgaagctagaagaggcagacgtgggatagctatatccttggcaataagcatcaagaggctgggcgcggtggctcatgcctgtaatcccagcactttgggaggctgaggcaggtggattatctgaggtcaggagtttgagaccagtctggccaacatggtgaaaccctgtctctactaaaaatacaaaaaaattagctggacatggtggtgtgcacctgtaatcccagctactcaggaggctgaggcaggagaattgcttgaaccagggaacaagggaggtggaggttgtagtgagctgagatcatgccactgcactccagcctgggcgatggagcaagactccgtctcaaaaaagaaaaaaaaaaaaaaggaataagcatcaagagagagtagccagaaatatcaaaagccccagatagccttaatttaagggctctagagttctcctctgcaagaaacccttattctactttatagtactctatttattaaattcattcttatagggtgactaaaatgtgccagatccccaccctcaaagcacttaaaatctaatgagagagacaaacaaactggaaaatttccagttgttataactgttactaatgaaataaacagaatgtgacaatgcagagtgacattcaattgctcttacttgtttatgtaaccactttcactaacagaccatatgagctcctgggagtgatcttttgttttttattcttctttatatttctaatgtctagctaattttagatcctcaataaatgctcatttaattaattaatagatgagtgaacatataaagcagcctctcaatgatgtactctatattcatctgttctcatactgctataaagaactgcctgagactggataatttattaagaaaagagatttaattgactcacagttcctcatggctggggaggcctcaggaaacttacaatcaaggtggaaggggaagagctatgtcttacatggcggcaggtgagagagtgcgtgtgtgaaggaggaactgtcagacacttataaaccatcagatctcatgagaactcactcaccatctcaagaacagcatgtgggatgctgcccccatgatccaatcacctcctaccaggtctctccctggacatatggtacaattcaagatgagattcgggtggggaaacaaagcctaaccatatcatgctccaaagaattgctagaacagaaataagtagctcaaaggaaagcctatttttttccttttgaaactgaagctaaaatgctttcagactttctctctttgatacatttggtgttcccataatgagagacagactatttactctgacatattttctactagtggccacttctcatgaacatcttaaggtgaacaaggttacagctggctattttccagaaataattaaggataattaaaaagaaatatttaatctgaggcttcagaaaattggatttgggtttctcaattggtgttagaagtcaagtttactatcaaaatatttttaaagtgcattttgttttttaccactaaattttctgagttgtctcaaacctaaaattgaaacagtaccttcataataaaaccttccttctttactgcaatgctactttaggcaaagtatatataaaaatgagaatttaaagaaacctatatgatctgtactttaactcagccttgactaaatcacaagtttcaagtaactaaggactcatgaatgggatcccaggcacccaaaacacaaaaacatgatgaaaagtaagaagacgaaaatgactagagtggctttaaaatggcttatccaaaatataagaagcgtttttttttctaagtggaattttttttacgctctcacttattacattattttggttaactgtcttcatgtgataagtgcatttttttgacttaatgaaacagagtaaaaaaaaaaaaacataaaaattaccatgtaagaccagacccatcaatgccttatatacttttattggtgcagtttgtcttctatagcctttaacccccaacatccctttcacatctaccctgcagtttcctagtaaggatttctgggaatgtatatgaatatctgcagatattaagtagtgatgacacatataatagtgaggctttcagatgacatatatgagcatgtgacatgtggtagagatacagttggctctcagtgaatgatatatatttcacacacacacacacacacacacacacacacacacgcacatgaaaatagtttcattggggcttctctattggcctgtgtatttcatgaataactggcctgtcaataataaaaactggcacaagtattgtgtgcactctatctgctttccttgctcaataaagtgtgctattagaggtttctcaggcagtttcaaacttaaagatttaccttcacatttcaaaaaagtagccacgtaaaacaattccaaattaaagtaaatgtgtttggattatggcacaagcaagataaaagaaggatcttctcaaataagttactgtttgtacctcaaaatccccacatctgggaaagacacaaataaaatttcactttctttgttctgtttgttgctgagcacaatttaattgcaatcagatagaaactcatcctaatgacatgcaaagaagctaaaaatgatctttcggtgatgacaagaaactaaactttttcgtttggatagtcactagaagaaaaacaattttggagaaatcatgagggcataagcaggcagcataccatgcatgtctgggaggcaaatattatttatctaaatgaaacacattgtgggtttggcggccaacagcttccatgataaaatcagtgtgaagcagatgtgtgtctcagtagaaccgtgtttgatgttagccctgccacttgctgctgtgatcttatctataaaaataaagacaaaatacctaactttcttgtacaaggatgctgcaaggattggattaggtgacccaggcatgtgcaagcagccagcacaatgcttccatcagggcttgctcagtcaatagcattctgtcatctctggattgatctaggtctcagttttcacatctgtgagatgggagccgccttaagggtgttgggcatttccctatgattcacaaaggaaggtcatccagcaatcctagtactgggtatatatccaaagtaaatgaaatcaataggttgaaaatacactcctatgttaattgcagcactactcacaatagctaagatatggaatcaacctaagtgtctatcaacagatgaatgaataaataaaatttggtctatatacacaatgaaatattatttgaccattaaaaaattaaagttctgtcatttgtgacaacatggataagcctggggagcattaggttaagtgaaataagtcagacacagaaagacaaatgtatgatctcttgcatatggaatctaaaaagttgctttcatagaagtagagagcagaagaataataattaccagaagatatgaagcagagggggaggggagatagtaggcacttggtcaatggctacgaagctacaatttgataggagcaataagttctggtcgtctattgcagtgtagggtgattagagttaacaataatgcattgcatatttaaagctagctaggagagacgtttaggaatgatctcatcacgaagaaatgatatatgataaatgccgatcactctgatttgatcgtgcactacttacacgttttgaaacatcatgttgtaccccgtaagtatgtacaattattatgtgtcaatcgtgaataagcaaaaggaaggtgagaatgtgtctccattatgcgataattttctttgggggaaaaaaaggataataaacattatgcaaccagacagggcagaggtagatttcttttaaaggggagcaatcagagttctaaatgacatgaacatattttaaccatgaagaatttactgtctagtcaaattgatcagttattgccaagtgctttgaaggctctattatctttagactacctggaggaacattccatgtatttccctattctgttacattgtgcagcttatttagcaaacagttacgggaggtgtttttaagcatcaggaggaaaccaggttgtcaagaaagaaagttctcttgacctgtgacaacaaggcagtctctgtcatcctcagatttatgtaatgtgtaaagagattctcatttaaataattccattgaaataaaataatacaaatggatcatgacactgatttatgctttttaaggttatgttttatttgtatttgttttttctgtttgtttgtttgtttgagacggagtctcactctgtcatccaggctggagtgcattggtgcgatctcaacacactgcaacatctgcctcccgggttcaagcaattctcccacctcagcctccctagtagctgggactacaggagtgcaccaccatgcccagctaattttttttttttttgtatttttagtaaaggtgggattttgccatgttggccaggctggtctcaaactcctgacctcaagtgatccacccgccttggcctctcaaagtgctgggatgacagccgtgagccactgcacccagccctgtatttgttttttagatatgtgatagaagaagaaaatagaagcaatgtttttggatgctaatatatgccagaaactgctattttttcagataaataataatatcagaaataaccagttatgtatcaaatagtatgccaaatgctttgcatccattatgtcacttaatcctcatatgatgtgaggaagctgaagcatgaaagaggaaacttgctgaaaagaatcagaacctcaaatctattgaacactgaagctactgtatgtcaccatggtcctatagtatccaaatcgcctttaaaaacttacagcaaaatgccattggtttccattgggtggattaggaatacaatgggattacagcccatgtcataattctggagtagaaattctactccagggtcctggaggctttgacttatcaaacatctgaacattttaggattggccccactcactgctggacaatctgaagagaagccctagcagctcctggaaggggcagtttccagctttgtatccattctgctcactctcatctccactaccatcttctccacatcactgttgtaggatgcatatttgaattctccagtagattgtcctatggactctgttttctcaccaataattacctcctgaacaggctgcacctgaatcctatccctttcccccacaattttttttttcttttgagatggagtctcactctgtcacccagactggagtgcaatggcgtgatcttggctcactgcaacctccacctccagggttcaggtgattctcctacttcagcctcccaagtagctgggactagaggcacctgccaccatgcccggctaatttttgtatttttagtagagacagggtttcaccatgttggccaggatggtctcgatctcttgacctcatgatccacccgccttggcctcccaaagttctgggattacaggcatgagccaccatgcccagcccgtttcccctgttgaacagaatgcagactgactccacatgcttccagagcaagaagtccaaccacctaccctaccagtatttacttccacatcaacttgccaggctgcagccagacccctcctgggactctttctctgccttctcattcccatctttctctactgtctaagccactctgatcaatctgtgaatttccatgtccaggggaatcctcttccacccttcaacactcagggatcttggatatgtagctagagattaggttgggggccacctgctcctttcaccaactaggaagcacctttaaaatatcagaattattatcacaatgcatgcttctttggtttgtagtaaggataaatgagatcttacatatggaagagacaagtgaagggatacaagaatgtaagacatcctcatgattcattaagagatgcatgcattctccagctatggggacgcataatttttgcttttatgtttactttgggaatagtactttattttacttcatgctcctctatgaacaagagatctatagtgtgtcctacagggaaatttaattccctcttttattcttgcaaactagtaagttacaggtttagccataaagaagcaagcaggcatctctgttttcaatgctctctaaaaccaaacaatcctctggggattttggtaaaatgcagattaattcagtaagtctggggtgggacctaatattctgcatttctaacaggctcccagatgatgctaattttgctggtgcatggaccacactttgagaagcaaaaccctagaacattacaagaaattcctaatctccgtgatctgctttgtttcaaaatatttcctttcttccatctttcattagcttttacttatttactcaagccttattcccaagcaaaacaggtctcacccaattagaaagagtcaaagacaaaattgctgacaactctcttggttttctatgctactttcctcttgatcccactgaacgtagatcgtgtagaaatttagatgaaggacacatttaagacctactcttagcacggctgatacaaagtcatagctctccagtacatattttatttattaggaaaattgaatcatggaaaaataaacagagaaacctgaagaggaaaaatatgaatacagcattaaaaacataatttgcctttcaaatagaaataataccagccatttattaagtacttttcttgtgccaggcatctcatttcatgaataatgaaatattctggaaatgaattattatctgagaaatttgataaactcagaccgatcctgccttgttttgtgctatgagacattaatgggattttttgcaactgtgaaatggtaggtatttaaataggagaatgggaaattttaatttgatacggttggcaaggtgtttgatgaggctgtcacaatgacaacaaaatttaaatgcatttattgggattacctgtgctgactgaaatgcaaaagacagaaaaggattcattcacactgacttattttgaatgtgatgcaaatgtaaagagtaatatgatgtggcattatcatgatttctagtaagaaaacactgctgtttggtttgggccaaagaatgaggaaactcatagaggatggctctgcatatttctaaaaccaaaagaggatccagtacaacaaagaatcaaaaccctggacactggttaagaggagggatgaatcactggaatcacttgagtccttagtattttgctgaaatgtattatgcaatatacatccttttctccgcccaatttttgtcctggctgtgaagatagcagttctttatgctttgacatttctgttttgagtttcaaagtcagagtgataaatagagtagaagaacttaggatttagacttttaaataaagccagggaatattctattaaaaaaaataaagagaaactgttgagggacagagttactagctaatttatttatttatttatttatttatttttgagatggagtttcgctcttgttgctcaggcaggagtgcaatggcacaacctcggctcactacaatctctgcctcctaggttcaagcagttctcctgccttggccctgcaagtagctgggattacaggcacgcgcaaccacgccaggctaattttgtatttttagtagagatggggtttctccatgctggttgggctggtctcgaacttccgacttcaggtaatccacccgcctcctggccttccaaagtgctgggattacaggcgtcagccaccgcgcctggtcagttgctagctaatttatatacttttattactgttgtttgttttaagacgaagtcttctgcctgctcacactatacagaatgagcctacaggaacaaaacataagaggtgcaatttgaggactgtcacctctgcctgagaaagtatctccatgggtgcttattaataatgatatattttaaaaagttgtaacagaaagttccaacaggttgaaaacatattatcttctcattgacaaaacagatagcatttattataccatgtgtggcaatttatttggcacattgtggcatccctttttcaaaggcttttcttgccagcacattcatttacctcttcatgatttttttggtcttatgtttttaacaagactgagcagaaagttgaagactatgtgatagatcccttgtcatcttccacagtgcttaccatataatgattggtatagataatcttatggatgtcatgtcttcaatatggcttataatgaaatgatagctaccatttcattgagtgtttcctatgtgatagacattctgatgagttttgtacacatataattgacacatcctacaataatgcagctaaggaggtattatttttaacacatgagaaaatggagtcacagagacttgaatggtgagtctcatttacataaatagaaagcagaagagccaagttttctctgactccaaacgtatgtatcatcacccccaatgctagaaaagtatctaagaagactatatttaagaaaagcctcatattgctggcctatttgattttagtctgttgttttgtcaatccaatctaattccacatgccaaaataattgtcacatgttagtctaaagctaacttcatgtctgatagcctagagcagctaccacattcatttgctaataaaatctgtcctccgtagtctggctttcaagatatttatccattaattaattcaaatctcatctttactcattctcctttaaagctcatcagatcatttttaaaaataagtttctgccaatatcatgtaaattcagcaatcacagtccatctgcaactcccccatatgtggagggggcctagttatatggtgggaaaaacaactgggcttgaaagtttttagtacattcttacagcaacatttcttaattccctgaccaagctgtctacaactgtgcacctatctccacaattattttgtatctttaccctgagttatttttcttcataatactaattaactgtattagtaaggttaagtaatgctacattattctgtggaaataaacaaacctcaaacctcagttggttatcataataaatttttttgtgtgtgctttccttatagcctgatatgcatcagatcttcctcctctatctccttgctgtgtgatctggaacatgtaaactctaaagagaagatgacaagaagagatggaagaggctgttcactggcttggcttgaaagtgacgtgcatcacttttgttcaccagtcaactgaccagaacttgtcacgtggccctaatctaattgcaaataatgcaagggaatgcagatgagcatatgtacatttgttacgcactatctctgtcacattacctcacagaacagtatatatttatttgcttctctcccctctctcccttcactaaaaaattcatttatatggctacagattttgttgtattttccatgccaataagatcaagtagaacagtggctggtacacactggtacacagtgggtactcaaaataaattgttgagtgaaagaatacttgtaagtgattaaagatggccacacattctttgatggttctttcgttgagaagtggcatgaatttatgataactgtgaccaaacaatacggcagaagtgacactatgctaactgtaggcctagcttgcaagagagtagacagtttccactttcttcctagtggggcctatcctgagtccaggaagcacatgctagccacttggggatgctgcatggagagagagagagagagagatctaaacaacccccagctctttcagtaccttctgtttatcttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccagtaccttctgtttatcttatgtgaggtcacagacattgcagagcagagatacatagttaccctccaaatccttgacccacagaataatatataacaataaataaatgttgttttaagcccgtaagttttggtgtggtctttaatattatgcagcaatagataattggactaatattcatgatgactgacccttgcatgttcaaccccagtacctacagtctaaactatacacatttattatctctaaggaagaaaggctcaatgtttttaaaagatgcctattttttcgtatcaatgtacaagtgtttctattctgtgaagtctttaccctctttctggtcaaattttgaagactgtcttcttttatatacccagaaagttctgcatggatacatcctgccatagcactcaggacacctgattacttctgtgtgtttattcttttgctgtaatctgtacaaggatgttcactatgtgacacattccaggacacattctcagtgacccctagtcattctacactctttaccttccactccaggtggcaatttgaaacacaagtcaaagagagtgatgttcttacaggcatggtttttaacctatgcccatgaattaaaaacaatttaaaaacccaatctttcactttagctgttgttagttaatctcacttgtatacacattttacaagtgactctcatgcatcttgcagcttatataaccaccaattcagacaccagaggtgacagtagctgctataatatactcattggtttaaaagtgtttgttttcctattagttgcaaaacttttaagggcaggcagcttgagtcccagttacccagttgagataacccacatctgctaatatttttacataaaagtcagtgaaaatataattggcaatgtcatgcaaaactggaaataaatatttactatttttaagccattttggtctataatttaatcacaagatcgttatacttggaatgcaaaaggattggatcatggtggcactattttaaagtctcatttaaatataactaaatgctgcaataggtggtcataactgtagtttgactctaattaatataaaataattggagagtaaatttatccccctgttccatatcaatagctctttggctacaaggcaaaaagaatgtgaacattttctcggtatcaataaaaattagcttaaatatctaagtcaatttagaaatgataaatcagtctccatagttaaagaccaaaattttaaataaccatattaagcaagactcatatatttttaggaatgctctcaaaataaaaatctctcttacaaaccaaaggaaacaaatatagttgaataattctataaacctttcacaaaaatatggcattatggcataaggcaaatatgatggttcaaccagctaagtaaacactgattaagaattaagattgaccacagcaataaggggtattttcctctagtcaatcactcaggttcagaaataccaaatttatcttaagacattctaattaggcaaaactatttgatagatcgagtagttggagatcagaagcatgcatccaattaagaagaatgttattgaatgattttcattcactggcctcttctgttctctgtattttagtttaccttcagcacctcattgaagagagctatatccaaattcaatttattgccccaagacctctttcaaaaaaatggctctggagattcccagctagaaaaacttttctcttctcctaagcttccataacatgcatcagggatttggtatttctccctctgaattgtaattgtttctaggcactagcttctctgccagcctggaagttccttaaggagctgagcccatgttttattcatggttgttcctctgtggggcacagcacttgggcttcccttctttgagcatcaaaaacaagtgtcatttttctttcacttattttcacatccatgtcctcttctaagacctttgcaagtcattcgtagttttaaagagactacatttaagttttgatagataagcaaggtaaatggcaagtccagcagtatagagaaaaacctctttcctgtagtggtatttgttatatattttatctgaattttgaggttcatttgttttcattattgacagatgatttctttgtttgtttaataaaaagcagtaattaattttcccttaattacatgttttacttgccactagctggtgtatctagggattcatattgtaaaaagaaatggaactcattggtttgaatcataatgtgtgggggtatagaggttatttaaatattgtttagttctttttttttattttacacataatagacaattctcaaaatggcagtaaggaaaaaacaactcattctttatattttgaaaatttttggccctgaacacaaaactttaattgtaacctttaatttattaaataaaatattgagcttctaaaacatttgagagtgtgcagcatattgcaaaagatacttggaagaggcaagctgatcttgctccaagaagcttctggttaaatatcaatatgatgaggtttgaaaaaggtacacacaaccactacattacagcatgaagtaagatttaggctgcaagagagatgcaagttacaaatatgaaataagtttgggctgcaaggaaaattgactctggcacaagttcaggagcattttagattagcaaagtagaattgctgggagttcaggtcttagatatttcataaaataactacacctcaatacattggaatttagaaataaagagaccattagtgagattccatttctgcaatattgttttttctaactttgtcccttgttttttgtctgttcctatcctagtataccaaattatcatcatattccctcccatccatgattctagcattttagataaatcgtcttgccattttccaagcgtttggaattgaggtccatgctcatgcccttttctaagaattccaaactccttgagcttaatcttatatcttcttttaatatccctgaactaaatgactctaatctagaatttgtacatatgaccaaaatgacaaaggtacttcccatgaatccccaaacctcctgatattgtatataaaattgtgaattttcctggagttagactacatgactttggttaaatcctcaaaaggagctcctgccccactgaatttaagaagttttagtacttacagaccattggggatatattacacacagaggaggtacaggcaatgtcttacaaaaggcacttgtaatggcagtctttatgatttctaggaagtatgcagaaaaatttcctgaaggtaatggtcatccaaaaagtcaccatggaatctcttctcctgcaaggaattcattactgagtaactccttacctcttggtataattttggcatggagtgaaaggtctaacctctcaatgctgtttccccttctgtacctcctctgtctctttcaggcttaataggatcatctgttgacttgaatcagagtcacattcaaagctgtgaccatcactgacttggcactgtctgtatctgtgtgagtctccaggagaggtgctagtgtctggggctggaagggtgtaggttgctggtaattcagccatgtgcatttgctcatgaatatgtgtataataagagagagacagagggggagaagaagtggagaggggagagagatgagagagagaaagagagagatcaatctgagagagaaagatatgtatacacacacacacacatacacacacacacatatatatatatataaataaaaatctgagagagagatcaaatctgatctgtaattgtatccacttcagaccaaagggaccacacagataaatataaataagtgaaaagattcagtggggtcaatggaaatcaagaagagggcagtcttggcagtttcttctctattctcactgatttcattgattaaacgagaaactaatgtcaagtcagagatatttttatgcaaagctgagaatatggatttttgggtgcaattttccaaagtctatgcattaacaactaattaaaaacatgtaaaagaatatagagcacatagaggaaaattttctcagtttgataaagaatggctacagaaaacgtatagctaacattgtacttaaggtaaaaaaatctagacactttccaattaaggtcaggaacaaggaaggattcctctctccacttcttttcaacattgtgctagaagtgctagctaagaaaaacaagacaaaataggaaataaaatgtaaacaccttgtaaatgaagaaataaaattgtctttgttctcagatgacatggtcatctctgtagaaaatacgaaagaattgataaaaacaactcctggaactaagaagtgatagtaaggttgcaggatacaagattagtttataaaagtcaatcacatttctatgtaccagcaatgaacatatagaatttgaaactaaaagtacagtaccatgacattagtatccaataaataaaatatctaggtataaatctagcaaaatatgtacaagatctatatgaggaaaactacaaaactccgatgaacaaaatcaaagaagactaaataagtggagagctatcccatgcttatggataggaatactcaatattgtcaagatgtaagttcttcccaatttgatctacagatttaatacaatcctaatcataattccatcaagttattttgtagatattgacaaaatgattttgtagatattgacaaaatgtagatattgacaaaatgtagatactgacaaaatgattctacataatattgacaaaatgtcaatattacgtagatattgacaaaagtttatatggagaggcaaaagatacagaatagccaacacaatattgaaggagaagaacaaagttagagaactggcaccactcaacttcaagatttactataattaagacaataaacaaagaggctgggcatgctggctcacgtctatgatactagcactttgggaggctgaggtgggcggatcacttgaggtcaggagttcgagatcagcctggccaacatggtgaaaccccgtctctaccgaaaatacaaaaattagccaggcgtggtggtggacaactgtaatcccagctactcaggaggctgagacaagagaatcgcatgaacctgggaggcagaggttgcagagagcagagatcacaccattgcactccaacctgggagacaagagtgaaactctgtcaaagaaaaaaaaaaaaagaatagacaaagaggtgaatggaatagaaaaaagaattcaaaaatagtcccacataaattagtcaactggtcttttacaaaggagcaaaggtaatacaatggagtataaatacagtcttttcaacaactgcttctaggggtgccagactcaacaaacctgaatactcacatgcaaaaaaaaaaaaaaaaaaagaatctagagacagaccttatactcttcacaaaattaactaaaagcagatcatatatctaaatataaaattcaaaactgtaaaattcctaggagataacatagaagaaaacctagaagaccttgagaatggtaatgacattttagatacaacagcaaaggcatgatctatgttggaaatcattcatatgttggacttcattaaaattaaaacctttttgctctgctaaaggaaatgttaagaaaatgcgagacatcatacactgcaagaaaatatttgtaaaagatacatctgacaaagaatcattttccaaagtatacaaaaaactcttaagactcaacagtaagaaaaaaacaacccaattaaaaaacatgttaaagaccataataagaagcacctcccaaaagaagatatacagatgggaaatagcatatgaaaagatgcttcccatcatatgtaattacaggagtataaattaaaacaacaatgagataccactagaaatgtatttgaattgccaaaatccaaaacactcataacactgaattctggtgaagatgtggaacaacagaaactcctatgcattgctgttgaaaaaggcaaaatggtacaaccagtttggaaaaccttttggcagtttctataaaaactaaacataatgttatcatatgatccagcaattgtactccttggtatttatccaaagaagttaaaaattttgactgcagaaaaacctgcacatagatatttatagtaggtttgttcataattgctaaaactggaagcaaccaagatataccaagaaaccaaaaaactgaaagtacaaaggtggtacatacagacaatgaaatattattcagcactaaatataaatgagctaacaagccacaaccaatatggaggaaacttgagttcctatatttaattcattctccctattactaagtgaaggaagacagtctgaaagggttgcatactgtgtgcttccaactgtaatacattctagaagatgaaaaattatggaaacagtaaaatgataagtggctaccaagggttggcagaaagggataaacaggtgacacacagaggattattaacgaagtaaaaaatactctgtatgatactgtaatgatggacacgtgtcattatacatacatttgttaaaacccctagaatgtacaatatctagagtgaaccctcatataaactacaaactttggggaattatgatgtgtcagtgtaggttcatcaagtgcaacaaatatgccactctggtgagagacgtaaataagaggagaggctgtgtgtcggggtgggtagggaacatatgcagtatctctgtgtcttcctcttcatttggctgtgaatctaaaactgccctaaaaaagtctttcttaaaaagagtccagaacaaagacaaaacgtacatttgttgatatggaacctaggtagtctgaagtttgcatactttcatctatagcttaatctccccacctattttcctccaccatctttgtagtaaatttgaactattctgtatctacaaaaaaaagccttgaaatttcctcacagcttattcttataaaatcctctcagtttacaattcgttctcttgactgttctacttccttactctaccagtcccagattatccgcctccatgatgaatcattttttcttctaggaccatgaaacatataatctctatcatctgcatggcaaattgtcacgtatttgtccactgggtattctttctgatgttgctgttgttattttcacatgttcatgtgtctgtctcatttcccttcattattcattcatgcattcattcatttgccctacatacacccattctatattctgcatccttgtgcttgacactgaagattagaccacagagcaagactctttccatgctttgtaactcaccgtaagtgtacttctaatacacaagatcaatcaagaaggctattataaacctttgtgacctgaaaccctctgaaggctgtttgtattgatatggtggtatggactgaatgtttgtgtcccctcaaaatttatatgcagaagccctaaatccaatgtgataatattgggaagtggggcctttgggagataattagatttcgaggaagtcatgaaagtgggttcctcatgatgggattagctcccttatgagaagagaacagagcaggctctctctcagcctaaggtctgactgatacacaactggtattcagaaatatttattgtttggttacttattctcatttgcaataagttataacatattaacaatatattcctacatttcacagtgtggatgctattgttgttgccactgggtatctatgtgggaactaattgaggaccacatttacaatgtgcccaaattgtaaatgtaggagtatctatgtgggaactaattgaaccactgagtatctatgtgggaactaattgaggaccatgtttacaatgcgtacaaatcataaatcaattagttcatattgatttacaaacaaggaagaaaaagtatttgtttacattgatactgtccatgtaaacttttttcaattcaaaagaaacacatagttctgtcataaagtagattttctatcccttttattttctgagcttatttcagaaagcacttgcaatagctttgcacagttcagcatttatgaaggaaacctttgttagcctaaaatgtagctgtaattttttttcaaataatttctacacaaagcttttacaccttatttgattacctcaattttttcccaatgagtgaatacggacttaaattcattttttataaaaagcattaaccattgtttcttgtaattacactcagtgagagtcgaacaatagtgtctccatttgaaacagacttttgttataaggttgaaattgactttaaattcttttgaaatggccccaaaataacacatagcacagtggtcgtctttgaggtgagaattatgtgtcttattattgagagattggactgtgtttcacagaaaaattctcatgacctactaatgtgtttcagtcaattgttctgaaagcacaggataagaattgtaatgataatgatgaaaatatatgaagacattgaaaactgaggttctcattgttatagcatgtcagttatctttatctcattcaacagcatattttaaaatgtcacactgatttccaaagaaggaagaaaaatttaaagagttcaggcaatgcatgctagttaaacttattgtgataatacattcatagacattgaaaatattggacaaagaatgaaaaaagagagaagaaaagcatgcctaaagatagtcagtgcttggccagtatatatcttagggcagaattcaatgactcaggttgaaaaataaaaacctatctagatattttgggtttcttctctctctgattaatcaaaatacaacaaggcagaaatgaggaaagatgcaaacttttagtggccaatgaggaaatataccttgggggcatatatggtgagtccaaagattggtggccaagaataatagaaaaagaagagatgcagtagaacaagaaggacatatatcatcatttatctctgctccatctctccatttattctgcaagtgatgggcgcaaaggaagaaaacctgtgcaggaattaaaggggcagctctacagagtcactgagagctcattgtccagacttggataaaaatgggttcctagtcctgcctcagtgagtattacttgtgtccatgatcatgtcacttactgcttctaaactccatttgtttcacctgtaaaatggggataattatggtccctaaatcatagacactggagatattaaatgatataatgcagaggaagaggactgagtcaatgtctggcatttactaagcctccagtagagcctagccataaggtttctattataattaaaaacatataaggaattttaaccattctttgataagtttagttacccaaacttttttctataataagctgtcctataacactctagaactgaagacatgtatcctcagccacactatgtttgactcagctgtagagagctgtcttgcccaatgactgactgtggtaggaacccctgattcttctgattaaaaatgatattgtttgacagtgtccccacccaaatctcatcttgaattgtagctcccataattctcacgtgtcatgggagagacccagtgggaggtaattgagtcatgatagtgaataagtttcatgagatctgatgattttatgaaggggaattcccctgcacacactgtcttgcctgctgccatgtaagacgtccctttgctcttccttcatcttccagcatgattgtgaggcctccccagccatgtggaactgagccgattaaacctcttttctttataaattacctagttttgggtatgttattattagcaaagttacacaagataactctgacaccacagaactccctgaggtgttgattaagactttgtgggtctaaaaatatccgactttttcctctgagcaattgtacttctgtactccctcttccagtgacgttaatctctaatcctgaatgctgaacttctggagaacccaatctggttcattagcgccaactattcaaattgtcttcagggagctagtgctttccttctttctcacaaaattacatggcttacattttctgctgctggggaaccctcagccatggatcctaaggccaaggatggacggagaaattccctgacagtctattctaggaccatttgaaaaagagggacccgagaccacaccagagaaggagagagttggggacctaagtcctggggaaaggaataacaggaattagggcctgattactgatctgggcctgctatttttaaggaaagtgtatttatgggatagaggggagggggaattattcatcatgatattagttatagattctagagatctagagaaataagcagaaaataaaaactacaagaagatgtttaacctagaaaaatgaataattactaattaatttatatgcatctcttttcatttcattcatttatcactttagtcactcaacacaatttaactgagaaattatacaacatgagacactgtggtagactgtgtggggtgaagcgttgactgaaacctggcccttgtcttaaaaaaagaaaaactcacatttttgcctcattatcttccataacaacataaatatattttattatacatataccagatacattttgtttgtcctaatcaattctgtcttatgggaacaacctatacctaaaaagattggagatttgtatcacataaaatgataaaaattttgtttcattattttatagttatagctcagaagttccagtttcttggtgttcttttctggtattagaggtacctgcttaaacttttacaataaagaatgaaagcattggctaaatgcattcccagaggctttgaataacaactctggcaactggtttgcccacaaaattgagctgatttataacagccttaaaaaattaattaaatgcataatatatattagctgaataatagactgagttgggaaggtttttcagtagataatatcttgcggttaacccagaattttttccctacacaaaattaggggcataaattactattttatttttagagaaactgtaggcatcagactggatgttacaaaacagcttcaataagacatagaaggccattgcattcctcagttaaagggaatgtttgttgcaaagataattattcttttcacaaacacctgtgcttccttttcaagtgcagagtaatactaggcagtggctgcccagccaagaacattacctgctccggttgcatataaaggagtcatgtgactgatttcagccaatagaatgctcataagtaagaatagttaagaagtaatggggaccctttccaacttctctccctccaaatgcaagcatctagctaagtactcagagtcctgaagagattgctgaagcaatagctgggaagagactcactccttaaagaattgtttgaaagaaaacttctcacgaatcagaaacacctgtttagactttacaagcatgagctatctccttctatttgtatatttatttgttacagcagcaagcattaccttaaagtatattgaaagcgtgtggttgaatgtgaaaatgttgtacggaaagatagggaaacatatgctaatgacaaattgggtccaagataacgagcctgttaaaagatatgcacgtcttttaaatgatcgaatagaattcattataacattttattcccagtaggaaaaattagatttctaaaagaatggtagcacttgtggcaagatcttatgttgcaagtacagtagatgaatgaagagaaactgcttaacccccattctcttaaagattaacatttataatttgtaatttgcctttttacatgtgcatctgtattaacacatgcccatctgaaaatatattcggagctttaaatatatactatagggttttgtcaagaattattaaaggagataggatcacatttattcaatgtgataaataattctagaccctcccatttggagaagaaaagaaacaaaaatagtttactggcttataatatgcatgcataatttttctttttcataacacaataataatgatacaaaaaacactataatcctatataagcaaaagtgcttagttctgggtcaggcaaattgaaagcaaggtggtgagccagactcagcaccatattgatgagaatcacaccttaatagatggagaagcaagtagaaaggggtttagatgatcttacataacagaggcttttaatcaagctggaaccctgcctacctctaaattattacataggagaaaaagacttttattttaaaaattcaattgtattttaggacctttctgtaacaacagtgtgatctatgcctaaacattatatgatccaaattgtgccccttgaaatttcttatgttgaagccttagttcccagtatctcagaatgtgactgtatttggaaatggggcttttaaaaatgtaattaagttaaaatagagtctttagggtaagccctaatttaatgacttgtgtcctaataagaaaaggagattagaacaaaaacaacacatacagagggacaaccatgtgaagacacagcaggcagatggccatctacaagccaaagagagagccctcagaagaaatctatcttgttcacatcttgatctttgacttccagcctctacaattatgagaaaataaattgctgttatttaagccacccaatatgtggtacgttgctatggcagccctggaaagtgaatacaaataatacataattcatgcattcattccttcaacctttacttagcactaattttgtcatatgtcctgtgctaatggatgtagatgacaatgtaaattaaattctcctatgtcctcaagcaaatcacagacaaatggataagaaatctctccttccattatacagtggctccttattatggaatcttgctatttaaataaaatatattccatcagtgataggttaaatggtgttctcccaaattcacatgctgaagtcctagcctctagtctttcagattgtgactgtatttggaaattttgtgactatagatgtaattagttaggatgaggtcagattggattaggaggccaacctaacccatatgactggtgtattagtcaaggttctccagagaaacagaaccaatcatatatgtatgtgtgtgtgcatgtgtgtgtgtgtgtgtgtgtgtgtcacacagagattattataagaaactggcacacaattatagagtcaaacaaattgcaagatctacatggtgagtctgcaagcaggagagccaggagagctggtgctatagtttttgtttgaccctgaagccctgagaatcagcagagccaatctttcaacttcagtctgaaggccagcaggtgccagacccaggaagagctgatgtttcagtttgaatttgaaggcaagaacaattcccctttacttgagggagggtcagcctttttgttctatttaggttttcaacaaattggaggaggcctgcccacattaggatcattaggaggatgatctgttttgctcagcctactgaatcaaatgttaatctcatcacaaaacattcttacagacacactcagaataatgtttgatcaaatatctgggcaccccatggcccagtcaagttaacacataaaattaatcatcaaaactgatgttcttataaaaaggggaaatttggacaacaaaaaagacaagcatatagggaagatgggacaatgtcttttaccatgagcatatcaggctaccagatgctagggagaggcagggaacagctcccttacagccctcagaaggaactgactctactgacaccttgattttgagctcccagaatcaaaattcttgtcttacagtaagacaataagtgtctgttgcttaagccacccagtttgtgcaactttgttatggctagctttaacaggttacaccatctattctacactaaagttaaatattttaaattctggaatcagtaaacaaaccctgctacttgccatttggggttaggggagtaagctatgtcagtccttcacagtttcttttcttgatatctttttatcagcaattcactgatatacccactattctttcaaccaacacttattaagtgtcttcatccatatctcttgtattgtgctataaagcttatgataaataccactgagcagaggatgctaatcacagagttaactgtagtgtgattcttggggatatgtcaaacaatgaactgagactgatttatctttatgaattcaagttgcttatatcacaccagtctaaagaaaataaattccaaaaataatatcacttttaaatcaaaattgagagacaagaatatcaaagagactggatagactctaacttttatcaaaaaatgatgtagataccagtgggaaaaaaatagaagattcttagaagatggttattttagagatttgaggggaagtaaagagaagagagaataaaaaaattcttaatcaaatgactcaagtttatattaataatatgaaatatttttaattatctcacaaactgaatacttgcatccgagtgtccatgtcaaggaaacaattttgtgtttaaacctctgcagatccaaagattcatactaacatctcaatggttgaaaactgtcattgaaaggaaacttgaaaataattaattcttaaactgcttaatttttcacttttcatttcacggtttgtcactaaaatagtaattattttttcttctcttgctaatccaacaatttcatactgacagcctttcactgggaaatttactttcatattactgctttacactttaaatacaaatatttttcaagatgaaattagatatgttggcaagaaatatgatctttagttaatgatttatgtttctgctttggaaaaagaaatgtctcttacatatattatacagacaagtggcttccaaacattctgttgaagtgttcaaagggaatgctttatgattattgctcaataaaaatagtgtgttggcatttttactcccgttacctcacaggaaaaaaaaaaaaagaaaatgctgcaatagtatgtcataacaattaatagtatgtacactggattttggtagaccaaactataagtcctggattttattttaccaattctgtggtttaggtaagtggtttaccatttatgctatagttatcttagctataaaataggaccattggagtatacacctctgaaggtgtctggaaagactgaataggaaaattcatggaaagaacttatatagaagggaaataaataagtgctcaataattgttagttgaggctgtaataataattacttattgagtgctattcaagggccagggattgggctatggagtaaagacataaaaatgaggaattcacatgtttctgggacctcgctaaatgtattgtgaaattaaaaaatggcggtatatgtgaaatcactttgaaaaagaaaaaaactctacataaatacaagaaaaatctctcaagacagatagtagccaatgcacaatttaattccaaaacatgggtcagcttcttactttggaatgttatagttttaatttaaattattgccaatatttaatattaaatacattgaccacctgttcattaattgatgaactcaattatactatcacttatgcattctccaaacatgtacaagtgtccactctgtcatgggaactccccagccattctggcagccctatgttttgtttctcaagcacgtagtcacacctttcttcccctttaatgtcagcttattttttcttcttggttgactttctaggggtgttctatgacacgctgagcagcttgtggtgaacgtacaagtgtcttaaaataatcgagtgtccctacactaccaaagtgttaaatctaattgaagaggccaccatgaaaatgagtatctggcacagccttggctgggcttaggaaagcaacaatttgagaacctagatgttggcagatgaccgtattaagatctactggaactgcatttaaagatttcatatgcatgacaaagcccatctactcctacaattggtttgatttacagcccaagataatggtgcttctagtatctcaaatactaaaaaaatcatatttaattgctttaattcactattaatcgattattataatgtactgctaaaggacaattctttctaagttctacaagcacaaataacatgaccatattatctttccaaattgctgactgtacaatattgtgggaatataaactacaatataatccagtggtttagtagctgttactactgtgaaaaaaatatttaggaggtcattatatcatagattggtatcatttgtctatatatatatatatatatatatatatatatatatatataactcaattttattttaaaaaatagtaaaagcaaacatcacatgaattaagaatgtattttatactttaagatttattttcaaaatgtgaatgtaaatcagatcttcccatcacgaccccagaagaataatgatttattttaatatttgtgattttaggatttagatactacctacttaccaagatactcacttgtaaaatatcttttaagaatatagaggcaaaatagtgtagcatagaaaacacattgaaagttcatattaatagccccttcgagtttttatagaccctagggtaaaaacaaacaaacaaacaaacaaaaaacctccatcccttgcctcagttctcattcatgtggtttgtttataggatcaacaacaccggtgggaaattttacagtattcttcttattgtgggcagctctgatggctccaaggttctttcttgtgctgagcaggaacctatttactgtggcttccattcagtttcagtattccttttagggctaaggaaaataattctcagaagaaggccaagcaacatggtcaaatagaagcacccagcaattatctctcttctgcaggaacaccacattgaccaactatacacacacacacaaaagcaccttcttaagaatcaaaaatcaggtaagtgatcacagtagctggttttcacatcatattgaggaaagaggcactgaagagggtagaaaagacagtctttaatcacctataccatccctccccccatcccccgcatccccctcatcccctggcatgtattgccatgcggcactgagagaatgtctgcgcctggggaagggagaatgcagtgattgtgagacttagcattggaactcagtgctgtcctgtcacagtaaaaagtaacatggggtggaagtcagccttcatccacagagggagcatttagaccaaccctagccagaggcaaattgcccgtcccagttgtcagaacatgagtttcagcaagccctgccaccatgggcaaaaggactctggggtcctacatcaacttgaaaggcagtctaggccatgaggactgcaatccctgggcaagtcctggtcctgtgctgtgctgggctcaaaggggccaggggacttggagtgcatgtgacctggtgagataccagccgggatgcatgagggatgcttgcaccaaccctcctcaaccctaggcagtatagttcacagctccaaaagagactcattccttctgtttgaggagaggagaagggagaacaaaaagaactgtgtcttgcaacttggataccagctcagccacagtaggacagcgcaccggacagagtcctgaggccccattccaggccttagcactcagatgacatttctagacacgcattgggccagaagataacctgctgccttgaagggaaaaacccagttctggcaggattcattatcttctcgctaaagaacccttgggccctgaataatcagcagtggtagctaggcaatacttgcctctgatcttgggtgagactcagaggtgtgctgacttcaggtgagacccagcacattcctggctgtggtggctatggggagagtctccttctgcctgaggaagggagaggaaagagtaaaggggattttgtcttgcagcttaggtatcagctcagttacagtgagatagagtgccaggcaggccctagggttcctgattccaggccttggctcccagatggcatctctgggtctgcccggcattaggaggaactcatcatacttaggaggaactcatcctcttagaaagaactcatcacactaaaaggaaggacataagcctggataactttgccacctgctgagtgtagagcccttggtccatgagtgaaaataggctgtagccaggcagtagtcactgcaggccttaggtgagacccagtgctgtgcagtcccagtggtggtggccatagggatgcttgcattacccctctcccagctccaggaagctcagcacagagagagaccctgtttgtttggagggaatgtggttctgaatcattatttaggggaatattgtctgaacatggtctactttgaagtttctcaccctttctcataatatgtcccatcaacataaatattatcaagcttcatttcctataattttcattatgttgcccaaatgaaaatattctgttgcaaattattgaaatgtaaaattttgtattaaagtataaattatttgttaaaatatttaaaatatgattggttattctacatacagaaatgtctttggatatctcagtatgttctcatctttcccctgtcctatcattattcttccagtgactcatgccaagaattgatcacaatgctccaagggtggtctgaccagcagggaactgagcagaactgaacatggcttcctgttttctgtacccaatttctttccctttttctggtaccactcatgtccacatcataatcatcttttgcctgaacaatctcaacaggctctgacgtggtcgtcctgcttcccccatgaatcctgagtgtttaccttccacttagtagctaaagggctcttttgaactcataaagtttatcaagtcatcacctcctcaaaacgttctatacacttcccataataatgagcatgaaatccaactccataccctatgtggtctatataatctccctttcctcagtctccccttattccattctctcttcactcatgaatttccagccaaaattttcttctaatgtctcaatgattaggtcaagcaggctccacacagtagggtgtgtgcactgattgtctttgtgtggaatactttctctctctctgcatatttacatggctgtccttttcttgtcatttagattttagttgatatccctcctcttcaatgaggactttcatggcctccaaatagtaagtagcttctttcatcaacttttatcatgtcaccctaaatgtagtaatagtacttgccaccataaaatattcttatttatttgtttattgtctagctgtctaatgaggtaagacccacaacagcagtaatcttaataattttatttagaataatgtttggaatataaatattgttgagtgaatgaatgcatgcatgcatgaccacagtatagatgtgttattgtatatgaagctattaagatcaaagagtttgagcctgggcttgaattgctgatctacatttactatggtgagtctaaacaagttacttaacctatctgtgcctgagattgtacatctaaaaaaggggcagataaaaatgttactttcttctcaaggttattgtaaggattaaataaataaattgctctttgtaaaatgcatagataactactgtataaatgtagcaataaatagtagtacaacccaatttttagaattttggcagccacactattgactcatattacacctaaagtataatgtaaattctctaagtttttttttttaacgtgtgctgctttgaagtctcacctctatatttttgtgcttacacagctgccttttagaagccaactacaggattttatattggtccgctttatttggtttcattcagcacatcattctactctgttgacaatgctgaaggttttgagttattgattaaatgtcaccttggatatttgaaaccaggacttcaatctaaaaatctaagctacttaactcaagtgacctcagtctagaggactctgagtattcatggggccagtgtgttgtcttctagcagtttcctttcacttgcccggagaagaggcctgtgaaggctggccctgggtctgtaaaacacataccagaagtgggagaggacataggttaaaagcagattgacagaggaggatcaaagaagccataagtatacctcagctgacaatgaccaagcttatgggaagaagatacagaaaaatagaaatttggatgtagagcaaatcttattttttcactttttattttgaaataatgatagattcataggaaattgcatagttagtacaaagaagttctaagtacccttcacccatttccatcttacatagtacttaacaccaaaacacgactttgacgttggtataatgtgggtgtgtagttctgtgtcatattagcaaatgtgtagatttgtgtaatcaccactataattaagataaaaaatattctatcaccacaaagatctctcccacactttccttttacaatcacgtacccaaaccctcattactcctgactctgggcaatcactaacctcggatccaactcgataattttatcactgagagactactatataaatggaatcataccagatgtgacctttcaagattggagttttcactcaatataatgcccttgtgatccatcctagctgttgtgtgtatcaatagtttgctcatttttattgttgagtagaattccatgctgtggatgtaccagagtttgtttaactgctcacccactgaggcatattttggtcttgtttttggcgattaaaaataaactgctgtgaacaatcatgtgcagattgttgtgtgtctaggttttcatttctctgggataaatgcacagagtacagttgctgggttgaatggtaactgtatgtttagatttttttttttaaagtgtccaactagtttaactagttttttgagtggtgtactggcttatatttccattgtcacagtttttactttagctgttctaataggtatgtagtgatatctcattgtcatcttaatttgtatttccctaatgtctggcaatggtgattagcttttcatgggctcactggacacccatattttctttatgattaagtatgtgttcatatctttttctcattttctatttgaattgtctgtttttactgttgagttttgagattttttttttttttttttttttttttttttgagacagagtcttgctctgtctcccaggctggagtgcggtggtgcaatctcggctcactgcaagctctgcctctcaggttcaagcaattctcctgcctcagcctcctgagtagctgggactataggcgccggctaccatgcacggctaattttttgtatttttagtagagatggggtttcaccgtgttagccaggatggtcttgatctcctgacctcgtgatctgcccacctcggcttcccaaagtgctggaattacaggcttgagccaccatgcctggcctgagttgtgagtttttaaatacattctagatatgaattctttgttagatatgtagtttatcaatatcttctcccagtctgttgcttgtcttttcatcttctcaacagggatttcaaagagcaaaggttgtttaattttgatgaaatcccatttggttattttttcttgtatggatcatgtctaagaactcacaagtcccaggtcctgaagattttctcccatgtgacctgctacaagtttcatagcattacgttttacatttaaatcaattgttcattttaagttaatttttgtataaagggtgaagttaagattgaggttcattctgtttgtttacctgttgtccgatttctcaagcatgttttgaaaagattattattcctccattaagttgttactgtttctgaacctttgaccaaaggtggttgggcaaatttgagcgtctttttgggttctttgttctgtttctttaatctgtctttctgccataccacacaggactattgctatatactaagttttgaagtcatgtagagtaactttacctacgttattattttgcaaagtagttttagctattgtagtatacttggctgtctatacaatttttagaatagttttgtctatgtgtatatatatctgttgggattttatttatttttttatcttttgattttttaaattatactttaagttttggggtacatgtgcacaatgtgcaggtttgttacatatgtatacatgtgccatgttggtgtgctgcacccattaactcgtcatttacattgggtatatctcctaatgctttccatcgtccctccccctaccccacaacagtccccggtgtgtgatgttccccttcctgtgtccaagtgttctcattgttcaattcccatctatgagtgacaacatgtggtgtttggttttttgtccttgcgatagtttgctgagaatgatggtttacagcttcatccatgtccctacaaaggacatgaactcatccttttttatggctacataatattccatgatgtatatgtgccacattttcttaatccagtctgtcattgatggacatttgggttggttccaagtctttgctattgtgaatagtgccgcaataaacatatgtgggcatgtgtctttataacaacatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcatctgttgtttcctgacatgttaatgattgccattctaactggtgtgagatggtatctcattgtggttttgatttgcatttctctgatggccagtgatgatgaacattttttcatgtgtctgttggctgcataaatgtcttcttttcagaagtgtctgttcatatccttcaccctctttttgatggggttttttttttcttgtaaaaaaaattttgtttaagttctttgtagattctggatattagtcctttgtcagatgagtagattgcaaaaattttctcccattctataggttgcctgttcactctgatggtagtctcttttgctgtgcagaagttctttagtttaattagatcccatttgtcaattttggtttttgttgccattgcttttcgtgttttaaacatgaagtccttgcccatgcctatgtcctgaatggtattgcctaggttttctcctagggtttttatggttttgggtctaacatgtaagtctttaatccaccttgaattaattttcatataaggtgtaaggaagggatccagtttcagttttctccatatggctagccagttttcccagcaccatttattaaatagggaatcctttccccattgcttgtttttgtcaggtttgtcaaagatcagatggttgtagatgtgtggtattctttctgaggactctgttctgttccattggtctatatctctgttttggtacaagtgccatgctgttttagttgctgtagccttgtagtatagtttgaagtcaggtagcatgatgcttccagttttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccattatttgtatcctcttctatttcattgagcagtggtttgtagttctccttgaagaggtccttcacgtcccttgtaagttggattcctaggtattttattctctttgaagcaattgtgaatggaagttcactcatgatttggctctctgttattggtgtataagaatgcttgtgatttttgcacattgattctgtacctgagactttgctgaagttgcttatcagcttaaggagattttgggctgagacaatgggattttcgaaatatacaatcatgtcatctgcaaacagggacaatttgacttcctcttttcctaattgaataccctttatttctttctcctgcctgattgccctgcccagaacttccaacactatgttgaataggagtggtgggagagggcgtccctgtcttgcgccagtttttaaagggaatgcttccagtttttgtccattcagtatgatattggccatggggttatcataaagagtgcttattattttgagatatgacccatcaatacctaatttattgagagtttttagcatgaagggctgttgaattttgtcaaaggccttttctgcatctattgagataatcatgtggtttttgtctttggttctgtttatatgctggattacgtttattgatttgtgtatgttgaaccagccttgcatcccagggatgaagcccagttgatcatggtggataagctttttgatgtgctgctggattcagtatgcaagtattttattgaggatttttgcatcagtgttcatcagggatattggtctaaaattctctttttttgttgtgtctttgccaggctttggtatcaggatgatgctggcctcataaaatgagttagggaggattccctctttttcttttgactggaatagtttcagaaggaatggtatcagctcctccttgtacctctggtagaaatcggctgtgaatctgtctagtcctggactttttttggttggtaagctattaattattgcctcaatttcagagcctgttattggtctattcagggattcaacttcttcctggtttactcttgggagactgtatgtgtccaggaatttattcatttcttctagattttctagtttatttgcatagaggtgtttatagtattctctgatggtagtttgtatttctgtgggatcggtggtgatatcccctttatcattttttattgcgtctatttgatccttctctcttttcttctttattagtcttgctagcgctctattaactttgttgatcttttcaaaaaaccagctcctggagtcattgattttttgaagggttttttgtgtctctgtctccttcagttctgctctgatcttagttatttcttgccttctgctagcttttgaatgtgtttgctcttgcttccctagttcttttaattgtgatgttagggtgtcaattttggatctttcctgctttctcttgtgggcatttagtgctataaatttccctctacacactgctttaaatgtgtcccagagatactgctatgttgtgtctttgttcttgttggtttcaaagaacatctttatttctgccttcatttcgttatgtacccagtagtcattcaggagcaggttgttcagtttccatgtagttgagcagttttgagcgagtttcttaatcctgagctctagtttgattgcactgtggtcttagagacagtttgttacaatttctgttcttttacatttgctgaggagagctttacttccaactatgtggtcaattttggaataagtgtgatgtggtgctgagaagaatgtatattctgttgatttggggtggagagttctgtagatgtctattaggtccgcttggtgcagagctgagttcagttcctggatatctttgttaactttctgtctcattgatctgtctaatgttgacagtggggtgttaaagtctctcattattattgtgtgggagtctaagtctctttgtaggtctctaaggacttgctttatgaatctgggtgctcttgtattgggtgcatatatatttaagatagttagctcttcttgttgaattgatccctttaccattatgtaatggccttctttgtctcttttgatctttgttggtttaaagtctgttttatccgagactaggattgcaactcctgccttttttttgttttccatttgcttggtagatcttcctccatccctgtattttgagcctatgtgtgtctgtgcatatgagatgggtctcctgaatatagcacactgatgagtcttgactctttatccaatttgccagtctgtgacttttaagtggagcatttagtccatttacatttaaggttaatattgttatgtgtgaatttgatcctgtcattatgatgttagctggttgttttgctcattagttgatgcagtttcttcctagcatcgatggtctttacaatttggcatgtttttgcagtggctggtacaagttgttcctttccatgttcagtgcttccttcaggcctcttttagggcaggcctggtggtgacaaaatctctcagcatttgcttgtctgtaaaggattttatttctccttcacttacgaagcttagtttggctggatatgaaattctgggttgaaaattctttctttaagaatgttgaatactggcccccactctcttctggcttgaagagtttctgctgagagatccactgttagtctgacgggtttccctttgtgggtaacccgacctttctctctggctacacttaacattttttccttcatttcaactttggtgaatctgacaattatgtgtcttggagttgctcttctcgaggagtatctttgtggcattctctgtatttcctgaatttgaatgttgacctgccttgctaggttggggaagttctctcctggataatatcctgcagagtgttttccaacttgattcaattctccccgtcactttcaggtacaccaatcagaatcttatcaatatcctcatctcccacatgaatattctctgacagttccagcccactctactctctcatcctttcctgaaatgttatggctcttatagcctgtgccacaaaattaggcatttaattttatattgtcttgttttgttttctaattatgtcatggatatattcttttccatgctagattgtgaattcttggcaaggaaccaattttcatgcttttctgtgtctcttttcagcatttagaaaatatggacatataattatactcaataaaaattgttaattgactgaacaactttcctaggttcattgtaactcttcagttctatgacattaaagtacagagcacaaaatggccaacaattcgtatgttaattatctgaaatgatgaaatcattcaatacacctgggcagctatgagaaatgtcgttgatggtgtgagcagtagtggtgcatgcaagggccatccatcctaaacagctctcatacactttgagttttggactgattcatcagttatctaccgagtagattgcttaaaaagaagtgttgggggctgggtgcagtggctagtgcttgtaatcccagcaatttgggaggccaaagcaggtggattgcctaaggtcaggagttcgagtccagtctggcaaacatggtgaaaccccatctctactaaaaacacaaaaaaattagctgggcgtgatggcatgagccagtcatccaagttacttgggaggctgagacaggggaatttcttgaaccagggaggtggaggttgcagtgacagtgagctgaaattgttgcactccaacctgggcaacagaatgagactctgtctcaaaaataaaataaaataaattaaataaataaaaattaaaattaaaaaaagtattgaggttttattgctccatttatttgtgttgtcatcaaccatttggtatccattgcctcgaagtaaatcaaggtgatctaaagggttaatttatgattcttggaaaattctataatgttcgcttatctcatttgaagaaaaagtaaaagttaaaatatttgaagaagttactactcagactataaaaatcatgtagtcttgccttctcattctattctcaaggttctggaagttaaataaaaatggcttattataatgctggtctttttactaactcataagaagttcaaaatatgtagtttttactcctctacctgctagtatttagataagcacctcaaaaccaatattcacgtttcataatcagagtgccctagttaaactccagatttgttacttactagctatgtgactctgagtaaatcatgtaatttctaagagccttcgttgtctttcagataaaataggcaaagccatatctacttctcagtgttcttgcaagaattaattagctcatataataaatgtgcttattactattcaaaaaacatataaaagcataaagagtacattactatttatctgggaataatcctttttattataatgtaataattgttattacaattattataaaactcatctttttgagtagggcatacattattgttcaaaatgtaataaaattggtgaagttttagaactggagcaagatgtcatagtagcgtaaaagagggcacttaacaagacctgggtgccagaaagtatatctaaattagaagatttttaatatgagttttagagattttaaggaagtcattatcagggcttctggagacaaggtggcttgggcacatttatattttagacatatctagcaggagggaacatggttgagcagagggtgatgatgacataaggacaccactgaaaggaatttgagtaaaatgatgacacatattaggagagatggggcagatattactcatttgagaaaaagccacacttcaagagtgactggaaagagtcagggagtgcgggaaaagagtcaaaggtgatccttaagtatctagtttgggtaactaggatagtgtggctccaacctgtcgtaatcagcttgggctgctataacaaacattatgctgagtggtgtaaacagtggaaatttatcttctcagaattctagaggctccaaagtctgagatcataaatgtcagcatggttggattctgttgagggccctcttcttgggttgcaggcagctgccttcttatatcctcatattctcagagagagagagagatcatctctcttgtgcctcttcttataagagcactaattccattcatgaggactctaccctcatgatctaactatctcccaaaggcccacctccaaatatactttggagattaggaacttaacatataaattttgggaagcacgacaattcaccccatagcatacccattgagaagaacaatacaagaaaatttggagttaactaatttgaggagaaaatgatgagtttacattaaatcaagacgaacttgagatgttttaagagggaactgcttcttccctactacttatatgttctgccaggaagagaaaattctgctagtgtggtacttctagtttcttctcttgtccctgtactcactctgcccctggggaggcgaattatttatttggttgttcaaactggggagagtgactcttctgtctagaaacagccttcctatggagagcctgggctgtcctctttcactccatgctttacatctgtaaattctgtaggagcctccctcttggaagccaaattgccccacaatccaggtcagattgtggttcatattagccactgcacttacccttgtttgaaagtcacgtgccccaacttggttatggcttggtctctatccttcctgcttatttttcagctttctcagtgttgaggcaggaatgaaaggtatcctttatagaaaggactctagagattccaacaaggccacttttgacaacacatctatgacccattttttggcatctcacacaattggctcatttaagtttttcaatgtttgagctaattaaaatataaatatgatgtatgttttatatacttccaaaatgtaataaatgctcagtaagtatctgtggagattatatatttaaaattagttgggaaacataactatcctactgttaaacattttttagagagatttagagatattcatttattgaactcctatttggctggtaatttgctcagtgtgacctgccatcctacactttttacaaactgccccacttctcattttgccaaaccagattgcctttctcttaatagctccttctttcttgccactgaacctaaactcatgttctgagcagtaggcaaaataattaacagacccacaaagatgttcttaagtcccagaccctgtgaatatgttatgttacatatcaagggggaattaaggctgtaaatggaattaaggttgctaatcagttgactggaatataaagagattattctggattatccaaatcagttcagtgtaaccataatggttcttataagtgaaaaagggaggcaggagagtcagagtcccagaaggatatgtgataccaggaagcagaggtcaaaatgatgcaactgctagatttgaacacggaagcacccacaagccaagtgatggggatggcctctagaagctgtgaaaggcaaggaaacagactctccttctagaaaagaatgcacattgatgacatctgattttagcttagtgaaacccatttcatatttctgaactgcaaaactgaaagatagtaaatttgtgctgttttaagccacgaggtttgtggcaatttgttgcagcagtaacaggaaacaaatacattctgcaactcatctcctgcattttccctgagtggccatttataaatacatagactctgacccagcctggccagagataaatcaggctcctccacctctccaactgctagctctgtgatcccaggcaagttattaaatttttacatgactatttcctcacctataatatggggattatcatgacaccatccttatagggatgagttaatagatgcaaagtcctttggaaaagtgggcacataacaaacactatagaagtgtacgctaatattttcattattatgcttacctctacaaattattttataaatcagttcaaacgccaattcttctatttccttttggaacaataagatctttcttccttaaatttatagagtactttaccttaacaatattttatagcatgtgttcgttattatgcttacctttacaaattattttataaatcagttcaaatgccaattcttctatttcctttttgaacaataaatttacagagtactttaccttaacaatgttttatagcatgtgatattttaattcttatttaatcactttcatacatattgaatcctctctcctaagatataagatcttgtaaaaattagtgatatgcattttatatatttactttatttattctaattttgttattcctatactgtctaggccagtgttttgcatatcataggtgttcaataaacatatttgaactaccaatggtgttttccacttgtgctaatttcaagaaacaaacaaaatcattcactattcaatgggcaacactctacagaaagaattaataaaacagaagaatgaataaaaacccgaagagtagcatgaagtctatagaaaatatcctccacaagtatgtagtgggattcagattctttttttcactttcactctagatgttcaactttaatttaaataacatgttagatcaagtgtgcttttataaattagttattagcccataaactgtcttatatagtctgctctgaaggttatcactttaagaggcatgatatactgtggggactgaattttagtactgtgcaaagacctgattggaatgaacatttctgaacttctagagcctctccagtaagaatgcagttgttgctgtgaaattgactttaaaagaagcttctgatgacaaggcctagctgattattgtttcagagatgaagtgaaaaaagagcaaacatagttaccatagaaataaatgtattaagttctaaaattaacattcttattagtgattatgcccatatttttttgatacatctacagttaatctcaaaactttcatcatgggtatggggttatacttcctggtatgacccaagatgtgaaactcaattaaggtcaaatgtcattaacttcggtagtatgttttaaaattaacctcaaaacggccccaaattttgttaaaactatagaagaagaaattatttattaagaaggtaagaaaagtaattcttctaaactatgcaatcatttatttattggctctgataagaataacatttcaaatggttgtgttttctgtcagtaatttgaagttctagtataatatttttatttaattacatgattacaaaacaagtctttacttacatcatatgcattatatgccaaattaattctcctttgaaaaggccaattgctgataagagcaatgaattctattgaatagctcactgaattctgagagagtaattaagaaatttttatatacacacagaaacacatgtggctcacacattaagatgtagacgacaatctttcaagataccatctaacaaatggaggaaatatgttttcagcttgcaaacttcaaagctctatgtccaataatgagataaatcttcatttctgatggtactaatccaacactgaaaaattaattctcctttgaaaaggctaattgctgatgatttcgcagaaaagaggtctattctttttagtggatatgaattgatcctgctaatgcagaacctgactttttcagattcctttagcctttagtatgagtgaatttttaaaatttctcttttgttgtgttagaaataaatataatgattttttctcatgctgatttttaagagtttaaaggaaaacaacagctgatagctcattaaggctcatgagacaccactaagcatatacaactcccattttgaggctgcataagccaaacactttcaattccactagaaggtgtcattagaagtacttaagcaaagaaagctactaggagcaagaacaccccagagaatttctgtaaagactttgatgcacccattgtcccatagtttaaaatgttgtatcactcaagcagcaacctcattaacagatcatttagattatcatgagttatgatgaactcaagcctctgtagtattttcttcccaacaatttgctttattacagcaatataacagacatctgccttaaagagaagtcttactttccactctattggatgccactgaaatttacagtgtctggggcaggaggaagaagtaataaagtcttacagggaaaaaaaaaacttgttacctaagggcaatatcagaaatgatgagaaatgagataagccagtaggactaattcaactagaactgaagaagctggctctgaatctgatttgctctcctccaaaagaaaaatatgctcatgataacaataactaatgtgtacttaatacttttgaggaaaatgactatgtggtgctccaaactatgtgcaacattctgtgccaggttattctatctatctatctatctatctatctatctatctatctatctatctaaaatttatgtatacacagaaatataacattttacataagtagtaaagtaactctgtattttaggtcttatcattgccatgttaaatatatttccagagtaatatagtcagtaagttgtttaagtggggtttggatgcaggtctctttggtttcaaaggctgcagtctttacccctcatcatattgccttgcttttgttgccttcttcacttcttttgtctctgtttcttattcagacaaaggtgggaattgactgtaggtgaagactcttctttggctaattggtttattttatccctaaggaagattcctattcttgcttctggtctctcttctccctctctctcttcctctctcttttttttctctccctctttccttccccctcctcagaaaatgactagactttacctttgcaatagactaaatcatagcccctaaaagagatatgcctaggtactaatccctgggagcttatccataaaaaatgtatttgcacacctgatgaaattaaggatcttcaaaggaggttcttgcattggattatccaagtggaccctaggtgaagtcacatgtatccctttaaaagggagggagatctctgtctccctctgggcttctcagtctagagggaggcagatacacacaagagaagaggcaatgagatcactgagtcagagattggagttaggcatccataaaccaaggcattcctggaattaccagaagctggaaggcaaggaatggattgtctcctaaagccattaaaaggaatgtgaccctattggcacctttaattctggcttctggccttcctaactgaagagataataaatatctattgtgttaagccaacaagtttgtggtagtttcttacaatagtcacaggaaactagcacaactctcttctttgaaattctggaattggcggcaggggaaattgcatgtaaaagcactgcatgtttacctctggctctgtgaaatcacaggaagtacagttaaattctaggaaacacaggggcatttttacctctgcacaaatctataaagctcctgagggtcctgcagtctttttccaccctgatgtctcccaagacagccttctgattgctgagatatagcctacattgaatagatatttgttgagcaaatcaacctgcttctgctgtggctccagcaggactggaacatttcaggaaagaataaaaggtcatttctcctgagttaagtgttaattcttgctttgaatgtcagtggcgtgctaacacctgctctcacatgtattttaggtccatcagcgtatcctaactagaaggccttgtgactagcagaaaagaaaatgtaggtgagccatgcaatgatggacgtggactgctctcagggcgcagtgacaattatgacttagtcatcaaaggtgaattgatacaaacacttgaacatatcttaaattagattgttccaggaatccttaaaatgcaagagaaatggcaatgatggggcagtggataaatctaaatgacattacgtgggctatgattcctttctccatgccatttggaaagttagaagaaatcatattaggcctgagaatagactgggtgcttctcagtgtgtatcctttacacccagagtgccaatcatctaggatgcaccggttctgccatactggggatatacagtcaaagtccattcttactagctggtaccttgcaggaccagttgtcaaatatttttaacagcaccttattcatgcatttttttctagaatatatatgaactttttccatccccagtattgtggctcccctcccatccctatttagatcctcatctctcacttggatgcctaaaatagccacttcagcccctctttctacataatcatctcctgtaatttattctcaacacatgttttcttgaagccttatccaaatatatgattcctctactaaatgcatgaatacataaagaaaacaaacatagaataatttactgctactgacttcatgtcattccacaggattaaatatagatcccatattatacacactcatattacacttatataatatctatattattatatatctacattaaatacacatatattctatacattaaaagaccctcacaatttgaaccacattgtatggactcaatgtttgtgccccacccccaaattaatatgctgaagcctaaaccccaatatgatggtatgtggaggtgggatctttgggaggtaattaggtcacaacggaggagctcttatgaatagaattaaagctcttataaaaagagacacaagagagattctctctctctctgccagttggccatatgaggatacatgcagctatcggcaaaccagaaaggccctcattgaaaacccaatcatattggcaccccgatctcacacttccaggcaccaaacctgtgagaaataaatgttggttgttgaagtcattcagtctatatagtattctgttattgcagcctgagctgactaagacacccatctaactctgcagccttctgttcctctctctatactgaagtctatttcattatttcatatgtatttctcatggctttttgaaatcaccagacaatttcctgcctccatggttttagagctgatgtcaaatgggaacaccctggtgacaccaagccaacagatgtcaattctggttggtcaaggctgctgctctatctgattagttggtttgggttaccctaaaggcagatcctgagacaaggaatttcatataaatagtttactaaagacataatctcaggaaggaggagtgagaaaagcatagagactgatacaaggatggaggaaagccaatataaatgtattttgacaaagttactgtgagaaatcagaagttcacacgtatgctaggacatgtgagaagcccacctatgaaatgaccttataatcatccagaaagataaggcatctatccttccatcattggttaggtttgttaactccactgcatttccaggttatactgatgaacaagatgagggaattccaaccacatcactccaggccaggaggctgaatcagaaagataagtaatcgtccatttcctctgctccctcactgtggactggaacgtggatatggtggtggggagccaggttccgtcatgtagatatagtggagcaaaaaagctctaaaaatctggatccctgcatgacctcatggaacagagtagttgtatttttttcatcctaccacccctggagtgcctaacgattctatattgtcaagtgaaaattatttcagtctcattctggtggctaaacccaaatcttaattaatattattctctcatgcatctgtcccatgctgtttactttcactgcactctagttccacttcctgtcagactctattgcaattatctatttaaatgcccatctccatcgttgcattgaaagttcttgatgacagccacggtgccatttctgaaccctgagtgcctggtaggtattggatttacaagaatttttaaataaaatttaaaatgtaattgctccaacagtaaagctgtaatacatgcaattaaaaatatatgatacataatcaccactcactgggctgcttactgtactttttctcatgaagtataatttgacacaggaaggttaatgaagcatttcctgggaaacatactttacatataacatgactccaagatgtgtttgtaccattcttgtattctttccctctgtcacaattagagaggtggttcttctcctagccaagaaaaattcttctatctatgctatagatcttcttttttctcctaccattaagaccctaagctcttttttcgattccttcaagttctttctctctgttggttaaaatctctctaaaacaatcaaagaatgctacctagtcttcacatgttcctttaagtggcagactcttttctttccctctttccctccctccgtccctcccttctttctccctctctttccctctttccctttccttctttctttctttctccctccctcccttccttttccttcctctctctctctctttctttcttttttttttttttgagtcttgctctgtcacccaggctgaagtgcagtggcacgatctcggctcactgcaacctccacctccctgattcaagtgattctcctgctttggcctcccgagtagctggcattacaggcatgcaccaccactgctgggtaatgtgtgtgtgtgtgtgtgtgtgtgtgtgtgtgtgtgtgtgtgtgttttgagacagagtcttgctctgccacccaggctggagttcagtggcatgatctcagctcactgcaacctccacctcttcagttcaagtgattctcctgcctcagcctcccaagtagctggaactacagccatgtgccaccacacctggctaattttttgcatttttagtacagatggggtttcaccgtgttagccaggatagtctcaatcttcctgacctcatgatctgcccacctcagactcacaaagtgctgggattataatttttgtgtttttagtagacatggggtttcatcatgttggcccagttggtctggaactcctgacctcaggtgacccacctgcctcggcctcccaaagtgatgggattacaggcgtgagccactgcacctggccaggtgacagactcttaattatcctgtgggagtcaaggtttcataaaagccttcacttgctgtctgcattttctcactcacttcacaacacaattccaacacaaccaggtttatatcgctcttgccaacatttcacaaaattcaatggacttctgttatcatacatatctgtcagcagcactcaacaccactcaatcctcccttcaaatgtccactgtgtcttcatttctgtttattcttcttttctctccagccactcattctgaatgtattttgctgcctcttattccctcagtagacatttaatgataaaaattctcaacatttatttcaagatacgcttcccttctcactcaatataatgtcgctacttatttttttccaattctatggcttcattggtcatgccacaaatcctaaatgttcatcgcctggacagaccttgcttctgagttccaaaaatgtctattcaaatgtgtactgagatgtctcactggcaactcaaaaccatatgccattgtatctgaaatgttggcccccttcaagactctcaaccaagaaattgcaccataatttacctcattgttgaagccaagaaaatggaaatcttatatgatttctcattctgccaccaagaatggccaaccacactgaattgcctggaactgaggcgtcttgtgggaggtagaacttttaaagctaaaattaagttagttggttaccttccaatctggctcctggctctgtgcattctatttcctaaatatctcttatatttgttcaattatttccattttcatgacctctgctactgtctcttgtacagggatccgtacgttcattcttgcccttcatttctcaccctacaaatgctttctgtacacaatgaccacaagatatcaacaaaaagcaaaacttatgatatcaatctcttccatccttctcattgtctatgagataagacccagcaatatctgggccctgcgtgtctcctcagactcatgattcattatttcctctgtgttccagcccaactaacctttccatttcttaaatgtgccatgaaacaggcctggaattactcttccctactccttcttcctattaactcctcatcttttgggtctcagaatcaatgtaatttcctaaagatgttttgccttctctccctagacaagatcagacacatctttttccccccgcccatatcaaactgcactgttccttcacagaattcaacagcattcattatttgttcaatatccatcttcccagccacactagaaactccatgaagcaactattattgctttattctcttaccactgtatatacaataccccaatcagtgcctagaagcaaaaaacttttgtgaaatgaataaatattttgttatagaatatttccttatgtgatatcatgtcctattataacttcagataggttaactaaaaatataactctattaaggaaagaaataaggccatggcccctcctaaaattttagcaagttttaccatatcccctttgtatggtttggatttgtgtccctgcccaaatcttggattgtattctccaatgttggagtaggggcctggtgggaggtaattagatcatgggggtggacttcccccttgctgttctcatgatagtgagtgagttctcacaagatctggttctttaaaagtgtttagcacctccctctttgctctcttcctccttctctggccgtgtaagatgtgtctgcttctcttgcaccttccaccacgattgtaaatttcctgaggcctccacagccaggcttcctgcacagcttgtaaaactgtgagtcaattaaaactcttttatttataaattatccagtctcaggttgttctttacagcaatgtgagaatgaactaatacagcactgaatctaagatgtcatcaatggtaacgtgtcattattttaagtataactaagaaagaaaaacaatgttgaaaaataagtcatgaaacaccttgactgaaagacacatccagttttcagatatcaaaaagtaaaaaactgggaaaggccacaacttccacaacaaatcttgtttgctcacttctctctctactgggtggtccctccttggtccatggagtatcacctcattcttgggccattgcaacttccttgtattctcctaactagtatcttctcttgtatacttgaacccccagcttctttacatttcaaccagactgatcatttcacaatacaaacctgatcaccccaaaatgcaaagcctgatctctggataaccctatactggttgtctattctatgacacatcacacacatactctcccttgttttctgtcttcctgacatggttcctaaaatatgccagcttctttcctttatctggaatattctgcgacttgctgtcttcaatcgttccttctgctccttttcattttatagtgttcattacaaatttccccttcccagaacgatgttctgtgattctgtcactgcaaatcagtagcccctctcccctgcccatgccgttagaatttttcacacgtatagcctgttctcttccctcaccgagctcatctcaagttctcattacacatatttttttgtgtgtttatttgcataacgactgttgcttccactgaactttgagctccataagggtaactatcagcatgatgtgccagtgccatataccacagtgtgacacagatagattatttattgaatgaatgaggaagtggaacagttacactttgctgaaacaaagacaatagaaaattcaatgcacagccctgagaggaatctagaaacaagtctgcagctaaaaagaagcagcatatacccccaaaacttaggtaggtgtcataaccacatcctcataaccatgtgtgttctcaccagatacacctgccttctaaagactgtttaaaaacaattcacactaaaggtactacttaagaaaaataggcccttccatcttaaaagagaaaagtttttatgtattgcattgtatgttcctctcaaatattttaaaattattttaagtcacagattgtttcataaacataattttgtttttccaataaaaagctttgaaaaaactcagaaaatatttttgcaaatgtggacctcaatatcatttgttatgtctcattttgaaaaataatcaaatttgaaataaaatgtgttttagaaggttagaaatatacacatattttctcttcacacgtttgtgaaaaaaattaggtaaatgactaatgagaaaatactactagactaaatttacaaagaatacagagcaaaaacagaacaatcttaatagaatcagtgccaattacatctcacatttcaatggcagtgaaaataaatgtgattttgacatatgaaattgtgttaggaatgtttttatgtagaggaaaatgttatcatccttgggggctttttgttcaaccaattttcaactttctaatgcctggctgtgccttgtgtggaatcagggaagtcactatttctctgtccttgaatactgctcatgcatcattctcataaaaatatatatttgcccatccctgaattcatgtgtctcttcattcactcagcatttatggagaaaattttatatgacaagcacttggctagcttctgtatatacaaagatgaataattctaggattaaaatatggcaggaaaaataaaaccattaacaagtaaattctgaaagttaaatgctaataaaaaagcagtagacatatgtacaaatattgaatgccattttatatctctcttcattttccagagaagggcattaaggcttaagataacaaggtaatttcatggagatttcatacctaacgaatgaaaagactagggcttgaattctggtttctcatttcataactagtaaatccctttaccgagtgttgtcaaacatatgtcatccattttatgtatgaaatctcctttcatactatgcatcttcaccagtttgagctgctataacaaaataccatagactgggtaccttataaacaacagaaatttatttctcacagctctggaggctggaagtccaaaatctgtgccagcatggtcaggttccagtgagagccctatttcatgtcacagactgctgacttctcattatatcctcacatgaggaaagagcaagagaactctgtggagttccttttataaagacaccaatccattcatgagcactccaccctcaagacctgattacctcctacagaccccacctcctagtattatcacattgaaggtttgatttcaacatacgcattttgaggggaaaccaacattcagtccataagaccatgaaaaataacaatttttatttctgttatactgacaaggaaaccaagactcagataggctcagcaactggccaagccacacagttagtaaatggcagcaccaaaattcaaactcaagtttgtccaacccagaaacttctgcaatgtctactatcacgagcttcctctctattccagttcccatgtatctgtgaaatgatttaattatcacacattactagcatttgttgagcatttatatgtcccaagcattccttaaagatgcttccaagaatcaagttatttaattccaaaaaaaataatatgtaggtactgaggtaccatcctaaggtattgaggtattatcctgatagcacaccgagaatgctatcgggtctcccaaagatggagaattaaagaacgaatgtctctatattcctcagcaggagtcagtctaaaaggaataatccaccagccagagtatatgccatttttagattacagatacaatccactataagttccaaacccagagtggtcaatattgcttttcttcttttatatctgttctgttttgcaaaatatatgttatggttaaagaatgaacttgagtgagctgccctgaaatgagagccatttgtttaaagttctgtggtgactccttcttccttcccacctgcatccccaaccacatgttgagattcctggaaatatgctccttcataagggtagagagccaatgaggaccaaatgatatgttttcctttccctcagcttcaagggctcaaagtcccagatgaggggcagggagcatactccatgacagaaataaacaaacagccaggtggcccaagtaatgactagccaggtctctggaaactcctcaagaactcaccggcttgcagcctaatctgggaacagtgttgtacatgactacatataatataatgtgaatagtactactacagacaggtggaccaacatgatctgaaagcaccagttaagaacacatacagaagtatttgatacaaggtaaaatctatcattcaaaggcatacaagtactttgcaactacgaaacacctctaaaaaactaacggctttgagacagtgctatacataaagataaataatttaaaagactatatgtacattctcaaaagtttgtccttgcacaaatcacttgcttcccaccataaacacttctgagacccttcctaataaaaccattaaggttgagcaggcaacattgtttagaagaacaactgtgagttgtacatgacccttcataaaagcagagactactaaacatcattagtaggcgatattacagcatcttcaaacccagacataactggcaccaaatttgcaggaaaatgagttaccttcctaatagcccttaattacaattacaatgtgactttactcgtattccagtaatgaaagcatttactctcattcctcatctgatttaaagggcaacataagctgaatgcaagataccttataaaattagaaaagcaattgaacaaactttaacactgtgccccaggatgacaagaaggaaacttcttcagaaacaagacatcagtgtatccaaaaagttctttggatttcacagtttgtaatcccagggaaagaaatatggaaaaaaaaattgagaactcagttatttggccaagctaaatcaaacacatgtttataaatctaatttctatttcttagagataccgagttacagatactatatgggctaatgataacgaagatgacaaaacttctttttagtaaaaaataaccattagctataaaaattagaaaatagagaccagtgaaatataaattgagaatagggtataatggatattacaacaattaaaagaaaaaaagctggccaggcacgttggctgacgcctgtaatcctagcactttgggaggccacggcgggaggatcacaaggtgaggagatcgagaccatcctgactaacacggttaaaccccatctctactaaaaatacaaaaaattagccaggcgtggtggcgggcgcctgtagtcccagctactcaggaggctgaggcaggagaatggggtgaacccgggaggcagagcttgcagtgagccaagatcacgccactgtactccagcctgggcgacagagcaagactccgtctcaaaaaaaaaagaaaaaagcttattaaataatttaatttagtgctataccttataaaacattgtaaaagaaattccaaatcaaaatgttatttaaaaacaataaataacccctctagttcaaaacagaactaaatatttatgaactttttagaggaatagtgcttttctgcatcaaagaagtgacaacaaaggtagtggcagattcaacacagaaaaattacaacttcctcatacaatgaaaattttacctaaagcaaagaagggattaacatctaatatgacaaaatgttaagatctgaattgtacacaaagtgcacagaaattgataaggagaagctctggtgacggctagaagattgccagagatgtgaaccatgtgtgggaaagctcgactgggaggataatataaaacaagaggaaagaaaagtcagatttagagtgagaacattgtcaataagaattgccagggtcccctagatggttccaatgagcctcgtctcctgataatcacatccttgtgggagggggtctcacattgacttgtgtaaccaatatgttactgcagaaatgaagttatatgacttctgaggctaggttaggaaagattttgcaacttctgccgtgtcttttcttgtatcacttgctctggggaaaggcagctgccacattgtgaggaaactcaagcagccctatggagaggtcaatataaaaataactgaaacattctgagaactgaagcctacatctacttgattattgtacaaaggaagaaattgaggcacagagattaagagccttgcccaagtttacacaggaaggaagtgccagatctaagatcaggtttccagagcctgagtccttaacctttacatgatactgccttctccatggtagaaatagaatgaaaaaatgtttacaattgtatgaaacataacaacaaaaaagaaatgctaaaattcagaaactgattggatgtgaaggcaaggggtgcattgaaatggctttagtttttcaaatatggataacaaggagaacagtagggttattaattaagataaagatcagacactcacagtttgaaaagtaaaatgtgcacataaatgtatgcatgtgtgatcattcatgttgtttagagagtaaagtgatacacagggaatgtagtgagcaagctggtttgggattatcagatttgagcttgcccaggcaagaagaatttcagagaagcttcattccactagcatatattaaaagatggcctctttcaaatgataatgtgtatactactttccttctggagattcataaaacgttggaaatttcctcactccacttaacctcttttttgcccgtctcattcttatcagtcactctaggcatggatctaatctaaattatttttaaaatatgactctttaaaaacacatactaattaagtagaattcaataaaattagtttatttaaaacatgaatgaaataaaaataattagactcgttttgcaataactagaatataaactactatgcagagtgcaaatgctatgtttcattagtgtgtaagagaatattctaagtttgagaagtgttttatttctctaaaattagaaaaattttagtttttctttagtttttcttctcccaaacatatgtgactttatttcattttaatatataagtctttttaataaatacatttctgtctatggggagctcggaaaaggcaggtgcagcaggtgttatttttgaagagttctgtacacgttcacatctgcttagttgttatgcactgctgcatgtaatggccaagaaaatccaacacaaatgctgaaaccaaaatccccaggaaaccagcagaaacgaaattggacaaatcctaatacataatgtatatacttcaatatcctattgcatgtggttacaaatttgaatatggcatatagcttatctttgtattttactaaaataaaactaaaacccacaaactatctggggagattaaatttaccgtacataaaaatgcccaagggaatgctgcattccttttatgatagagggactaggcaatgaccagagcggtgcaattaaccagactgttggtcatgagttgatattattgttccactagccccacttgattcactgccaagctcatcccataccctcatttgttagagccactccatctttgctctatttcacttgcatagaaaaaaaattcagatcctgaaaatcaatatgttgttgaattctaattttgtcttattttacttgcagatcttatctcacttgcagctgtttacattttccatattgtgttaatagtcaaattttatttctaaacataacctaatttttgctgtgcaggtaacaggctgtttaacaagctatacctactttagggtccttcagtttttttattctgtttgactatgtaatgtcttcatcaaatatctcctcatttgaacatcaaaaatattattttttattatagcaaccaccaagtatcatgatacaaagcactaaagttggttcttcgagaattattttgaaaatagctcttttaaatgtagaaaataaatttccttgtgtttcttattttatatactaaatatattcatttacaatatatatttggttttcacttcatatgttcttgcctcctttgaataattttaatttaaagagaagacacaatttccaaatgtttaataaagcctcttagaattatacttcatgcaatagataaatagctatgatacctgatcagaaaatctcatgagcagtaatgactgaggagggctcctgaaggatgctatgtctccgtatccttccacttccccaaatatacaattaatttaaagctggacagacaatgggacaaagtttcagccattaaactccaaatccctcaaaatttaaaaacaaaaaaatttatcaacaaaacaaatagcacattttaaaatttaaaactaacttaatatatgactatacaacccaccaattccatttctagctatcttccccaaagaaatgaaaacatacattcacaccaagacatgtacagagatgttcatagcaactttattcacaatagccaaaaagtggaaacaggccaaatgtccatcagtgagtgaatggataaacaaaatgtgtcatagccatacaacagaacattactcggcagttataaaaaaggacaaagatacatactataacattagtgaaactcaatcatgttatgcttggtgaaagaagccagacacaaaagaccacatacaaagatatcattttttattttgtttcattttattgtgccttgcagataccacattttttttacaaactaaagatttttggcaaccctgcatggagcaagtctataggagtcaatgggagtcattctgaacagcatgtgctcatttaaagtctcagtgtcacattttggtaattattacaatatttacaactttttcactattattacatctgtcttggtgatctgcgatcagtgatctttgatgtggctaccatcattgtttggggcaccataaaccacactcagataacatgttgaacttaataataaatgtgtgtgtgtgttgactgctccacagaccagacattctccatctctctccctctcccccagcttccatattccctgagaaaaaacattattgaaattagaccaattaataatgctacaatggcctgtaaatgtttaagggcaaggaagaaccacccgtcttttagtttaaatcaaatgctagaaatggttaagtttagtaaggaatgcatactgaaagccaagataggccaaaagctaggactcttgggccaaacaggtagccaagttgtgaatgcaaaggaagagttcttgaagaaaattaaaagtgctactccagcaaatacaccaatgataagaaactgaaacaatcttattgctgatataaaggaagttttagggctctgggtaaaagttcaaactagccacgatattcccttaagccaaagtcaaatccagaataaagtgactttcttcacttctatgaaggctaagagaaacaaggaagctacagaagaaaagtttgaagctaacagtggttgattaaggaaagaagttgtctccataatataagaagcagcaaatgctgatgtagaagttgtagcaagttacccagaagatctagctaagaaaattgatggagggggctgcattaaataatagattttcaaggtagaccaaatggtcttttattggaagaaaatgttatctaggactttcatagctgtggagaagtcaatgtctggcttcaaagtttcaaagtacaggttgactcctttgttaggggctaatacagctggtgactttaaattgaagccgatactcatttaccatttgagaaatcctagtgtccctaagaattatgctaaacttactgtgtttgtcctgtttcccataggtgcaacaacaaagcctgaataacagtacatctgtttacaatgtgacttactgaatatgttaagcctgctgttgggaactactgttcagaaaaaaaaagattcttttcaaaatattactgcttatggacaatacacctggtcattcaagagctctgatgaaaacatataaggagattaatgttgttttcacacctgctaacacagcatccattctgtagctcatggatcaatgaataattttgattttctcatgtaattatttaatacaaggacagacacttctcaaaagaagacatttatgtggccaacaaacatatgaaaaaaagctcaacatcactgatcattagagaaatgcaaatcaaaaccacaatgagataccatttaacatcagtcagaatggcaattattaaaaagtcaaaaaccaacagacactgacgaggctgcagagaaaaaggaacgcttttgcactattggtgggagtgtaaattacttcagccattgtggaagacagtgtggtaaatcctcaaagatctagacgcagaaatatcatttgactcagcaatcccatcactgggtatatgcccaaagaaatataaatcattctattataaaaatacatgcacacacatgttaattgcagcactattcacaatagcaaagacatgaaatcaacccaaatgtccatcaatgatagactgaataaagaaaatgtggtacatataaaccatggaatactatgcagccataaaaatgaataagatcatgccctttgcacggatggagctggaagatgttatcctcagcaaactaatgcaggaacagaaaaccaaacaccgcatgttctcacttttatgtgggagctgaatgatgagaacacatggacacatcggggggaacaacacacactggggcttgtcaaggaggtgggggaagggagaacatcaggaaaaatagctaatggatgctgagcttaatacctaggtgatgggttgatctgtgcagcaaaccaacatggcacacgtttacctatgtaacaaacccacatatcccgcacatataccatggaacttaaaaaagttgaggggaacaaaagaaaaaagaaagaaataaatttcttaatgttatagctgccatgaaaagtgagtcctctgatggatctgggaaaagtaaactgaaaatcttctggaaaggattcaccattctagatccaattaagaatgttcataattcatgggagaaggtcaaaataacactaattggagtttggaagatgttgattccaacccttgtgaatgactttgaagggttcaatagtttagtggaggaaggaactgcaaatgtggtagaaataacaagagaactagaattagaagtcgagcctgaatatgtgactgaatatgttactgagtttgatcaatctcatgatcaaactacaatggatgagaagtttcttcttctggatgagcaagaaaattgccttcttgagatggaatctacctctggtgaagatgcagcaaacattgttgaagtgactacaaaggattttgaatattacacaaacttcgataaagcagaagaagggttttgagagtcgactccaattttaaaagttctattgcaagtaaaatgttatcagacagcattgcatgcaacggaaaaatcttttgggaaagagtcagtggggaaacaaatttcactgtggttttaagaaattgccacagccttggctgggcacggtggctcacacctataatcccagcactttgggaggccaagccgggcagattacttgaggtcaggagttcaagaccagcctggctaacatggtgaaactctgtctctatcaaaaaatacaaaaaattagcagggcgtgctggtatgtacctgtagacccagttacttgggagactgaggtgggagaatcacttgaacctgggaggcagaggttgcagtgagccgagattgcactactgcatttcagcctgggtgacagagtgagatgctgtctcaaaaaaataaataaataaaaataaattgccacagccacacaaccttcagcaaccatccctgatcagccagcagccatccacactgagatcaggccctccattagcaaaaagattatgacttgctgaaggctcagatgatcatcagcatttttttggcaatcaagtattttaaaaattaaggtgtgtacattgtttttttagacataatactattgcatatttaataggcaacaatatagtttaaacacaacttttaaatgcattgggaaaccaaaaacttcttgtgactatatttattgcagtcatcaggagctgaacctgcaatatgttcagttcaataggtatgttgttttgtatgattgtttgtgtgtgtatgtgaagaatctgtgtatttattgatttatcacctaaaaccttcttaaaattttatctattgagggggtacaagatttcttacatgcacatattgcgtagtggtgaagcctgggcttttagtaaacccattacctagacagtgaacattgtgcctaataagtaatttttcaaccctcatgcccctgccatcctcccacctactgaagtttccagtgtgtattattgcgctgtatatgtccatctgtacgcattgttcagctcccacttataagtgagaatatgtggtatttgacttgctgggttatttcacttaggataatggcctccaggtctctccatgttgcttgcaaaatacatgattccattcttttttatgcatgagtagtatttcatgttgcatataaattttatatatatatcatttctttatatataacaaaaatgtatataaatgcataaatatgtttgtgtgggtgtatacacacatacacacacaccacattttcttccattgatggacacttaggttgattccaaatctttgtgactgtgaatagtgctgcaataaacataagagtgcaagtatatattcttttatttatataaaatatccaaagaagggcagatatgtagagacagaaagcagatgagtggttgcatagtggtggagagtgtcaatgggagtgactatatgcacatgagatttcttttgaagctgatgaaaatgttctattattagtgtgcggtaagagctagataaattatacacttaaaacacgtgagctttatggtatataaattttattgcagtaaagctattaaaaacaaatggcatacactatcataaagctaatattactatgtttattgaaaacctattatctatagacaacacatgactcagattacagagggaacaggtcttaaacatagaaactatgatttaagtgtatgctgatctctaaatgactgacattagctcctttttttgagatgtttcatgggagaaaatgtatagaaagctaagagaggtggaaagatggagacacaaaagaagaggacagggtcaggaggcccaagtgtacctaaatcacaagaatgagcctggtgattcaccctgcaatcctttgcctttagagaccctcttggataggaattaggaagcatctccagaagggaaggtgacaaagacaatgtaatacgatgtaggttttttagtgattctctttcaactattgtgtctagtatttggaaaacattagaaaaaagttttagctatacatcattattttatatgttgtatttgctgatacagagattcaaatcagttgggtgactggtgatcagtagatgctcaataaatatttgtccaatagaagaatgaaagaacaattatgctatccataaattacaatattaaatatccatgagctatataattcaagggcaatggggcattggctgtgagagaaaattgtggaagaaaagcagatttgggatagggttagaagataatgaggccagccttggacataatgaacttaagcagagctcgtcccattgacatagaaccatctggaatgcatctcaatatatggttctggattgaggatataaattaggaagttttcagcatagctgaagtcatggaagtctgtgacatataaatcaataatgaatcaatttattttaattgatatacaaaatatttccatgtaattaattctgtctataattctgtattttttggctctgatggtaaatctgaataagtctattaaaatcttcagacattatacattttctttgagaacaacagtggctgtaaacaaagctgcctttgttggcttataaagaacatttgctgttcccacaaattacttttaatgatgcaaaagtccctctgtgacagagacttgttctgtggttatgcatttccctttctaatttcactttgtttcctttctggggtatactccttttgagacacccagagtctgaaaaatgtgagtcaaaccacagattggctggtaggaaaaaaagaaaatagttcatttcccctcttattaaatgtttattcttgttatatataaactcacttgctcttgctatgtggcattacaatattagttttactggtagggcttttaaaatactatcaatcaaatggggtgatagatatattatggggaacagaaccctgatttggagttaaaagaacttttatttaaataacagcttttccatttaccaactttgtgatcttgggtaaactgtaaggtttctctgagattcagtttcttgatccatcaaagttaagtaaatttatgtttctagtaggtttttcatgataattacatgacattatatatataacatatataatatataatataaaatatatataatatataatatacatataatatatataatatataagatatatatattttatatatatatctccaatatctaaatagactggttgctgactttatcattagttgatggttgacagaattatatacatttattttaattatatcattatttttcatatctaataaaaacttaaatcagtggagactttattcaaatatacttcccataaaattcaatgtagcgaagtttttggagcattttttactttattttattttattattattatactttaagttttagggtacatgtgcacaatgtgcaggttagttacatacgtatacatgtgccatgctagtgtgctgcaccaattaactcttcatttagcattaggtatatctcctaatgctatccctcccccctccccccaccacacaacaggccccagagtgtgatgttccccttcctgtgtccatgtgttctcattgttcaattcccacctatgagtgagaacatgcggtgtttggttttttgtccttgcgatagtttactgagaatgatgacttccaatttcatccatgtccctacgaaggacatgaactcatcattttttatggctgcatagtattccatggtgtacatgggccacattttcttaatccagtctatcattgttggacatttgggttggttccaagtctttgctattgtgaatagtgcctcaataaacatacatgtccttgtctctttatagcagcatgatttatagtcccttgggtatatgcccagtaatgggatggctgggtcaaatggtatttctagttctagatccctaaggaatcgccacactgtcttccacaatggttgaaatggttgaactagtttacagtcccaccaacagtataaaagtgttcctatttctccacatcctctccagcacctgttttttcctgacattttaatgatcgccattctaactggtgtgagatggtatctcattgtggttttgatttgcatttctctcatggccagtgatgatgaacattttttcatgtgtctgttggctgcacaaatgtcttcttttgagaagtgtctgttcatatccttcatccactttttgatggggttgtttgtttttttcttgtaaatttgtttaagttctttgtagattctggatattagccctttgtcagatgagtagattgcaaaaattttctcccattctataggttgcctgttcactctgatggtagtttcttttgctgtgcagaagctctttagtttaattagatcccatttgtcaattttggcttttgttgccattacttttggtgttttaaacatgaagtccttgcccatgtgtatgtcctgaatattattgcctatgttttcttctagggtttttatggttttagctctaacatataagtctttaatccacctttaattaatttttgtataaggtgtaaggaagggatccagtttcagctttctccatatggctagccagttttcccagcaccatttattaaatagggaatcctttccccattgcttgtttttgtcaggtttgtcaaagatcagatggttgtagatgtgtggtattctttctgaggactctgttctgttccattggtctatatctctgttttggtacaagtaccatgctgttttagttgctgtagccttgtagtatagtctgaagtcaggtagcgtgatgcttccagctttgttcttttggcttaggattgacttggcaatgtggtctcttttttggttccatatgaaccttaaagtagtttttttccaattctgtgaagaaagtcattggtagcttgatggggatggcattgaatctataaattaccttgggcagtatggccattttcatgatattgattcttcctacccatgagcatggaatgttcttccatttctttgtatccttttttatttcattgagcagtggtttgcagttctccttgaagaggtccttcacgtcccttgtaagttggattcctaggtattttattctctttgaagcaattgtgaatgggaattcactcaggatttggctctctgtttgtctgttattggtgtataagaatgcttgtgatttttgcacatcaattttgtatcctgagatttgctgaagttgcttatcagctgaaggagattttgggctgagacaatggggttttctagatatacaatcatgtcatctgcaaacagggacaacttgacttcctcttttcctaattgaataccatttatttccttctcctgcctaattgccctggccagaacttccaacactatgttgaataggagtggtgggagagggtatccctgtcttgtgccagttttcaaatggaaggcttccagtttttgcccattcagtatgatattggctgtgggtttgtcatagatagctcttattattttgagatacgtcccatcaatacctaatttattgagagtttttagcatgaagggttgttgaattttgtccaaggccttttctgcatctattgagataatcatgtagtttttgtctttggttctgtttatatgctggattacatttattgatttgcatatattgaaccagccttgcatcccagggatgaagcccacttgatcatggtggataagctttttgatgtgctgctggattcggtttgccagtattttactgaggatttttgcatcaatgttcatcaaggatattggtctaaaattctcttttttggttgtgtctctgcctggctttggtatcaggatgacgctggcctcataaaatgagttagggaggattccctctttttctattgattggaatagtttcagaaggaatggtaccagttcctccttgtgcctctggtagaattcggctgtgaatccatctggtcctggactctttggttggtaagctattgattattgccacaatttcagagcctcttattgatctattcagagattcagcctcttcctcgtttagtcttgggaggagggtgtatgtgtcgaggaatttatccatttcttctagattttctagtttatttgcgtaaggatgtttgtagtattctctgatggtagtttgtatttctgtgggatcggtggtgatatcccctttatcattttttatcgcatctatttgattcttctctcttttattctttattagtcttgctagcagtctatcaattttgttgatcctttcacaaaaccagctcctggattcattaattttttgaagggttttttgtgtctctatttccttcaggtctgctctgattttagttatttcctgccttctgctagcgtttgaatgtgtttgctcttgcttttctagttcttttaattgtaacgttagggtgtcagttttggatctttcctgctttctcttgtgggcatttagtgctataaatttccctctacacactgctttgaatgtgtcccagagattctggtatgttgtgtcttttttctcgttggtgtcaaagaatatctttatttctgccttcatttcgttatgtacccagtagtcattcaggaacaggttgttcagtttccatgtagttgagcagttttgagtgagtttcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatcctttttaactttctgtctcattgatctgtctaatgttgacagtggggtgttaaagtctcccatttttattgtgtgggagtctaagtctctttgtaggtcactcaggacttgctttatgaatctgggtgctcctgtattgggtgcctctatatttaggatagttagctcttcttgttgaattgatccctttaccattatgtaatgaccttctttgtctcttttgatctttgctggtttaaagtctgttttatcagaaactaggattgcaacccctgccttttttttgttttccatttgctcggtagattttcctccatccttttattttgagcctatgtgtgtctctgcacatgagatgggtttcctgaatacagcacactgatgggtcttgactctttatccaatttgccagtctatgtcttttaattggagcatttagtccatttacatttaaagttaatattgttatgtatgaatttgatcctgtcattaagatgttagctggttattttgctcattagttgatgcagtttcttcctagcctcgacggtctttacaatttggcatgatgttgcagtggctggtaccagttgatcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttaaaaattctctcctttaaaaatgttgaatattgccccccactctcttctggcttgtagagtttctgccgagaaatctgctgttagtctgatgggcttccctttgtgggtaacccgaccctttctctctggctgcccttaacattttttccttcatttcaacttcagtgaatctgacaattatgtgtcttggagttgctcttcttgaggagtatctttgtggcgttctctgtatttcctgtatctgaatattggcctgccttgctagatttgggaagttctcctggataatatcctgcagagtgttttccaacttggttccattctccccgtcactttcaggtacaccaatcagacgtagatttggtcttttcacgtagtcccatatttcttggaggctttgctcgtttctttttattttttctctaaacttcccttctcgcttcatttcattcatttcatcttccatcactgataccctttcttccagttgatcgcatcggctcctgaggcttctgcattcttcacgtagttctcgagccttggctttcacctccatcagctcctttaagcacttctgtgtattggttattctagttatacattcgtctaaatttttttcaaagtttttaacttctttgcctttggtttgaatttcctcctgtagctcggagtagtttgatcatctgaagccatcttctctcaacttatcaaagtcattctccatccagctttgttccattgctggtgaggaactgcgttcctttggaggaggagaggcactctgctttttagagtttccagttcttctgctctgttttttccccatctttgtggttttatctacttttggtctttgatgatggtgatgtacagatgggtttttggtgtggatgtcctttctgtttgttggttttccttctgacagacaggaccctcagctgcaggtctgttggagttttctagaggtccactccagaccctgtttgcctgggtaacagcagtggtggctgcagaacagcggattttcgtgaaccacgaatgctgctgtctgatcattcctctggaagttttgtctcagaggagtacccagccgtgtgaggtgtcagtctgcccctactggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctaggcaatggcaggcgcccctcccccagcctcgctgctgccttgcagtttgatctcagactgctgtgctagcaatcagtgagactccttgggtgtaggaccctctgagccaggtgcgggatataatctcctggtgtgccgttttttaagcccgtcagaaaagcacagtattagggtgggagtgacccgattttccaggtgccgtctgtcacccctttctttgactaggaaagggaattccctgaccccttgcgcttcccgagtgaggcaatgcctggccctgctttggctcgcgcatggtgcgctgcacccactgtcctgcacccactgtctggcactccctagtgagacgaacctggtacctcagatggaaatgcagaaatcacccgtcttctgcatgactcacgctgggagctgtagaccggagctgttcctatttggccatcttggctgccctcccgtatatggagcattttgaaatataatttttcctaccatattctttgtgtatttcctctaattttcccttcttttgatcttagatgcttttagaaagtctctctttgcttacttgaaactactctttcctaaagtaagaaagaacttaaattttcaaagaaaaaatgtatatataaggtaaatagatattattgttcatactcctatattattatttgaaatacacaaatttgttgttagggatgacaccaagccttctgaaccctcatcaggtcttctagaacaattgcctgctctactattaactatgttgcttgagatcaaatatttaaccctttggtgccatctctaaagtaatcagattagaaattagatctccagcagtttataagttgttgcacttttttgaggattttagatttaggactttcattttaatgatacaaaataaacaattaaaagcatactctgcattgttaggatgaccacttgagtatgacctctgatttcaatgtttatgatcatgtaggtgggtttacttcacttgctagaggctaatgaggaaagaaaaaaacagacacatataaatgaagcttccacagcaaggagggccaaatggtgctgtggctcactagaccaatgagggttttgcagaaacttaaaagaaaaatactgagagaattaagttaacacataatctatgggagtcatcgtgtcaaacttgtgcttactcttagcagttagtgctatagtattctattacattagtgccagttatttcagacttctctggctttttaattttgtttatatttcatttgtgctataaatggaatgtttgtattcctccaacgtttttgttgttgttgtgtgtttgtttgttttttgttaaaacctaatccctaatttgatggcattaggaggtgagggtctttgagaggcaattaggtcatggaataagtacccttatacaggaaatgtgagagctctctctctccttccaccatgtgaggacacaacaaaaagttggttgcctgtggatcatgacgcaggcccttaccagaccctgaatcttcgagtgtctcaatattggacttcctacagaccagaaccgtgagaaatacatttctgttgtttataagccactcagtctatgccattttgttattacaaccctaacagccaaggacatttataaataagttttaggcttcttggttgttaaagatctgtaaacatagagtgttttatgttttctctctatacaaatttaaatagaattttaatgagtacaattttatattttatattctagagaacgttttcctttgaaaagaggtctgtgcttcattgaagtttgagaaatattgaataaaatcttgatttattaatcagttctgtttttcattcccagcatttcattatccctggatgtttccctgctttcaacagtcgccaaggaagagagaacataggagaaagagagaacgaaagaattgatccttggctttgagtttcaaatggcacaggctctgacgcgacaaaagattaagcagaaaatattatcagggaaatgtttatctgcactttacccttatcctcagacatggtcaagattccacaggactaaattcaaaagtaggaagtaagggagcaatagaaatcccaaacagatttagagagtcaggtataggaagaatgtggcaaccatctccaagtaaaacccaggaagtaggcaatcctttgaagtccttctcatctagaacaggtaggaacagaaaaagtctcctgcctgaggttgcaggcagactggcctgcctcagtctctcagtttcccaaactcagcgtggcactagaaaaattcagtgatgccccaaagaggctctaaggataggtttattacagcccatcatgggatcaggagtagcagaatgcttcctgtggacgctgccttggagtaggggtcaggggtggctcagagtgctgccgaccagaagagttattgcaggcaggaatgaacaggacagggtggagacagtgcggagaaatgatggagacccagacatgacccacgtcatgcccacccatgtccatatagtcctgccaggtcctggcactacataagctgcatggagaagggaaaagaggaacatgctaatccagtggaatcaggcttctgatacctagtgcaatgatagagcaaaacagaaatgaggtttacttgcataaaaataacatcaaaacaaacaacaacaaatctatcctttctctgtatctatctatctatctatctatctatctatctatctatctatctatcatctatatcatctatctatctacctgaagttgtagtgggtgagaatcattaggactctaagatcatagtcaagtttaagataatgtctatccttaagaatggaacttgaaaggttagcatgtactaggaaaaatgcagcaacttgaggaacccaaagatcaatatttttaaggatctatcttcaggatctatctagctctaaccatttctgaaatttctgcagcgttggacttttgggtcttgatgttgataataccaagcaatcatcatgatcgagtcctactgtagaagcaaagtggagcccacttgtccactgatccccactttgtatgcggatggagtttgggccaaaaatcggaggtccagacctctgatgtcttccgagtaaagctaagcttttgtgccattttggagatagtaacatgcaaagatgggctgccagccacaataagatgaaaataacgagaaatagattttgtgtacaatcaagaagtctccaagtagagtgtcaatgctgtgattcttgatactgactgtctactggtaaatggttcctgggtcacttatatttgaatcagggccacctggctcttgggcagatgagttgtggcactaaacttcagaaagctgatccactgctcagtcatctgggaaaactgaggcagcctaccaggcccctaaatataatctgtagtgtatttgtcttaaattgattagaaaaacagaaaatggaaggttgtttccatactcatctggcttctaggattgatataactatttttcccttttttttttctccaatagccagggaggaaaaatccagtctcatcccactgatattaagatagccaaccttctagtgttttagagatcagattgtattcgctttctagtttttctaagattgtaaacccttagtagaaagtcttctacacctgatgtttttctatacacaatgtcaatacttagtacataaatataagatttttgatacatttgacaattcctattctgctgagtccaaatttccgggaatgtctgataatgtacagagaagctacaattacagcagggagatgaggcttgatgactacccaagggtacgagaagctttgcagaaggcaatggaacaatctagtttggggcaggactgccaagaaacaagttctttcaaaagtaacaaagaaaatctcatcaaattggatttcacacagacataaggctgtaattcagctgaggcaaacagcagggaaaatcattttcttgtccacttcaagtaacaaaatgattcccctcctgtcacttctgagttgattttgttcttttgccttcgaaagctgaatgaaatataaaggagaggttgtgcatctatctataagtttaaaaaaaaaaaaaaaaaaaaaaaaaggaaagctatactcagtgggaaaaatggaaagaaacagttgagttagtatctctgggacttaatctagaataaggattccaaaaatcacaatttggtctgctgttgggggagagattgttccccatgtcttccttaagcaccaaaaacaattacacagctccagcccatgtgcaagcattagcaactattctgggattgaatccaaatttgagcatgtgtaatagatgaggattttccacaatgtggaatatttgaacagataacatcagaactaacagttaatttattttttaagtaaagaagaaacaaaccataaaaacacaaggcgtttcttgctaaggttcagagacatattcagtgaaatacgcaaataccttaacaagaaataggtgacatttgacttaactctaatacaccataattagtttctttctccatcaaaaatcaaagttagtgtattttgatctaaagctagaattgagatttctctgctttttcttttggctggtcatatgaatcatgcttaaaatgggaaagccagagggtttgatgtggtccagacctatccgtagcctgtttcctatccctgattcagtcttatcagagctgtcccataatctgtacaactacccatacagcttcagaatatgataaagaaaatagacagaggttcttacatacagaaataaggcctcctcttttgtctctccctgcagagattctacaaatctttgagccaaggagattatcaaaatgactcacttttaaacaaacaaacaaacatagctcaccagtgttttttagaatgcaagaaaaaacacaaattggaaccaagaaaaatctgttaattgcttagattctttatttcccttttatgtttactgccactaattagtctggattatccaggggcctaaataaaatagtacgatctaaaaatgcatgtgttgcttttagtaagaatatcttcacttttttcttaaaagtgaagtaagactatcttcacttttcttaaacccattctattaaaaaagaataaaaaaataaaaaataaaacaaaaaactttactacattctcatctgggtcatgatcagtgctgaaatactaaccacaatagattctaactttgaaattttgacaatagttatcatactccgagtgtttactatgtacccaaataccaatactaaatattcactactcagtactttattataaccacatcacaatactttgaaacacagaatcattaaataccatcattttccgatgaaaaaactcaggtgtaggaaggttaaggaatttgctcaaagttatacagctagtaagttgcagagacatgacttgaacccaaatctcttcgactctaaattcagagctgttgaacttggcagcagtataaagtcactcctccactcaagaaacaccaatgattttatatcttatgccacaataaaaagtaaaaagactcaaaaataaaacaaaacttaagatttatagttatctggccatttcttgttagtttaatcttaattttcaccagtcatccacatgggtccccatgctaccaccccatgttccttaaagttcttacaagggcccagttcacttttgtcccttccctcacattgttttcctcacagtagtcttctgaaacgcatttcctgtctctccttcccataatcccactgttaccccatgtgcatattaaactcccaggccatgtctctataaccatacacagtttaatacagttgcaatccaagttagtgttcatcatttagctgctatagatagtagttggtgtcatgtagcttacatttgtatttcacctaaagtaaaccattatctattaaggtcagggactacaaatttataatttgattttttacctcaaaacacactatgaaactcatagagagctctaaataaattcctgttgtttaaatgaataaataagagttcattacaaatataacaaagtattttcacatgaatttcctagacacttcatattggtgtgagccacttcaaaacagtacaaaagggattaaatacaaatatatctttttaatacttattaaaatgttagacaattcagctttagtaggagtttaattataaaatgaaaccaagcaaagcctaaatacctaattcaaaagatttctgttctatagtgaaagacagatcaataatgataaattggatttttagcctttgggaataaatggggaaccaaaaagaaaagcaaaccttagtaaagtaattctggtctaccactagtgagtggacaaaattattttacaatcagtattacattctattggaatgaaaacaagatatattaaaaccttaacatgataaatagatatttgatattatttgtccaataataatccttaacagatataagcttttttagaacatctatgtaaccaaatgtttttgaaagaggaccaatccatttgctaaagccataaagtcatttagaactactgataataaacagtgacaaacagtgaaggcgatggtttcggaatacttcactttccttttcattcctttttccctcgcctttacaccagcaaagaaaaagtcatcataaagccaatgaagctaaagctctagggctacctgcttacacaggcttcgtcaaagtctatctatttataaatagcaagtaagatttttaaaattccttttcttgaagagtgccctccaaactgtttaagcttcaggtcccacaaaccttaattagtcgcatccttgacctgaagcatgcatgcccttggaatccaagaaacttaaaattccatttggcaaaatttgctgttgttgttgtggctttcttaggctgttggtttcctaattcgttcattcattcattcttcattcatccactcatttatccaaggaacagagactcatcttttgcaggcagagatcatcgttcttacggctttagagtgactacaacttcctgtctcttgttctatggcttctgccactaacaggtaaaggcatcacgctttcctctggatagcttttctgtactttatgccttccgtttttttctcatcttttgttgttctctctattgacctgtgcatttttgctacaagtagttacttcatcctatatctggtttatggttcccaagattggttttgttatatctgtagttattccttgttgggcaaaactttcagagtagactaccagcagattatttgcaggccataataggctgctcactataacatgccctgccctggtcaaacaaatggaagaaaccaacaatcgatgccttccatgaatccacttttactttctttctttttcttcctcacagcattattatttcaccttcataaccagaaaaatataattctatccagcattataattagtcaaatatttcatgttttatttattttttctctatccccacagggcttagtgttaattgaaataatatcattataattaattaaaatacaaatacagctaccatcatcttactatgtgtttggaacacaactattgttttcatgtgtcacttcccctaattctctccaaaccccttgaggtagttgttactccattaaccatttcacaaacggggaaagtgagactcagagagcttaggcaggttgctcagttaataagcatggttgctaggatttaatctaggaggtctaattctagagcagcaactttcacttgtgaacactggaatcacctgaggagtcttaaaaatccaggtcccatccccagagtttctgatggatagaagatgtagcctggccggggttgccgggggggggggggggggggcgctgtttttcatcttcctcggtgattctcctatgtcccaggtctacagaccaagttatttaccattaggtaataaagagtgaatggacaattgaatgcattaatgcatgacctccccattctctattttttaatagataggttctgagagttccatttaaataaaaacatcaataacatctaattggcctctcagaaaataatgaaacccattttgtcaaaattgatttaccctgaccaaacctgttgccaaagagttaatgctctttcccggagagaggcagtgaacagattccgtaaatgaccagcttagtctaactccctttttcacgtggacaggggccgtgttggggaagctgcagagcgcatcaaactgaagctgtttgaatgggcccctaggtccatttctttgttttatgtcctccaattccctcagcctattatccttaatgtgtcatccctacttgttttgcctctactggggagtgggagcctcagcgctacaggcaattagcactcagagtaggcaatgggagcttcattttctaccctgcagccaaattttttgttagtcacagtcaaaccaaagatacagaataaagaacctagacaaaactataaatacttaccaagcaccaatttgttatgtgttagtcactgaactgacattataaagtgactaagaaattcaaggagttaataacctggggtgggtgagaggaggataggcatgtggaacaagatgagttgtgaatatttaacttgtgtgtgtgtgtttgtgtgtctatgcgtgattcagtctgatcatgctgaggtttgtgaaccaccaccttatcaactagttctacctactccttatagaactgaggggctaactaaacaggcatccagtcagagcatctgtgacaattagagtccaatccacaaaccctgcagcaaacggtccaggaagccaaactgcaaactctgcagcaatcagcctagagcaggtaggtcttggccaataacaaccagcgtccctgacttttgccttgcttccaactcaggatcaaccaaagaaaattaattatgctccccaaagcagtcatagaagatgctccacttctaggtaacctgccctcagcttccctgtgccaacaacctccaatcagggcactcctgaagccttcccattttgcattataaaactttcccattcccgtgtctgcctttgagtctttgccaaaatgcaagttgcaagagacagtggctgactcccttgctgtagcaagttctgaataaataacctctgtttcttctcatttaaattgcctttgtttatttttacagtgcaagtgggtggtggggggtggtggtgcggatgctgttttgaaattttaagctcaccctctccaagcaggtgaaccttctcatatgtgtttccctgaaatctccttgcctcccccttaagatgtgtgtaggaagggggaaggcagaatgacagaaagagggaatggcacctgcatcaaatccagacagatcaacccaaggagacagaggcttgacttcttgccagtgttacagtggcatttgaataagaacctaagaccttagcctcaacctctaaagaggaatgaaatcgtgaattcagtcaccattatgtttgaaatgacagaaaaatcacgccatccattgagtttccttagatatgatgaggtttttgaaacatcatatgcaatgaacattcaagcaggaatcaagttcagttagggagaaatacaattatattttgtcatggttgaatactcagtggtgctaatttgggttgcctactttggaagtttagagaggacgatatgcactgagaaagggcggagctcagggcccaaatggtggaagaggtagcattttgagctgaccaggaaagatgagaattttgagaagtggaactttagcttcctccaggctccagagacattggtgcaaatgtcttattgaaattaagcacataagtttaatgtaatacagaagtcagtgcagtggctatacccctgtccctttgctggttgtcagctcagtgggtgggtggatgctgtattcactcaaatctagaaagttgtgagtacactgatgtctgtgggttgggtcacaccaacccacagacatcagtgtactcacaactttctacatttgttgctgaggttctttttaatttctacaattattcaacatgtgtctgaatgctaaaaataactagcgtaaccaaacatagagagaaacattttcttgttaaggctgagtttttaaacaaacaaaaataatgcctttccccactgcctaatgtacatttttaaatcatagaaattgggttctttgttaaattcactgtccctctttctctccaacattgatattagtaagacagttttttttttctcccttctagaagaatgtggcagaatgagcacaaagtaattagcaggtttagttagaagttagaaactgagaggcaaatgaaattaaagttggggtaaattaattagtaaaaggtgctagagttgtgtgtgctccttaactaagtgttgtctttcaatgtgtcagcactgacaacactttgtgaggtttagaaacacagaagaggaaaggctgacaaccagggagccagaacgggaaggtgttgagcagggtgtgagactcctgggaagggaagaataggaaccatccctgggattgttctagccttcccaatcctttcctctgaggttcagcagtgcaagggagaccatcaggtcaacgtgggggagggtacttggcccatgtttctagacatcgggaaatctgtgctgaggagccttggaggccagtgtccattcataagagcctaaagtccttacgaagaaacaaaaacaaaaacaaacaaaagctgggcctgtatattagttttctagggctgccatagcaaatatcacagactagggggcttaaacaacagagaaatctgttttctcagttctggaagctgtaagtccaagattaaggtgccagtagagtgttttcttctgaggtctgtcttctccccgtgtcttcacatggtcttccctccctgtttttctgtgtctgtattagtctgttctcacactgctataaagaaatactccagactgggtaatttataaaggaaagaggtttatttgactcacagttctgcatggctggggaagcttcaggcaacttataatcatggtggaaggtgaaggagaaacaaatgcacatcttacgtggtgacaggtgagagtgagtgtttgtcagctcaggaaaatctaccatttataaaaccatcagctctcatgagagttcactcactatcacaaaaacagaatgagggaaaccgccctcacaatccaatcgcttcccaccagttctctccctaaatacctggggattaaaattcaagatgagatttgggtggggacacaaagcctaaccatatcagtcctaatctcttcttcctgtgaaaacaccggtcttactaaattaaggcccacctcaatgacttcaattaatcttacatacaagtttgaagagtccatctccaaatacagtcacattttgaggcactaggggttagaatttcaacatgtaaattctggggaggcacaattcagcccataacagcttgctgaagaattctgtagaaaaggaagctgagtgtgtgacagtttgccccactgtgtgctttaaaatgaactagcttctcgaagaatacataagccatcttattctggaatggcataagtgctttcttgtccccaattctccagcaaaaccggctgggcaaggcaggagacattacaactaccaaagctattccaatccatacacaaccccaggtgactcctacatgaaatcagccggccctttgccccactgctgtccggcccccttatgcagaaaaaggagtgcaaaggcaaagggagaaggcatataggagcttttacacttagaaattgcagagtagttatttttcatatgtattaaatcctggttttcttggttgatgggccattatgattagaaattttacttgatggtatgaaagcatcttgctgttttctttgtttaattatttgatggtgagtaatcacatattcaagcctaagtcactcgttacatattttaataagaatcttttgtcttagaaagtaaaagtgctgactgcatgccttctcatttggaaggcagcatcttgtaatgaagtcagcaaagacagagaacatgttttattaaaatactacttctaattccatctgtgtgaccttgagcaagttacttaacctgtcggaactacatatttctcattggtaaaatacaatcatgtaaaggagaagtaagtgagatattgcatacaaaacaacaagcatattgcccaaaacataaccttttgcttatctaggttaattatgcaggtagattcccatgtttccagtacgatgtcatgaaaataaaaggaccccatgcaaggatcccaaaagcctgattgtaagtccaatttgatattttgttcaatcacttggcctctgtcagcttcagaattttgaatgttaaattggaggcaatggccatcttttgaacttgacacaatttatcaagaggatgaagtatgtaaaagtatcaaaaatgagtcactggcaggctctgataatgagttaggagcatctccttcatcataaagagttcatttttggggacaaagtattaactctttgcaaattactggaatgattaggtaaaatttactaaaaatttctcttgtaggaatcatttctcagccaaacaatgtagcctaaagaaagtggggctaattttgcagatcaagttttttttttttttaagtgcgtacacattttgaaaatcaatattttcccccaggtactcagggttaaattgctcttgtaggaatcatttctcaaccaaaacaatgtagcctaaagaaagtggggctaatttttgcagatcaagcttttctttttaagtgcgtatacgttttgaaaatcagtattttcccccagttattcagggttaaattgttcttgtaggaatcatttctcaaccaaaacaatgtagcctaaagaaagtggggttaatttttgcagatcaagtttttttttttttttttttaagtgcgtatacattttgaaaatcaatattttcccccagttattcagggttatctgataattcttagcccagtggaaatggaaatggtacctgcactccacatttcctaagttctgaatttgtttgatatatgttgttccacagtcattgtttccaggtcctacccctgcatccaacaataaacctggtattcaaacaaagcagatgtcgagaatgaggatgaggaagtgaggtgagaagggcacacatgtgaagaggacatagggcataccctctagtactttcaactttaagttgattctaggacattaggatgacaactgagtctggtaccttgctccagttctagtttctacctgaaggactctagagatggggaagtttctgtcaaagagtttcttctctggacattttttcccctttaagctactggttaaaaattactgttgactggctgggcacggtggctcatgcctgtaatcccagcactttgggaggccaaggcgggcagatcacaaggtcaggagatcaagaccatcctggctaacatggtgaaaccccatctctaccaaaaaaaaatacaaaaaattaaccggacttggtggcgggcgcctgtagtcccagctacttgggaggctgaggcaggagaatggcgtgaacctggaaggcggagtttgcagtgagccaagatcgtgccactgcactccagcctgaacgacagagcaagttaaaaaaaaaaaattactgttgactttgacttttgggtaaaatatgtattcttttatttatctcatttatatttattgaatgcctgtaatgtgacagggactgttctaggaacctgggaaacatttctgagcaaaaaacagaaacatccctgtcctcacagagcttgtgatttcaaaattatctttttctgagttaaaagtcaaccatttgtttttaaagacatggtggagcatggcaattttcaaactttttgatttcagagcctctttacgctcttaaaaactgttaaagactgtaaagaacttttgttgataccagttatatctatcactatttactatattaaatgttaaaacagaaatttaaaacaataaacaattttaatttattaaaataatgatataaaaccattacatgccaaaaataactgctacagaataaatatttgtatgcccctaaaattcacacgttgaagccctaacccccaatgtgatgatacttggaggttattgggttgagataaggtcatgtgggtggggccctcgcaatgggattattgtccttaaaggaagaggaagagataccagagtactctctctccactttcatgtaccaaagaaaggccgtgtgaatgtatagcaagcatgtggctgtctccgagccaagaagatggccaacaccagaacataaccacgctggcaccctgtgctcagacttccagcttccagaactgtgagaaaataaatgtccgttgcttaggtcacccagtctgtagtattttgttacagtagcccaagctaagacaataacatattttgtaaaaaaacaaaaaaacaacaaaaaaaaaacaacaaaaaaaacctatattttctttaaaaatcatgagaaggacactgttttacatttttaaaaatatatatattttttgttctggtttaacagaatagttgtattttcatggctgctcctttattcaacttgtggtatcaacgtcatacagtgtttggaaagtcccactatacatttatgagagaatgagaaagaaaaaggcaaatcatgtattaatattattatgaaaatagttttgtcttcatggatcccctgatggtgtctcagagatccctgggggtccctggactacgttttgagaactgatggtatagtgggaaaagtgcctctctgctaaactgagttttgatctgtgatcttgagaaattttttcatctctctcaacctctgcttcttccatctgaaaatgagtcgtttgtcttacaaaatgggcagaatctttcccatctgtgaccttccttgctctgtctgccctctttccttcttgagttggccatttagtattttaatggaatggacttagttttctttttcttcttcttttgctctccacattatccccatattcctggatctggcactaatcagggctagcataaaagaaggggggtctttgtgatatttgaagcttaaaaaggtacagactcctagcaaaaaagtccagggctagtctatgcagcctcaccttgacagtgcagctgacatagtattgacaacagatacctgaccccagaatggacaggtaagggcagctttctttttatttatttttcctctccctcaagagcatgatctcatctacatgatctcaactccattcagctacatcctgaaaaactgtgatgactgacaaaaggaaccgaagtgggactttgatatgggcaaataagaagcaaagtagtttagaaatatccaagacaaatagaattccccggtgaagtcagccccacttggagacagtggcttcataagtcctgaatgatgcctctgcccctaccttttgctccagagaagcctccccagtctgaactctttgctattgagaagccagcgtgactagatgaataagcagtggttctcggacttgaatgtgcatcagaatcagcaggagggctttttttattttattttgtcttattttattttattttattttattttattttattttattttattgtgagacagagtcttgccctgtcacctaggctggagtgcaatggtgccatctcagctcacagcaacctccgcctcagggttcaaatgattctcctgcctcagcctcctgagtagcagggattagaggtgcccgccaccatgcccagttaatttttgtatttttagtagagacggggtttcaccatgttggccaggctggtcttgaactcctgacctcgtgatctgcccacctcggccttccaaagtgttgggattccaggtgtgagccaacgcgcctggcccatcagggctttattaacacagatttcagggcccatttccacagcttctaattcatcaggtctggggtagagttagagcaattgcatttccaacaagttctcaggtgaccgcacgttgggaaccagtgcaacacagtaaattatagatgatttgagctaaaggatggcaatgagacttttggactctgaatgtctctgtaatctgtttacaaaacaaccatactaccaggcctccaacataatagtttgttccattctaacctcttatgattaagggtgaagtaaaaagggtcacatcactcactatatttttagagtagttattctaagaggagattctataaggagcacactataacctttttataaagcttattttctattttatgttctcctgcttggggtgggagggacttctagagggatggcaggggttactatatggttaaagccttaatttgaacaatttctttttagtcgttacagtgcagatgtaaagtattagcagtgaacatggggcttgagttcatgattgagacagggtataaataccctgcaattatcttaggcagactgagcctgtaatctttccagtctgggtttagcttcatttttccatgaccttttaccaagtataaacacaacgtcaaagattctaatggttgaaataaatgcagtctattatgttatacaaattaagatcagtgtttggaagtccagggctgaaatcagaagattttgtggagaccattacggccatctggtaagttctccctggccttatagggccaagagatgagaagataataaatcagttaagcacttggcattgtgtttgtttcacatacagtatctcatccaatcctggtgatttcttttggtagtgagagcgactacaaatagaatccctattcaacatacaggaaaagagaggctctgagaaatcaaactatttgtttcaaggcagcccaactcaaacagaactcagatttgagccattgtgtatctgactctaactcccacagctctcaggaaacacaaaattcaactttttgacaatgaatatttatcaatatcaactttgttgagagaagagaaatagcaaaaaaaaaaaaaaagaaaagaaaaaaggtttttgtctcttggtatttccaatttagtgaagagaaataagagtgtttctggaagggatcaagttcaccttctcattttactcatgagaaaaccaaggtccagagaaatcaaatggtttctttgtagacaaaaagcaagtagcaagggtgtcttgatacctttaaatctacagagaaatgctgaacaattctttctaatgaaaaatttgcttatttaaagaattctttttgctttcttgccaaagcaaaccttccaggtagaaagaagactggtatctaggcttttacatgggctctctgtcaaggtcaggcatgaatagcaagtcctaaattctcacctgaccttgaaggtcctgaaatgctctttctgttcctgcaactggccaagttgttttcacctctggacctttgcatttgctattctctctacctgggatattcttcatttggattttcatgaggccaagtcttactcatcactcaggtctcaactcaagaagatcccctctaagaggtcttccctcttggctgtcctaagagcccaggatgtcagttctcttacagggcaattgcttctgcatcccattaccagagggagtgtgttctctgggattaactggctttcctcattttactgtctcacttccccttctctcaccatacttactgagatcaactccctaatacatcacttgcctttaattccttcttttggggtttgcttttgtgacaacccaaacacagaaacgaaatcttattcaacctgtctctcatgactctgattattttttatagcacttattactactgtctgaaattattgtatttattaacttgtttatcatctgcacttccatcttacctgactctccgcactctccccaacctcctccaccccatcagacgcctaatagaatacaaacactgtagtggcatgactttgcctgtcctgttcactgtggtatcccaaaaacttagaacctagcccataataggtgcttaacatatgtttattgaagaaatgaaagaaacaaatgaaactctccaatgtgttaatataaaggaatcttggctagtaaatcgtgattttgaactactaaatcaaaggctttctctgtttgcttcagtcccatttagattccattgttctttccatttttggagggaatcaatccttaatcaatcactttttgctaagcatgctgtccctgcacaatcaaaagttaacaaagatatataaaaatcagtccaggctttggagccaaaaagttcattatctgcctcaatcaatatttataacaggtatactgaagacatgctaaagcagaagtctctgttcctttgctttccttccatcacatttgccttgcataatcatctatgtttattaaaagggttcctggtctgttcctgttaaacattgaccttcaagtgcttgacttaataagctggagaattacaataaatcagacagccttgttcaatcattgatattacaaagaattgcaaggagaaaccagaacagcttgaaaacacaataaagtacaacagctttcatagagagtaaaagggaaagtcaagggaagaaagtctgttctcagagatgctctcatggaattaagagagcagaatcccatggcattcaagactgttttccccctgattaaaacgttttgtcaaagcaaaaatcaaatgagtacttgcttatgaagcatgcgatgtttcagaacatgacacaggaatcataagtgttcaaataaataaaccccattcaggaaaaagagcatttgtcacagatttttccctatatgaagccaatataggagactataaggattgagggtaaggatgctattccctgaaatggtttgcctccataagagattataaggcaccaaaagtgcagatgtctctattctatttaccaactccttctcataaacccggtgcctagaaaagggcttgccacatagtaggtgatcaatgcatacctcatttagagaaagaatacagagctatttgtactttcttgggagcaaaagattctcatttgcaacatgtttaaactagcatagcccatctttggcttacgttattatcagtaaggagcactatgattatgtgctatttcttacatatcttattgcatccccagaaacagataatattccatttagataagtcttgtgttaagaactgaattctgtgtgataagtaaaagattagtatttggagccaggcgcttaccattctaagctttcttttcctgatatttaaaatggggctattaatgctaatcactttataggcttgacggacagattaaataaggttgttgatatggtttggctgtgacactacccatatctcaccttgaattgtaataattcccaggtgtcaagggcagggtcaggtggagataactgaatcacggcggcggttcccccatactgttctcgtggtagtgaataagtctcatgagatctcatggttttataaatgggagttcccttgcacaagctctcttgcctaccatcatgtaggatgtcactttgctcctcctttgccttccaccacgattgtgaggcctacctagccacgtagaactgtgagtcaattaaacctctttcctttataaatttcccagtctccggtatgtcttcattagcagtgtgaaaacagacagcatctatgtagcactcaggacaaagtagacactcaatacacattggttaacctcacatttcacgggtgagaaaactttggttcagaaggattggatgaccttctccaggatcaccccactgggaattagtgaagacagaatttcagaaaacaaaacttcagatctctctgaccacagaacccatgctcttcatccaagcatcattgtgtccacggcaaggagtgtaattcaggtgcaaactttgcatattttcatttcagtttacctggcttacatatagtagctgttggcatcaaaagtacttgcttttaaaatgatgaactggctgctgttgactttgggaatgggagtgaatttacgaaagttctcaaccttggggaatttttctcactttataatatagatagacagaaaacttgggtcattttaaatgcaagatatttaggagtggattcgctaagtttgctatttaaaatgtgtctgataaaagttgatgttcttgggataaatgtgtcataagttgagataatgtaaccagtgttgaagcagaaatgttaaaaaaaaaaacagtgtgaatgtaaatgatgttttgtatatcactgactcaaagacttcttacataccatcctcctacctatacttcatgctgtattagctgaactataaagtggcaagtggcaatgtgattttcattttctcccggcaaaacgttttgacctaggagggagccttgaatgaccttggccttccattccctgattttttactgttccttttttttttaatccttctatatcctccctcatatccctaagccatactgaatgtcttgcagttttgttagtcttgatgctacattagaatcacctcgcaaaattgtaaaagttgcagatacctaggcatcacttgcagagagtcttaatcagttgcttgaggtatcatttctaaagatttcctaaatgattctaatgcatagctgtgtttgagaatcaccgcaatttttctgcctctgaaccattacagaagttaaaatttctttctttctctttatcctctgtgtaattcctagccattcttcaaaatgcaattcagaaggcactagttccaagaaacgtcatcattgcataatgttggtctgcctttgtatttaaaaatttctctgtgcttcatgctaatccacaatagatttcactaaactaaattccttgaacatgaagacaagccatggaaattgtttgtttgtattcatagtgcctagaattgtccatgtaggagctatttaaaaatatgttaaaaatgaatgagtggttgagaaaggaattcttaaaaagaggttaataactctgggtacttgtcctggctgtgctgtttacaaatttgccctataactctgatgctatgttgactgcaattagatttaaaatactatagtatataaagttaaacatatgcatatattatgactcagcaatttcccacttagacatccaaagaaatgtatagataatcattgagttataatggggttacagtccaatatatccatcataattcaaaaacactgtaaattaaaaattcacttaatatccctctaaaccctttttaaacttacaaaatcataagtcaagccattgtaagtccagatgctccttgacttatgctgggattataacccccaaaaggccataatctagttgaaaaatcctaaattgaaccattttaggtcagggaacgtatttctgtatatatatgctccccgaaggtatgtagtagattgttcatagtggcacatttttaataaccaaaaagcaaaagcaatcatcaatgtccatcagcagcaaaacggataaaatatttgtggcatagacacacataggataccatgtagcaacaagaatcctataaacgcatgcaatgatgtagatgaataatagataactttgaacatatggagccaatcgcaaaaaagtacactattgtatgttatacatttacatatagaactaaaaccaaaaaagcaatctcttctttagaagtcagggcagtcgggtggatcacgaggtcaggaaatcgagaccatcctggctaacacggtgaaaccccgtctctactaaaaatacaaaaaaattagctgggcatgctggcgggcacctgcagtcccagctactcaggagattgaggcaggagaacggagtgaacccgggaggcggagcttgcagtgagccgagattgcaccactgcactccagcctgggcgacagaaggagactcagtctcaaaacaaaaacaaaaacaaaaacaaaaataaaaaccggaagagggcaatgattggaaggaagcacaagggtggattctggggtgctggttgtgcttttgatctggtcattgattaccctgttgtgtccagtttattagaaatacatcaagcagtacactttggatatgtatacttttctgtatatacattgtacttccatgaaaagttaatactttggtataaacaatatgatagatttgtatttataaagtgactttgatctaaaccttagaaacacttggttaatatctgaaagaatttaccttccaggtatggcttctcaaatggggccattgtattggatggcagtgttaatcagtgttaattttttcagtcagagagaggtaccgtggtaatgaggagggcgtgtgatggagattgtgtgtgaaagatggagatttattgtgctgtcctgacagatgtttactaagttttaaaatatttcaaaataaataatttaaaatgtgaaaaaaagagaattttgttgcccttgtttcagaatcttccatgcaaaatgtttatcaagcctcgtaaaagcaccaacaacaggaatttcaccagccatataagaacagcctgtttctgtttaacttgttcttctatcacttactattaaaagttttgtccctttgacagaatcagatttgccacttgtatttgtaatacaccaccctataaatcattaaaggcctccaatgttcacccaaatcctcatacttgtggaatgaatatgccggattaggagaagccatttatcctcttggatactggatccagattattctcatctgtagagcattgggttgtatttgatgacattctcagtttttaactttgatctagattattattaaaagtgcctcatttctctctcagaggtgtcttggttttgaaaataattatatggttttcctgcttccaaggaatcttccagatttagctttctagacatctatggttttaaagatgtgaactagattcagcagaccactgaagtgcggggtaggcatctccctgtgtgtttgtccttgtgtagcagatgcagatttataacatgttagaataagaaatttttgcggccaggcacggtggctcacgcctgtaatcctagcactttgggacgctaaggcaggcagattacctgagctcaggagttcgagaccagcctgggcaacatggtgaaatgtcgtctctactaaacgacaaaaaaaaaaaaaaaaaaaaaattagccaggtgcctgtaatcccagctacttgggacgctgaggcaggagaattgcttgaacccaggaggcagaagttgcagtcagctgagatggtgccactgcaccccagcctgggcaacagagtgaggctccatctcagaaaaaaaaaaaaaatgttttgcaaatgtcaaaaattcaaaaataatcccttttagggaagggaattcattaattgcctcattgctaatgattattacacatgctaagatttcccttcttgagtgatgctgaaagtaggacagaaggatcacgtcattaagacattcctgttttcaatgtctctgggtttgtcctatttacaatcaaaagttgcctacttcctcacatacacaatgttaatgctttattttcaaaacctcctgggtttaacatgtgtaattattaatttattcaacaaatgatggagagagagagtacattatctgctatgtgccaagaacttaaaagggtcagggcagattattgaggcaaccggaaaatgaggatgattccttcagtccttctgcatcccatatttccatggagtcctgtgggtctttatggcaactcttgttttcttaaactcttattccctagtccacatcttgtgctaccttttcttgtcttctattctgcccaggctccaaggttaggcaattcaactatcatctccctgaattaatcaaccgtcttcatcttccatcatcctaatctatactgctcacttagtaaatttagtaaatgccacttagtaaatgccattcctatttgctaaatactgacagttaagacaattttaaaaatattactacaatttcttctgattctgccataatttcttgttatgtgatctcagtgaaactcatgagattttttctcatttcttttattaagttgtattttgttttctaatttttactctcaagccaccaactttcaaagaaggaaacatacacactagaaagcccagacgttttgcttcatggagtagactgaggccattagtttccttttctaactcaaagtttctctgtgtcatcattcacatctttcgacttcccttctgccctggaggaaagaatgtctttcttctttccccagttgcttggacactagtttccttctgtacaattctttcttatctaaccccccaaacccataaaatctaacttgagttctcaaaatgagactaaatttgttctgaggtctccccagaccacccacaggtgacctttgaacaacatgggtttgaatgacccaggtccaattatttgtggattttttccacctctgccacccctgagatagtaagaccaacccctcctcttcctccttcttagtctactcaatatgaagatgacgaagatgaagacttatatgatgatccacttccatttaaaaaatagtaaacatattttctccttcttttaatctttttaataacatttcctttctcttgtttacttagttgtaagaataccacatacaatacacatagcatacaaaatacatgttgatttactatgttattggtaaagcttctggccaaaagtatgtcattactagttacgttttggaggaatcaaacgttatacatgaattttcaactgcaaacgggggtcagcatccctaacctctgtaagtgtcaactgtatttccaaagccaataactcttctaagtttgcttttacatcactaaggggatttgaaaattggccatcctgttcttgaaattctttcttctcttggcttcttctcatagatttttccttctctgctcttccccaagattcctgttccatttcctctactcttgttttctgaaaatatacatcccccaagcttgtgtcctctgcccactattctatcaatataatcccattcactgttctcatgaatctttaactgtcttttaccttagaaagccatattgtgagtcaacacagagctccatgatgcatagccttcggccataaacacagctaggaaatgagggcagaaactaccatgatggagtggtacttcttgacctaggcacctggcccatgctgatggcaccaggagacaaggctgcaaggaaaggtcaactttacaaatggcatcagtagaactagaacatgacaatctagctacaaaattctcacatacggattcaggtaaactccgagatcttttacaatgaaccattcaaagactgggatcacttaagacagtctgcagaggtctcacaaaatggacattttagaaaagatggtcaggttcaccagactgcctcttataaagtatatcattgctgctctctgctggtcaaaagcattattctcttcaattaagatgagcagaggtgtagaatgggtcaaagagggaaagcagtgctttcaaaatgatatggactggtgctaggtaagacttattaaatgacttcatagactgcaatatacattcttatgcagaaacactgattttagtgagggtctattggacccctaaagtaaagatgtgcaaagcatccccatttttgtagaccttttactcatagaaaatatgggctctatcagatatttcttcaaccactaaactagtcaccactttttagtgtagaacttactgtaaggcatcatgtttgtatttttggcaggaaaattggcaagtcctactgaggattattaacttgatatactgcaaaatcctaaaatgttatcttaatcctaaaataaagattaaatctacatatacgtacaatctattctactgaaaacttatttttaagagtgtatgggtagtagtttttgattattcagaatatttgcatacaaagtgtccttcatgagcagcacaaaggggcaaatcttgggctcgaaagcctaacacacaggtttacccaggctctgccacttactggctttatttccttgggtcagctcttgaatatccttgagctccacgtccctattttgaaatgcgggaaatcataatacccacctcctattgttattacaaatattaattgaaatattccctatgaaatgcttaacagtgctccctgcaagttaattggcagtcagtcataactgttactattcatgtaaacagcttaagtagtagtatttattacatcttccaaaacaaaaatattttaccacgggttttaaatatactatgtagatatctggagaaagttgtctttagagctgttcttagctctgacactggctgtgtaatttaaagtaatgtcttaaattttctgagccttgaaatgtttccggatgcttgccgtgccctaaggtcctaacatgtctctatgttttaattttatttaccactgttcagtggcctatggtacaaagggttttgttttctgacctactgttccccacctaatgacttgcctgaagaacaaattaccactggaggaagcgagtaatctttctggagaattagcaaaggataatttttagaaggaacaatggaagcagaaaagtacacacgcacaatcttgcctttctcttttcggatattaccacactaaaatatgatctgactcttctgtgtttattagttcagcaaataggcattgggttttcactgggtttgtaaactagaagttacagtgtgctgaatcttgagaaaactgattgctagaggtagaacaacaagaatgttccagatgtttcctgtcctttcctccattcctccattaggtacctctcaaagcctaagttgatgataattctcttgggatgcaggtttagacatgtctatattaagagacatggcagggagtcctcctccagtccaagcaaactcatcaagttccatactactgctggagggttccagcaatataaattctacagacaaagcagtgtcagtcagaccccagagttttgatacgacttagatataagggttgagtcaggacaaactattaatttctgtcttctgtagtcactgtcccttttccttgagaatcttcctcatttatttgtgacttcctcctttctccaacaagacctctcgtacctttttatgatgctatacaagctcagctgcctccatgctctgcccaggcctgccttccttaactgcacactgtgggcccttctcataaccaaactctgggttccattcctttgatcaaccctactgaattcatgaacacatcaggctaatatttcccttttctgtcctgtcgtcttggcaaaatatttgaacaagagggattagggttgaacatggtaaaagatcaattctcatggttagatttcaaggccagaaagaccctgaaaacctttcagaattgtggtacccgacgacaccaccagtgcactggaagagctccctctatcacacagagcaaatgacagaagaagcaaccctttcaatcaaaagacagcagcagtgaatagcatttccacagatgaagaagatgtggaacagaacttaaatcccttccaatggtttcctcgatgctcaagcttttcttatcagggaaggcagggtaaattcttgttctcccccatactccatatttttcttttttcatttctttgtaatacaatatttgatacatttgaagatgccatatctttagttaaaaaaagaggctttgtttgattctaatatttatcaaattagtaaactcttttagcatcttatcatctagtcaaaatgcctttagagtgatgtcttagatctgagtctgtgttaaagtaatgttttaactttttggagcctctgttcatctgctcaacaggtataacaattcctgtttcaggacttactacaataaaaacatggtaaaatacagttatgatgagattactagcattttaatgaaaaaagcagtggtaaacttagaaataggaaatttttccatagtaataaaaactctagatgttattatgaacacgtttagaaataatagttaataaaacatgtatttttctaaaatgaaggctttttcccttacacaggcttttttgtttttttttttttgatggagtcttgctctattacccaggctagactgcaatggtatgacctcagctcactgcaacctctgcctcctaggttcaagtgattctccttcctcagcctcccgagtagctgggactacaggcacatgccatcacactcggctaatttttgtatttttagtagagacagggtttcaccatgttggccaggttagtctcgaactcgtgacctcaagtgatctgcccgactcggcctcccaaagtgcatatgctgagtcattgccatctacatgtcttcgctttgctggtgttgtttctgccacctggaattcttttttctatttccaattccttctcaactctgtgccctaaggatcccactcaaatagtgtaaatattattaattcctcaaaactcagttctgtcagattccccatcttatttttcttattgtacttataccttgcttgtcaaactttatattcttatatattttcaaacacaaatatgctttttcatgctgtggtctttctgtctacagagcatgccatcattcttgttccttctacaaatcacttactaatcctaaaagccaaattctgaagactttctcaataagttcttgcacaaaggtaaggcacttctttctttttcttcttcttttttttggttgttctctcaccattgttttacatccctgtggttggcagaattatggcctcatgatgtccaagaactagtccccaagaactatgaagatgttaacttacatactaaaagggactttgcgtatgtgattaccttaaggatcttgaaatggggagattatactagataatcctggtaggcagaatgtattcctaaaggttgtaaactgaaagagagaggtgggaggctgagtgtcagggcaatgcagtatgagaagactcggccgccatggctggctttgaagatggaaaggagtcatgaggcaggagtgcgggcagcctggagaggatgggaaaggcaagacggattctcccctagagtctccagaaagaaacacgggcctgccaagaacttcattttaccctagtgaaagtcattcagacttctgacctccaaaacgataaggtaataaatgtgtgttgtttccaaccattaagtctatggtaattgattccagtagccataggaagccaatacaatcactccactctaacactaggtatttttttaacttgggtttgcatgttgctttatgttagatttctttaaaaagaatcccacatcacactaagactcttatttatttatgagttttctctggagcaaaaatcaggaaagtgagacctgcagcctgagctgccataggtgcattactcgtttcaattatttgctttgtcctcggaagacaagaaaacgaaaaagagagacagataagacaaaaatagaaacgtaaacaaaagtaagcacctctttcagttttattatatcagtcagaagtacttcaggtaaaatgggaagaatgccaacatgtttttgagcatgtactaggtaaaatggtcattagagaaactgtgaatttggatacatggcccagatgccccttcaatgatggactttgcccagtttgctcagagtactgtcagcagaacaccccctgtggccagctcctcagggatggcttcagctgtagacgattatcttgctgtgatcacacccttcccagcccacatccaaagagacatgactttccatctcgactcaactcaggacaaccctaaaggaacgttctagccttagcactgcccctggaattggctgaggctttctttgaaagtgaaacacagctcaacttcttctgctcgggcttactgtctttctctccgtccgtccatagatgtgaatctcaggggcatcccataataaatatcctacacactaaatacctcctgaggggctgtttccgagggactctaacctatgacactatttttagaagtgtagaagaaaacacaagtgtagaaaggttaatttactctccctcagccacgtttaatgatcagtctttttaaccccagagtccacattctttctaacatactgagcttctcacactgggctatgtatcaagtcaaagttacaggatagatgtccctggagagtcaattttacccaattaccagaaatttaacacactctctcagattcaaaagttcatagtagagtgcgaaattcaatgagcttttaagaaaaagcatgatctttcaaaaaaatagtcttttatttattacaggcagctacagtatagattgccgtcaggctgcttggctttgaatccatgttttgctggttactacctgtgtggccttatgcaatttgctttctcttttgggcctcagcctctccacctaaaaatcaggttataaaagtacacattccatgagaatattgagaagaacaaaattatatcattcatgtaaacttcttagaacaacatttggtacatcttaagtgctcagtaagtgcttacaatcttatcaaagcccatcaaagcccattccctttcctctgtgtttagagtacttaattaactaattaactaatgcatctaaaaggattgcacaatgttaacataacgcacctcctctgtgcctcgattttaatttaaaactttatgctaataattttctgtctcctccaacgcaccccgctattctaaaaaccagcttgaatttaataataataatacataaaccctcaatattctcttatctcctaatgaatcaagtccaaacactgcaggctgctttccaatgccctttatgatctgaccctcatccagttttccagtcttttttctgaatttgccctgacaaagtggactactctagtccctgccccctcctttctttctgcaaaagtgcatttgctcaggttggttgccaaggttggaaagtccctgtccatctgctattgatcacctttaaggtcctctcagtctcagtttcttcatgaagccctccctgtcccctgcagcctgcctctgtctccacctccgctagcatgcattatctgggacagtcacttattgcagttgatccttttggtcaagtataacttgtacacacaggcataacttggagatgctgtgagtttgtttctagaccctggcaataaagcaaatatagcaacagaacaagtcagacaaactttttgatttccactgcataaaatgttatgttcatagtatactgtagtttattgtgtgtaatagcattatctctaaggaagagatgcacataccttagttcaaaaacactttaatactaaaaaatggtgacacagagacatgaagtgagtacatactgttggaaaaatggcactgatagactcgttcaatgcagggttgccacaaatcttcaattggtaaaatacataatatctgcaaagcacaataaaatgaggtatgtctggacaaacagactgtgagtgccctaagaacagggagtctctgttttctgtcttttcataacaagtactaagataaaaaaaaacttatagacattcaataattatttcttttgaatgttagtatttacataatcatcattttttgatattgtttgttctagttgagaaaaagtgtcagatataatttgaaaaaaatatgaagaaggaaaatttggtctcttctctgtagacaatgaaatccctgattttatgtagaaacatgtagagtctactgtgttggcttaatgtttgaatacacgcttaccatagaagaactcagataggaaaagtttaggaaaagtatgacccatcttttattgaaatgtacactttaattctgtgaaaatatttcaatgtaaaagaaatgatgcaagtaaatctgcatccattcaacaataaaatctctttttagggcattacaaaaggtaatgaggtcaagcaaggtaacatgtgagtttgtatatagtttcaggataaggagacaacagaaaataacaacaaaaaaaaaaaaccctggctcaagtctgtaatcccagcactttgggaggccgaggtgtgtggatcacgaggtcagaagttcgagaccagcctggccaacatagtgaaaccctgtctctactaaaaatactaaaaatttgcgaggtgtggtggtgtgcgcctgtaatcccagctactcgggaggctgaggcaggagaatcgtgtgaacccgggaggctgaggttgcagtgagctgagatcgtgccactgcactccagcctgggcgacagtgcgagacaccgtctcaaaaaaaaaaaaaaaaaaacccaaaaaacaaacaaaaacaaaagttaaacaaaatctaggctgccctgggctgaggatcttagaaactactttgatcagaagaaggacaaaaggagcttctgtattatttgttcggtgaatagtttgatctgaaatgaaaaagagcttaggccacgtaagattccagtgagaggtgatgaattggctagctttgggaataatcagtactgtgcattacaaataggaggggttagttacatctacacatcccagaacttttatactcctggaagatggcaggacaggcttatggctattctttgactttagctattctgttttgggggctctgtagtgaagattatctctaatcatcaacttgctgcttcagaaatgtgattttcaatcagggttcctagggtgctgagagctcctggatgtgtgagctgtacttaacggcaaagatctgaggtcagagttgctatcttcctatgtgtctcccgcccttgccttcctgccagcatctcttcaccttgtcgtgctttcagagcaggaactgacgcaaattgggtgttggactcccaagaaacgtgtcacagctatttagaaagtgataataatcctaatgccctgtaatgatttgaggattaaggaataaaactgcaaatatgatgcatggcatataaatgttgaaagtaggtgcttaaatggagacaaaatctgtgaaggagaccaactcatttggcattttcatattcttactatgtttagttcatatctatataacatagagaagtgtggatcctgcaaactaagacatggaggggaatttctttatacctgcaagaaaaaaaaattataaaagacattgaaactgaccaaaaagattactaggtgttgtgcagaatcctcaagatagctcccccaacattcaggtttcctagttatttgatcaagcattaattcaggtactccctaggaagacattttgcagacgtgaagtcctaagtcagttgaccctaaaatacagagattatctacataaacttaatctaataaaaccagcccttaaaagtggagaacagagaacttcgtccactggtggcagggggagaaacagaaagatccaaagcaagagaaggactcaaagctccattgctggtttgcagatagagaagattaagtgagaagtaataagggtggtctctaggagtggagagtgaccattgaccaatagtcagcaaggaaatggggaacctcagtcctacaaccacatggaactgaattctgccagtaacctgaatgagcttggaaggagattcttccccagagattccaggcagtagcccagcccagcaacaccttgattttggccttatgaaacccagtggtaaaggcagctgagataagctagacacttgatctacacttgatcataaatgggtattgttttaagccactaactttatggttatttgttacactgtaatagaaaactaatacacttggtgttttcaatggaccactaggctttgtttaaccacagccatcacagtttcttttttttttttgagatggagtctcactctgtcacccaggctggagtacagtggcatgatcttggctcactgcaacctccacctcccaggttcaagcaattctctacctcagcctcctgagtagctgggattacaggcacccaccaccatgcccagctagttttttttttttgtatttttagtagagatggggtttcaccatcttggccaggctggtcttgaactcctggcctggtgatccacccaccttggtctcccaaagtgctgcgattacaggcgtgagccaccgcgccaggcccagagttcttattctgtgaagtctctgtgcctttaactccccttgagtgagtgtacagctctgtaagttgtagataactgataacaatacaaatatttttgtctatagatacacacatgaattttatccttcagaaatacaacccccttctgccccatgcaataaaccagtattatatttgtcagttcacgttggcattactaatctgccaatatgtgagtggtactttaaatccttctttgaaccagttgtaacatccataccatgctaaagagttaaataaaatccttgatgtacttattttatatctgtataagagtcattattttacccttttataaaacatatcatttaatagagatacattcagagatttctaaaatttacagggcaaggactgtttattcatcccagagtttatgtcaaaaaaagagctaaatattgtacataagctcatctattcctcatgctaaacccctgaccctggtatgaagagtccctaattgaaataaagaaaccaaaactcaggcacatcacaaaacatactgtagagcacacagtgctggagtcttggagctgagaatttggcatactggaatataaagctactactacttccgttgttccatagagctttccaatgtaaaatggggctcatctcctttcaccctaacccagcatctcctccttatttcttcagtccattcttgatgtgaatattttcctcctcagtcaagtttgaaaacttagagccatttttgtcctttcatttccttttctttctatatccattggttatcaaatgccttaagttcagcatctaccatctcttgtagcctcttcctctttctgtttctgctactatcatctgagtttcttctcacactaatagcagctcaaataggcaaacaggaccagatctgagttttgggagtttggcacttttacaattttagagggccatctttagggaaaaaaaaaaatagtaatatgaatacaaaatgaaacatttattcagaatgagaaaataagccacaagaaatcaacaatcttagaacttcttatttctttgttttgagatctctgatggcaatttaccagaaatttttacatacaggtgattcctgactgtaactcaaaacccttccccgctctaaactccctgcaactccacctactcacaggggccatgcaaagaagtaaccctaatactcaggcttccgtagctttagaaacttagagtctctactatcaattctttttccatttttagtaaaggaaataaattaagcaatggaaggtctaacaaattattcagagtttcatggaggtggggagaggttacgaacctgggacgttttaaacactcagattcctgaattataacccaatattctaaataaaaacctgaggacatctgtatttttacaaggctccacaggtgaaatggatgcaactgacctatgaattacaaatttgaaaaccactgctctagctcaactgcatgaaaagtgacctgatcctctgtctccaaaggttaaagctttcagagtgcaacagagtcctccaatatttcctgggcactgtggtctgtacaatgcaaaattcagaagctataaaaaatggaggtgaaaagggccctgattaaagactgaaacagaagcaactgcttttctctctgtgcagctaccatactggtcttgattcaagtaaagcaatgtgcctgatgagaatcactgaagcacagaaaatggtctggtactgagagatgagcaaatgaatcccaagtatcaggagtacacaggaccagaaaagaagtatttccaatacccacgcctgactaaagatttcactagcctcttagctcaaagggacaatagataaacatcaggtctacactgcaaatttgcctgcatattaattataatttatttcttctatctttgtccttgcattagactgtttaattccgtgtatgaattcattttgaagtgtagagtccatcgttctcagtaattagctttacaaagtctatcatcgaaaatattgttttagattctttgaatacagattctatgaaagagaaaaatccttaaaagtgggagactcggccgggcgcagtggctcacgcctgtaaccccatcactttgggaggctgaggcgggaggatcacgaggtcacgagatcgagaccatcttggctaacacagtgaaaccccgtctctactaaaaatacaaaaaattagccaggcgtggtggcgggcgcctatagtcccagctactcaggaggctgaggcaggagaatggggtgaacccgggaggcggagcttgcagtgagcagagatcacgccattgcactccagcctgggcgacagagcgagactcgtctcaaaaaaaagaaaaaaaaaagtggaagaccaataagaattattcagattctactggccagagcaggaagctcagctaccagcatttatctttagactcctaccacatatgattgccccaactgaaacacaggtcagagagtctgctgtacttctaaagtgatgagaacaaatcttcctgtcactttatgtcacagtcatacagttcccgaatagcaacccatagatagagcccttggcaaatttgttatcagcggtgtgtgtttacacacatcaagtgtctgggaaataaagaaaaaaaggaaaatattgacagtgtagaggatgttctttcttctggaaactcataagattttgaaacacagctgaatattttgaacatacctttatgttcaaaataaattaggaaatgattcaatactaagcataattgaagtcatagaaaagcattttttattcttttgctctattaagacacatttcattgtttctcatggttactgagtggtacatcgctgtatatacatatttatataagtatattagatgtaccttttgtgtgtgtatgtatatgtatatatatgtggggggcatatatttatatatatttatagcaacatatactgtatacttctacacactttgctctccgtcctgggaggtggaccagaagggttaaaaagtgcctgtgtcctctggcttccggttgggctcagcctagggagtgcctggcctgagctggagggaggtgaggtattcaagatccctccctgaggcttggctgcaactgggtagggtacactccttgaccaaaggctacagttccattccttggacctatctacccgatgcccccacccccaaacctgggttccaataacttccctcttcactccttcagttctcggggaggcccagtttgcactgctgttgccagccagagagaccgtagctttccttatggtttccctacaacctttgtaaatagttcctttattaaactcttttcaaattacccaatttgtgtgatccgtatcttcctgacttggaccctgatatttttactgaatattgactagtaagtgtattgctcatgaactgaactgcttcagagttgttgagctcctaacacataatttattatttttctttattatcaaagtttttaaaaatgtatttactcctaatttctttcaaaaatagatttatgacaggaattattttgatgttatattccaggccattaaaagcatcaagtactttggccaggcgcggtggctcacacctgttatcccatcactttgggaggccaaggtgggtggatctctttaggttaggagttcgagaccagcctgaccaacatggtgaaaccctgtctctactaaaaatacaaaaattagccgagcatggtggcagatgcctgtaatcccagctacttgggaggctgatgtgggagaattgcttgaacctgggaagcagatgttgcagtgagccaagatcacgccactacactccagcctggacaacaaaagtgaaactccgtctcaaaaaaaaaaaaaaaaaaaaagaaaaaaagttcaagtactttgggaataatagtaagaggaattaaaaaaatcaagtactatttttatgaattctgggcattttcccctccaaatcatagaccaaagactactcaatgaatactcagtgaatctcttcatgttatgaaaatcaggaaactgctgcctaatggcttaacctttgatgtaatgattttcgctcagtagcttaaatctatgacaatgttcatatttattgaattctactctttgcctttaggctaaggaactatatgctttatgacattgtatattataaagaacaatctataccaaaataacaaccttcagagaacaaaaaacagaggatgctggagtcagcaattgctaagatactggacagacagcaaggtgagtaatggagttaataatctggaatatggaatactgacactactaaaaccatatttgggtgactaaattaacgccacacttctcatccacctacataatgtttacgcatccaatgatgatagttacgtttatccaatgtcaaggcatgcttacaccgttctgacatataatacctttaccaaatgctaattattttattaatttaaaaaatatttaaatataagaagtgaaattccactgtcaagatgcattattcattgtttttcctgtatcagttcaaaaaatattattcttaaaaaagaactggaccaaattccaactgtgatactacagaagaaaaaaaaaaaagctgaagtaaacaacattaagaaaggccaagtaaagtgacaaatcacagcaaataacaatttatccctactgaaaaggacagcacaattcaatttgccaaatcattttatttatctctgagtggcaatatgaatgatcaatctgttttgatgaacactaaaactttgctgaatgaaaaactgtgctgcctttaacatgtcaaatttaggtacagtaaaagaaaatgtgaattaaattggctttgagtatacagcattaaaagataaattgctagcttagaaatatctttcccagtagctttatttgaaccaaaatattttgcttaggaggaattacataagtgtgcaatctatataataattatttcttggtccctaaatttgaaatgttctcaaaagcctaaatgcagaaaaaggctaagaagattatatgaagagaaagatctggtttgatcaaagactttggctgtgaattagagagggttttatagttttgggataaacaatttagcaaaaccctgatattctttcttccttcatgcatttatgcatttaactgtttgttaaaatactcctatgtgcaaagtttgtcctaggaagtgggaattaaatattgaaaactctctgttttcaatagctccaaaaaccacataactggagctttaggacccatcttgtggctcctggaaaatgaattttaaattgaatcctgagagattagtaggagttatctaggtgaacagagaagggtctcaagtgaaaaagcttccagggagacagcaatgtctgcagaagtctagaatgagaagacgcaggaccattctaggagttccgagaagttgatttggtgaaagcaaatatgttaagttttgaaaaaggacatggttgacataaggcgagaccagaaaaaaaatttagaatgttgaggtgaaaaaattatactgtattagtaattagtcccagaatccctgttaggaaggaagctttggttacgaacatatcctaacttttagtccagaggcaagactaaggagagtataatgaagtaaagaaaagaggacgatgagttgctctgcattggaaatgaacagggatctatggtttggggacactggaaaaatgagaaaaggggaaataaaaaagcaggaataaaattataaagggaggacaaaggaattataaaaacatggattttaagttatttgtttcactgtgttggaaatgtccttttataacaccctaataatattcagtactagctaccacaaagacaaaagagagaaatgcatttgtagtgttttgtttttatttgtggaaatacaagttctatatctgttgtcatatcagggcaatgatagaattgcctgtcacggtcagtacgtagagtcaaatgttattcagcaaagagaggatgactctagcacttgcagaccccttggagatggtatgagacttttcacagggcagtgtgcagggattggagccaatcttctagttcaaaggagcatggagttccagcaaacacatagggtatgtagaactccagaaagtttgagactgatttaaggataatgggagtgttaatgagggtaatgcttggctccatttgtcatctggatacactgtaccaatggctgagagggaggcaggactgaggcagagaggccagttaggaaagcaagtatgttgggtcacttgcaaagccaccattgattctgatgttctgggatggctcccctgactgtgatctcagttcacctggttccaacctggggacacagaccaagtacttagaccttagtcaaagacattacccctgtcttagaggagggagtgatagagttgggtgattatgtgtgtgtttgcatgtatgcattggaggagtttataagcataaagggagcaagaaatatcaacatggctcaagtggttattcctctaagaccatttgtgagtataaaattgtgtgtgtggttacccacacaataagaaattgatgagaacttaattgaatcaaattagaaatttactagccccacattctgtaattctgccctggcagaaaaatggacctaaattcagactatcggtcttaatatgcatctaatgaagaagtttgaaataaaggcaatctgctgacttgggtgctttgaaaaaagaaaggactcaagttggccattatttcttgttaatcaacacagtagttaatgaatataaaatttacatccttgttacagtaacatttaagttacatctttcaacccattttgtatcttgttatcactcagttttgtttctgtctaaaaatctacttgctagaagggaaaaagagcctttctataatattagaagatttatttaaatagttctaaggactatggactgtaaacttaaaattaataatgtttgccaaaggaaatacctgtgttagaagacttgtgaaagaaacctttgttctttcacacaagagttaagtgtagcttgtcataggaggtggattttagccataaatcctagtgacactgatatcatcaatcgagtcctaagtaactctacctgtataagaaaatcatgattttattaaaattacaatggtaactaatgacttccacagtttcccacaatcacatcaggcctttacctcccttagtctacttgggctgccattaactaaataccatagaatggatgtcttcaacaaaagacaattttttttttttttttttttttttttttgctgttctggagcctgagaagcccaacatctgagtgctagcatgggtgagatctggtgtggcctctcctgctttgcagatggctgtcttctctctgtgtcctcacacggtgatgagatagagagcaagctctttggtttatagggggaccaatcttgtacaagggacccacctccatgagcccatctaaaacaaattatctcccaaaggcctcatctatcatcacattgaggattagggcttcagcatattaattttgaggggcacgattcagtccacagccctccctctgtgcttgtatcactgctttttcttccttgctgtgaatgaactgaatggtatgggcttttatctaaggacaccctctagccttgtgcataggctctgaaaagttctccttgcacagggacaacattgtcgggacttagccctttttctcctccatgctcaaatttcacttttctgttagatcagttccaacagcctgcacaatactgtaaatacttctatattgaagattaatataaaaacaaaataggctgggtgcggtggctcatgcctataatcctagcagttttggaggcagagatgggcagatcacttgaggtcagcagttcgagaccagcctgaccaacatggtgaaaacttgtctctactaaaaatacaaaaattagccaggcatggtggcacatgcctgtaatcccagctacttgggaggctgaggcaggagaattgcttgaacctgggaggcagaggttgcagtgagcccagatagcaccactgcactccagcctggatgacaaagctagactccgtttcaaaataaataaataaaataaaatttaggaaactgttgaccctacatccccttctaacttactgtctaatttcttcacttttcattagagccactcatctaatgtgtctatattcactatctctaacttcttttcttccattctctcattttttaaaaataaataagatcattatacaaaactcaaacaacataggaaagcaaaggaagtcttgcttctatcactgccccaccaaactcataatacaagccattttttttttttggtttctaatttctaattctttccacttttctaatgcagacatcaatatactgtataggcttgtctgcagtttgtttgtttttactcagatatacccaggagattttcccactgtcattatttaaagaatgagtccccaatccccaggccacagactgacaggtcctggtccgtggcctgttaggaactgggctgcacaggtggaaatgagcaaaagccagcggtgattattatcacctgagctccgcctcttgtcagatgagccgcggcattagattctcatacaagagcgaagcctattgtgaactacgcatgcgtgggatctatgttgggtattccctgatgatctgaggtcgaacagtttcctctcgaaacaatccccaccccccaaccctgtctgtggaaaaattgtcttttccacaaaactggtccctggtgccaaaagggttggggaccactaatttaaagaagttcttcattctttaattttacaatggctgtgaatggtcatcattgattcaactattccttacttgctggacattgggttgttgccattacaaacaatatcctaattaactccttaaacacatggcatttgatatttgcacaggtgtatgcacaggctagactcctagtagtagaattgttggctcaaagggtaaatacatctataatttatttcatacaatactgccaaatttccttccgtaggagttgcaccattttcaaatgtcacaaagcaacatataaaagtatttattttcctgaaaccttgccagctgagtgtattttcatattttgtatagatagatgacaaaaattgtattttcagtgttattttaatttgcatttctattatgaatgacattgagcactttttctatgtggttaaagggcattagtatttctttgttaattctctctctgtccctctctctctctctctctttatatatatacatatatatgtgtatatttatatatatatgtgtgtgtgtatatatatatatatatatatatatatgctttacttgcttttctatgaattgttggttcttctcaatttcttatagctctctatatactaaacaaattatcccattgtctggacaacaacatgcaaatcataaatccatctatattttgcttatcttgaatctggcttcctagaacctttggaattctgggaaaaccccagattcaaaaagagcttagaaacacatattttaccacctcttgggagctaaaagtacagctccttgagcactcagtcatgtaaacatgactacaaaaagccaaaggtacaaaatcacacatcatgagttctttcatcaggtatatccactcagtacccaccatgggtggtcaggtagtgctctaagtatcagagacttacagccaaacacccacaccgtaactcaaggatttacactggtcaccaaattgaagggccagttagtagttaaaaaaaaaatggaaaaaaaaggtaagaaatacattgactggcttgcagtacaaaaaaaagaaattatcctattgctgtgatgatgaattgcatcatctccattattcttcgaatttattgcaatcaagttgtttgcccttatatatactaaaattttctttgtcaagatcaaacatgacttctatgtagccaattctaatatcaattctcagttcaccactaagtgataaatggtttacatgatggataccccagttacccagattggatcatcacacattgtatgcttgtatcaagatatcacataaatgacacaaatatgtataactattatgtattcataaaaataaaatattaaaaactaaatcccccacagaaacttaaggtaaaacgattcccagagtatatgctgaatggtcattatttattgtatcttcaacccatttctgaatcatgcccagctcttatgttatagcacattttcattgcacaacccctgtgtcatcctctattgctaggattctcatttcattcatgttggaacagtgacctaaagagcttaaatgtgccattatcagatctgcaatggagatgaacacttgcctatgcaacatccatctttgtttataataaaccaccatttatattaaaagtgataatcttcccaattaaatattccatatttcccaatatgatacagctgaatctagtcctctgggaaaatttaatctatggtatgttagaagtgatgtgtgggactttaccaaagctctttaaatggaactccttcagctgagagtcatgccctccttgacttttcctctttttgtctttctgctacctggaatgtaagcataatggctggagctccaacagctgtgtttgaccatgagctgaacttgtgagtaaaagctatgttctaggacaggggtttccaaactttctgtaaccgacaaaataaatattttaggctttatagcccacacttgctctctttcatatttttctatttttgcttgatcttctttttatatactcctttaaaaagaaaaataaaatttttaattttgcagtccctacaaatgcagtctgggccagatatgcctgtgagtcctaatttactgagtcaccttactgtaggatggtgggagagaaagattagagagtgcctcatgacagcagagctggcatgccagccctattttgcgtacctccagacttcctttatgagagagaaattaatatccatcggtttaagctactgttactttgtgttttctattatgtgcagataaatgaatcctaactgataaatggccttcgaaggaaatgtacatattgcctctgccaaggaaccttagaagacattattttaaggagaaatactataaatacaaaagcatgtaaataggagaaaatttcaagggcatatttacaagagaaggttgaagtgaagaatcttctctggagggtatggaaagacgttttgataaatattattccattgatatgtcaggtgaagctagttgattgcagtcctgggagtgaggaggagcagtttgaacttgattcattagttaataaagagctattggacgttcttaatcctagtgagggcataagaaagccatcattcggaaggagtcacttgtcagtaatatagtctggactggaacacggaagctctatgctggtgatcctggagggctgaatctcaaaagtttgaaatgacaatagaaagaaaaagttgattctgagagatgttaccaggtaggggcagaatgagtggactagcatttgttagataaatgcatgtaaacgttggcagaggagggaagagttggctatatctgcaggtaataaatttctgctcttataatgtttataactatttttgctcccttgcttatctatctattattttctatattgtacacttatttcaacagaacaattcatgcttcaaccctcgaaaaattgtcattggacacaactttataccacttagctgagtttcctaatctctttcaataaataggtaagcacagaaccccagttgtagctaaagattcttgaatttattcaggtcaatatattgattaagtaataataataataactcacaatttttaagagcatggtatttgacagatgttacagactacatagattctgtgttgtcttcataagaatcctattagatggcagctgtacacagtcagcttcaccttcaatattgtgaaacggttgcttggaagaagctgtctagccaggaactgcatttccctgtatccacaccattttggtgaatgctcatgactggattttaccaatgaatgtgaacaggaatgttgttaatagcttcagggctaaaatggttatgaaagtgcaagagatgctctaaactgtctttctctgctcaaagagattctaggggatcatgaaacaattatttggagacacccaggatcccagagtcaatgcacggaaagagctatgcatgagagccacctaacacatgtaaaactgtgacatacatgagaaatatacattaattcccttaagccactgagatttttgagccaaggctggcctactgtaactaacacagtaggtgttattaacattaccatttatacaaacagaaataagacttgggaagatctgcctaagacactaagtaatagagctgtgattagcatttgaaatattcaatttcagagcccatgttcttaaccattgcccaatatcatcatctttttatataaatttgtaaaagtggtgatactgttttttttaataaactaggaagaaattctaaactcctatattttgaggtgtgttgttcatgttcacaaagccccatagccaactaataaggtaatatgcattactaatgggtaatatgcattctacattaaaaatggcatttgctttaaggaattcaatgatctaggatttaaatattttgttccaagtttaactgataattccccccaagcttttctcattggcacaataatatggcttaggggaaagtatgaaggctgagtaatcagaactgcttggatcagaacatgacctcttcggccttgagtaagacatgtaacctcgctgaggcttcgttttactctctgcaaaagacagttaacatcaccagctttttaggataattctaaatattagaaataatgctggaaatcttaataaatcactcagtacacatagacagtaatttaattcaatcaagaactatgtatttaaatgtctactataatgcatgccagacattgttgaggctccaaagatacaataaacaaaacagacaaaaatcctcacctatttgcattcaatgtattcttttttttttttctttctaacagttcataataaaagaaaccaatattaaggcactttcaattctgatcaagatggagtaacagggacaagatttacattcccatccgaaacaacaacaaccaaacaggcaaaatatattagacaatagtttaggaaacactggccattaggtaaaatagatagtgatctcggagatacctggaatgaatgagatgagccctacaattgcccaagcaattatgagacaaggaagaatgcaaaatgagattggaaaatattttaaataaaaaataaaaacacatgatatcaaaatagcaggattctactaatgcaatatgtacacagaaattgaatcactaaatatctatgttcgatagcaaaaaagatatcaaatcaatagccttaacttctaccttaacaataacatttaattagaaaaagaagagtaaattaaatcccctgtaagcaaaaggtaatgatattaatcagagcagaaaacagtaaaatagaaacagaaaacaatagaaaaaataaatgaaaccaaaatgtagttcttttaaaaaagtcaatacaatcaataaacctctagccaggctaatcagaaaaaaagagagaaaatacaaattatcagcatcaagaaagaagggacataactacaaatttttctgatagtagagaataatatagaaacattgtgaaaaaaaaacacgcatgtgaaatgaacaattttcatgaaagataaaaacaaccaaattttactcaggaagaaataggtactctaaataaccctgtatctgttaaacacattaaagttacagttaaaaaatttctcacaaggaatgttctaggcccagatggttttgccttcgattctaccaaacatacaacggggagattatacaaattcaaagcaaattcttcctgaagacaaaagaaggaagacttccacaaatattctatgagccagcattaccccagtatcaaagccagggaaaggcgttacaaataaaaaaaaatacagagtaatatctctgatgaccattggtgcaaaatttctaaagaaaatgccagcaaatcaaatctaacagtgtataaaatgataatgcattatgatcaagtggggcttatctcaggaatgcagttagtttaactttagaaaatcagtgtctgtaatttacaatattaacaaactaaaaaagtgattatttcaatagatactgaaaaagaatttgacaaaactgcaatgtgaattcctgacaaacactctcagcaaatcaagaacaaaaggaaacttcctcagtgtgataaaaagcatcttttaaaaacttacagctaatttaatggttatatttaaaaaacttaatattttccctctaatatcatgattatgagaagttatctactcttacctgttcgaattgtatagtgcagattctagccagtgcaacaacaaaaaaaagaaatacagtattgagcatgaagaagatatatttatttaaagatgacagaactgtctatgtataaattccaatgaaatctacataaatatctaatagaaataattgcatgcagtgagactgcagcatacaatatcaatataaaaataacttccattaaattgaaattaaatattatttataatagcttcataaattgataacttagtaaagttatcaattttccccaaattgatttacagagtcaataaaatccaaaccaaactcacagcgggcattgtttatttggtagaaatcaacaagctgatttgaaattaatgtggaaatccaatgaatctagactagccagggaaattttaaaagaaaagaaagaacaaagttggaggaataacagtgccagaattcaagactgattataaagctacaattattaatatagtgtgtgtcattggtgtaataaaagacaagttaatcaatggaatagaaatggacccatgaatatgtagaatattgatttttaataatgctataggctaagcaatggaggaaaatatcgtatttttagaaaattatactaaagatatgtttgagggggaggagccaagatggccgaataggaacagctccggtctacagctcccagcgtgagcgacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagccggagatctgagaacgggcagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgatgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaaccatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaactaggtattgatgggacgtatttcaaaataataagagctatctatgacaaacccacagccaatatcatactgaatgggcaaaaactggaagcattccctttgaaaaccggcacaagacagggatgccctctctcaccgctcctattcaacatagttttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagccctcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaatcatatgtttgaaagcatcaaaaaaaaaaaaaaaaaaaaaaaaaagaaaattatactaaaaattaggtattcaaatgaaaattatttaattcatacctcacaccatgtacaaaaattaactcaaaatgcatcatagatctaaatataaaatgatacaacttctagaaaacaaggaaaaaaatcttagtactcttggattaggcaaaggttttctagatatgagaccaaaaacataatccataaaaaaattaagtgggactccattaaatttgaaaattctggtcttttaaagacactgacaggaaaatatagttatatagctaatatgggggagggagtggtatggattgaatgtttgtgtcctctctaaaattcatgttaaaactaaatttccaatgcagcagcattaagaggtgcggcctttaagagatgacttggccatgctggctctgccttcatcaataaattcctgccttagaaaagtcttgagagcgtgagtttacctctactgtcccttccaccttgggaggacacagtatttattcctctggagcatgcaggaacagggcaccatcttggaagcagaaaacagcccttaccagacactgaacctgcagacaccttgatcttagacttttcaacctccagaactgtgagcaatatatttatgctatttataaattacccagtctaaggttttttgttatagcatcacaaatgaactaagacaggaagaggagaaaacttgtacttagaatatgtgaagtgctctcaaaactgaataataagaaaataaacaacctatttaaagaatggacaagagtttgagcagacacttccaccaacaaagatgtacaaagggcaaataagcacaaagaaagatactccatatattagtcatgaagaaaatgcaaattcaaccataatgagatactgttacactcctggtaaactgactaagttaatattctgatcataccaagtatggtgaggaggtggagtgacaggaatgctcacaagtgctagtggtaaagtagtttatctgtcttctaaaaagttaaacatgcacctacaatatgacccatttatcttactcctagggatttactcaagagaacagaaagcatatagacatacaaaggcttgtccacaaatattcataacagcattattcataatagccccaaagtggaacaacccaaatgcccaacaagaagtgagtggatggcctggtgcggtggctcacgcctgtaaacccagcactttgggaggccaaggcgggcggatcacttgaggtcaggagttcaaaaccagccttgccaacatggcaaaaccccgtctctgctaaaaatacaaaaattagccgggtgtagtggcaggtgcctctaatcccagctacttgggaggctgaggcaagagaatcgcttgaacctgggaggtggaggttgcagtgagctgagatcacgccattgcactccagcctgggggacagagctacactccatctcaaaaaaaaaaaaaaaaaaaaaaaaaagaagtgagtggatggatggatggataagcaaactgttgtacatttctataatggtatactatttagcattaaagtggaatgaaatattgatgtgcacagcaaaacatctcaaaataattatatataagaagccagataaaagggtacacattgtgtgatcctatttatgtaaaattgtcaaaacagaaaaaaacccacaacacctcatgtagaaaacagacccatgttttcctggggaaggtggtgaggagggctgggagaaacaagagaaagttccagggatgatagatatatatgttcactactttgattagaattattttacgagtctatacatataccaaaacttagatactttaaatatgtacaatttgttgtatgtcaagtatagcttactttaaaaatgtaaaactataagacaaaaagaattatcatttagaattttttactgaatcaaaatattttgcagatgcatcgaattctctgcttcctatcatttagtcaaccatttgcagaggcctagagatagttttggcatggaatagatagtgtcttttcatttagcatggctaacatttaacttaaaaattgtaaagatactaacagattagaagttaaatgcttattcgctgataacatcttcaacattgagattcaaagcattgtgccccttaaagattagttcaccactggccatcagtagccacttttatttaattatatttataaaatttaaatgaatcaatgctcttgcctaagaaaattatacccaggagtacagaatgaaaaatgaaagtcctcctgctcatttttcatttctaagtacttcttcacgattaacaatgagagcaaggttgacaaagatgatgaactgccatttctaatccttcctggcaattgcattcacttattttcttttgtgaacaggaaagtacttggagagaaattatacagtgattcatggttctggggaaggctgctgatattttgatcaggccacctcagtgccctcaggaaatcaaagtgtcctatcactctgtatccattatcattacaaagatggtctgcttttaaaccatcttgatttccaggtagtaaatgattttttaaataaaaggtgtttctaaaagtattcatttgtactttttcttcatcaaaagagtattatttttattttaggaaagaacaactggagagaaagagagaaaggcttcttgcatccccattttatttgcttttaatcgttgcctttaccccaggcttcttggtaatgtgatggtgttaactaggagtccttatctctggggcaatgaccacaaaaggaaagtttagtagtagtgtcagggaaccacaagtttcagactttagtagctgtccatgaagattgtttagctctatccaacactttctgcaacttgatggccatagtttcctgagtctgagtctttagtgcaccaaaaagaagtatccatacctggaaaagtttctgttaggcacaggtatgcagattctttctttaaccataggctagataggctatggaaatggatatgcaaataaaggacagctttaccgaaactatctaaatttttctcttatatccaaagatctgttatcctagggtagctggagtcctaatttccaaaattttcagaaaagaactcaacaaccaaagaaagattagggagataactagtatctactgagtccccactatatgctcacacagaaacttatatttgtaaatcttatatctcaaggccacattagtctggaaaaaaataaagtggggtcaagacaagaactagcaacagcatatctgcctctgccttcactgtctcttgtaggatctctacactatcttctttaaacatgatttgctagcagttctgggagtcctctggtgtagctcaaagatgctcacagagagcatcctctcagtatctcgaagcatctgccaattccttcctcctggcttatcagtctttgatctatgacggctatcagacctgctgaaagtcatgaaacagctaaactacttccactctgccaatagccctagggatgttgcattcacaggtacatttatttaaaaattctccctgtgaagagttgatgtacgtgcatgttaagtcaacctatagctacagctttgaacagttatggctctctaatcaggaattaaaactctattttgttgttgttgttgttgctgagacagggtgaagtgcaggctggagtgcagtggcatgatcatggctcactgcagccttgacctcctgggctcaagtgatcctcctgcctcagcctcctaagtagcgaggactgtaggttggcaccaccatgcccagctaattttttattttgtgctgagacggggcccttctatgatgcccaggctggtttggagctcctgggctcaagcaaccctccctcctcagcctcccaaagtgctgagattacaggtgtgtaatctcaccacacccaggctgaattaaaactctagagatggttacttaagcacttaatagtgttatcagaagttgtgccagagggtttactggcaaaaatagatattagaaataagttttaattgagtaaatgaggttctaatgctaccaaattcagtcacagtcttggaaattctctatttggttttgtttgggtttcatatgtatgtagtcatactttatatttgtgtgtgtgtgtgtgtgtgtgtgtgtgtgtgtgtgtgtgtgtgttttatagtgcagccctctccttaggcttctgatatgagaacctgggcctgaacagaaggacatcagaatggttcgtcccaattagtactcaaacactcccagcctttggtcctgattttctgtattcacaatcttttgtgcaatctctactttgtattaccttaacagagttatttcccataataatttcttttctcttaagctttagacctctgttaggcccattctataatgcccacacatgtttataccaaagaagaacactcctatttctgtggaaagacaaattaaacttctgtctatcagagccttagtaaatagaagttcaaaaagcagagtttttataggaaaagaaggaatcttgagattaaagtgcattcaaggaaacaccaaattatatttagtagagctttaccagagatttatttttggaaattgttctgatagtcaaactagatagtagattccccattcacggagttctatgtggaaatactcaaaattataggttaagcatggtagatctttcattagcatcaattttaccaagctatttttgccaggataaagggaagtatttttatataagtaaaaatagtgtactactgaataataaacataatttgcttcggtttctaacagaagtctttgaagaaatgttgttttcttggttagccatttagtgtaaggccccagacttttctggaaaatttaggtaagcactaaaaagcaatatttgggattgtcagcaaacattaaatcactgtatctaaatatgaatcttctatattttaattttaaccatgatccctgcaatttgaagtgaggtaagaggaagagaaggaaagatcatccattttaaagaacaaagaggccaaaacaagcaatatcataataaatgtagcatagaattatagagaaacctgaattgaattacattgtgattgctcagtattatatcacagtcatatgtattttaagatgaattgctggggttttaattaacatgtaggaaataaaacagtggaaaataattttaaacatatttataacatatatgataatacacctgcttttaataagtcagctgaattacatttttgtatgtaaaagttaattttcctatttcatagatatggaagtttgatttgttttctaatttttctttaactccttgcattagatgaatcctatatctccaagtactatatttagtcaagtagatttcctttttaagtgaaaaatgggttttgagatagaaaagagctttgccttaatatgccaattatacagctctttttaactctaacttgtagtctgagagatggtaagatttttcagttcagttgctctcaacaactgagatattgactgactcaagtttgagttacaaataaatctacataaaaactttcactttattgattcttttcaaaaacttctaattatgctttcaggtggttaaatggcaaaatctaactgcatctatgacaaagtgagctatattaaaactgtgggataaaggagaaaatgactactaaccagtgggcaactgtcaacaatacttccctaaaacaactgttgacaagctgctagacaaatgtcaacttagatgagttcaataaaagtagatcctgcagaatgagagggagtccctgtgttggcagagaggagcctgtctttgttagagacagaatactaaaactgtgctgatcttgggtggctgtacccaagaattcatcctttcactggacagtttccaagttattgtactttataaaataattggcattatcatgtttccatatactaagtcaatataagtgcattttcagaacagcgatgggatcagatttcactcagaatccctctgtcagaagaatccagaactcacaaaatcctattgttccaattaagaacatggatttgggaacacctggatttgaatcctgcccttctttttagcttggtgaccttggccaagtcaccaagtgatcctttatttgtagaataggaatagtcatagttagctccatgttgcccgggaagaataaatgtagtgacatgtgtgtgagatcttagtagagcacatggactcagcacttgctcagttcatggtagctctcaacagcctccaagacacaaggagtcagctgacatttctataaatacttgtctcagctcttgggcaagtgggaacttgtgttctacaaactctgatcattgaatcgataggatttcacttagcatagttctttaactttcctaggagccaacatctactgagcacttaccatgtaacaggctctattctgatgttgttttgttttgttttgttttgagacagagtctcactctgttgccaaggctgcagtgcagtggcgtgatcttggctcactgcaacctctgcctcccgggttcaagcaattctcctgcctcagcctcccgagtagctgggattataggtatgcgccaccatgcctggatggctaatttttgtatttttagtagagaaggggtttcaccacattggccagtctggtctcaaacacctgacctcaagcaatccgccggccttgacctcccaaagtgctgggattacaggcatgagccactgtgcccagcctattctgaatgttttaactgaattaatccatttaatactgatatgaactgtgtgagatagaaagtaaccttattttacagagaaaaataaaattatgttataggattgccttgtattgaaaaactagtggggggaagagatgggattgaaatgaaaataatctaacacataaacttgtgtctttattgctacttttattgcctctcctactgagatgtaatgtccctaaggaaaggatgattttgaatgttttgatgtcctccaagcacttgacatgttgtcctggcacagcatgcatgttgttctttagggatctcccaatttatttgaggagattcaatgtgcaaggatggtaaaacataatggcatttataaagccccactctggtccaagtattggattcggtggcttattggcctcattttatcctcaaactgactttgaaccataggtgtgcttacccttatctataagtcaatcaggcttcccaggtatcatacagaccccactccggtgtgtttaaacagaaatggaattcattaaaggtagttctgagaatttctaagtgagctggagcatcatactcagatgattcttggtcaagttcagtgcccaacctcatccccaggactgcatacggaagcggcactacagctcgtatggctaacgctgaacattgaaatcactgacactgtttttcttggcatctgctggctttaccacaacccttgccaggaaatagattctgtttcctcacttccaaattgaagtcttccaagagcgcatctgattgatggaggcttaggtcaaacatctgccttaactgcaagggaagctgaaaaaagtgtgtgaatttaaattcagagaagcaagacttgtaaactgagggaatttcctgattacaggaaagatattaaaaagtgctaggtttgggggaaaaaaaaccactttgtaaatatccactacacttccattttacagatgagaagactaaagctcataggttagatcactgagtgcatatcacgtgagtagtaagcagaagactgagcatatagaggcagacctgtctccccacacaaagaaataacaaagcgatgagaggtttcaacagtcaatagcagagcagttcaggggaggaaggctcccttccgggtgcggtgatcacaaaaggcccaagcaaagtaacatcatttggacagctccctagaatcctcatctcaaggctgtaagaaaaatcttaggaatgatttagtgcacattcttcattccacggaggaggaaactgaggcttgtagaaaagaattgctctgcccaaggtcatagcctctttgtggcaagtagctgaaaacccaaacccgtgacagtaggtccagtgctctctgcagcaagccgtggaccccacctgctaaatcacatctctggcagaactgtcgggcagactttctttgaattgacaaacagaatgggagagaaagtcacgtgcttcagtcaaagcaaaaaagaaaagcttttattctgtatgtggtttctcatagaatacttctcgcccagctgcgcccaagtaggtaaaaggctcttgcttatgctaaggagcctttcttatctctgcacaccccactcctttcctgctaataccaagtacagaaggcaatgaaagaaaaggtcacctgccttcctcctaatgggacactgatgtttttaagtgctcacgtgatctgtcccagaaaatgtcaaattgttcccttataactctaagttggcggttagttgagtggctctgttgtccagacaatggatccactcaatttttgcctctcatttgaacacccacatttaaaaaaacttgggaagaaaataatggaaaagttgacctctcagttttccggaaaaggtgaccatacaaatgtgtcttttctggctgtaggctttatgaaacttctgagaagaagcgtggtattttagataaaaacaagggtttggttgttagactgtcctgtggttgaaattcagctctatccttgctggtgtgtgatcttggacaaaagacttaaacttcctgagactcagtttgtatgcaaaatgagaataattataaatttgtaggggattagaaataatgcagattcttgacatttattatggacttgttatacatgaaggattattagtttcactctttatttcattaactactttgacttaagctggtctctttgatgaactttcattgactctctggtacttgacatttgtataatattactttcaaaaatgcattagtaggctgggcgcagtggctcatgcctataatctcagcactttgggaggccgaggtgggcagatcacctggggtcaggaactcagatcaagaccagcctggccaacatggtgaaacctcatttctactaaaaatacaaaaattagccaggcctggtggtgcatgcctgtaatcccagctacttgggaggctgaggcagaagaatcacttgaacccgtggaggttgcggtggaccgagattgcaccattgcactccagcccctgggtgacagagcgagacactgtctcaaaaaaaaaaaaaagaaaaaaaaagcattagtaatatgttaactcatattattttcagcaagctttttaaaatatgattttgttacttttttttacagataaggacactgcattgatgagtccttaagtaactggtgaccaagatggccttaatgtctccctcagcttgactaaggtttacataggtttctttttgactctaggccactggcttcttttttcttagataatttacttaaaaaaaaaaactctgcaattgtaaattatttctctacaatctagagatgtctttctcaaggatttgggactaatttccttgaagtcatagaagaaaataagatgcctatcttcctatctttgggagggtagaggatccttagacaagtgacagccaatacaaatggcctaatcacattgaccaactacagtagtcctcccttatccttatccgtgagggatatggataattcatttcagtaaatgcctgaaaccacagatagttctgacccctatgtctattacacacaaatttctttttccttcacaatttcgtggatagaagattcattcttaccctagattttagcaacttcagcatacgatttttttccttaactagacaactttcaccttttcacccaaaggaaatactttatggcttctcattggaatattcaaattgccagtatcactactcttgtgctttggggccatgattaaataaaataagagttacttgaacgcaagcactgcaatacttcacagttcatctgataactgagaagactactaagtgacaaagggaggattcatgtcccaagcaggaaagagtgggccagggtaagattttgacatgctacgcagaatgccatgcagtttatgacttataaattgtttatgtctgggattttcctttaatattttagatggcagctgaccacagataaatgaaactacagaaagggaaaccccaaataagggaggactatggtatacctctaccgtcttccagtacttttccattagctcatcccagagtttaaaactcccatttgtttttttttagagttgtgttcaccctttctctttcccattgcaataatcttgacctctactgaaatagtccagaataaaacctttcttgcctgtctaacttgtctgaggcaatttcttttacactggcccaaagtcactgaattagacaaggtaaagctaagatttttagtcaagtcatttgtgtttttctcatatggacttaagttgggctttaagaccaagactgcagaccaaatttttattctaagaaaggcattatcctggaatcacaatctaactaaaacagcctttgttttctcctctgaaaagtgagaaagctggactagattcctgtctcacagttggatcttggagatccttcacaagccttgatggactagggaagaggggaccaaaagaggcctgactgggggctccacaatcatgcatgcttaataaataaataaaataaattggggccatatgttgacctcatcaagaagggtggatgctgctacaagtaaaaaaatggaaaatcactggattctaacatttatatggcctgttctagctctatttattttttatttttatttttgtgatggagttttcactcttattgcccaggctagatagagtgcaatggcacagtcttgactcactgcaacctccacctcccaggtacaacaaactctcctgccttagtcacccaagtagctgggattcaggcatgtgccaccacgcccagctaatttttcctatttagtggagacagggtttcaccatgttgctcaggctcctctcgaactcctgaccttgggtgacccacccacctcggcctcccaaagtgctgggattacaggcatgggccaccatgcccggccttgttctagtaacactagctccttcctaggacatcaaaacaaatccagcacacctgtcttttcctcagagcctgctttcaaagttttatctatctcacatgtttacatgtttatctaatactgttgctgataagcagatattcagtgagtaggtactcctcagacactatctatttacattttcattaaacaggatctactttggagataatttccaagtcaaaaagaagaaaagcacttaattgataggaattccagatccctgaactaggatgacaggtgcaattggcttattcactcaagagttattgaatgcctactatatataggattcaaatccctgcattgtgtagggatttcaatatagagttaaaaaaatctggcccgtggagaatacaatctagtaaaagagatttgctatatactcaagcattctcaaaatcctaaatttaaggaagaagaattgctgatttagctttttggagttttaattcaataagaataaacacaaactatgctcaaggtatcttaccaaaccatatattacagggaataggagatgagattcacagaagcaggaaagattgtttacctttatatctcttctctccttcaactctctacttcacacctatcttcttcatagcagggctcaaaacatggctattaaatgcgtaagtaaatatttaataactacttcctgcattaaaattatattacatttggcaaggcacagcggctcacacctgtaggggtcgcagcattctgggaggccgaggcaggcaggttacctgaggtcaggaatttgagacaaacctggccaacatgacaaaacccggtctctactaaaaaacaaacaaacaaaaacaaacaaacaaaaaacaacaaaaattagccgggcatggtggtggatgcttctcaggaggctgaggcaggagaatggcttgaacctgggaggtagaggttgcagtgagctgagatcatgccattgcactccaggctgggcaacagagcaagactatgtctcaaaaaaaaaattatatatatatatatatataaaatataacatttaaaaagaaaaatttaaacaaagtttgcaataatttatcccccatgttttacaggttattatacttttccaaattaaattcaggattcaactgctaatcttggcttgagcaagacaaatctattagcatgccccaggcaggtttatcaaaaacatctttttactattaaagcctcaacctacttcagctacaaatccctgcagacttacttagcataaggcactatcatttctatcttcattacaacacagtttaattatctgccttagaaataaggttcttcctcttaatgaaagtggttagtctggtggctccaaagggcacaaggcagtttcaaggcttaattctgattatatatgcaattacaagttagaaaatatgcttgaaagtcaatgaaagttctttcatctatttctccagttagaaaacataaacattggttggaacgaagattttgttgttgatgttttacttgtctagagcattgcttttcaaatttgaagatggcgcttccaggtgtcacttagtgtcatctgatgtcagttccatcgttactggggttcacatgaaggtagtggattcacagacctcagtttatttccaggtatagtaaccatgtgtccaggatagttatttaagtcccatgggtttaactttctcatctggagtcctactttttggggttggtgatgatatttaaggaaataataggcatgtgattggtgagaatgttagctagtaattatattacttcacttaacttctcccttccaaaactgcctattctaagtgtttgcttcctcctgtcctgtcgtcagccatatttctaacatcccattctcatctgaggaccatatctcctgtgtcactgagaaaaggagtcaccagagaactccttctagttttctgtcttctaacaccaaactttttttttttttttttttgttttgagtgtctcattcattgctcaggttgcagtgcaagtggcatgatctcagctcactgcagccttgacctcctgggttcaggtgattctcccacctcatcctactgagtggctgggaccacaggttgcaccaccatgcccagctaatttttgtgtttttagcagagtttgggttttgccatgttgcccaggctggtctcaacatcctggactcaagcaatccacctgccttggcctcccaaagtgctgtgattacaggcgtgagccaccacgcccagcaaacatctatattttctattatctttccttctcccttttcatctttaaggaatttggaccccatattctaagactcatttctcagcctgggcttttgcccaactcatttgaccttcatccagaccttctccatcatttttccttgcttcttttagtgaaaccttgcactttctgctcactctggttcatttccctcagcttcaaacattgagatcatagtagccagattcagttcacaaagcatccttcacataaagttttgctaaggaaataacaaagatgtgtacaaagatttttgatcaaggatagccattgtggaaatatagtaggaagcattggaaaatgccccagtggtcaacaatataggttagctaaataaattagggcaatattggttagctaaataagatggggtgttttagaaaaatagaaaatgttatgggaaattctttagtcatgggtaaatatgtcaagctggtattaagaatcatataaatgcatgtgatgtctgcaggcaggcacatgtgggtgttatgcattgaaaaatgcatacatgctatttctggcttgtgagatacaggctaactttaattttctttgaatttccttgtattctctaaacttcatacaaaaaaacttattttctttctataataggtgagaaaacaatgttttttaaaaaatgcttctttgcccttgtgtcctttcaaatgtcaactcatttatttctttctcttagctatctttctccttaaagtacagtttacataagctacctccttccacttctttcctgattatttacttttcaatctaatgccagttcattgagcccccatcatgggtcatgcactgagcaaagcacagagcaagtcactgaggatacaaggatggtggtggctgaaaaaataatgtttttttccatcaagagctttaacaggctgctaagaaatgaagtactctctccgttgaatctatcccaagaaataagtccacaaagaccacaaatataccacaatgtttatgataacaccagtttaataagtacctaaaaatgtaattactgaaactctcataaatctcacttctgcatcattccaaaatccataaacaaacacaaaaatgctcttaaagtaattccagattaataacatgaatcaagcttctagtactagagtttatgactagaatcctaataatagtttttcattgatgttgcttaaaaataagaaaaaagattgatttatagtaataacatagatataaatatctgtatccctagagttctgctttgcaaatattaaagaatttttttatggtgagaaaccaatatacatttattagataatacttgccaataagtaaaaagtaaataaaataagaatcacacatatatatgagtataaattaatcattttggagtggaatttacagcttcagtttttacagatagtttctttctttctttcattatctgggttaaacaaaggaagaagaaactactgttggcaagttgcaatggcttctttcctctaatgtttatatgtgtgtgtgtgtgtgtatttgtgtgtatatataatatatttagtatatttgtgtatatatatagtatagtgtatttgtgtatatatatttgtgtatatatgtgtacatttagtatatatatttgtatatacatacagacatatatatataaatcttatccttatgtagtgaatacaatactatgtgaatacactatgattatgaagtgattatatagtaacattctaatctcctggttatgaaaaaaatacttaaaagtttatactgaaaggggaggatgtgttaatctgttttaagtttaggctacaggcagaatatgacttctcccaaccaaaggcaacattcttgctaactttagtatatgttaggtttcaaataccaagaacagaacttggaacaacatggacatttacagggcaatcacagtaaaacctgctgcagtagaggcacctcagatggatgcttaaccagccttataggtcaggaatatcctcctgagggaaatagcataaagacatttaagctgagtcttacaatgttagctagtctgagaggaaaccaagatagggtgacaagtttttttttcccacttaatatcatttgattaagtgtccttgatttgattaagtgtccatgcttggctccaaacatggaaactgggaagctaaaaaatagtcattctctagacattaaagctgcagcttctcttaaggctgattctcagtgatattttagctcttgatcacattaccttaccgggtttgatcatctctaagattctactataggtgggagtatcacatggattgcactgactttcaggatctttggattctcatccatacgttcatgcatccatccatccatccatccaaaccatatgtactcatatgttgaaaggggtcatggttgataccatggtataatgagctgtgaagcttctccatttagggagtttttcatgtaataggtagggctaagtcgagtgcatgtggcaggcacaagcagaatctgcagaagttctgagagtccatgtaatcgaaacagtctcctctttgacaacaaggcagtttttcttctgacttcactgcattcattacataccattactacagatactgtaattctttcctttgggcctttaacattctctgtgggaacattatttatcaaagagtaaaattttgaaacttaataaaacaaacataggagagattcatgactaacactggtacaatagtgcccttgggtcaaacatttgctttactaaaatgccaaacagtctccagtttctaccaataaaacatgacttcatttgctttcagcactgttggaatgcctctactatagcccttagtcagaggagatataattatgactatagcttcactgatattggatgttataagtggacattcagaccaattagaaagaggaatgtctgggaaagaacagtcaagggaaggaagactgttggccttgcaacaggagacctagccaagggtatttgacacattagatgcaggatgcctagtgaaataccttgagaaacaatagtgaagctatgaattggaaggaaacatttcagcagaagcaatctgaatgatgcacacgatcatatcattttcttgctcaaaacaacccagtgattcctctttggaattagaataggtctcttcagggggactgacagcatccttgcagtccagaccatacattttctttttccttactttcaacttttcctcttttccctccccctgtcctttcctttcccttcctttcctgtctttcttttcctttcctttccttctaataatacatttaaggggtacaagtacagttttgttacatggatatattgtgtagtcatgaagtatgggctttccatgtaaccatcacatgaatggtgtacattgtacccattaagtaattttctcatctcccaaccccctctacccttccagcctcacatccttccaagtctccaatgtctattattccattctccatgtccgtgtgtacacattattttcaacttcatctattccatattatcttcttaaagtgttttaaaaaattatttttaaattgttaaaatagtatatatagtatatatttatcatatgtaacatgatgttttgaaatacgtatgcatcatggaatggttcaagagagataatttacatatgcatgctctcattttttgtactgagaacattaaaaatctactcagcaattttcaaaaatatgttattaactgtagtcacattgtttgcaatagatctctaagttattcctcctatctaaatgaaaatttgtatcctttcacttacatctaacccaccaccactcccagctccagaccctgttaatcaccgttttactttctacttctataagatcaagtgttttagatttcacatatatgtgatctcttgcagcacacgtctttgtgtgcctggcttctttcactaaacataatgtcctaaaggtacctacatgttgttgtaaatgacagaatttccctctttttaaaaggccagatagtattctattgtgtatatgtaccacattttatttatccattcatctgtcaattgactccgtagtctagccattgtgaataatgctgcaatgaacatgagtgtgcaggtatctctcttcaatttattttttttcctttggatatatttattttcctttggatatatacccagaagtaagatttgctggatcacatggaatttctatttttaatttttggaggaactttatgcagttttctgtaatggctgtgttgtttttgttttttttttttttggtttttggagacagagtcttgctctgttgcccaggatgaagtgcagtggagtgatctcagctcactgcacctctgcataatggctgtaatttatatttccaccaaaagtgtactagggtcctccttttttccacatatctgccagtacttgtcatcttttgtctttttgataacagccattctaacaggtgtgaaatggtatctcattgttcccccccattcttgttccctgatttccaattgcaggtcttatccttctgctccttaagccttcccaggcattcctcttgccttggaacttgctgttccttctacctgggagtcttttctctgatctttacaatatggattctctcttatgtagatcttagctctaatgtcatctcttcagagatacttctggtcaccctgtctacagcagcccctcctttcctctcccttctcaggccatcactctctattcctttgcaataattgattttccttatatcgtatctcactaccaaaaattgttgtttattaattttcttgtatattgctgcttgttttcttatttattgacaggcagtacaaagcagtggttaaggataagaataaactccagagtcagcttgggtttgaatcccatctctatcactatgcaggtgaccatggcaagttacttaatttccctatgtttcaattttatcattaataaaattgggataaaaatagtacctgcctcataggattattgtgagaattaaatgagccaatcagcataaatcacttagaacagtacctgaaacatagtagcactaaataaattgttattattatttgtcttttacattagaataacagtaagaatcttagccctctagttcaaatgctgaattctctagcatctagcatagtgttttgcaatagcagatactcaatcaatacttgaataaatgttttataggagattgcctagaggaggagaagaaattttcaggggactagatctgaaaaagcaatttaagtcacagatgaaaagaaattcgctattacgtaatgaagacgagagatgggaggggttgttagcacaattagctgtaacctggtattaatgaggccaaggtgataggtttggcacttttgtgtgttccacttaggttcgttctctgccatgatcatttgttctgcatttgtatggctagtcagctgtcttatgcatcaatgcccacaatcaggaagagagagaacaaagaaatacatttatcaattatggctaaggaaaatccatctgaaagtgtcttcctgataaacagtggtgattcttggtgttgtcaatatggcatatttcagtactagctctctactgagttcaaaccacctagcacaggtgatctcatactaataatatttccagtgcttaaacaaccccctcctgagatggaagttgggtttgagaaattaggatgagcattcccaatttcttctcccttcctgaaatatttttggttgccaccaggtggtactaggtaagcacatccgaacaggacaatgtagttttattatacaaaagattgccaagagttgcaaaaaaattcctacgtataacttctagaaagattactattgtataagacagaatacacttcacttttggtttagacttttaaaacaatgtttcatactatctaatattcaaattgtgctaaggtttgggagaagactccatcttcctatgatgaacgctttcattttggagtagcttttgtcttaagcaggaattaaaaatcctaagtcatgacaatttcaggtctccagagaaagccttctcattttcccttagaaatttacttggaatttcgtcaggagttttcttcccctccttttcttctttatcttcctcttcctccttttctgctcattctcctcctcctactccctcttcctcttcttcctctctgtcctcttcctcttctttttcttcctcctcccttttcttcttcttcttcctcctcctccccctcctcttctcctttttctctttttccttctccttcttctaatctcctattttccttctctgcttcatagacacgtgcttttgcctgtcttagtttactcatctgagaaatggggctagaaatacatgcctaactaggttctttaaatgtgaaagcatgtatttgagtgagtagtcagtaaaagatagcttgtctttgtcatcatcattctaatggacattttcaactaatccttagggtcaaaattattccagttcattttctttatttgataggattttaactgtctttttatccatttccataattggcaaatgagttcacatgaggcatctactgtatcagcatgcagctatgagaagaagcatcagaaaaaataattgccactgcctgggcacaaatttttccctccctgtcttaacaaactgctttatttctgaccccttaactacagtgtttcttgttcaatgctgagtacatcttgcaaaccaagcttgaaacacagacctgctctctatcctagagagtaaccttctttctttaatctgaaacataaataacctacctcttatttccaggtgaatagctgtctatttctatttgactttctgatcatgtgtccacttttccaagcttatatcctcaatatcccttttacaaagatttaccctgtctttccttttcctctgagtataatactattttaagaactttctgctcagaacttttattatcctgaagactacagccaaattgtcataaggaaacagtgactttgtgaaagaagtatgtacttttcaaagctcaactccttgtccagacacatctggcaacacctacaaatactgtcagctaaggctcctgctgtggtcatagaactacagcattatctcagagagtctgtaaagtcctcttattctggggaagtgggtaagaaagtcgaagtagggatggaataagggaaagagagtgtagataaaagaaattctcctgaagagtatgtcaccttttcaagcatctctaagtgaaattggttcagattcctaatcttacatacaattcaataattaaagaagggttaagataaattcaaatcggcatcacttatgcatttaaagaacacgtacaattttcctttctgctttctcaaccctttttaagtttatttgtttatttttgagacaggatctcactctgtcacccaggctaaagtgcagtggtgcagtcccatctcacagcggccttcacctgccacgctcaagcaatcctctcacctcagtctcccaagtagctgggactacaggcatatgccaccatgtccagttaattttttaaattttcttttgtagagacagagtcttactatgttgcccaggctgatcttgaactcctgggctcaagggatccctcatcccaaagtgctgggatcacaggtgtgagacactgggcccagctcaatctttttatttaatagcccaacttcacaggatttagaaaaaatagtcaccaaatatcctattttagggtagcatgagcattttctttttcctgaactccatatgtttggcttaaggcaatgtggatattttctcattttattttattctcagcaatatagcaagaagtaattcatttattttgttaaatctctaatgtatagcttagctgaagtcaataaaagtcaaagttaccattcacataggctatggtccatttctgacaatctcaaaaccatgccatggcacttaaaaaaacctgctattttatatgtatacttaggtttctcattcaaaactaagcaaacatggaattcaaaggaagttaatcatgtgtgactgcagagtggaaataaaatgaaatttctaatggtaacaaatatataatcagatcattaatgtttattaagggcaaagggacattccaaacactgcggcaaattgtaaagtgctgtaacctctaagagtgagacctgctctgtcatcctcactgagatttctacctaattcgttaaaattcatttttgtttattttaagtatgcatacttgccctctgctaggaacagagggaaatgcgtgaaaaggttaatggggttttgattacttgaatgggcagaggagaattccttgtcaggagcacattgcctgtaggtcaaactggttacaataatgccctatggttttagggcatttagattctccttactaattcttcagaatcctcattttttttttctgcaggtatttttctctgcctgcagatcatgcactctctatgctcaatacattctgacaacacactagtcctgctctaattcacctgagacaaaatggcagcaaatacaaaataaccttccaggctggctcgaaattagcataggctctgtagcccaacggccccagggctgaaaactgtaccctttactagacagataactttgggaaagtcactcaatttttctgaacttcagttttatcatctgtcaaatgggtctaactatcaataatgacaattgctgccaattcccagttcatcaggtagatgtgacagtaatatgagaaaacttttacaaatcatgtagcacatagtcaacagatcagtatttactaatactacttaagtatgtggaggaaatgcttgtcatatttaataatttttagttatttatcttagtcatgagttttgattattgacaacattgctccaaagagttttgttttaattgccttacagatgctgtgttataaaggaggacagttttgtgctggagtgaaggataaacacaggggaaaggcacattttcaaagcagcaatctcttgactagccatatcctgctttttactcacttaaacctctaaatccacagctgcaagcaaccaaaggccacaagtcccaaagaagcaatctaatcaaagaaaacattgaatcaaactggcttctctcccttctcctcaactggcatgaaaaatgctaaaggtggtaataataataatatatttaacatttctcatgttttttgtttctaaaacatatggtttcttgctacatgtagagaattgctaagacattcatttcagctttcagctcttgcaaattaaacatacgttgtgtaaaaactactttaaatgaatgatttttgaaatgaagttttaaaaagtactctttgagagatgaactcccttttttccatatatgtatctggatttctttatgtcttttttgagtagcatcccctcacaagagtagcatcccgaaggaaacttcatagcattaaccatcatggtaatagattaattactaatacaagtatttgtttaaggtctaacttattaactagagggtgagatctctaacagcaggggtcctgcctgttcaccacttcatcatcaaaatctagaaaggagctaggcacatagtagaacctcaaaaaagtttggaaaggcagaacaggttgtggtgaggagacagctgtagagttagaaagtcctagaattgaatctgaataaaaccttacacactctttgcatacttgggcaaaattcttaagttccctaatcagtttcctctttgataaaataaggagaataatacttatgttgcagagctattgtaaaaagagtaaaataataatgtatctaaagcatacagaattatacctgatgcattccaagtgttttataaataattgctattataattatcatgattactgtatagtggatacatgtagaattaattatttaatgtgatgctgaggaccaggccttgactattgagtctttttaaaggcattgtctcccagtttcccatctgcttcacagctccatccatatgcctttttgaaatacacatccagctcctggtcctttttaaacttcgagaaaaagcatcttatgtcatcaaatgtcaatgtaatattaaaggcatttgtatctctgtttaagatcccacatctgttatcagttaatattttgagagattcttactagcagcagtttctgatccatgccataaaaaatgcttttcataaaattgtgtacaaaacccacttatgttttaaaagcccaatgatagctcactaagtatagtgatttcttcaacatgatgttgtcatctgataggtgtgtagggaagcaaagcacatttgcacttgtcctaagaaataaaaagggtccttctgaagttcatttaactcaacttttctattctcctcagttaaaaggttttgccacttgagagtgaaaaattatgaccatagaaattacattttagtaattactcagatttataaaatcatttttcaaataccaaaggtctagtaaaacattaacattcagggatttcactttcccctttatttctaaaatttgcattttatgttatgccttcagcttttctaatgaggattcaaaacatgttcatcatcaaaccattgatgcatctggatgtctacaactttgtagtttaagtccatcccttatacagtagataactattgaagaaaaccaaaactaatgtaatctttgtgaagaaacagggtttttttcagaaatatgagactagagacccaaagatttcaaaatttctgtgggagtgttgatggccgtggccatttcccactcctgaatactaattttgcatgttcccaaactgcaattctttggagtctcttgagtcatcttttagttggtaatattgttgttgcttcctttgctaagtataatctactaaacaatcttggagttctgattacagaccactgcagtatcttttaagtaactctgggaaacatgaagcctaatgttttggttcgttagtattggttagtattcattagtattggttcgttggtattggttagtattcattagtattggttcgttggtatttggttcagcagtattggttaatatgatttcaagtatggaggagagcaccgcccaacaagaatgctgtgtgtgccacacctcccttaccatttgaactaagtgcaacctttcattgtttctttttgcgagtgggtgggggggggcactgagggtgggagggcaactcctatgtaccagacatggaatcaggtgctggagattcagtgataaaccaggaaagatgaatgaaacccaaaaaccaaactagaaaggttagcaaacagttatcaaccaacattctaaaccccaatggctttaaaggtaagtctagggatgttgtactttatttgccatctcttaaaaaaggaattaaaaaatacaagaagaaagaaactctaatggccagtagccataaaatctatttacatattcttccacctctcaagtctcatgcaaattaatgtgtaattacatttagatggcgcagctgctctgacactctgctcccagcttttatttctgagtttcaaaggtttcataaggaaaccttgaaagaaaaaagtaaatattttgaaaaggagttacaatttgtcagcagtaatccttccctggataggcaaagaaaggcaaatcttggtagatgagagaattgtggcttttgaaaataatagcattacactgaaatttaatctgctagcgttattttttccaagcaaaccctctttgcattcaatttgtcatttattacagtaagaagcaacagggtccaaaagagaattgtttgcagtaagcacagagatattctcaacaaaggtagaatttgatagcatgcacaaaacaacacattacttatccagcattctgagtcaccttttcagcaaagaaccttgtgtatttgatagcaaagggagaagaaatcgtgtttattggaatgttaaaatgcgtgatagggcggacattctattttaaagaaatatgagactggaatattgattctgccacatacgaaggctggaaagtattcataaatgatcaattgcctatagtttaatgacggaagataggcattggtttcccaaacctttttatgctacaacaaaaccgcacaccaagccctgccggagggtgctgtataatcatcagagccctttctgagtatgtcaggatgatgcgccctagtgctgaaagatggtggttacatgagcaacagaatgctagttagcaaggcaatgaggagctgaggtccacattaaccatggtcggtgcacctaatcatgaatcacagctgtgccacccttggcagatgaacaatctcttacagataagacaaattttatctgggatcagtatagtcttttaaatgatgtatgaaaccaatttaagaaaggctgagttattccaaatagtatggcttttattctttatttgtcagtttcatcattccctccttgctgactattcagatacatgtaaaggagacagccaatggtttggcacatagttggcacacaatgaatggcagagatccttgtttgtgttagtattttgattatttttcttaccacaataacatgacctgaaccatgatcaatctgtctttatgcttccagtagagatcttgattcatagctctccctaatattaatccatttcatattgttttatattatagttaacatgaattgattttgaatcctttcctctagaagtataacttgtttgagacacttacaagcagacattcaattatattcagagggaaaatttataacagttcaggagaggaatttaactgtcatgtattccaccagcaggtaatgtcagcattttcttatagttaaatggcttcatcaagttactctattgctttaattctaggatgccatcaattttagggcacattatcagttgagtctcaattcttttacactcttgaggaaaacactccatttaaggtatggattaattataaatgatatcctggtttagaaacattctaagataaactgcatttttttaaagttgaaattgatagtaatttgtgagcatgacgtaagtgcacaaaatcttacatgctttatggtctttaatgttgacttaaaactataatatcaaaagagaaaaattaacagagcctaattactctcaatttataaaggacaggtttcattttcaatcactctccagttttctcaggtttcttattcagccgtataatgtcaggcaggatactaaccagattaggctttatcctcatatctttgaaaacataagttccataacaaaattttccctagaggttacttccagtattacagcatctaagtgattcattataagcactgaaaagggtcacatgtattactttattcatttaaatgaaaagaaataaaaaaattctttatttaaaaagaaaaataatggcaggccttggccactcatgcctgtaatcccagcactttgggaggctgaggctggaggactgcttgaacccaggggtttgagaccaacttgggtaacataacaagacccacacaccaccccccagccctgccgccccgtctctactactactactactactactactactactactactaataataataataattagttgggtgtggtggcacatgcctgtcgttccagctactcaggaggctgaggcaggaggacagcttgagacaggaggatgaggatgttgtgagcagtgattgcaccactgcactccagcctgggagacagagcaagaccctggctaaaaaaaaaaaaaagtctggttgtttgttttagaagagtaataatgaagactcataaatgatcacagcctaggaggccctacaaaatggctgcaattattctgctgatgttggacaagctattttttaggatcaattagttaattgtgtgttgctttaattacttacactctttttaaagctttctttgtgtcacagctgagctcaggagaaaaagtaaagcttgcagagcaattctttaagtgtggatgtaaaatatactaatggatttacttgctagctggcacagtgtttaaatagggtcctgctcacgctgagaaaaaatattttatcagcacctgactccaaagagtcaagaatatggagaaactcacatttctctcatgatgggtaatttctgggtatgcaaagctccctgtagcagtcattcagtatggatcacttattgcaattttaaattttttttttttttttttttgagacggagtctcactcttggccaggctggagtgcagtggcgcaatctgggctcactgcaagctccgcctcctgggttcacgccattctcctgcctcagcctcccgagtagccgggactacaggcgccagccaccacgcccggctaattttttgtatttttagtagagacggggtttcaccatgttagccaggatggtctcgatctcctgacctcgtgatccacccacctcggcctcccaaagtgctgggattacaggcgtgagccacagcgcctggcctaaaatttatttttaaactacaagaagggaatggcaaagtattacatgtttcttaacatgcatctagtcaattagcaaagcaagtcaatcgtttaagcttttcattgtgtaaagggggaggttttatacacggcaatttgaatggctatgcctagaacacgtggaagcacagagaaatttcaaagattatgaacaatagaatggcactaaagacacttttacaaatgttgctttatcaagtgggttttgttttcttgtttttcaagaaaaacagtcttccttactttaaatgtttttttcccataattctgtttactattgataagaatttaatttaagcaccaatgggcaattatggttttctcctcaattgattatccaaaatgttcaatgaaaaatgtttgcctgtgggtcctctcacatttttgtttataacctatgactcctgccacttccatacaccctactagtctctgcataaaaatgaggtttattgacgattggccatcacttaatacaggtacttgatgaatgtgtgaaaaataatggatgaaagaataaataaatgagtaaaggaatcaacctctatcttaactcagccacaagtaataaacaatctcgggtcctaatggtctcagtaaaaatctatataaggtctcctaacttcgaattattttcttaaattattatttgtccataggtgtggtcataccttgtggccatgttcctgagacagggtaatcggaatataagtggaagtggcatagtctttttccaaatctagctcatgagaccatcccacactacccccatgcgctttgccttcccttctctgcagcttgattatcaatgcacaaactggcattggagctcatgcattaaagatggtggaacatcagtcagcccaggttcctgaatgatagcatgacacagcgaaccctgctgcaattttggcctacagaaacaaggaataaacagctgtcatgttaaggcactgttatttcaaggtttatttgttagagcagccatttttttcttttaacacacgtcctctgctttcactaagttcccactcaccaaagggttttactcctactattctaatgatgtcctgtgaatcctgacccatgggttagatctcagctcaagtgtggcttctcaaagggaaacttctcttcctccttaatgaagtcatttctcctctatattctcctgggaatcacatgaccctactccttagcacttgtccaggaaatcttcattgccgcaaatgttctctccctcaaggtcattgatgaggtacagatgccagtcacttcaggagctgtgggcatcacccaggaggccagggcagcaatgcaggtgagcacttatgaaatgccccttaggacacccacagataactgaaggagatgactgccaatgcaattcaattgggaatatatgtgtactcaaatattaatacagataaagtcttatttatgtcagcaggcttctaaagttttggaaagttcatgtgacctaggtttgccgaataaaagacttagcaacaatatagtcatctattaaggagctaggaaaaattttacaaaatgtctcagcactgatgttcatttgtgagcccaggtagctcagatgcactgtgcattaattttaactgcatgtgtgttttatgccattggatcttcaaaaggctcttattgattggacatgtggtagaaaacagaggcattgataaaaatggaaacattcagtgccattcaagaaatcaaagaaaggaaccaataacaaagttatatttttattttgttatttaattttatttcgcttttttgccttgagggtgatagttattcaccttctacaagaaaattgccttcactttgattccaactagaacgcctggttgcaatggctcattaagaatgttgcaacttctttccgcccaagtagactctcaattctcctctttgctgaaccctgaggctactcatgagggttacatgagtaacccagcaacacccagctggctggcttttactttttgtcgagtaagcatcattcctgcaaggaagcagtcagcgaccagatttgggcaactcaagtttcccggcttctctttttgtttttcatattttgttctcttgatctcttcctgctcatttcttacaacaaaaactttgctctggaggcatggacttcttaaagaattttagagtattttaatgattaaagtagtatacagtattacgaatcttcaattagtgaagcaaaagttatcattagtccacaagctattttagcattctagcttattatcacttaacgatttcaatgtttccttcctgggatggcaataatggcatgtttcattttaatagaacacatgttttctgttcatagtgctgatttaaatttgtccctccttaattaagtcattctatctaatcagctttggcatattttctcatagtaagtatttacccttttgcctttttgatggagtggaaatataccttagtcattcaacttgataggacacaacctctttaacacaaaatgataccaccccaggaagaaccagggatttttatcatttactttacaccatgcagatgcctcatcttagcaagactttcttactttcgaggatatcttcaaatttatctgtgcaagactggcttcatgggtgtgcaacctgtataacacacagagctccgtgcctagaatgttctgacacttggtttgctgttctgatattgccatcaataaattcttaacaatatttgaataaggaaattatattttcactttaccctaggccctttctgtactcaaatacctatgcaaggcaaagatgtagattcaaatttcatataatgctcattgttcagggaaaataggtgtagtcttgtctctttattcaatttaacattgaggtagaaaatacagcacataaaacttaagtgtacactctgatgcatttgtacatgcacacacacacagttgtaaccaccaatcattttaagatacagacattatcagctgatcatctgtctccctcatccttcttcccactcaatctctgcaccttctatgggtaaatattatgctgatatatcaccaaattttgaacttaatgtaaacggaatcgtaaacaatatagctttttgtgcttttttggcattctatttgtgagatttatccaagatctaacagagatgtatttttttaaagccgtataatattcaattatatgaatatatcacaatttatccattctattgcagtgggtgtctgggttgtttctaatatttggttattgtgaatattaactattgcgaacattcttgcacatatcttttgatagatatatgcactattttcttttgggtatataactaggagtggaattgctagctcagagtatgtacttatgtttaactttagtagacatcagtagtgacctttgaatgcatattataactttttgccaagctgtatccatgccttcatcatgtaagatttattttgtcttcaatacagcacgttggattgcttccaatagctcttttaaacgtcacaaccatttgggatagaacttttctctatttttacagatttttttcaatattgaaatttagaggacttacaaccagaccaagatttcagagtctgaaagaatacattgattctagttctgttactagtttagtttccataaatacagcaaatcagctgtatttattgcaaatatatattaatcagtagtcacagaaagaaagagaaagtttcagcagagctccaatccaaattcctggtacatattaaatgcttaattaatgcttgattctgtgaatatgtattaaactgtgactatcctaccgttagaaacaataagaaaaatactcataataaataatctatgtttttctgagcattttaagttattatttacagttctaggaatagcttaactttggactcagttagaactatcatcccaagggcacaagtatgcttgagtttcagtaataagtcaataaaacctaaatatattgccaaaatcttagaatgagaaatcacttatttaacaacttcatttgaggggcaacaatattcttgagacacattttaaaaagaagtgttaacaaggatatatgggcttctgtagagaccactctagccaaatacacatacgctatacatatgagtaattttcagaaaattcaggtaaggacctgaaatccaaattactgcatgttgcagacacttgtcattccaagagtaaaaatgtacaataacattattctcgcttctaacaattagtccaggaggacatgttttctaaactctccatggagccctccttcaaataattaacactgttagaaaaaaattttacccctgagagttttaacctctagagccactgctagcattagtgctccctctgtttacaattgataatgagaacagagagacataatttaattgggagggtaaaggggaatttggaaaatgatcagggtgatatgcaaatgttcgtttatttggggtgaccattgagtgctgtgtcactgtgttagacatgatgtttagtactttatagactttttgtcttctcccatttattcctcacagcacatttatgagacaggcactgtattgtgccccagaggaaggcagtctcctgtatgcaagtctttagacctcttgcttatctgtaaaagtaggccttgggtctggaacacttccttaccaagagatagagtcctcatgacctgcgctggacttaccaccttgtgtggaataactttccctgttttgttctgctggagcctgtgcatcatgtggcacctggtcaaccccactgttatatctatcctcttccaggaggggatgaggtgcttcttctgcagcacagaaagggcacctataggccaattgttctgcatcagcctccaggagggaccttctggctttgggggactgacatgcagtactgacactgacctggcgctgtcctttctctatctgaggagtaaagtactgacactgatctggcgctgtcctttctctgtgtgaggagtaaagtactgacactgatctggcgctgtcctttctctatgtgaggagtaaagtactgacactgatctggtgctgtcctttctctttgtgaggagtaaaaaacatcgttcctttgggtatatacccagtaatgggatggctgggtcaaatggtatttcaagttcgagatccttgaggaatcgccacactaacttccacaatggatgaactaatttacagtgctaccgacagtgtaaaagtgttcctatttctccacatcctctccagcatctgttgtttcctgactttttaatgatcgccattctaactagtgtgagatggtatctcattgtggttttgatttgcatttctctgatggccagtgatgatgagcattttttcatgtgtctgttggctgcataaatgtcttgagaactatctgttcatatccttcccccactttttgatggggttgtttgattttttcttgtaaatttgtttaagttctttgtagattctggatattagccctttgtcagatcagtagattgtgaaaattttctcccattctataggttgcctgttcattctgatggtagtttcttttgctgtgcagaagctctttagtttaattagatcccatttgtcaattttggcttttgttgccattgcttttggtgttttagtcatgaagtccttgctaatgcctatgtcttgaatggtattgcctaggttttcttctagagtttttatggttttaagtctaatataaatcatgctgctataaagatacatgcacacatatgtttattgcagcactactcacaatagcaaagacttggaaccaacccaaatgtccatcaatgatagactggattaagaaaatgtggcatatatacaccatggaatactatgcagccataaaaaaggaggagttcatgtcctttgcagggacatggatgaagctggaaaccatcattctcagcaaactattgcaagaacaaaaaaccaaacactgcatgctctcactcataggtgggaattgaacaatgagaacacctggacacaggaaggggaacatcacacactggggcctgttgtggggtgggggaagcggggagggatagcattaggagatatacctaatgtaaatgacaagttaatgggtgcagcacaccaacacggcacatgtatacatatgtaacaaacctgcacattgtgcacatgtaccctagaatttaaagtattaaaaaaaagacacctgcatgcatatttttatcacaacacgattcacaattgcaaagataaggaatcaactgatgagtggataaagaaaatgtgatgtgtgtgtgtgtgtgtgtatatatatacatacatatatgtgtgtatatatatatacatacatatatgtgtgtatatatatatacatacatatatgtgtgtatatatatatatacatacatatatgtgtgtatatatatacattacatacatctaccatgggatactacacagccataaaaaagaataaaataatgtcttttgcaacaacttggatggaactggagtctataatcctaagtgaaataactcaggaatggaaaaccaatattgcatgttctcactaagtgggagctaaactatgggtatgaaaaggcatacagagtggtataatggaaatgggagactcaaagaagagagggagggtgagggtggttaaggaaagaaaaattatctattgggtacgaggtaggctactctggtgatgcgtacattaaaatttcagacttcaccacaatacaattcatgcatgtaacaaaaaaccacttgtacccctaaagctactgaaataaaaaaaataaaaatttttttttttaaaaaaagcatcgttccatccagtgcctgattgtgttgtgttttccttggtgactccaatattaaaatcaaataggcagaaatgctgatttctacttctgatataggcaagagatgccacttcctccacagtccctactttgcaaaagaagaaactgagtcaaagagtacttaagtgacttgtccaaggtcacccagtgaataagaggttgagattcaataggccagacctattttattcaaaaaaatgggctttaatccacacttttctccctataagcttttcttatgtaacttaccattccaataaagaaggaatgtggaggattcagatgagattgcagatgcctatgtatcaatgagcttcatgaagctttctgttttagcagtatctgttatagcccaatatgctttaaactgaggcactagtgtggcataaagctaactcaaatctatttattgctacaatcaagaggttgacatgctttgagaacattcaagttaaaagaacaggaggtgaaatataatgaaagagaaggatacagaaagaaaggactgaaaatatgattaaatgtcagagaagaattcagaagtggtgttgtagaactcctaagtgctcacacattttcattaatcataccattgcaggatactatgaattgtgatcatctactgcccatttatttttattttgtttttgagatggactctcgctctctgttgctcaggctggagtgcagtggcatgatctcggctcactgcaagctccgcctcccaggttcacgccattctcctgcctcagcctcccaagtagctgggactacagttgcccgccaccatgcctggctaattttttgtgtttttagtagagacagggtttcaccatgttagccaggaaggtttcgacctcctgacctcataatccactcaccttggcctcccaaaatgctgggattataggcgtgagccaccacacccggcccatcacaggtattttctaagttgtaagatctatttcctcattatccttcacacaataaataactacctttataaaatacctaatgtgtgtgaagtatccttgtacatgctattcataactatatcccatcacccatcataattttataaggtaggtaaaactttaaacttcattttagaaacatgatttggagaaaagagaatgcttatgcactattggtgggaatgtgaattagttcagcccctgtggagagcagttggagatttctcaaagaacgaagagttgaattaccatttgacccaacagtcccattactggatatatacccaaaggaaaacaaataattctatcaaaaagacacatgcaccccaatgtccatcacagctgtctgtaatgttggactggataaagaaaatgtgggatgtatacaccatggaatactatgcagccatacaaaagagcaaaatcttgtcctttgcagcaacatggatgcagctggaggctattattctaagtgaactaatgcagaaacagaaaaccaaatatcacgtgttctcacctattagtggaagctggacactgggtacacttggacataaagatggaaacaataggcactgaggaatacaagaggagagaggcatggagcaggacgggagttgaaaagctacctcttgggtacaatgctcacttcttgggtaacaggttcaatggtactccaaacctcatcaccatgcaatatacctttgtaacaaacttgcacatctacccccagaatccaaaataaaagtagaaaaagaaggaaaagatacctgattctttttaagcaatgtggacaaggccccagagcagtgacagtccagggtctggtgctcagatccgtctcagtctaacgattaaccatgttctttccacttgtttatatggcttctatcttattcctctatgctcaatggatctctatacctctagttataaatcccataatgggcagggtaggtatcctgctggctgtgtcactcaatagaaaacaaagagacagaatctacaagggctactaggcccacgcctcacatttgttggccacaataggaatatatacagaggctcttggcccacagcctgctctcctccattgtcacctctagctcagtcctgcactgtaaagatccttgcatacatatctatgcccaccccaggccacaagtccaagctcagttcacatcctccacaaataacgaatacttggctactctcctgagctgtaaccgtgcacacttttgtgcaattcaccattcagagttggactcaggaaaatgactcatgcaggttctgaaaaattggcttgtgccacccacttgcataacagattctgggatcccaagtacctgcaatgtggaatagaaggctgtgtgtgggctctggacaggcaggtctcaccttggccctgtggggaactgcacagcaggaagagactcagagtgaaccgctcaaagtcacagtgcccatggatcttcaagaggtgtgtattgactggatgattggcagaaaaaaggggcattgcaacaaatgagatcattacaggaatcaaagagcccaaatcatagtttttaaaagatttttccttggagttgctaattattcgtaatctacaaggcaacctcagcttattctactttgattccaactgagaacagccaggttgcaatgcctcattaagaatgttgtgatttcttttctgactgggtagacacacatctctagcttgctgaacctgcatgttaccactagagctctgcctctgaaaggcaaggaattgccctgttcttgcccctgctggctctcactctgtggggagcaggcactgcttctgcagggatgcaaggcaagtaatcacacatccttctaagaaccttatatcagatactatgcccatgatgcaacttcctatctatgtcttatgaatgtcttaaagaattttcataaacttgaatgatacaagtgatatgaggttagagggaagtcagaggtggtggactcacttacatttgctgattaaatacatctcagttttctgttttggtaataaaaattatctaaagttcaactcccgggaagggctgcttctctttttccccttctccgtcccagaatggctccaggtacaggaaaacacctactagtgttgtagatgaaatgagaatgaaacttgcattatgctcatcgctgggttggtttccattgcaaggcatggttgttctaatcctggaatgtgccccagtcggtacttgatgagggctagtgggcaggaatcccttttggctgctgcctctactcactttgaatatacttctattttgtatttcctccactcttcctatttttttttaagagttctctctctttaatgcatgtgcttagttcagtccaatgaaaggggaaaggattgaatctgatgacctgggttcactcctagctttactatttcccagctatagaatattgggagtccctggacttccttgagacttagtttgtttctctgaaatataagggcataatgtttgtcctttatacagcatagatttaaagatcaaaaagctgtagtttttttgtaggtcaaaggggctctgtaaatcgtaaagtgcttgcagaatggtgaagtggaaatacggtgggattaacgtttagatgacccagccttaaatccaggctctgccaatgattggttttagattcctaatatttagaatgactagataactttgactttccttagaggtctaataatccatgaaattaaaatttcaagtattcaaaaataatttaaattcaacctctgagtcaggaaatgaaaactgatctctttagatttcaaggttttaaatatgataaagtatacataagcagaaggaaacattggaaatagatgtttcacttgaaatgggcagcttttttagaaagggaaacatacaggatccctcctcatttaattcatgtgttcaacaaacatttactgagcatctactagtaaggatgtagaaatgttcccgatatagttgggagatataaaaattagtatgtttgggagcctttatatcaagggatttaccattcattaatggagagaagctcaagaataactacaataagtgggactttcaaaattgctaccaatgagagttatttttaaaagttccactgggaggtaagaaaagaaggaatatatttgctctgtggcagacttaactgtgaatttctggaagtttcaacgaaaagctggttcatcaagaatgcacggaggaataagaatatgactgtggagtaaatactgggtcgaacctcattgttctacaattttctgagtgtaattccacaaatgtcctatatttcttagcaaacatccatttaattcttttctgagagcacgttctaagtttgggcatgaatatgtctgtgttgacgtgtatatatatgactttgcctgcatctttatatcttttttcctcttttacaaaaattaatatagaaagttctgtcatgatcccaaggtataacatgacagacgcttcaggaggtgtctggtctagttggtgagataaaagccaagatgataattctttggtgtatgccaaatgccatgcatacatgatcccatttatctttcacaactgtgtaagccaggcactgtgactagacccgttctccagatgaggagcctaagtcttagaaaggctgaataacttctactaagaatgtagcttgtatgtgttgggtttacgcctcaggactatatttaacaaatacttaaaacttaccacgtgctttacaaatactaactcctttgttatatctctctaactagtctatgagtagatgcagtcttatctccattttatagttgaagaaattaaggaacagagactcagcaacttgcctgaggtcacacggttaataagtggtacacagctggtgtttgaagccaggcggtctgtctcccagtccatgctcctaaccactctgagggcagcttctcaaatcccgctagattgggcttcaaagccctatggttaatcactgtacaaatggcctctttgtgctatcacctgaacagaaacaaatataacatccgtgacatcgagagagctgctaatccaaccatctgcattcaggttctgcctctgtgctcagccagcctgcctctgtaaggcactaacacacattctttctaccactgacctgcactttggcattctcatcctgtggctttaattaaatgttaacattcatttgcccttttccattgtgttaaagataacctttgcttcctgtcgcgtctagataagcttcactccatgacaggtaccaaataggttcatcttgatataaagtaaagaatggagactctttgatcctctctgctgacatattttaaaatgccagtatgaatatttgttttgtacttacttcttttacggaatgtcaggataataaattatttctggatactgcagtagctgaaaggttcaagtccaaattagtcatactaagtggctttgacccttcctgagagtcaaacagacttatctctgagacacttttgtttctaatagttgaaaatacattatggagagaggtgctggttgggatttagagggtcacaatttgctggtttggaggaaggttataaagaggttttctggatctttactcatacattcactctattggatgggggatggcttcttgctaaagtgagaagagcattagactgagaatcaggcctagattccagcctcatttttgccacagatgcattatgtgagcttgaacaagtctcttattttctctgaaccccagttgctttattgttttaacaattatatttcattaacagtacataattgaaggatgttatctgatttgctcatcagaataaactcatgagatgcagatttgtattcacattttacagaaaagaaaactgatctttagagaagttaagcaatattcccaaggtcataacacagctagtaaaggaggtggagccagaattcaatcgtggggctatccaatttggaaatccatgctcttcaccattatagctacattcattgttggagagttctacatgtttatgagtgtactcattgtcgctttagagatgctgcatgtatctcctaaaaatgtttttggcagatgatcactgtctttgatagcccattgcagtgatgccatctctaatagcatttactttcctagcctcggaaaattagacacccccctggttagtcagggtggttattggcagcatatataaaattatcttgaattttacagaaagaagagaattctctgtgtttctgaattttggtactaggagaaatattatatttttataagttataatgtattagaaaaaggatattttaaaatgtaagagaaaacaagagttaaagatgagcttggaaaaggagaaatggcagaagagattcctctttggaatgcatcttacaacaactaaatatacacagagtatctatgacaataaaacacttcaaaatattagtaatattttatgtaggtgatgggattatagaatttctcatttcttttttctttttaagctttgctaaattttctgtaatacatatgcattgtttttgtgctaaaaataagtgaaacacacacttatgtacatgtctgcagcaagcaaacaataaaccatctagtagtcttaggctagctaacatcccagacagcaatttgtctatggcacatatctagactaggctaactgcccaggttggtcacatcaaaaaacatatgtccctttgttaatctctctgatgtcatccattatttccaacctaatttcatattagattattagtgcaaggctttcctaaagcaatacacctcttaaatgattacatgacaggaagtcttcagactaagagcctattttaatcagttatttccacttctaaaaattatatttactttctttttcattttcttttttttttctccttttttctttttctttttttttttttttctgagacatagtctggctctattgcccaggctggagtgcactggcatgagctcagctcactgcaacctccacctctgggactcaagccatcctcccatctcagcctcccaaatagctgggactataggtgtacgccaccaggcccacataatttttgtattttttgtagatacggggttgtgccatgttacccaggctggtctcggactcatgagctcaagtgacctgcctgcctcagcctcccaattacagggattacaggtgtgcgccactgcacctggcctatatttactttctagtcattgaaatagatcaagttttttcaatgcaattaatgaaatgcattatcctttatttatgctaattttgtcctccattccatatgtctagaccccttgtactaatttttggctatcccacagtttcgtaattggccttactctttctcatgattcaccagccataggcacaatgtcactagactactctttctaagatacatcaagtgggtcaatgcagtctttgagaatgtatggtatttgccccaatacctataatcccctccaaaatagcagacaaaatagtctcttcataacctggtcctctaagtttggtatcaaatcacatttccttgatcttctaacatgcttcaaccacacctgcctttctgccacatggtcatactttactcagcccctggccttctgctttgattcttatttttttctggtcattgacggtctttttttccccttctgcttattttctttctagtgttatctcttcctaaagccttctgcaattaccgtgcctattgaaattgctctttttcatcagtctttagtaattaaactcttttgtattagtccattttcatactgctgtaaagaactgcccaagattaggtaatttataaaggaaagagatttaatggactcatagttcagcatggctcaggaggcgtcaggaaacttacaatcatggcagaaagcaaaggggtagcaagacaccttcttcacaaggcagcaggaaggagaagagcaagcaggggaaatgccagacacttataaaaccatcagatctcataagaactcactctctataaagagaacagcatgggggaaaccatccccatgttccaattacttccacctggtcccatccttgacactcagggattataaggattatggagattacaattcaagatgagattttgggtgggaacacaacaaaaccatatcatctttactaaatatttattgttgttttttaactaacacataataatttacatatttatagggtacatagtgatgtttctatacacaccatgtatagtgatcagatcagggtaattaacatatccgtcatcttaaaacatttatcattcttttgtgttgggaacactcagtatccttctaactatttgaaactaatatatcattaactatagtcatcctatagtgctataaaacactagaacttattcctcctatctagctgtaattttgtatcctttagcaaatttccccctacccctctttccccaacactcttcccagtctttacaatcctttgttctactttttattctgtgagattaacttattttagcttccatatatgaatgagaactttctgttcctggtttatttcacttaatatgatgcccttcagttccatattgatattctgtcatttagtaagatttcttttattattctctaggtcatatctctatctatctatctatctatttatctatttatctatctatctatcatatctgtatgctgtggctccccaatatggctgttagttgtagaaaggtaggagtgtaatctgtatattgtattttctttttatccctatcagtgtcttgtacagtgttgagaatatagtaggtacttgataaaattttgctaaatcatatttaggttcgtgataactgagtttaatcctccaccaaataaatgagatttcgtcattagtaaatcaaattttaagtacaaagatcatttaatttttaaaaagttcaataattattcacttattttatctgtttttgactataaacagagcattgttcatgctcaaatgcttaactggttgaaagaagctcttcctctgacaacttcctgtcaaacggttatttaaaactctcaagtgtgttgctctaggagaatgacaccacggtgatttaacatgggatgatgcctaaacaatggatgacagaagagttattaacaggaagcaactatattgcagtgtcctcaaagactcctaaataacaggaaagttatcttcactcaactagctgcctggtaaagactgttgcctcattaacaattgttgcctcttttattttactgcctttatttttcttttactatactttgctgctgtggttattaaactgccaaagccagtatggaaggaggagctgtgttttggaacccagtgttctcatctgcattctccctcagcgagattttctgtcatcaaattagcctagagaaatagcatgctgattaaaaataagctttaagttccattgaaagctagaagtctattatttgcctagatccaggcatagaaaggaagacactcaatataaaagaattaccagttacattctgatttccattgtccttttaaagttaaattatttaaaaaatcttatagcagaaaaatggcttgaagtaggttttatctaataacttaggtggataaacaaaaaaaatcaatttgatcattattgcccaatattgcgtcttatgtgcagaactttatattactataaaaatttattttagtattccttccaagtatccactgaaagagctatatgttttccctccttccaccttcagcccatgaagacagatcctattttctcaaataatttcttaatgtttaatgaataattaaactgaatttcaaatatgtaaagagctaaagagatctcatgagagttatggacagaaaccaccatatgtaaaatgcaaaaaaagattaaaatttatcaatggagaatgatcaacactgaaactgatgatgcccacttatatattttttagaatttttagaaattaattgaattttatacttgaaaaataaggatttgtaagcaatattaagcaatagtgaagtttagctctaggtttagaatcagagaaactgaatttgacttctagtgacataatctcttaccaggtgataggttggtcatgtgatatctttttctgattcttaataatgaggataatgtcattcttacttttttcaccaggtgatctttcagaataagactgtgaaagtagtttgtactcataaggtgctctagaaatgtaagttattatttctcccatatctattgctatataaactgtgcactttaaagttttatctatatggaataattctaccctatgagaggggctcccaacccccgggccacagacctgtaccagtgtgtgtcctgttaggaactgggatgcacagcaagaggtgagtgagcattactgcctgagctctaccttctgttggatcagctgtggcattagagtctcataaaagtgcggacccgattgtgagctgcgtatgtgagggatccaggttgcatgctccttatgagaatgcctgatgattgatgatctctgaagtggaacagtttcattccaaaaccatccctccactgtcgcctaggtggaaaaattgtcttccaggaaaccgattggtccctgctgccaaaaagattgggaactgctgccctatgacatctaagaaagcaaagctgtttagaaagaaaacatagtagtttatgctgggcactagctatatgctaggcattgtgcaagcagtatttaacttcatcttcaaaataaccctctgagttagggacacaattatatccggtttacaggtgaagaaatataagcccaaagaggttaaaaacttgcccaaatcagggcataaatagtagagtcagctgcatcctagattttctccaaatgctgtccccttccccaccatattgcattggagatcttttctttcatcacaggatttataaaagcaaaagtccacttcagggaggagccaacccccttgataaagacatgagggggacttgcccatcaacaaagaaggtgccagatgcttccctctcagatggccctggcagcatgcctgttccataaattgcctcagtgaggcttctgctactacatccctttattaaggcctttctgtgattactctgctgctttctttccaatctctcagataaaagagcaaataagcagatgaaaaatgcagtctaaaggctgagttagaaagaaactgcactatgagaagcagggaaagtaactaatattttctaagtcactgtcatgtctctgcttctaagttgtcttaatccattcacaacaatttcctagagctgtattattattaccacttttcacagaatacatttgcactcaaaaagattaggtaatttctcttggaacctggtttgattcaaattgtttccaaagtctccctttgtgttattacaatagaatgcaaaacaaggaatgaagtacagtgtaagttattcattatcaagagggcttcgtcagtcccaaaagggtaaaacattgtttcacggttgtcttcatctgtttggattgctacaatgaatatcacaaactgggtagcttctaaacaacaggaatatatttctcagagtactacaagctaggaagtccaagatgaaggcactggcagatatggcatctggtgagggcccatttcctcaccagacaccttcttgccatatcctcacctagtcgaagggctgagggtctctttaaggaggactgttttataaagtcactaatcccattcatgaggactccaccctcatgacctgatcatctcccaaagtctcgactcttaataccattacagtgggttaggatttcaaaatatacattttggggaaacacattcagaccactgcaatatctaaaaatctttctcttgctatgtgtaaggcatagatatgcatatagcacataaacaaatatacagtatacatggggtattaaaatttcattggagaggtgattaggagaaaacatttgaaaaagctttttaggaggacaaggatgaaaaaaggctaagaaacacaggtgtaaagaaagaaataataactaaagtgaactaaacttgcagggattttggctctcatcaaggtccggacgaggtgcatgctgtttctccactgcgtcagccatgggagatatcatcgtatattttagagcacatgaggcaaagttgggggcacttctcaaaacctggtgaaattccatcgaatccaatcaaagtccagaagaatcagcactatttttctttctttctttcattctttctttatttttattttattgattgattgattgatttttttgagatgggatcttgctctgtcacccagcctggagtgcagtggtgtgatcttggctcactgcaacctctgcctgccaggttcaagcaattctcctgcctcagccttccaagtagctgggattacagacgcacaccaccatgcccagctaatttttgtatttttagtagaaatggggtttcaccaagttggccaggctggtctcgaactcttgacctcaggtgatccacctgccttgccctcccaaagtgctgtgattacaggcgtgagccaccatgcacggccgaaagcactacttctaaactgttaaactcctagaatcaagcaatcctccagcctcagcctcccaaagctttgggattacaggcataaaccaccatacccagcccaagttattttcagttaaagaaacacagagaaatggtttggcccatgtatgggcaaaccaagtctttgctgtgctcctctctccacacacaacgttctaccatcacatcacaacctgcctttcattctttcatccgtctcccaggatggagtcagcccctagattcatgcctcaaaaaatccttgatttctccacctcacattcttcttttgcctcttggaatgtcccatgtctgcacagagtgtcgtacagcccagacactgcatttacaaagacctggatttgaattctgactctgcaatgaatgactgggtgcaattgatatatcctcttcttatgcctcagtttttccttatgtaaaatgggactactgatttttaccttatgagacagtcatgaagagagaacatggaagccatttagcactgtgtctggtcagtagtaagtatttatttgatgttaatataccaggaattttgacaactaagttattctcttcttagatctgaaacaatgtgtatgtgtattacatatcaaacaataaacatgtgtgagccatgaaaaatcataactcagatgacatctccttcaggaaatccacatccatatccctgtctcctctcatctacctctgagctggtatacctttcttttgttgtgttctttaaactgtgttataaatggtccgtttacgttctgtctctttcattaggctgacttccccgtcaaaaaaaattctgccttatgaaatttcctatttttactacctaaaataaaggtttttcataacttactgttaaatgatgaatgttggtgatatgtttccactagtttgattacctgtgttgcatggatgtagcatatattttcatctttgtcagaaagaattttatccctgtatcttaaagctgggacaaaaggccttaccattgaatacaatcttacttctgttgatttaaaacttgactatatatgttaaacctcttaatatagagagaggtatatatgaaatttatcttaaaccataaaaacctacacagtttatacttctttcttatttcaggatgttttctcatttattatcagtctgtttcatataccatgcataattccagggagagacatgcaggaggtaatttctttctatcctttcttgggcttcacagctaattttagcaaatgcatttggcaaactttttgtagaggttcatagtatttattttgcaatttttcattatgagtttcaagagcacaaaacccaaatatcagggagaagaatgcatactgatatcagacatgcagtgttcactagtagcccttatctactgaatcgtaacagcacttaatcttataggtacatattgacagccaatttatctaattactcacattcacaaattaattggagtgataacaggatatattatcctcactctgacatgtttttggaggtcttcagggagacttatttcttgaaacaactgaactcttgaagtcgtttaaaaggatctgatttataatcatggcttagaacgtatcttcattcccttgctgtcctttttttttcaattaatgaagatacttcaattagaaagtcatacagctttgttggaatgacaatgtgaaccttttcatggttaagctcaatagccaatgttacaatctacacttctttgagatttaactaaaagacatattcattgattcaagcaaatgcgtgttcttttcctagtaacactttcttctttatcctttgaaactccatgcaaatgcaaacatcactttctcagaagcctttctggactccttccatatgtgatgaggttggaagcttcttctctgtgttcacctggaactctgtgcatgctgggcacattataccatttcactgtgatcttttatctcttctgttgttaagcaacagatcaaggactgttgcctggcacatcttacaggataggtactaggtcagggaaaagggataaaaatcagaaaaaaggggacctttccttgaggaatcacattttactaggaaatacataaaagtaaactagcaattaaaattaaaggttaaagtctatgaccaagatattctttgttgttgttgttgtttgtttgtttgtttgttttgagacagggtcttgctttgtcccccaggctggagtgtagtggatcctccatggcctactgcagcctcaacctcctagcccaagccatcctcctacttcagcctcccaagtagctgggaccacaggcatgtgccttttttagagatggggtcttgctatgttttccaggctggtcttgaactccaggaatcaagcaatcctccagcctcagcctcccaaagtgttgggattacaggcatgagccaccacgcccagcccaagatattttcacagttcaatgaatgcaaagggcggttgagaaatgactttgcgttggtgcgggtttttacaaggatcaggttttttgggctattagtttgtttgctatgagagataactccatggatatttctgatgtgctattattaaattacacatttaaaaagatagcttaatagcaagcacctgagcagctaatacttttatattctaatgtgtcctcactgtgtacatggccatttgctttcactatatgtaatttttaaaacgtagtttaattcaatatttcctaaacactaactataagtgtgttaattgctgtgaatgacatgaggctgagtaaatttgtcatcttgggaacttattttgagctggaccctgtctacataataggtactatactagtatttgtcctaggccagattatttaattcttgtgaagacacggggaggaagatattatcatttctatttcagagattagaaaattgataatcagaatagttaggtaacttgttcaatgtcacacagctgagaagggggtagaacgagaactaggatcctttcacccaagcctggcttcttgttaaactagtatatggtttcccagaggagtcaccatgctatctagtggtggaagataagacatgaacccaagtggccctgttataagaagactgtcctaaaccctgaataaaccaagaacattgacatttaagatagaaaaatccataaaggcttcatgaagaaggcttcatgcaagaaagtgggaaagatttcccaaagacacggtaaaagggagataggaacatctaacataatctatagtatctatacttctgacaagtttcatactgaaaaataagtaataattactgtactctgaatacctattgtgatttcaattataatcaatattcactgaatgactactatgcatctggtagtgaatgaagctgcattatcttatctacttttcattacgagctacgaagtagatgttattgtatctcattcaatatatgaggaaactgaggtaaaggatttaagtaacttgcccaagcctcacagtaaaataaactgcagagctagcattcaaaacactgtattacttgacctactgttaatatttacgaagtgcttatctctgtgtcagtcccataataagggctcaataataagagttgctaccatttattgcacattattacaaaaggcatgaaagcaagactatgtacaacaatctcaaagaagtctacatggtcgtttttgatgagggattggtgttgggaggagacatgtgggcaaaggcaagttgggagcacaaaagaagaattttcaaggtcagaaagcatttgaccttgatttgagaaacgactatcaaacaacaatggtgttacagcaggccagtaacctgtagaacccaacttataaagtgcgcatttaaaatgcacatttgaaagtgagagatgattgacctagacttggaaagtgattgaacatgagctgcaagggggaaggaagattaaaagatgagttttggggaattgagcttaggtagatgagtgggatatggtggtagattaaattaaatacaaggcaaagagcaataaaatcagccttgggttggggctgggtcaaaggcatggaaggaattaacagaaggaaaatgacaaccctgtttggagaaactttgatttataggagccaatgtggtgtacatctaatgatgttcagcaggttgttaaaaatatgtgtgacttagtatagcccatgagagaaaaggacagggttaattatatagattttgaaatgatacagaactgtgcaatattgctcactaaattattactcattgtgtccaaagtagcttttggtcaccatccccctgtatagtttttttttttaaatttatttatttatttattattattatttttttagacggagtttccctgttgttgcccaggctggagtgcaatggtaggatctcggctacccacaacctccgcctcctgggttcaagtgattctcctgcctcagtctcccgagtagctggaattacaggcacccgccaccatgcctggctaattttgtatttttagtagagacagagtttcaccatgttggccaggttggtctcgaactcctgacctcaggtgacccacccgcctcggccttccaaagtgctgggattacagacatgagccactgcacccagcctgtatagttttatttatttatatttggtgtgctttccagtacctgaaattatgtacaccatatacatttatctttatttttattatcagtattcttcatttcattattataaggaatttatttgacattttcatcactgtatttatagattctagataaaacttggcatattagagggcattcaatgcatacatttcatatgaatgaatgagtatataaatcaatgggtctcagtttttatatccctaatgtaaaacacacattctttatcactaataggccattgatactcctaagaccatgaggaaatctatgcactatctgctcagaaaaaggcacagacactgcaatttctcatatacgtacaaaggattcacagacatctcaaggcccatagattcatctagaatttgagatgcaaagctatgggctcatccagcatttctctcactgtgaaccttgagggaaacctaaacttagggattttgattgtttttataactgatttccaaatatcttagtaaaagtagtgtgatatatatatgtgggagtattaactctggtttctaccctaaagcatgtgggtgtttgaaatacccaaattgggagttcaaattccagagatggctattgcaaatcttgacaatatttttaggacttctagaaatattataaattcgtaaatttaatcaatttataatattgataaatttaattataaattgataaaattcattggttttaaaaactgtggttggcttaaatgaccacaaaagcaacaaaggttgcttttgtgaacaaaatatgcaacccagcaaacccagcagccctgcgttctggaaacaagctctgtggctggggttctgatgggtccatgtatggaagatctctgaaacttagctgtgtgaaaggtaagctgaccctgctgttagaacatgttctgtccaccacagggataaacccttcctgcaaggtgctcgtcaaaaagcctaaatgacagagattggagaccccactgatgtcacagaaagaatggcttgatatgcacatatttgtttgggtgtgtgtgtttgccaaataatgggtggaattattgggtctgatatttgctttcactgtaacataaagagaagaagatttggttaattatatgaatttttgaatgatccaggtttcatgtcctataaagcccaagagcaaagtaagaggtcaaatagccttcaccattcactaatggttaaagcttacaaatccttgccaattatacattctcaaattaacctacattcatttgcaactggttgagagaagaaaggggacacgattaaattgtaaggagacctcagagaaatgggaggagagatagaaaagcaccacaacattgaaaaaacagcaggaaggtttcaagtgggaaggtgtttggtggagttgacaaatgcttcatactttgaaacatataagcactaaggggaaaactttagttttaaaattagagataaaattgattccttttaagaaaaaaaaatcaatagaatggcagtggagtggaaattttcagaaaaagaaatattaaaaacttactgagttcttcttctgtataaaatactgtgtcaggttttgttaggagaacacaatatataagacagattttctgaattttaacaatatttgaattggggatttcttcaactgcaaaaggagatgttatgaaaaatagtgtccaagaataatgaaacacaaagaagttattaattatttgtttggttgctttttcacttattctgttctaatttatttattttatccagtttattcaatctccttttggtaaagtcgtaccaggttctccctttaggtaggtgcttatactccattttcactatatggctagtacagtgactatgtgactatgtgatacataccaccagctctaaccatgggcacaaattgggttgagacaattgatataatgcttcactgataataattgattaagggatgaacctatggctaaattcagggcaataagaacgaggttcaggaattctattagatacctaaggaatagaagttctcacacaccggggcctgttatggggtcaggagacgggggagggatagcgttaggagatatacctaatgtaaatgatgagttaatgggtgcagcacaccaacatggcacatgtatacatatgtaacaaacctgcacgttgtgcaaatgtaccctaaaacttaaagtataataataaataataataataataataaagaagttctctttttttacagttgataggaggaatttaggttcaaaactaaaccttttttgtgctacttgaggctgagcctagaattcccagaggttctcagtctgaaacacagaatcaaagaagaggggaaacaggaattaggtgacattattttagctgctgaattaagcttcacctgaagcttcacttttagtttctaaaagtttagaaatgtctttaaacttttcagctatgtgagttaatatattctcattgttattgaaaccagtttgatttgaattttttaaacttgacattaaaaaaaagtcctaatggagaaatgtctttcagagattctggaaaagccaaggtagggatgaaagtttatgaaggcaaacaatgggctaaatctagaaaaataggttggaaccagcaataaagagccctccaagcctccaaggtatttaaattagctacagattgggcttttaaataattcatcgttcattcctctgtgctcttaacacctgctccttaggcctccagtggttactgatgttgcccagtcatggattacagctcattgttcaaatgtttcttttatccactagattgaatgaaaactcctccagtttttttgagggcaggggttattttttactcaaactactaacctcacatctcctagcataatgcctgttacatagtaagtagttgtagcagggaggaatgaagtgagaacatgtattaatccgttttcatactgctataaataactgcctgagatggggtaatttataaaaggaaagaggtttaatcgattcacagttcagcatgcctggggaggcctcaggaaacttacaatcatggtggaaggggaaggggaagcaaggcaccttcttcacaaagcagtaggagggacaagtgcctagcaaagaggggagagccccttataaaactatcagatcttgtgagaactcactcactatcatgagaacagcacaggggaaccgcacccatgattcaattacctccacctggtctctcccttgacatgtggagattatagggattgcaattcaagatgatattcgggtggggacacaaagcctaaccatatcagagcatcattttggcaactccactctggcagcagtggattgaaaggctggaatgaaataaaaaggaatgagaagagaaggtatgcatttcagtatttcagagagaatggaaaagggctcagagaaataactcaagaaaatgctacaatctgaatctaggcagccccatgaataaaatggagatggccacacgaataagttttcatacagtgatcctttttcctgttcctgttcttttttattcatgtaaagttctgaaaactgttgcccatggtaacattcagtggaaagctgaccagtatttagacacatctatcagatcaaacgttgatgaaaaagccctgtatctttcttttttctagagtcagttctaaatatagacaggatgggctccttagagcaatagaagtgactaacattgagttgcagtattgacaatgtccttttctcccctaaatacaagcaaatttgaaataaaaaataggataaccccaaagagataagtgttttaagcatgccagatattttccagtttttgttgtattttagagtgttgatctcgcactttctgccatgagagcaggatgttcagtaaaaagaggaattagcaatcaaaggaagcactggtcttaaagaagctttaatgcatttgagtaagagatattactttctagagtaaactttagaaataggtccagtatacattgtcatagctgattgagaaaattttctaaagactcagtcttagaaggcagcacatacctcaccctatttataaaatttctttcaattttataaatgttaaggtaatatcctattacttcagaacacttggaaaatacagagaaaaaaacacaaggtgttttactcatgatgtaatctgttcatgcaactactgttaacatgtttttaaatttttttctttagaatattatttacttaaacacaactaagtaaaattttttacactctgtgtctttgcttagataagtcttccctgactttcaatttgtaattttatcccttccctgtccccactattctttttccctagcatgtttgtttttgctttgtagaacttaacacaatttttaacagtggttgtacattttttatgccagtttttcacataaggacagaatcacagttgtgttttgcaatattgcctacccaacaggaggcaagttgttggcatatagcatgcacagaaggtagacgactaaagttttcaggcattgtggtgcagtggtttaaagcagcaggctctgcagcctggcttcctggatttgaaccctttgagaaaggcagaatactggcctcccaaagatgtccacatcctaattcccagagcctctaaatatgttaccttacataatacaaataactttgtgagtgtgactaagttaactatctcaagatgaggaaatcttcttaggatatctgatgggtccagacaaatcacaggggtccttataagtgggaggcaagtggggcagggtcagaaaaaggtgatataatcctggaagcagagagagagcaagatactggaaggggccatgctgctgactttgaagatagaggataaggccacaagccaaggaatgtaggtgactgctaagaatctggaaaagataaggacaaagattctaccctggagtctccataagaaaccagccctgctagcttattttagacttctgacctccagaactgtaacagaataaatctgtgttgtttaaggcactatgcatgtggtcatttgttccagcagcaataggaaattaatatgcctgctttgcatatgaatcgtctcagcagttcaatcattctctctgtgcatcagtttcctcatctgtaaaatgaagaagaaagtggcacctgcctcacagcatagtttaagtccataaatactgcaaagcatgtagaacagtgcttggtatgtcccatgttatcaataaatattaattgctgttgaaagtatatattatcaaacaaacaaaatgacagtcagttactcctttctaattctttaatttaccaatgcaatctatcggtgttaaatttctcaatctttcttacttagttgatgaatagggtgtgtgtgagtgtgtgtgtgtgtctttcttggtatcacagtttttaatttgactgtttagttcatctgctgggaggaggaagagcccttagtcatctttgttctgtggttcacctttagccgcccactccttgcccacattggaggtcacggttgaccctataccagctcctaaggccacctgcttatcagccgaggaatcttctctagtcaacctcacattctttgcatttgggaggaagaaaaaggtgattgcttttattggcctacatctggattccctctttctctctgccttgcttttcagttacctcatcctcagttttaagaatctgcccagcccttcaagatgatgctttgtgttgtccccgtctccatcagtttgggttgccgtaacaaaaatatcacagaatcggcagtttaaacaatagaaatttatttctcacacttctggggactgggaagcccaaagccaaggtgctggaaaattctgtgtctggtgagggcctgcttcctgtcttgtagacagccatcttcttgcagagaggaagagagagcaatcctgtgtttcttcttttttaaataagggcttcaatcccatcctgagggccccaccctcatgacctaattaaattacctaagccaacttacctccccaaagcctcatctcccaatgccattacattagagactacagtttcaccctatgagtttgggttggacacaaacattccacccataacagtccccttcactctacagatattcccccatggttctacttacaatttttcaactgttttttttttttttttttttttttttcagatggagtcttgctctgtcacccaggctggagtgcaatggtgccatctcagctcactgcagcctccacctcctgggttcaagcaattctcctgcctcagcctcccaagtagctgggattatagatgcgcaccaccatgcctggctaatttttgtatttttagtagagacggggtttcaccatgttggccaggctgctcttgaacttctgacctcaaatgatccaccctccttggcctaccaaagtgctgagattacaggcatgagccaccacacctggccccaatttttcaactttacgatgatgcaaaaccatcacaattttgaggtaatgtacagtattcaataaattacatgaagtattcaacaccttattataaaatagaccttgtgttacatcatcttgctctagtgtgggctactgtaagtgttctgagcatgtttaaggtaggctatgttaagctatgatatctggtaagcaaagtgcattaaatgcatttttgactaatgatattttcaattcacaacaggttttttggggcataaccctattgtaaattgaggagcatctgtatttaacacctccagaggttactgatgccctgatcctttatccacctcaggtattcaggttttcatattagtgtcctgattttcatttttaccaggacagtagtcctcaggccagtataatacaaacataaaaaggaagatcctttcaacctaaattttgttaaactcaggggtttagagattgtcttgtgtttgaatttgggctccacaactcttttatccacagggagaatgacgatataccccatattacctaagacaatcccaatttataactatggatccatagttatggatcaatatagttgtgattataactattgtaattattaatggcatcccctgttactcttagaagtatcctggtttttataataaattctataatcgctggatttttgatgttgaatgagtccctttattcctcatctgtaaattacaatgatgacactcctcttataggatgctgggtgcagtaacatgagcaataatcatggtgcatagcagatgctcaatctaggttagattcattgcttttaaataatgactgagctccctaaaaccaagaagaaaaatggagccagactggggaaaactgaataatttgatttggaagaaggtatttaaaagcagtatttagttggagacaagataggcttagtcaacttgccaacggcttaatgccaggaaggcccagtagggtcacagaatctcagaaatggatgaaaccatacttattatcaagtctcttccccctgctcatgcaaaaagcttcaacaatctgtgacaaagccatcacctaattattaatattaatggctaacatttataggacatggtgctaagcaccccaggtggattaccttaaatcttcttcattcgaactctataaggcagatactgtgattgcctcactgtagagatgaagagactgatctatggttgcatgagatttgcaagttcatgtagttagaattcagtatcttcattttgggtggctgaggcaaagggattgtttgagggcaggaagtcgaggccagcctgggcagcatagggggagggagggggggagggagggagggagggagggagggcgggagacagagagagagagaaagggagaaagagaagagaggaaagaaagggaagggaaggaagggaaggaagagaaggaagagaaggaaggaaggaaggaaggaaggaaggaaataattcggtgtcctgcctactagtgagcttttggttgccacataggattttgatgatacaattatgaacgtgaaatttgtatttgaggagttcaaaatgcccttaaaaagtctaaataattgacaagagtttctttattgtaaaggatgctttatttttatggattttatttggcaaatgttacttcctatttgctactagttttttaagcacaatgaaatgctataatatcttgaaacatagggaggacttctgtagttaagaggcaatgatgaaaatgacacattggatactttttccacaacaatctactggtttcagggcctgggagaatgtgttatctattgagaaatttacaatgcaatgaatggatagttaacagaagcactgaggtgtagtgaaaattgttcagggtttcacagacaaaacaacttaattcaacttgatgtgaaatagctgactgtgtgaatttgaaccagtaattttttttttactctgcaccttaggtaccctttctgtaaaatggaagatgggctagattattaacaccttttcaagtttgaccagcctctgattctctgaaatacagcctagattccttgcaaattgtcagtttggcaacaaacggtggtgcttagaaaaagctcagggcattcagtagaattcaattttatatgtcacagatggaagctaattgaaattatgtaggtagatcaagtgtaacaacaaatgcttgcaccagcatgtagcagacctttagcccagaactgcttcagtctgtcaacagcactgagcatgttgcagtaaagttggtaatcatctgtctttcttacagaaagtcattgctgagagcagagttttgttgggtcaaggacaccaggttgcttattttgaaaggaatcatgctcagaatctcgcaaaccaaaagcacttttccaattctgcattaatagatgtttaacttggcccagagcaggagcaacagtgccaaaagggaagcatgcccactaacaagactggactgtggcctgagactttgaagacttctagttttaacttccccctgtctgtatcttgagtgcctgcacctccaagagtttttttgaagcatgcaaatggtctgcctgctctagctccacttcatggctcttctctcttttgtggcatctaatgaggattacctcttgctgcttttgcctgcttgtgtctgttcatttatcttaagttccaggactgtgacttctgcccaagtggtcagcctaaaactgctctctccgcagttaaaaaacaaaacaaaacaaaacaaaaagcaaaaaaccaactagttatcaaaatcaattccattctagttatttattgattgcatgtagtatgctctacactatgcttgaagctgggggttcagaaaggattcagatatatcccttccttttccacatagagctgacatactcctggaggagcggacagatcaactatcctttatgtcaggagatgtactagttttatagaacagagcttctcaaactatatgtagtgaaggatcagttttgttccttattttttttctgtccaattcattgtacagtgatacttttgtaaaataaaaaataacacttatgtgtactgcaacaatatcacattgctgcgattgcttctaaatgcttacattcaatttctgcattttgttgttgtgaatgagtaggcgacaatttgcaaaacagcctgatgtgatttggctctgtgtcaccacccaaatctcatcttgaattttaacccccagtgttggagaaggggcctagtgggaggtcattgaatcatgtgggtggacttcctccttactgttctcatgatagtgagtgagttcttacaagatctgatggtttaaaaatgtgtggcacttcccctgttgctatctctctcctgctctgccacggtaaaacatgattgcttccccttcaccttctgccatgattgtaagtttcctgaggcctccagtcatgcttcctgttaaacctgcagaactgtgagtcaatgaaacctctcttcttcataaactacccagtctcaggtagttctttatagcagtgtgagaatggactaatacacagccccatcctgcagtcaaccactcaaggcagcacttgactgaaacagcttaaataaaatgctgttgaaacacacatgagtacacagttcatcccctctggggtatgagctctatctcagggagaaacaccagggaatatcttttagttctcttcttccttcatctttgcttcattcaaggccaacaactacctccatcttccagtccggttttactttgcttcgatcagattgcactaaacctagtgttctcctcccttccatataacacttttgttcttttgttaatatcattttctccttccgcttatccaatcacactggttcctcagcctggtgctgtccttacactctacactgactccttcagacttcttccaagcccgttgtgatcaggtgaagctcttcacacaaaggcagatagctctgaacacaccattactctgttacactcctggaatgtctgtgcacggtcactcaaggcctctttgatctaattctcacctaaattttcagttgttcttcaccacaatgattgaatccatttgcaatgctgcactgaagctgcattatttgctgttttccacatggatcctggacctacataccttcatgactataatcatgctttttgccccttctgccttaaaacttaccccacatcatcatcatttcccagtgccctgacttgccccactcatccgtcttcacaaataatgcctattccttaatacccagcttcaatgccacatctatcgggaaatattctctagagatcattccacatttgtaataatagctcaatctgctaattcccaatgtatttcattttgcttgttttctggcactaggtagggattgtctgtcttcagctatggtgatttgtaggcacatcacttatcatccatgtaggctctctgaggtcagaattcatgcattacttactctctgtaagtgtctcacacagtgccctgttaatttgattatttattcatttgcaaacacagacgtttttgaacctataatgtgctgttcacatcttaccaaccttataagaacttatcatctattgggagaaatcggataacaaacatagttatcaagctatttggcaagtgcaaagagtgttttgcactgcataatacagaagatggagagaggatgcacagccagcaatgcagatgaccatgtgttcagggagtgtttctttagaaggcatcattggaggcgagagtaaaaagatgagcaagcccaagataggcacctcatagctacctgattgctattctatttgatttgattcctttgcacagttctgagagtcccactcagatttcctctctgagtcttcttcgcatacttacaggcagctgtaatctacttgttgtatacagtttacagtccatttaaccaaccagaatttcaaataaagcagtataagcaactgtattgggttaaatagtgtccacccaacattcatatctacctggaagtcagaatgtaatcttatttggaaatagggtgtttgcagatgaaattaattaagatgacctcatcgtagatgaaggtggtcaaatccaatggctggtgtccttataaggggagggagatttgaggatagagagacacacatgcaataggaatacagcctttggaagacagaggcggaaactggagggatgcagctatcagccaagaaatgccaaggactgccagaaactcccagaagctgagaatccaaggaagaattctctcctggagcctttgtagagttcattcccctgcttgtgctttccaggtttgttctcagacttgcagcctccagaactatgggaggataattattatttttaaatttaatttaagttccaggaaacatgtgcaggatgtgcaggtttgttacataggtaaacgtgtgcaagagtggtttgctgaacctatcaacccatcacctaggagttaagtcccgcgtgcattagctatttatcctaatgctctgcctctccctaatcccctgacaggagagtcaggggagtgggggaagggagcatgttgttcccctccttgtgtccatgtgttcctattgttcagctcccacttataagtgacaacatatggtgtttggtttttctgttcctgcattactttgctgagcataatggcctccagctccatccatgtccctgcaaaggacatctcattcctttttatggctgcatagtattccatgctgtatatgtaccacattttctttacccagtctatcatctatggacatttggcttgattccatgtctttgctattgtgactagtgctgcaatgaacatacaggtgaatgtatctttataatagaatgatttatattcctttggttatatacccagtaataggatttctggatcaaatggtatttctggttataggtctttgaggaatcgccacattgtcttccaaatggttgaactaatttacatttccaccaacagtgtaaaagcgttcctattggggaataaatttatatggtcttacgccacccaatttctgggaatttgttacagcagtcctaggaaactaatatagcagcctcaagagataatgcatgtacatcctcattcttaatttggcctgactatcatagaaatgtcttctcctttattgtcctagatggcttaatttctacagagcgctctgctgattttgcacaaattggaggcatgccaaaattctcttaaagggctatgaatttattcttattttcttaatgcaaaaaaattaagtaaataactatcatttaagttaaaaatattgttttatcacattttccaagtattaaaacttttacattctttgtatctatgtatgttcctcgcacaaagttgttccaggttcagtatacattttgtcaaattgtacccaaggtgctatttcccaaatcatattgcttaactgaatgagtagcgttacttttttatggaaaatatccaagtttgtgaatatgtacagtaaacatttttattaaaatacattgtaaagatgaaagttctaatatttcttaaaactgtgccttggtattgggttggctcttttgtaaaaaaagaaattgaaattactccttttctggtagtagtaggagaccattgggttcttctcagtaggcttatcatatacatttacaggaatatttgaaatgataaaaactctgtttagaaatttctgcctattcttgaaaacatcactgtagcattcatttcatttgataaagatgtgaagccatttgtcaggaggcaagagagagggcggcaaggaacttgaaattgcaataacattaataatttgtggaagctttggtctatttattgttaatgttcaaaccttgtgcacagatgcctgactttcccaatctgtggtcaatgtcaagacatagataagtgcatgcactcaatcagaggaagaaaggaagctggccgatagacaagggcacacataaagtatatgaacaggttaataatgctttctttaatcagctggaattaactgttctttaccccgatgcttgtatttgacaggcggccttgattcaccactgccgataaattgctgggtagaatgaatgcctcagtgctcaggccctgtcatgtgttggagacaaatgtttttgttcatttccctggtaagcacaggtacaaattccttaacaaaggctttaactttaatggtgtaaagtatctgtgtcactctgaaaaaggtgttgtgcacacagaagagaaatgtaatcgatttgttgagttaaaaaaataaacatatatcatgctttaattaagacaaaacattttaatctacctataaaatagttctttatcaatgaccatattgccatggactttatcattgactatacagataaaaagaaggaattcaataaaagaaattgttcaataattgttaaaatgattggctactgggactatgtctaaaataggcaaaatatgtccaaatttaagaatgatttttacatataattcaataattttaatgtatatcaattatgaacaaaatataacttattcaacaaattattattgagaatttactatgtattagaacacttccatagatctgggatttaattcattgctgatgaaattatagaagaatttatttcattcatttattcatatgttcactcagaagcattcttagagcacagaccctgtgcaaagcgttaagagttattcttgccttcgaagaaatttcccagtctagtacagaagatggataagaaagtaattagctaaaatgcaatatgatgtatatgtatatgaggtgcaatatgatatctgtgtacagaagtatcatatatgagatttggtgataacagcacagggacagcagagagaatgaggggattaccgaatgtaggtctgagtgaaaggaccaagggaggtggagaggttcactgagggggcaacacttaatctggaatttgaaggatgatgaaaactttactaaaagaacatcagagacaagaagcattccagtgagagggacaatatgtgcaataaaagagaaacaggaagcaggaaaacgggtcacttgctaggttgatattactgatagtaaggtgttagccaaactggcctgaaatgcaaagaacagagaaataagcaaagatcaagtaagacaaagattgggaaatgtccactgagtttgggatttaagttgtcactgatgacatgtgaaaaagctctttcagtggggtggaaggaactgaagccagaatgtagtgggtggtgagattgtatgtccaaggggggaggcccaacccacatcacctgaacacaaacgatgtctactaaatacttcctcactgtttaacagatacatccatagtattttaatgtaaatacaagaaagaagataatacgaggcattaagaagcaagggtcatagtttgggggagatttctgagtatatttatagaattgttgccagggaaaaggtagagggtgaggattcagaagagagagaggctgaggctcaaggaccagagcccaggagaggtggttaaaaaaccaaagaacaaagatattaaaaatgctggtagaaagataaggcttgaagcagaaagaacacatttctttctcagtctgttcatcaagaaacatttataggacattttctatgacctggggactgtaagatttcttagagacattcataaatcctacctcttgtcactatgcttctaccttaatccactgaccttcaaaatatttttattacattaaaacattattatatataatatagtatataatataattattatatattatataatatatattacactatatagtcaatatgactttgagatatccataactaatatatatcacatataactaatatatattatatattatgtaattatattatataaatattacatataacatatataacatatattatataacatatataacatataacatgtataatatataacatatataacatatattatatataacatatataacatatataacacataacatatataacataacataacatataacgtatattatatataacatatataacgtatattatatataacatatataacgtatattatatataacatatataacgtatattatatataacatatataacgtatattatatataacatatataacgtatattatatataacatatataacatatatataacatatattatatataacatatataacatatattatatataacatatattatatataacatatataacatatatataacatatataaattatatataacatacattatatataacatatataatatataacatacatcatacataacatatataatatattatataacatatactatatatattacatataacgtatataatatatattacatataacgtatataatatatagtacatataacgtatataatatatattacatataacgtatataatatatattacatataacgtatataatatatattacatataacgtatataatatatattacatataacgtatataatatatattacatataacgtatataatatatattacatataacataagaatatatatatgttatatatatattttagtcagaccctcactgtcacccaggctggagtacagtggtgcaatctcagctcaccacaacctctgcctcctgggttcaagagattctcctgcctcagcctcctgagtagctgagattacaggtgcccgctaccatgcccagctaatttttgtatttttagtagaaacagggttttatcatgttgtccaggctggattcaaactccagacctcaagtgatccacccgcctcggcctcccaaagtgttgggattataggcatacgccaccacttctggccatatttttttaacgtataaaataaaacatataaggttaaaaagaaaaccaattatactacaaagcagttatcaaaatattaaaaatacacatgtagatcaggtcttataactactataacataaaagtagtcaatataatgactatttgagaaatccgtaactaaacatatttcagtgtctattggctatgaagtcacaggtgctactaataatactgtggtttgttctctacattcacaattaaatgatatgctaaatttctgttgaggttaatgaaaataaagatggcatgctctttgcacttaggtttacagacccctgaatgctctgatccacctacccaggataaggctcctgtgctgatgggagcttgagaactggctcctggctctctctctctacctcagttcctccactcttatgctcacacacctcattctagttacctcagccttcttcccttttgtcaaacatttggcgagtgcttctgcttcagggattttgcatctactaggctttcttgtgtctacaatgttctccccagatatccatgacttgcttcttcattgtgttcaagtcctcatcaaacgtccctcctcagagatgccaacttgactggcttatagtatgacccactccgtccttctctactcatttaccatgctatatttctcttgacaacactcatttacctaacagcgtatcataaactgtcagcttatttggttagtgactcccctactaggatgtaacttctatgaggcaaggatttctttggcttaacaatatcacagtgactgtcacatagcaagggctcagttattatttgttgaaatagatcatttcaactggctatggaaagtgcttacatgtgaggcatatccattatcctggggcctcagagaggaggaagtactgcttctaggagaaggcattgcctaggtacagtcttgagatcattagagattcaaggaaaggagaaaattgaacatatcagttggaaatatgtataggttctgacctagataaggtctaaagtcatgcttaataaaaataaatggccttgctgggcacggtggctcatgcctgtaatctcatcagtttgggaggctgaggcaggcagatcgcttgagttcaggagttggagaccagcctaggcaacatggtaaaatcctgcctctacaagaagatacaaaaataaaaataataaaaaatggctttatcagtcatactttaatggtcttaattttgcattttatccctactccctaaacttttttctttaaagatcttataagaagcaacccaaaataggcatatataaataatatagatggcaatgtgaatttcacataagcatttaggaagatgagttccattaacaaagaactggactggtgacatttgtataacattgtattgatacaaccactttacttttcataatgtcaatttcatttatttttccactaaaacatattacaaccattcaaatgaatgaatggaaatgcaacttttgagtgactccactgatttttcccccattcaaatggtttttggattcttatattaagcagtcttgagataagcttcattttatgctgatttagagagtgtttcaagatgaaatgtcagcaagccttatctgcaaacaccagatccaataagctatatctggtactaaaaatcagaaattgacacaattttaattagcctccagttagtgaacagatatttaataaatggtcacttcagcttaccttttaagatatacattcaggccgggcgcggtggctcatgtctgttatcccagcactttgggaggctgaggtgggtggatcacaaggtcaggagctcaagaccagcctgaccaagatggtgaaaccccacctctactaaaaaaaaaaaaaaataccaaaaaattagcaggtgcctgtaatgccaattactcgggaggctgaggcagagaattgcttgaacctgggaggcagaggttacagtgagccgagatcgtgccactgcactccagcctgggtgacagagggagactccatcatggaaaaaaaaaaaaaagatatacattcaacgggtacaaattattctctaaattacagccctttgtccttcaagagcatattataaaaccacagaaatgaacataaacagagaaaatacctgaagatatataacaaacggttaatcagtaaataattaattacgtactttcattctttgattctacaaagattacttgatgccagaacaatgctgggtgatgtgctaaggtgctggagatataaacgaaacaagttagacaaggtgcttgtctcatggagcttattttataacgagggagatgaataatgaacaaacacatatataaacgagttcaggcacttacaagtgctataaatacaatcaaataggtaataacataataatgtaattttggtccacatagatctccagtctcttagcgtaaagacaacttaatttaattcctggtcctatcaagccctcacacattaaaagtagctgcctgttaaagaagaaaagagagaagaatcaaatacacgcaataaaaaatgataacggggatatcaccaccaaccccacagaaatagaaactaccatcagagaatactataaacacctctatgcaaataaactagaaaatctagaagaaatggataaattcctcgacacatacaccctcccaagacaaaaccaggaaaaagttgaatctctgaatagaccaataacaggctctgaaattgaggcaataattaatagcttaccaaccaaaaaagtccaggaccagatggattcacagccgaattctaccagaggtacaaggaggagctgttatcattccttctgaaactattccaatcaatagaaaaagagggaatcctccctaattcattttatgaggccagtatcatcctgataccaaagcctggcagagatacaacaaaaaaatagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaaagacaaaaaccacatgattacctcaatagatgcagaaaaggcctttgataaaattcaacaaggcttcatgctaaaaactctcaataaattaggtattgatgggatgtatctcaaaataataagagctatttatgacaaacccacagccaatatcatactgaatgggcaaaaactggaagcattccctttgaaaactggcacaagacagggatgccctctctcaccactcctattcaacataatgttggaagtgctggccagggcaatcaggcaggagaaggaaataaagggtattcaattaggaaaagaggaagtcaaattgtccctgtttgcagatgacatgattgtatatctagaaaacctcatcgtctcagctcaaaatctccttaagctgataagcaacttcagcaaagtctcaggatacaaaatcaatgtgcaaaaatcacaagcattcttatacaccaataacagacaaacagagccaaatcatgagtgaactcccattcacaattgcttcaaagagaataaaatacctaggaatccaacttacaagggatgtgaagaacctcttcaaggagaactacaaaccactgctcaatgaaataaaagaggatacaaacaaatggaagaacattccatgctcatgggtaggaagaatcaatatcatgaaaatggctatactgcccaaggtaatttataaattcaatgccatccccatcaagctaccaatgactttcttcacagaattggaaaaaaactaaagttcatatggaaccaaaacagagcccacattgctgagtcaatcctaagccaaaagaacaaagctggaggcatcacgctacttgacttcaaactatactacaaggctacagtaaccaaaacagcatggtactggtaccaaaacagagatatagaccaatggaacagaacagagccctcagaaataatgctgcatatctacaactatctgatctttgacaaacctgacaaaaacaagcaatggggaaaggattccctatttaacaaatggtgctgggaaaactggctagccataggtagaaagctgaaactggatcccttccttacaccttatacaaaaattaattcaagatggattaaagacttacatgttggagctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacttactcatctgacaaagggctaatatccagaatctacaatgaactcaagcgaatttacaagaaaaaaacaaacaaccccatcaaaaagtggggaaggatataaacaaacacttctcaaaagaagacatttatgcagccaacagacacatgaaaaaatgctcatcatcactgaccatcagataaatgcaaatcaaaccacaatgagataccatctcacagtagttagaagggcaatcattaaaaagtcaggaaacaacaggtgctggagaggatgtggagaaataggaacacttttacactgttggtgggactgtaaactagttcaaccattgtggaagacagtgtggtgattcctcagggatctagaactagaaataccatttgacccagccatcccattactgggtatatacccaaaggactataaatcgtgctgctataaagacacatgcacatgtatgtttattgcagcactattcacaatagcaaagacttggaaccaacccaaatgtccaacaatgatagattggattaagcaaatgtggcacatatacaccatggaatactatgcagccataaaaaatgatgagttcatgtcctttgtagggacatggatgaagctggaaaccatcattcttggcaaactatcgcaaagacaaaaaaccaaacaccgcatgttctcactcataggtgggaactgaacaatgagaacacatggacacaggaagaggaacatcacacactggggactgttgtggggtggggggaggggggagggatagcattaggagatatacctaatgctaaatgacgagtcaatgggtgcagcacaccaacatggcacatgtatacatatgtaacaaaacctgcacattgtgcacatgtaccctaaaacttaaagtataataataataaaatgaaaaaatttaaaaagtagctgcctgtagaagacaggaggattcctgcattcttttaaacatgctagccatctgcagcagataacagaccccatgtagcaaaaattcctttttgaaatccagtctcatcagcaagttactcaggcaaataattttttcaccagcaattttcccatcccctttagtctgttgatgttgctttctcgtcctgagctttgagtcctgttgatttttcttaagaaatcctagatagggtacaatttattagagaaggcttcctggcttccatgtaacagtgtggaaactgatggcagattgaactggagaacatggaaaaattacctcctaatagtgcagccaactcaaaagtaccttccccagcatttctgaagacaatgcaaaaatatgatgccttataggcagccatgcctcagaacattattgaaacacttgtttcttaaaaatttacatttgctttaatgttgaagtttttcttctcaaagtctactgtaaaaaattaatgagatgcagtcagatggttatccataaaaatgttcatttcattgtaatttataacacaaaaaagtgcaaaataagaaccaaattaggccaaaataaggaactagttagataaattaatatatatccttattttgagtgcttatatactggcatactacagagtcactacatgttttgttgctaaagaatatttaatgacatggaattttgttgatggtagagtttggtaaaaagacaaaaaaaaaggaaaaagaattttctatatagtatgtacagtgtaattcaaattgtatgtttgttcacagaaaaattagtgagcagatatataatcaaaaattaatagtggtcaattgggtaacttacaaagcaacaataacctttttgaggcatttctcaagacttaaaaattttttttctaaagtttatatgggttttctttgcaatcagttaaagatgttattttgaaatgcttcttcttttgagtggtgaacacttcttgaagaggaaatgggttcattctttgacattcacagaggggttagaatcaagtcagaggctaatggctgagtcaccaggtaaggaaggtgtaggcaagagatggaaacatagaaaggggctcatcgcaaactccagtcttttcagaggaataagccagctgacgtgaggaactgctgacaaatgacactaatgaatcatagtggcattgggaattagcttgggaggggaggttaattcatattgtgaagaaatttagtgtgcagaatttgtcattctctaagatgaaatgggcattatttttagttttcttttgtttaaagctctgagtggggccttgaggtaccagctagaagttccagggcttgagtcctaggcctcttttcttggatttgctatcaaaagtggtgtggaatatttatccgcaaaaactgcagtatgctcgtctatatcatgggattaagaatgtcttcttatgttggccgggcgtggtggctcacgcctgtaatcccagcactttgggaggccaaggcgggtggatcatgaagacagagattgagaccatcctggctaacacggtgaaaacctgtctctactaaaaatacaaaaaaattagccaggcgtggtggtgggtgcctgcagtcccagctactctggaggctgaggcaggagaatggcgtgaacccaggaggcggagcttgcagtgagccgagattgcgccactgcactccatcctgggcgacagagcgaaattctgtctcaaaaaaaaaaaaaaaaaaaaaaagaatgtcttcttatgttccttaactctcagggttgttgggagggccaaagaaatgtgaagcatttctctgagcatatactatacatcgataacccaaaacaacactccaaacaagcctacattaaaaaaagaaatctttgctatctgtaaacactgcacttagttaagaccttgagcaaatacaatgcatttttttgagactgccttatcagcggtaagataaggataataatagtcatggtggttagttttctgtgtcaacttgactgcaccaagaaatgtccagattaaatgtcatttctgggtatgcctgtgaaggtgtctccatgtgagattagcattggatcagtggactcagttaagtagattgccacctccaatgtgtttggggatcaaccaatccattgagagtctgaatagaacaaaaaggtagagaaaggggaaacttaccccttttctttctcttgcctgcctttcctagctgggaaattgttctttcactgacaatggactaagatttacaccattggctcctctggttctcagacctttggacttgaaatggaatgaaatcaagggttttcctaggactccagcttgcagactgcaaatcatgaaacttctcagcctctataattacatgaggcaattcctcaaaataaatacatctctttctcacacatgtgtgtgtatctgtgtgtgtgtgtgtgtgtgtgtgtgtgtgtgtgtgtattgcttttttcctctggagaaccctaactagtacaacagtaaccagtcaacaagttgttatgatgattgaatatatcaatttatataatataccaagcagaatatctagcacatattagtgatcaatatttcttatcactaacgttattatcattatcaatatcagatttatagatattattcttaataaagttataatttccctcaaggttattcaaaccagtagctgatatttctctcaggtgtatttattctatgaacagtaataacttctctacaatagaggcctctctttatgatacatataagaaattttcattaatttattgtgatcatcaaaggtacaataaagacttcaaagtagaagctgcttcagttggtacagaaccctttatagaatagtttcacaggtagatcgagttctttttactgtttaaagatagaaatgatgaaacaaatttatattttggtggaaatatctttgttaataattattaagcagatggcattgtacataaagtttgcaaagaagcctactaaaatacagattggcttccttataactgggcttatcctcagtgtatcacagaatggtttagaacctgggaatgtcagcattagaatggggcatggaggttgactagtccactttaatctatcgtatcaacccatttattagagccttatatgcagtaactccagaactagaaactctcagctgtaattatcagttgcattaaatgctttccacagtgcaggaaacaacacataaccaaaatcaagttccccatgtactctggctcttccatagctagtgatatgaagctgttcatatctcttgattgtctgagcataatattactgatgattacaaaaccaaaaatcaacaaaaaccctgtttcttgagagagcatattgcatgctagaggcctcggtgtttggagaaaattaatggtcagttttttggagagaaaataacatgtgccaagccccacaggtgaggagtatagacttcacagcaagatcatcgaatgtctcaaggtaaggagagctcagaaagttgtagcaaacatggataaattgctagtgaggcaagcacttgctgaaatggctttccatagaggagtaagaaaattagcactggcccattcggttaacccaatattttaacaaaatgttcatttttactatcattcatttttaaatttatctttacttgtattgatatataacagttgtaatagattgagggtacacgtgaaattttgatacctgtataaaatgtgtaatgatcaaatcagcataattgggatagtcatcaccccaaacatttcatttttcttgctcgtggaagattaaacaatgctggcaaagaaatggtttcctttcctgccacttttccatgaaaaccaggctatagatggctaaaggccaatgtcactcctaaaacagtttcattataagtcattcagcaatctgaatactttattgttgcatttcagatagacaaatgtttactatccatgatgctatattacaatcacagatattctacatttacaacagtaggaagacataattttggaaaaagctgtttgcaattgactgtggatccattctatttataatattgaatataaacatgctaatactacagagaggaaaatgtcttcccagttgaattccctaacaagctgagacatagaatattaattctgcaccaatgttgatgaattctgattctaaaaatatttcttttaatgaatcatgaaattcttaagtttcaggttcgttgaaacaattagaatatgtttcagtttttagaacaaatgctttattaaaatgcacatttaaatgagacacttctctaagacctgatactttaagatgctaagtcctcaataacaataattaaagcttacatctcattactaataaagtgaaaaattgaatattgcttatgcactattaaaattcaattttattttataaaaaagtattaaatgctactgaatcaaaagtcaacactgattgataatttgtctgcatctattacatgaaagctatggccaaattagggatacaaatagagaaacacatgcctttctatcgtatacgagtaacaacccagggcatgggttttagtgtgatgaagatgtggtctcctatctcagcttcatgacttatcagctatttgacctagggctgcattctttagcttagctttaccttttattaaatgtggccactaatgcctaccacagtaacttgctgtgaggttaaaatgggaaaacacatgtcattttcttgcctttcaccagggagtgagacataaactgtttctctgtagggttactcttatcttaggccttcacttcctgccttggccgcatcacattcctccattataaacactttttcacacttagaagaattttacttgctcatttgttccgatttgggggtaagaagatagatattgcaaatttaaatataagctccatgaatgcaattactgtgtttcatttgcttttgctttgctttttcatttttactcaaacttttgtattttgtgcttctgctgtgactgtcatataataggtgcataagatgaataataaatacttgttgaataaacaaacacgtaaaaatccctgtaggtcatgggtgatacatttttaagaggggaataatattcaaaactaacaatgaaggtcaaatgagaagaagtggaatatgtcagaccaggaactaggaattcaggagaagtgtctggggcaacaccaagaatgagagtatctgggggaagcacgtggcagacagacccaggtgaccgtgcaaatcctctatcgctaacaacaaaagctttagtgaatgtatccacagcattactttgaaattcaaaggcaacacgtagctagggtgtcatctgcaagtagcaacatttctctattgatactataaattattacataaaaactagcaaaggaagacaaggatagtctttagagattttgcaaatacccggaggagttttcttaatgaagaggaaatattccgacatatgacagaaatctcataaccaggtataagcatcctataaaaaaaggaggattttttttaacttacagagctgtacctctgtagaacacgatagctaattctgctgcacattaggcagatgaagagacctgattcttccagtctacagatgggtcacagtcacatttgcaagagtagtctgtcacccagaaatgtggaggccaacagagcaccagcccaggacaccctttccctacacacaggtggcagaaatatgtggccctggcttgctggaagttctctactttaaaaccaactagcttctctctctcctgagtcccaaaagacagactgcctggcagcctcaacagctgttgcaatcacgccagtccagaggggaagagacccacaaaaccttcaaacacttcgaagcttaagctgattttgtcaactagaatttagttttacatgattcatcatttgaaccattactgcaaaatacttatgtgtgctaaaagaaaatctttgaagacctgatgcctaaatcactgaagaaccattatcgatttaggccacacagttgctatgagctgtttttgaatgatgctatttttgcatttttttccctcaagcagcaggcaattttgatacacctactccttgccaggcactatgttagccttagagattggaagggttaaacatagtgcaatgcttccattgtcacaaaataaagatgctgggcccacagatgtaaggtaacagatccaccactgagtaaaagggtttgattgtaaaagttgaaaaaataatgaaaaagaaaaattagttcttcagaaaataagaatgtaaaattggacctaatttttcttttcacaagcactaatagttaaaattctgttcataagtgaaacatagactctcaactattatcatttaaaatgcaattatgaaaatataataagtaatttttcatttcttttttcttttgtctaagtttctctacattatttattaattagttcttgcaaggatctcaagagataaggattatattgctaatatcctggttgtagagattttaataacttaactcaaatcagcaaagttaagattaaaataggaatgaaatgaacaagggaagttattttattgtataaaagaatttcagagttggaagaggttttgtagagtacctaatccaacctttgcattatataaaataagactgtgaagatgagcaacttgtttataggtcacacagttgctgacaggtccaatttcaaaaccacctcaaattactgtacatttctcattgcttctgttagccatccataccagtcattgcctaacaatttaagactagatactgggcaaggtgttgtgattttgtgaaccagaaatgcagttcttgttcattaggactcttctctataggagggtacaataaagggtttgaacattgcaatggaagagcaggaaacttcatgaactaagagagacaggtgtagttcttgttccctagaaataaatcccaatatgcatgcagagggacgatatggcccaggaacatttacaagaaatatgtatatctatatatttatatagatataaatacatatatatatatatacaccacagatggtatatatatttatatctatatatttagatatatctatatatttatatctatatatttagatatatctatatatagatatatttatatctatataaatataaaaagcaaagcaaaagcaatccacaggtggatatatatatatatatatatatatacaccccacaggtgttttttatatatatacaccacaggtggatatatatatatatatatatacacacacacacagacaccacaggtggagatatatatatatatatacacacacacacacacaccacaggtagatatatatatatatatacacacacacacatatatatatacacacatatatatatacacacacatatatatatacacacacatatatatatacacacacacacacacacacaccccccacaggtggatatatatatatgtgtacaccacaggtggagcatatatatatatgtgtgtgtgtgtgtgtgttctgcacagcatgagtacacatgcaataatataaaataatataagtggtaagggccctggtcactagagattgccttctgtatttaaaatgagagcaaccatactcaggcgtacctctctcttgccttgtgtgggcatgagctccatgtcaccagatttgattttttttttccagagacatcaacagtatagactttaggagatggtctaaagctcttagcttggttgctcgcctgagagaagcagagttagaacaagtgaagtctacccagttagcaaaagcacaatatataaagatcgtctttaaaattatttgtgtttaaattcacaccttccccttgggaatcttcgcacggatttgctaattgggtttctctgaatattcagttgttcaccgctgactgactagacttcccaaagccttgataactggagaatttccaaatgctgcatttttttcagccaggcagatggcatggtaatggtagatgtgaacttatgtcctttttccttttatagcagtgcctgagtatctgactgacctactgggattaatttactcttacaataggtgataatagagcccaattccagaagtggggtgctcagcagttcttgctaccatgtaccattttcacagccttaatgtgggaccagagcagtataagggcttaacatatattttctcctttattcaaacattactcctaagtactattattgttcaaattcagctagaaaactgagactcacagaggttagttaaacaactttcaaagtcaaacacctattaaatggttgagagtgactgaaatctggataccttaattttaaaagtcagtgctttcgctgttgtatctccccatgaggccaacccaagtggtcaaccagtaaaaaatttggtaagtatcatgtgattttctctacaaaacagtgaacaatctagtggacaacatttttcttttcagtttaaactagaaattcgtattttctttaaagtgtaaggtagaaatgactagatttcctggtatcttgtaaaggaggcaaaatcaacagtaagaagggggctaatattttcagtctctggggaccaattattacattgggtatacttccattataataaagatagatatacaaacatgcatgcatacatacatacatataaccatatcaaaaacaggcttgggtaacagaaaactaacaggaaaaaaatcctatagtttgaaagggaggtatcgaagttcaaagtagcactctctcttccgatgcattagtgatggtgttggaaatggcagtgggctggggaagggtaaaagcgatggtatgtatgtattaaggttctcttcctctaaccttggaatcacattaagtttcaaatacttgtcccataccctgctaactctatgaattttggcaagcaataaccatgtcaggcctttttttcgttgatcttggtggaaagaataaatgaaataatgtatatcaagtgcctgacagtgtccagcacagagtaggtacccataataatcacttcttctctttcctcctcctttactgattctctgctcagcagtggaggagtttcaaagcatggggcatattaatatggtaagattatttgaagatgttcatttagaatatgcaccagtattttcatttaaattagttcactcttcaaatcagcatggtgctccaaaaggtaacaatgttttggcgatgaatatgtgccagcaacttggattattttaaggcttgtataatatttatctatgaaaaaattttcccctttaaacattcaataagctcatagccatttgcttaagtattccatccaagcataaaagcttcccaatgaacgagagcactgtcttgtgacaaagcttatttctgtgtatttttaataagaaagggttcagaatggtgatttcttgatatccattcaggctttgaaaagagatcttatccaagcaatacattttctgaaagtgtaaagggagtggtaaactgttcagaaagggaggaggatctcatttctttctttttttttttcccccaggaaaaagttctctgcaaaaccacaggtggacataaaagtatccagacaactacactctcgcagagatcttaggactgttaaaaaaaaaaaaaaggaaatatacatatatatgcacaaaattgctgataaccataataaaaataatgcagaaattctccagacttggaaagtttaaaacattatgaaacttcttccttacagttacatagcacaattatttgtgtattcagctctgaaattttcgtcttcacaaatgacagtgaatattctgctgtagcagatgcttaatccattaaataagtgggagtcactaaaaaatccctgtctcatgaagtggaatcctactatttggctgaattttcctctggttttccaggaggaatacgcaggatacaaaatttgatactgacttctttatggtatcaagagtgacagttacataaaaacatatctggtctttctgacttttcaaaactatatttttacttaaattacaaacagaaaacagattttcatgttattggctggcgattttatgggatggaggatttaacagagctgtgatttagaattaattgtttgcttttctaaaaaaaacatagtcaacaactaccctaggagatctgacccagtaggtacttaaagcgaggatgggaaaggctgtattttctttttaaatcttctcagaaaaagtagcaatatatatcaaacatatgttaaaatagtaaaatatatgtaatataaatatatattatactcatatatgtttctatattatatgcatatatttaaatatacatatacaaatatgtatatatctacactgtatctcagaaattatctacaaatatgtcatttatcttgacatgtaaaagtacacatatacagaactgttcatgacagctttttttaaattattgaagaaatagactcaatttgaatggccaccagtggggaatgcgtttaaacgaattatgatacagccatataatggagtgccatgtaactagtagaaacacaatgttagatttatatagttgaaatagattaaataaaagctatccaacaaatctatctatattgttagattatggtatattgtagagtaaggcagaaaattttaggaaaattatacaggagaggagatctttattttcatcttaattccttctctgtgagctaaatgctattgttttcatttgtatttgcatgcattactttttactttaacggataaaacaaattaaaaaatgcacacagcaatcctgatgttcagccagtaccgagaacactgtggccctcatatcatgttaaggtgctagaacaaggtttaatcactagagtgtttgttgctccatcaacctaaaatattaatacaaattttgcccggggtaaaaaagtattcatttcatattaagaatgtttcaaaatattttgtttcaaaacatttttgaaacttaaaatgttttgaatcataaagcaaccttgagtaggtagcctacagaaaatgtggcacatatacaccatggaatactacgcagccataaaaaatgataagttcaagtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctagggactgtggtggggtgtggggaggggggagggatagcattaggagtatacctaatgctaaatgacgagttaatgggtgcagcacaccagcatggcacatgtatacacatgtaactaacctgcacattgtgcacatgtaccctaaaacttaaagtataataataataataataaaagaaatataatgggaaaaaaaacataactgagatgttttgatgttttaagtaactacctgaggtatgtttaagcaacatttaagtaacatgaatgaggttttgtttttttttttttttttgagacagagtctcgctctgttgccaggctggagtgcagtggcgcaatctcggctcactgcaatctccgcctcccgagttcaagcgattcttctgcctcagcctcccgagtagccaggattacaggcgggcacctccacaccctgctaacttttgtatttttagtagagacagcgtttcaccacgttggccaggatggtctcgatctcctaacctcgtgatccgcccgcctcggcctcccaaagtactgggattacaggtgtgagccccttccctcgcccggccaaggtatgttttaagtagactacctgcttgaggtagatttatgatacatacccattatcgtgacaatgaaataaaatgaaatgtgatgagaaagtgaaccattccacaccatcacctaagcagggcagcacacgaagacctgatgtaacgctgacaatgttaacacccctgtgtgatgtccaactaaaaataataaaaaaagaaggtgaaaaatttccccatgctgtcaatcaataatgatgtcatcatgaccctgatagaaaactcagtccaggaggttgatggtactaaattagaaatatccatctttccctttggcaaatcctcttttttttttttttttttgtcgtaagtattacatgctaaccttgtaatgagagggcagagaggtaatggggaccaacagcaaggaccctctggaagcctagagccttgggtcccatcctaaaagataagcactgagcacatcacacttaacctctcagcatttcaactttcctatcatctatgagatgagaataatacttgctatctaccccataaaggggttgaaagggatgctgagaaagtccatggaaagcactttgaacttctcagaagtaagattttacagaagtacaaagcctcacatcaaaagacacactcatacctttctgtgacatcaatgagtgtttcatagataggattatgcataggtctgacgctgaatgtgctttatcattaaaataatttctacggcaatttcttttctttttacctggacatatgaatgcatatgcagccttgacaaatcttatactccttctcagatcactgtgaggggtctctgaggctcatttttggctcaccaagctgtgttatttagccaacaggtataaaatgtggtaccccctacttctatctttaggcattgctagaaagtaatcttctggagaaagaaaagtagaataaatttcagtaggttattgatgacatcatgtgttatggccatatttgacacagaacagaactaattcattcaaactccttgttagcaccaacctcttctgaaattacagctgtttctactgctatctagtctacattattaagtaccacctgtgcactcagccctatagaggaatgttccatcagtcttggaaaaggaatttgtctgctagatagtgttaaaattacatagccattcaaatctttcttcgataccttgaaaatagattcttaatactggctatgtattaaaatcacctgagtccactggagaggagctaaatcataatctctgtggctgcttctgccacacagagatgttttatgagattccacatgtgcatgttaatagcagcactactcataatagccaagtagtggaaacagccaaatgtccatttgcagataaatgaataaaccagctagatatgtgggatgttattcagatgtaaacaaataaatggattactgatatgctacaacatggatggacctcaaaaacatcacactaagtgggaaaaaaagacacaaaaggtcacaggttgtgcaattccatttatatgaaatatccagaataggtaagtgtgtagacacagaattcagatttgtgattgccaggggtaagggagaggtgagaaacgaagaacaactgcttaatgagtatagattatccctttggtatgataagaatattttggaactagattgaaaatgttgatgcatgacattgtaaatgtatatatatgcatacatgcatacattcagacatagatttccaggtgtttacaaagcaatctgtgctaagagtcatggtctagagtttcaaacatggttgttgcaccagtaccattgcaactgtacagtgctggcccagtactatgcattgccttcaatcaccagtgcatttcttaatgcttttcttggtgtgacatagggagcatcacctgaagtactgagcatcttatatgagcatcacctggagtatttgcttgtgatgaatgcatattcccagtcttcactgcagacctacagactcataatctcataggagtaatagggcacggttatgcatttaaaatcattcctccaagttattcttatgcatttcatttttatttttaattgacaaataaaaatgcactacattttaaaacttgaaggccctactttggactttgccttactcttccctatttatcattttttgagctttattcatgacctacctccactgcttaatgctgagtatccattatctcttttaagcttcacaaatgacagcagtcttcatttataggagagaaaattaaggctgagaagaggaaaatgagttgcccccaagagttcacatttagaaactggaaaaacctgtaaccaaactttggtttttctcagaaaactttaaaccctttactctttcacaccttatcccttccaaggaccagttcctggtctctcattgtcccattgtcgctatcttctaatatttccctgtaatcatcgcagtcaccagataatcactgccacccgtccccagactcatcaactgatgaaccactattttcaatcatcttttcttgaaatttccagggctatttgacttcaggtaaagttgaccgtctccactttaacctgttgagaccaagtcagtcttgaatgagctcctctacccccaccctggctgttgcatttaatctttgcacctccctctgcccattttgcccaactatagagggagacgaggccctacctgtgtcccatcccttctcactacctgagcacccttcctcccaagctcatgcccccatccttgactctctccctctccatgaggtctaatatgacctttgattaaacatgcttaaattgtaccccacttccaagtaataacagctaagtttaaaagccgtgttgcttcttctttcttaaatattatcttatacctatcctttgtattttttcatcaccagtttttttcttatctcccctctcctcccaatgctgctctccttaaagttatcaaaaatccatcttcaggccaaatccatttgtcaatgttcagttcctcctcaacacctgcttcatctgacatttaatctccttaaactctcccctccctcagcctcagcctctgggtgatcagtctttgttttctttttctttttatttgtctcttctccagtaagtcccttaaacttttctgacccttagtatctttacctttaaaatagaaaaaaaaaaaaactaattcaggatgttgttatagaggctcaaccaggcaaaacctactttgtgtatgtgctcattgaacagacatttgttgcacatctcttgtatgcacagtactgagttaaacactggggtataaagatgacattgacgcggtccccaatgttgaagaactgtaaattgacttgaagaaacatgttgacaataacccggatgctttattcattcatttattaattcaattaattttgatcaagtgcctataatatgtcaagcagttatccaggcactgaagataaaacagtgaaccagtctgaataaatcactgcccttgtgtagcttacattttagtgacaagaaccacatagcaggctagataacatcagggaacataaatgctagcaaggtaaaaaaaaaaattaggataataaaatacagagttgtagcagtgagatgtgctagaagtggggtaagaaactacttctatgtggaaatgacgttagtccaagtcctaaatgatgacaagaagaatcagatattgagaaagtgtgctatatgaggaggacactgcaagtacaaatttcctggggttaaaatgaacttagcatatcaaacgggcagaaaggaagccaaaggagctttctgaacagtgaagagaaaagtggctcatgcctgtaatatcagcatttggggaggcccacattccgggatgatggcttgagccaggagtttgagtccagcctgggcaacataatgagatcccatccctgcttaaaaaaaaaaaaaaaaaaggacaaagacaaagaaaaaggcaggcatggtgcacacctgtagttccagctactggggaggctgaggtgggaggattgctggagtccaggagcttaagctagcagtgagctatgattatgccattgcacttcagcctgggtgacagagtaagacagtctcaagaaaagaaaaaaaagagagataagtaagagaatttggagaggttttggataccatgctaattaaggagtctagatttaattttaatgcgaaggaaagccactgggaggttttaggtaggagaatgtggtaatccaacaaatgctttaaagattatctgaaagctgcatggataattgattgtgctttgggagcagcagaaacaggatgactacttatgtccaccttagtagctcaggcaagagatgatggctgagattgggctgatggctgtggaaatggtgtgaaatgctcaaattttggttgctgaatgtgctttctaaggtctctctatatgcgtacttgttgttttccattttacctatcagaatttatattttttgagcactaggactttgctttggtcatttttccatgccacaatcgctagaacagtgcctgacacacagtaggtgctaaataaataaacatttgttgaattaaagaatgaatagcttgcatgtggatgctgagataaactcttaaatttggtgcttgagcactttcattgacagtgtgtcatcaactgagatgggaaagactaaaaaaggcacaagtttgtgaataaaaagcaagagttccacttttggcatgttcgatttgagacgtctcttgagagcagacacttctatacacatgtctggagctcagggcctgatatttttttcattcattcatgttttgtttccctatttgctgtgaaagcttggcaagaccagggtctccttaagtgtaccccccagacaagtgatatcaacataacctgcaacttgttagagatgcaatgttttgggctccacctcagaccaactgtatcagaaactctaggctgcggggcgtggtggctcacacctgtaatcccggcactttgggaggctgaggcaagtggatcacctgaggtcaggagtttgaggccagcctgacaaatatggtgaaaccctgtcctctactaaaaaatacaaaaattagctgggtatggtggcatgcgactgtagtcccagctactcgggaggctgagacagaagaattgcttgaacccaggaggcggaggttgcagtgagccgagatcatgccattgtactctagcctgggtgacacagcaagactcagtctcaaaaaaaaaaaaaaaagaaagaaagaaaaagaaacaccaggagatgagttcagcattctgcatttaaccagacctgttcatgactctgatgtgcatcaaggtttaggaaccactggtctaaaacactgccagacatagccataagaaagagctgaacatgatttggggcagctatgcaaagtagcaagccgttctgattgttttttcttgcctctcatcaaatctctctttatcatttgaactttcttagctgctttactttgtccttagaatcaaatattttctcttcttttaaattatgtaactatggttaacagcagaactttaaaaaaaattagcctttccaaacactttctcatctgtcacttaattttagcttctgagagctatgaaacagtagggatgggaattctagccccacttcacatacaaatatatgtaggcaaaatcccattaggtgatttattgatgatcacataaatttaggtagatttgagacataaaaaacattgacctcaagctttactcttaacactgatactaccgagtaaacagtaggtgctcaatacatatttaatgactaagtgaatgattcctcaaatagatgctgcaggattcaagaaaatgcaaatttactttatcatgtatgtacgcgtggaaaccagaatactacgtgaccccgaccttttctttaattggacacccacttccaagctctacccatattatccagcaatatgggaattttatgagggaggcagattataacctaaagttatgaataatcagtttcttatatctttaagacaataattgatatagtgtgctctaattcttaatgtggctacacttctcattctgtcaattacttgtgcatttgaaaacagaggtcagtgttccatgtcctgacctctgttttgaattacttgaagaaggcaaaaaactggtgatgctgagactgattcttgccaatgttatctgtctctctttattttaaaacttaaatcgcttccctacccctactggaatgcttttagcctatcgtacccatgataataatgaaacattcctacatttgcataaagctgtctcatttagcttagcttagacacagattttaaaaaacccagtagacattgaaacatagctagaatacggaaacattaatgatgtcaataataataataatagaaaacattttttgaatgttcactatgttccaaccactgggatgctggatgtggatggtaacatttacccgggatgtgaaggacttactatttttcgtatttcacagatggtcaagctatagctcagagagtttaaatacttttcacgtcatactgatagttcatagtgaagctgtgatttgaatccaggactgtcagactccaaaacccatggcattcaccacttttccacttcaagactgtcagcctccaaaatttatggtatgaactactttcccactcctacctcattaaaacaattagcattacatccgtgaatgcctgtcatctgtgttaacaactcaggcaatgagaagactggcctagttcatgtggtcaaatacagtgggtctattttaattatactcatgctccattgggtcacatggacataaatacatctggttagagtttttttgtttatgccttcaattacctggtttaaagcctagtcacaaacatgctccagctctttcattatggtggttggccatctcaagtttttacaccatttaatcctacctccaatctttgtttttcaccagcttctccagtccctttctgccattggctactggttgtatgctggaactcttgttattacagaaaaaaacacattttcagcttctattgcatagcaggcctattttgagcatgatggatacagcaatgaagaaaagcattaccttttctaaagtgccttacggtcaggtggggacgagagacatgtaaacaaataaggcattcagtttttccatattttagcctcagctctttgcaacttgtcttggctgtcaccctgggtgtcagctgcgcaggttctttccaacaaaagaaactcctgcttctccttctatcaaagggaacactatcctgctgattgaaagtttggcaaagcgcccaagactgtgtgtgtgtgtgtgtgtgtgtgtgtgtgtgtgtgcacgtgcgcttatgtgcattgtgcaatgtctaaacactcaaacaggatatttggaacagaactgtgtgattgtttcttatcagacctctttataagtgaccaatttaaagctgaagatgcattaaaacacaggcttcaggtgatcatctgtaatttaaacggagaaggtgagatggtcaggaatttagttctgagagttttgaccttatcatcaatagaaatgagcgtttatggtctttctatttaggaaagagtctctggctttaagcggctatgccttactgtgctttcataaaaggtcaatttgaaacattctgggcttttaatgtaccaatgaattacgggcaaaagcctttatcctaaaactattagataaaaattatatctttagttttgggataatatgaagaggcaaagccttcttcaggggactatacatagctatttataagtattcgtgattgctgtattgcacagtactgttaatttaaggcaaacatttttgcgttgtttaggatttttgaatgacatgcccatgacgtagtttgcgagaaagggaaaacacttggatgtagggcttgagatgaacttcggactcttccagcggccaagtgtaaatgttaggccacatgagcataaacacatctggctggaacttttcttaatgccttcaattacctggctttaagactagtcacaaacatgcaccagttctgatgtccatagtagacagagcttatctactagggtacattattttgctgaatccagagatagtctcagaatccttctcagcacagtgcttcagacattcactgatgatgtaggtaagtgggcccatgagatggaatatttttgtcattccaactataattcaaactcttttcgtttacagaggacaagactgatattcctaatggtgatgtgacttatttaagatcaaacagataagcagtcaagttgtcactacagccaaggatacacactgcttctacttcttggcccaagtgctttgaaaaagggaatcattttaggcaaggagacgttttctgactgagttgtcagctcttcttttcagctaaacatttatattaagagatttccattggcagagccccttctcacccccatgatgatcctagaatttaacagccggttttggagttcactgtgtctaatattgtctgctcttatttttgcagaggctattctatttccatagaaggcttgattataaaatcacacagtatagaaaatagttgtgtaaaaaaccttcaacagaaacactgaagggactctggctttaaatcaatgcttggctttaaatagggaagcaaatatcattgcgtaaaaaagataactaaaatatgactcattgctgggagaaaaggggatacttttgagaaaagatttctttaagattatgtcttacagagctgcttacacatcatacagagtattagaatggtttcattactacaagttaagagtcagattagaataatcattaaaagggaattccctgtattaaaaccaccaccttccactgaatcaattacactcctgtgtcatgaacatcaccaagaatcctagattcaacacagcattgaaagctggcatgaagattatttattaaccttagcattatcccaatttgacttgtcttactaatttttgtttcatccagtctcactaatggtcaccccattctcccagtcactatacccagaaacccaaatattatgttcgacttctttcattctctccctcatacacctaatctattaagtcctattggctctacgtctacaatacaagctagtgccatcaacctcttcccatcttcattattcccccaccctagttaatgctactgtcacttctccccagactataaaataaattacagaatgacagccctgcttctcctctttccttccactccaatttacacttctcatggtggttagactgattttcctacaacctgaatcagataatgtcactccaatgcctgaaattttcaaatagcaactgactgcaatctgaatcaatacaaactcctttagatagcttacaaatttctggaccctgcacatttccccagtcttatctcataatgttcttctgttcactcaccatgctcccaacagatacatcctttcaatattttaaacgcatgctctttcctatcgcaatgacttcccataaacagttcctttttatttattttttttgaaaacctttttcccctttctacacaagagtggatcctgctcatctttcaggtcttggttttgatgtcatctcatcagataccacccctccacaccccatagcagatgctttcaatactctgctcatatcaccttgggttgccctcttatcttcctgaacatgaatattcactcccaactgccagcatctgtgtctctttgttggaggatgaccttcaggcttccagaatgcctttgactgtacatggagagcctgaagtggctgtggatttgtatcccgcttcaccccagagtgcagccttagccaatgactgatggatgaggagtataaatgctccagcttcctggcttcatgatggatttagctctgcaattgaaatgtacttcccttacatcttccctgcaggattgagccagttatcctctgaggatctttgcttgatattgtgttcttatttattctccttccctttctggacctattttttacttccctaccacttctctgggagcaatttctaataaatcacattgacacaaaatctcatctcaggatctgcttctgcaaaagcacgctaagagacaactccaacttttactcaattactctccatcagtgaatcccatttattttattccaagcatttatcaaaaactgttgttatatattgaatttcttgttcacttgtctatatctctcattcaactgtgaacaaactgaggacatggactgtatccttttaaaactagtatacctccagcacctagcacactgtttggacatagtagttgcctaactaatgtttatttttaagagtgaatgaataaataacaaaatccttcctggtccccctgttcatccaggctgaattccttcttcctgctctggtttccatgatgtccatcaagtagcttctgatcagaattcaggttttcatggagcttgactataagggtagcatatcttggtcacactgacatgagtaattggtccatatgataattctccttgttgtaatatgccgttctcctttgagaatacactatatgccaggcagcactaaggtagagacacaatattttattaaatcctagcaaacagctttgtgaggaagatacattacctttgtttttcagaagagaaaactaatattcagagctaaggaatgtgcccaaggtcatccaaatggttagtggcgaaggctgtattagaatccaagagtgactgcaaacccgtgttcttaaccttcatcatgccacctctgttctatgtgaagtttacttagcttcttgagccattctcttgggaataattaagttaaaagactaagcttctgggccttcaaagtagagggccaaatcctagaatgttatgacttatttgagccactactcagctccagctggccttgaccttcaaatcggcaccaccactttctgttcctgccagagccggtgctctaagacaacttgtataactctaaatgtatagccaactttctgtttaattttttaattttattttttgcgacagggtctcactgtgtcatgcaggctagagtgatcgtagctcactatggactccaactcctggctcaagtgatcctcaccctcagccccctgagcttctgggactagaggcatgcaccaccatgcctgactaattaaattttttttctttttttggtagagatgagatttcactgtgttttccaagctggtctggaattcctggccttaagcaccttagactcccaaagtgctgggattacaggtgtgagccaccatgcccagcccaatatatatatacgtgtgtgtgtgtgtgtgtgtgtgtatccttatctgtggtagacattggctatatagccatccaaatcgttagtggtgaaggctctattgaatccaagtctgactgcaaagctcatgttcttaaacctcatcatgcagcctctgtcctatgtgaagtttgcttagcaaactctacacatcccaatttctaccacagagaatggaggctaaagagttgttctgatattcagcaatctacaaataaattttcagctgatggtcaaaagagacaacagtctggaaaacatgaaaagccaaaggaatgacttaggaatagaaataattcactaatttattcaattaatgatatttatccaacatctagatatgccaagtatgcacttgatacaagaaagacaaagcaaaatgagaatcagaaagggtccttacaacactggcatggagatgattagcatggtggttaggaacgtgatgtagaggctgagagttcatgtttagacaactcactgctgaactggaatgcaggctctgtctcttccttactggctgtgttatttaatctgtgccacatttattcctgtgtaaaatgaggatgaaaatactacacccaccatgctcatcaaggtgtcctaaagattaaatgacttaatgtttataaagtttttggagcagtctctgacacatatgatagccatgtaagtttgttcaataaacaaagcagagattggagctaaaataaaataaatgaaagatattatggggatgcagaaaagagaaacttagcctggcgagaaggtgcaaaaaccagaaaaggatcacaaagatgtaacatttaaagcgggtcttaaggccaggcacagtggctcacacctgtaatcccagcagtttgggaggctgaggcaggtagatcactttaggtcaggtgttcgagaccagcctggccaacatggtgaaactcccatctctactaaaaataaaacacttagccaggcgtggtgacttgcgcctgtgatcccggcaactcgggaggctgaggcacaagaattgcttgaatccaaaaggtgaacattgcagtgagccgagatcataccactgcattccagcctgagtgacagagcgagactctgcctcaaataataataataataataataacaacaataataataacgtgagtcctaaaagatggtttggaattcaccaatgaaagaagtgagaggaaaaaaaagagggagacaggccccagcaccagcacaggcaaaagcaggcaggagggaagctactggttgtttacctgaatgtgtttgcataagaagtgagaggatggggagtgatgagatattaggttattgcttaaaaggaattaggacattaagggccttgggaagcaataaagaagtttgacttcatgttatctagaagtaactttaagaaaattttaagtaaaaataatttcacgatcggagttacaaactacaaagtccactctggccacagtatggaagatggcttttgttgagtgaagtcatccacttaccgagttgccagattaagccaggtaagaatgacaggagccttaaataatgaactatcactggaaagtatatttataggaaataatagcaacagacaagccaattttgttttcaatggtcaaattagcagtagttcattttgaataaagttattgacctctgaggcaaagagatagaatcataatggaaaataagttccacaatcagaagtcagcactccaaattaaaagccagtcttcacctatttgatgggtggaaggacacttaaacaatcactgtttgtttctgacttttgaacacatcaaagaaagcatcaatttttatgttacctgagacactgaagaaacaattacatatttaaaagggctaaggaactttgcaaagtgtctataaacaaggtaattattcagaattaattcagtaagaccataataatgattgttacaatttcttgagcacttgctcatttccattgtgctagcaatttacatatattatctcatttatattattatctcacaataattcaataaggtaggtactatcagtcccatttaacagatgaaaaatgggggtttaaagagatttagatactcacttaaatgtcaagaggtagagcagaaaacccaagtctttccacatgtacagagcccacactgataacatctgtggtatcagttctcactgtgaatttatttgaactcagacattctttttaaggaaataaaaatgcaactttacgaagcgtacaatggagagtaaagaggatgcttttcctattatagtcatttttgcacaaattatccttctcacttttcatatactaatgatgttttcactgaggctgagcatttgactaaagtaacaaattattccttaaaaacaaaatgccaaggaaacaaaaaaaaacatgaaaatacattgaggacaactcagactgtcaatttgatagcagttacctgttaacagaaagggttatactatagtgatgacaacttggattccctggatttagccagaatggaatgtgactctcagctctattatttacaaactgggcaaaaacttatggctaaagctaagaagtaaaaaatgaggacgtttgacctaggctaaagtgcatgtggggtgtatctattaggcagaaggagctgcatctgcgaatgtcccaagtacaggtagatcttgtcttaattataaacctacaagtacttcagcatagctggaaaataaagcacacaagatggtgtgtcaagaggttaaaccagaacaatggcagaggccttggacaccatggtaaggagcctgcccatggttttataggggagagtgatgcaatcataatttggctatagtgaggaagaaggactggaaagctactagaaaggtaaggaaacatcttaagacattgccttaacgatccaagtgaaacgtggttagctaaggtcttgggctagtcacgtagtctatgtctcagtttccttatctgtaaaatgagatgacagctgctataatgtaggttatgtgtgagattgaatgagatgatatggtcaaagtgcccagctcagctatgaccactgtaaatagaacgatgtgatgcttgatgaacacaatggatgctgactcaagtttatatttctttcaaatatgactgactcaaaaatgtcatgttgttaaaatttgtccagctagaagaatattcatagtgacagtcctctactgtttaatgtgtattttaattgaatttgtttcttattgaagagtgcattaagctgccttttaattctctcatgacaataataccatggtgttatgtttgactaacctcgggtcctgcatgaataaaggtagattaaaaaaaaaaaaactcttctgacactatgttgaataggagtggtgggagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagcgttgttgaattttgtcaaaggccttttctgcatctgttgagataatcatgtggtttttgtctttggttctgtttatatgctggattacatttattgatttgcgtatattgaaccagccttgcatcccagggatgaagcccacttgatcgtggtggataagctttttgatgtgctgctggattcggtttgccagtattttattgaggatttttgcatcaatgttcatcaaggatattggtctaaaattctcttttttggttgtgtctctgcccggctttggtatcaagatgatgctggcctcataaaatgagttagggaggattccctctttttctattgattggaatagtttcagaaggaatggtaccagttcctccttgtacctctggtagaattcagctgtgaatccatctggtcctggactctttttggttggtatgctattgattattgccacaatatcagatcctgttattggtctattcagagattcaacttcttcctggggagttattcttatactttctatcctgtgtacaatataacaaccccacagctaaattttacaacattataaaaggtcacttttaatgatttaggcctttcatgtatcaatctttctacattaacattttctggaatttcaacatcagagttttcttaaactaagtgaataaatattcaagtctctgtgtattttgaaatgactctttgcataataatgtttttatatgaaaatggagtctctgggtgcacataaacaggttttactgatcttttaatggaaccaactgaagcacagaggcctttaatatcaaacacagtgctctcaatgtttataaatatttgtatagggatgccacttcccgttttaatattttgttactttaacaccagtaccactgtttcctctcattaattagctattgatgttttctaaaattaactttgcagacagtgttcactgacagagttctaaactaatgagtctgactttgtcttgagggaggcagaggaggggaggtggtcacagacatgcaaggagacagtgttgctttctgcttcaacacttcaaggggcagaggaacatttcttttacatgtggcctttgagcctgtgaggcatttgagcaaggaacacctcattcaccaatattttccaaacacattttaaaacccatgtgctaagggttttgatagagatggtattgggtgctatgggaagacacccaagacccacctagtccagtcctggcaacggtcaagaaaacttcctgggcaaaactatggctaaagccaagacgtaaagaatgaggatgtttgacctaggctaaggtgcatgtggggtgtgtctatcaggcaggaggagctacatctgcaaatgtcccaagtacaggtagatcttgtcttaattataaacctacaagtacttcagcatagctgaaaaataaagcacacaagatggtatgtcaaggggttaagccagaacagtggaagaggccttgtataccatggtaaggagcctgcccatggttttatagaggagagtgatataatcacaatttggctatagtgagaaagaaggactggaaagctactaaaaaggtgagaaaacatcttgagaggtttccttaatgatccaagtgaaacatggtttgctaatgatagaagagacagagaagatgtattgagacaaagtaaattaggatatctaatagacagagtttgcctattgactagacatcataagtaagtgtgatgcggactatagctgcccaggtaaatccaaggagtctgtctctatgtttttcactgactccttaatttccagcttgttttatttatttttatttatttatttggggggacagggtctcagtccaatgtccaggttggagtgcagtggtgtgatcatggctcactgcagcctcaacctcctgggctccagcaatcttcccacctcggcctcccaagtagctgggcctacaggtgcatgccaccatgcccagctaatttttgtatgttttgtagcatcatgttgcccaggctgatctccaactcctgagctcaagcaatcctcccacctcagcctcttaaagtgctgggattttaggcatgagccactgcgcccgccccagcttcattttagagtgctgggtgaatactgccacatctcgataacctaaattagaaatttacaggaagagaagaaatacatggctcaaaagttggggggaagaaaaggatggcagctgcatagaaagaacagggactcaagagatcagagctcaaattgggcaggcacaattctcattacctgtatgattttaagaattggttttggttttggatgtgagctaaaaagaaagacagtttggcgaaagatcctaaactatatctacattagttcttccctgttactcttcaaatttagagcaaagcccatttgaatttattgggttgagtacttaactcaataagcaaatcaggtattttgggataagagcatgagtgggagcatttcatactctaggtaaacagtttaaccaccggggagtatcataggctcaaagacttttcaggctctgacggtgttaagcaatacctagcacaatggttcccaaccatttctagtcatggactctgttggtcaaattaacacttacacggaaatccagaatgccaaatataaaaagggatgaaagtggagctgctttggttaaggaaggtatgaggtaccagccattgggcctaccctcagctgccaaggaaaacaattctgcagaacccagaagtattgctaatgtgcagacatacactcagactcgaggagtgctgctgagggttggtaggtagtaacgtaaacgtgttaagatgatagaacacctaaaaccatgctactgattgtaaaacagttcaaaatactattagatttaattcatcaaatagatcaaggtcaactttaactgtagaaaataagagttattatgcacatgataattatgtatgaagaaatacaaagccaccaaaatataatctgccacctttttctggtttctccattaataaatatttgctattagctcattcaattaatttttttccagcacttggaagaagacacattaatttaagaatagattgtacccaggtgcggtggctcacacctgtaatcccagcacattgggaggccaaggagggcagatcacttgaggccaggagttcaagaccagcctggccaacaaggtgaaaacccgtctctactaaaaattcaaaaattagccaggaatgtggtgtgcacctatagttacagctattcagggggctgaggcaggagaattgcttgaacctgggaagcagaagtagcagtgagctgagatcacaccattgtactccagcctggtcaacagatcaagtccctgtccccaaaaaaaaaaaaaaaaaagattgtaaaagaaaattctaaattataaaagctctatccacttattttttccttgtgaaacaggaagtgtttgcattattgaatttagggtaaagagaaggatcttggtctaacctgaaatactggtactttccaataatacagtttgggaaccagagttttaatctagtcatatgatttttaacacacgaaatctgaggcattcaggggtccctctgtaaggtcattaaccaaaccaaagtttattgatttatttttctgtaacagtgtctgacaggttatggtcagagactttccatgtggaatggagacaatcaggtagaaaagatttgcttttcatttctagtactgagctttcagtctagacaaagtaaagactgttggtggtcagtaaaaaggactttcttatgctgtgaaatatagcattttaggagatgcagcattactcgtgcaactgtgttcatctgctttattaacatgtgttatttatgatgctcagggtgccaatgcttatagatagttcttggaaacaattttactaatgttgtccaaaggtctgatggggtccaaaaaaaagaggcctctgggggactgcctgtcacagggtaggggagaggatataaagatgggagaggtcttggcttcataatcacccccaggtgctttggggctacacttccagaagcttgggatcaatgggagaaataaaatccttccgtaaataatgcagtgtgtttctataaggctcgcacacacataagaaggaaaagggacaggaactattggttgaaacaggaaaggaaagtaattatctgctggtttggcagtgatttatcgagaatgggaaagcaaatcattaccaatcaagaaagctcttaggatagggcaaggcagagaggtaaaactattagatgcattcagaaagaatttatgtgctttcttcatcagcaaccccatacattttactgtatttttaaaaaattgtcattacttagaaactgtgaaatatgaagaatgccttcttagtcaagtagcatttttatttgaggtgaactgcattgctagcagtttatttcgtgcagttttatagtggtcaggcacatggactcaaagctggactgctgggttccattcatagctaggtattttttggacattttccttaacctctctgccttcgtttcatcatacataattcaggataatagcagtaccgaccccataaagttgttgggaagtgtaaatgaattattgtatgaaaagctctgggaatattacctagcacattacaaatgctatattagagttggctattattatttattcatatataaaaacaacactaaattataataatagctcatgtttattgagtgcttactgtgagtcatatattttcccaagcattttatatgcaagtcagtcatcagatcttcatggcaaactattagatagagttattattatccccattttacggataaggaaattggcagcaaaactcaggcctggagctctttattactatcccttcatctctttaatatgaatttccttttccagtcttttcacatagtttccttcttcgtgtagagaaattaacaaaatgaatgtactttgaaggaggctaatccaagtaaagaagacttaagacaagctatgcctgtttaattcagctcaacaattcacaccttcataagccatgacaccattctcactgtatttcattttaatgctattattttgcttggtgactggtacatataaatattttatacagactcttctctttgtgccattaggatgatgaaatgtatatatgctaatggaattctaaggttctctgatttttcttttagggtcaattgtcaattatctacagcacaattattgtaagttgaagcaattctttcttccacttttctctatcagtatcgtctttgttgagatgaagcattttagtggcaatagacttactcataacatagctagaattgcagtgtctcattttattgtgtcactgccaaggatgatactggcagattcttaaggtactgctttgttgacaatgtagttgacactatttattgttattcttaattattactgatagtacatcaaaagtggaaaaggacaattgaataaacatatccttatcaatttgacctcttctaagaaatacatgatccccttgacttaacacaattcctggtcaatataagtgtctgccccactacacccccattacctgcctaatcagacctacctactgtatcctctatagcaatttcttcctaattgttgactgttctaatggacagtatgttcggaggaggcaacatggagcaatggagaaattgctgctgagttatctcccacagaaagtctgacttccctcctgtattatcctatctcagtgaaagccatttacattcaagtaggcactcaagccaggatctgagagtcatcttttaacagtgacagtgagaaatgatgactagtaaaggaatcgggggagagtggcttgactcactccataatcctcatcattatactctttccatgatcgttttactttccatacctttattcataacatttcctcaattctatgtagaatgctattttaacatatttaatacagtgtaatatccttatctctccaaattgcagagcttctaaattccacttacactaaaacctgaagctgctgcaattcttccaactttttctcttactatacccaaatcccatgaaaggtgatgaaaggtggatcactcgtttctatatactacagctgtacctcatatacacttctattattgcactttccacacttcatgtatgcatgcacgtgtgtatgtacatatggaaggtgtgtgtctccatttgactggagctctccaagggccaggtcttattcatatctaaatttgaaatacgcaacacaattcctagtatgcagcaggacaggtgtgcttattaaattattgcagaataaacagatgatggataaaagaatgattagactaagggtctgcttgcaggtctcatatgaccttggaaaaaatcaggtaatttctcactgcttaagtttgttctttcattaaaaatacaaattattttaaagacttataataatacatgttctatgaaacagatgctcctgtgaacaacaaactaggatacacttgtaaacccttccacttgctgtgaagtaccatgcctgtgtgtgagaattaaaaattgtggatccaatcaaagaagtataaggacagaaaaactatccttgaatatgttttcaagatgtgtactgtttgaaactatatctcaggtaacaatcaacagttttaagaaagagctttagaaatccaatcacaaagaaaagaatctttatttctccctttgggatatgacatttaacaaattaatttagaattctttaaaaccaacggagctaagaggaaattgagaacacttgtactaatcactcccaacttaaatgtagaaggtcatatatctaaaaggttacattactacaatggagaaattcaattactacggactcctaaagggctttacttaaaatagcacagaactgtaatgctgtcaattccaatgaaaataattgcatttccctaaatactgtgaataatttggtaaatacatctattctcttaaagtacaaatttccaacatctgcagaactcaagagcccaaaacataaatattcaaatatttcatcgagagttttaaatttattaataccaccaagtttactcagctgtttctatacttggatgactgatttttgtctgaagtttagtaaagaggagggtatcttgcttcaaactcactatgaagattgttaatttgattttttttcttcttttaacaaacaattcttttaggaatttcttaaaaattaaatgtgacaatctaggtccatagaatgttaaaatttaaaagaaattgatcctctaatcccatggcactcaaacctaaagccattactcaaatatagctaattctgggccctggtgttaatattcagatcctgttggtcagaattgggtacatttgataggaaccatcattggttctgatatgctgattcatggatctgcatagttatctatagatttctaattcagccttttatctttagagatgaagacgttgagatcctgacagcaaaaataatttctgaaagaccctctggactcttacagctgtgattcaaaacccaggtctcctgacttccagtggagtgctcctttataccatgagacatcctggaaggtcacacacctgggcatcagtgttcagagtacactgttatgagcccatgctgaatgcctctagccacatgagatcacatggattaataggtctataaaacaggaaacctcaatgcgagcaactcagcctagcaaagcagaatgaacaaatgggcactcaaatcatgcaagtgtttacacttctaattatgaaaattgttaacagagcttccctttattaattctcaccacaggccaggtctaaataaaatcaggcaatcctcccaacactcctatgagaaagcctagtgcaattcttattttatacagataaggaggactctgagcaaggaaatctagcataacaataaatagtagatggctgggacaaaagtcaaactcagttctctttgctattttcaccattccccttgtcctttccttcctgttgtagggaaataagatacttcaaggtttagcatttttgtatgaacgttgtagaattccaattgcggaggctttgccttcatgcatgagggtcaagcagtactttactatgagatagaccaagggtgtccaatcttttggcttccctggaccacaatggaaaaagaagaattgtcttgggccagacataaaatacactaacagtaatgatagctgatgagttataaaagaattgcaaaaaaaaactcatgatgctttaataaagtttacacatttgtgttggggccacagtcaaaaccattctgggctacatgtggcctgcaggcagcaggttggacaaacttgatatagaacttcctcaagcaaatggtgccactacattctgtccaaccgggtaacaaaataccctaggaaaatagtagcttttattcacaacacacaaccaggcgccaccttaatccacagtgcctgtgaatgtgaccgtttaaattaaaatgcagtcacaaccctgctgacaccttggttccagacttctagcctccagaactgtgagacaatacatttctgtggtttaagccaccctgtttgtggtagtttgtttcagtagtcctagtaaactgagattttctctttttttttttttttttttgggtagatacagtgtttcaccatgttggccaggctggtctcgaacgcttgacttcaagtagtgatccacctgcctcagcctcccaaagtgctgggatcacaggcgtgagccaccgcacccagtcttttcatgtctttaggtcagattcctcatcattggattctgagatggtaatagtgctgacaagtgctttgagtttgaagttgttcaacttgaccctggtctatgtgtcttacctattttgtttcatgttgcaagcactgctagctttcctattcaatacccatcctcccttctttttttctaatagaaagctacttttgtttgtaatgacagtggcccatctataaacttcaacttcccagactcccttgcaactagaaatgattttatgatatagttttgggccaatgaggtgtaaacagaggtctgctaaggagctctgagaatttttgtttgtccgtttactcatcaattcattcctttattttaatatcagtgtcattccttctttcttcactatttattctccatcctgtctggaacatgaatatgaggttagagttgcagcaacaatgttgagactatggatgataagtgtgataaaagccatatgctaagcacggtgtgaagtcaagatataactctgtcaggacttcagcctttttattgagaggaaaaatatacatatagttaagcaactaaagtaagatttttgtgttcatatagccgtattcaattccaactggcaaataataggaaatcagctgtggccccagagaaaagatccacagataggaacttttcaggctcttctgatgaaaatgactagatttttcaactcatcagcctacagtgaaagtcaccaataaacaaggtctgctcagtcatacagaatgcaatcagcatattattatctcactctgaaatattcatagagagccaaggatggaaaagcagagatcaaaacaaatagtataaggaattcagaggctacagattcagtgcaggaaacaaacaaaaataaattttaaaaatatatttgataccctagggtaacatttttaaaagggtcacataaatggaacaagaataagtagccattgtataataaaagaggaaaacacagtaataaacaactctcataaattcaaagaaaattgttagcagatataaaaaggagttcattaaggaagagtaaaaataaatttaagagaatctcacataaagaaatacgttttagaagtgctgcaaagtcagaggtaaacaattagaaaattgcaatagcaattcaagagactcaatatctgactaacagaatttacagaaagacaaagcagaatcaataaaagagaaacacatttcaaggaaataaagcaaaataattcgccagagttgaagcattaggccgtcagattcaaagggcctatcaaaggcacaaaacagtgaaagaaaagaaatccatactgaggcacatttttctgaattttacagcacctggataaagataaaatgctaaacagcttccagacagaaaaaataaaataggttagatgaaaagaatggcgttctgcttttaaacaagatatgagaatatgaaaaagtaaagctttaaaaaatcggaagaaaactgttctcctaaattccaatataaattataggtcatgtgtgatgagatttttttttaattgagagtgaaaatctttgtaaaaaattcccactttctttcttgggaagtaatggaagacacacttcactaatgagagagcagcaaatcagaagaggatgtggaatgtaacccaagaaagaggtaaagataattctttgttaacttttattttaagttcaggggcacatgtgcaggtttgtcatataggtaaactcatgtcacaggagtttgttgcacagatttttactcaggaattaagcgtagtacccaatagttatttgttctgctcctctccctcctcccaccctccaccctccagtaggccccagtgtctattgttcccctctctgtgtccatgagttctcatcacttagcatctatttataagtgagaacatgtggtaattgttcctgaattagtatgctaaggataatggcctccagctccatccaggttgccacaaaagacattatctccttcttttttatggctgcatagtattccatgatgtatatgtaaaatagcagagacatggaatcaacttaaatgcccatcagtgacagattggataaagaaaatgtagtacatatacaccatgaaatactatgcagcaaagagagttctaagtgagcctgaggagacctagagaacagctgccaatggcaacaagaggaaagtgttaaggagagatgtccccaagggcagaggggagatggggaattacagtttgagattaaaattgaaattggcaaattatacatatacagaaactttggcaaatgaaaacaaaaagatgccatttttactctaaggaaaacaaggtagtaaatgcaatcgtatgctatctagaagaggtgggaatagtattacatgactgtaataatgcaagcccttgaatgttgagtgaaaacatcaggaggttggtgataagggagaatgtgtatagagataaaggggtgttgttagagaggataatcctcatgttccatatgtggaagacaggtaatacctgaaatggaaaactcaaggacgatgagtaagaacagatgtattatgaaagcttatattaggttggtggaaacgtaatatggcttgccattacttttaatggcaaaaaccacaactacttattttgcatcaacgtaatggtagaacaaacagtcaaaagtttcaaggaaattgcatctatgaagcagaattcagagttagggtagggtggcacaagttgctgcttttctggttttcttcttgtgtatttttctgttataggtgaagggtcacaagctttaaggtacaatttcattttcttttttaaaagttcatgtagtactttaattaaagtcaatattaaataaaaatatttggctttggatttactttttgaaaactgagttttggtattggcctattgtttcaccatacagaactttaaagattatatatatatatatacatacatacatatacacacacacacatatatatatgccctacacatccatagtagtaaaaacctagaaacaagagctaatattaaatatattaatattaataatttaatatcaattaaattattcatcaaatattaattcagccagcttctagtctaggcactggtgatacatcagtggacacagtagatggacctccctgttgataacaagtgtatattttgggtgtgttcagatagaatatccttggctaagtcacgtactataatctatttgagccctggcttcctcttctgtaaaatgggcatacaattaaccactcattatttcaaaaattaattatgaggacctgttcagcttaaaatttttttccatgttaagatacaacatctcacaaagcagcactttactattaaaagagttcatttcgccatcattcctagcactagcaaattgaactattagggatgagacctccaatattacactactgccacattcctctttattatgaaaaggcagattgccaaaatcagtttctagtcactcagtttgtctaaatattgcagggctttttgatgttgcattagcagaatatacagtctacatttattccattcttttgtcggcctatgcaaaaaaatgaaatgaatctattcaaaatcaagatgcactgaactgcatatgatgcaaaagaaggattttgctaaacacagcaactatgtaatgcaccccattccttccccatcagcttggatcctgagactattttgtaaatctgcagagataagagttttctatatttattgaaaggtcaaaagtttgggaggtggagaggtgtaaggcaggtaggaatacagtattgtatttattaaacaatatgtcagaaacagacacatagcaggcactttgtaaagtacaatagaaaacaagcacctgttatctctaccactctaatttgcaccatcatttctagtaacagcaaaagcctccaaagtggttttcatacttctacctttcccattcccccatgaagacatccattagaatgatccactgaaaatataaaccatatcataacacttttctctccaaactttcattattttccccaaaagtccaaattttcttcaataacctacagaaagtatttgttaaatgaaagaatcaacccatctagcaaccaccagtgagacttgggtcactagatccttgcaatgtgttaagtaatacaattgaaataaaaagcaattagaacactggaaaacctactattctatggtatcactacatggtagtactgggaactaggacatgtgttgtgagtaaggactggaagttaagagaagtttatgtgggccatagtggtttgggtttcttgcgtagcagagactcaagtgtgagttggagatgtgaatgctccagtcattatgttgttatttaattaaatacaagaaagaaaagaacccatacacctgtatatctcaagtccacagctatcacgtcctcaattctataagatacgctttatcctctctataatagtttaaatgatctatttttaacaaaaaaagttacattttcttctttttttttttttttttgagatggagtcttgttctgttccccaggcaggagtgcagtggcgcgatcttggctcaccacaacatccacctcctgggttcaagcaactctccttcctcagcctcccaagtagctgggactacaggcacgcaccaccacgcccagctaatttttgtattttttagtagcaatggggtttcaccatattagccaggttggccttgaactcctgacctcaggtgatccacccacctcagcctcccagagtgctggaattacaggtgtgagtcaccgcacccagccaaaaaacagctactcctatggatgcagtaacactgcactggaatagacagatacataggtgacatacatggactgaaataaaatctgattgatgtgtcaagtttagagcagtgacagactcactgtgaagatggtagagaaacttgaactccagtaaactctgttatctggaatccaataaattgcaaagtgattaagtggtctctttgcacttaggtacacacctaactgatattctaagtagtctttgagaccctgaatttacacaactcaaggagagattaaattgtgtgcagcatcatgagagtgttgggtttattttattgcattccaattatttgaaaattgataacctgtgtacatatggcaacttcccattgatctgaatattggattaagtgaaacactctgaaattgccaactgaactgattgcacctaatgagatggagatgtggaaatagccatgagcttttcatcaccggctgcaaacctgcaattttcttggtgaagaaagaaaacacaaaatgctattggaaagtggttttcatgtcttgcacaaccccttcatccataaccttcaattctagatggctgcatactgttcacttggctaacttctagaatagagtggtggattctaggcaacaggatgtgatcactaaaaagacataaaacaattctaaaaatgtgttttgaaaaatatcaggtaagttctcataagtgagacattctcagtttaggtaaagcttagaattgtgtttcccaaatttcagttagtcacgtagctacctgtaattgcactagcaaatctacatttaatttatatgttatttgttatttttcttacgttaattcatttaacttacacttaaatacattattgttaaaggaaatattatatcactaccaaactataagtagatatcttttaccataaagagataactacaaatataaataaaatattgtcttcaaatattagttctgagttcaggactgtgatctctttgccaaaagagaaatatacaagcatttgtgatgtgttaaagactggcaccaaaagatgtgtgagtgtgtgtgtgtgtgtgtgtgtgtgtgtgtgtgtgtaatgctgttaaaatttagttaagcttttaaatacatttttaaaattggtatctttactataaggctacttgaagtctataaaatgctaaaaagtattgttattttctcagacaggtttatgttatccagtgtttcacaatatgtgtagagcatgaaatattttttaggcagaaaatataagaagatgcatatttctctcaatgtgtgctggcaaattgtgctgttgcttttgctgtttttcaaattccttcatgcctctatgatactctttgcttctgctcagtaagttagtcactctttcttaaacatgacacagttttcatctccattcttgactcatagtatttccttcactgctgcctcactttcagcggttaaaatacatctctttgccacccaaatacttgcacacaaaatagccaaaaagtgagaacacccaaatctccgtcaactgctgaatggttaaacacgtggcaaactcatagaagggatactatttagcaataaaagactgaattactcacatgtgctactacatcaatgggtcacaaatgctaagtaaaaaagaaacaacaaaaactagacacaaaaggccccattttctatgaatatatttgtacgaagtatccagaaaaggaaaatctataaagacggaaagtagattagtagttgcctggtgggagtggaggttaactgtaaatgggtaggtgggatcttatttggatgaaagaactgtcctaaaattggttagatatcatgattgtacaacttggtatatttataaaaattgacttttatatttaaaatgggtgaatcttttgaaatatacatttttccttcataaaattatgtaaaaatttcagccagctaggtggacaatcaaccacctatccattgacccattcttccatcttttaacgttttctctctcatgccataatctgaaggtgatttattcttgtcttgagaaaacataccattatgttttcatatatcatagatcttttcatttgtctttcttgtatgatattcaaatatttgtctaatatccttactcgaccataagtttttacagacaaactactctgaactagtccatgtgaaaataaatacttattgaatctatatatacatatgaagcaaattctatttcatggggaggggggaggggggagggatagcattaggagatatacctaatgctagatgacgagttaatgggtgcagcacacaaacatggcacatgtatacatatgtaacaagcctgcaccttgtgcacatgtaccctaaagcttaaagtataataataaaataaataaataaataaatcatgctactataaagacacacacacaaaaaaaataaaaataaaaacaagtaaaaatacccattagcacatattattaaattgcctgctttgaaatctgcaatttactggccgggcacggtggctcacacctgtaatcccagtactttgggaggccgaggtgggcagatcacgaggtcaggagattgagaccatgctggctaacacggtgaaaccccatctctaccaaaaatacaaaaaattagccaggtgtggtggcgggcgcctgtagtcccagctacttgggaggctgaggcaggagaatggtgtgaacccaggaggcagagcttgcagtgagccgagattgcaccactgcactccagcctgggcgacagagcgagactccgtctcaaaaaaaaaaaaaagaaaagaaatctgcaatttactttttgttatctaactttgaaaagtggtttaatgcctcaacacatcagttattaattcaaagaatgataataatagcagcaacaaaaggtataagcaagagcagccgcctttactgaacacttactttgaactggccaagctgtttggtacttctcattttgcagatgtcattccagaaaaaagaagctgagacacaatgaagttaaatcaactgacttaggtcaaatgccttggatgtagagcccaaggcaggatttgtatacacatggcttttgaagggagtgctctcaaggcatggtaggaatgagatgtaggaaggtaaaagaggggaagggataggagctaagatttttcaagggaagttttgctctagtctgatccatggagatctccgaggataaacaggaaagcagagtttttcctgtcttaagacaagagaatggacttaaatatacctgttcctgttactgcgcatgtgggtgcccttgtgtgtgtgtgtgtgtgtgtgtgtgcgtgtgtgtgtgtgtagccttggctgtagttacccaaaagtaatcctgcagaaaatgtaaccgacgtgagcacttgggggtgcccacttctgggggatgaacacacccaccgggagaagggattccaagagacctgagcagaccccaacagcctctgctacagctgttggcccaaatcgcatatatagtaaggggaatatctgagattcaaacttcaatagttctgatgcctatatcagtgcctttaatgccccacctttttcaggcagtgccacatttgatacacacacataaatgtacaatatccccattatggcttaggttgatccattagcaaatattttttaaattaaatattaatgcaaactaggataagaaagtcaagcctatttggcacccttctttaatattttaatgaactgatacaaatattttttaattacatgcattatttaaatagtgtctgaggaacttggaggttgcttgaaaaggtctcccaaaattttaaatattccccactccatatcttatttagactaatatatttaaattcattctgtgaatgaagatttgctcagaacctcagtttgaacagtgtgctaatcaccatatgttccaaatgagtcactctgaatttctgaagaattgttatatatctttagttttcattttatcagagataaaaccataaaggcaagaaaaatttgatgttaggaagcagttgatgagccaactgcctcccaaaggaaaacaatgccatgaaactacaatctataaaacaaacaaggccgggcgtggtggctcatgcctgtaatcccagcatcttgggaggctgaggtgggtggatcatttgaggtcatgagttcgagatcagcctggccaacttggtgaaactccgtctctactaaaaatccaaaaacaaaacaaaaaaaaagccaggcatggtagtaggtgtctgtaatcccagctacttgggaggctgaggcaggagaatcacttgaacccaggaggcagaggttgcactcaaccacgatcataccactgcactccaggctgggtgatacagcgagatcctgtctcaaataaaataaaataaacataaataaacaacacaaaagcatggcttgatgcctgccatctagcactgcacaaggagttaccaactttgttctaaagatagcatgacttattgcaataacacaaacactgtgtataagaaatgagacaaactctaaatggaaattgctcgccagagcactcagagcctttgttcatccattttcatccttctcccaatccagcttctttgccatttacatgtagatacacaggggaatttccatgtcctccacttatcttggttaccgctttttttctccttatctttcctattttgaatgccagcctcacagctatcaactttcaaataagtagccaagaggtctgaatacttggagtaaatagaatgtttgattggacaacattgtgtatgcatttcactgagtaaaatgctagtctggatacctgcctatgataaggccaccgttccctattaatatgaagcaacaattggttgagcaggggagaattaacatggccaaacatgttatatagtagacagcacctctaactggtcacatatttaagccacacaatggcaaatggggaaataaggtatatggctttggggtaaaggcaagtatgaggcagagaccaatccctggaagtattttctttgaaaagggaatccttcagagagtgaggcacctcatttctattttaaactatagccagaaacatttctcctaaatgagaaatttgccctagggattcctgatgtttgtcagaaaccgctgtaaatttattttcattcactggagagaagagaagggaggtaacatttatgacatatgcttgtgcttttcatctgttatttaattttcacaagtttttcaggataaaatagtatccttattttgttgataagagaattgagatttagacaaattaaaaataaaacgaaaagaaaagacaaattatagcatgtaaaccaagggacagatcttgaggtaaaatccagaccttttggacctgatgttcatgttctttccattcttccatgcaccctagggcttaatacatcaactcggaaatgtaattgagaggaggctacaaggagacaccattgtttgggattaaacaaaagcaggctgttttgtttactgtaagattcctcaacacttttaaaatgctgaagtatattttgagcttctgggaagggcctacaggacaatgtgtccaaaattttatgaccatagagtcctctccccctggaagcattgcctgactttgaaattctactgaaaatattttagatactactgttgctccagtagtgctatactagagaagagaaaggcaagggctagaatggcttctgtttttatttcatagacttctgcatcgcctgaaatgttgtgagctcacattaatttgggaaataaaataagtatcatttacatgaataaagaataataccatgtacattcccaatagaatgtatttatagatacatgagaagaaatatgtgtgtactaaacataggtccatatctcataattattatgcaaaagcaaaagaggaaacatattcatgtactgtctgatgagtattataatgatacagcaatgaacagagttctgtaaaactgggcactgctcaaagtgaacagcatatgttaactcatttaattatcataataatcccctgaaacatatgtaattatctccatgtgtcagatgaggaacctgggacacaggtaagttaatttacgtctcaaaagtcctactagttacttacgtaaggaagtttgtggaagaacctgataccaagtgtttttctacaaaatttcatactacttatgactcccacataaacctattttgcaaggaattctggaagccttgtgaggacttctgaaacctacataaagactaattagggctcccaggatgttatttttgccttctttaactttccatccaccttatcctgctttttgcactttggttattgagaaatcaaaaaaatatatatatagttaataccaaaatatattttggaagaaacaaatactataaaatctgatttagcaatataaaagtaatattaattttaatgatttgcctgattcttattcattcatagacatttgatgagcatctactaagtaaagctgcaggaaatataagtataaattagaaactctttccaccttaaaaatatgcttgtgggtttactggagaagacaggtatttaaacatcagcagcttttttctaccagtggcaagatttatgttgactcctgaacagtctctcttgaggtcttccttgctaccagagacacatgcacacacacatctgtatgaggattagccaggtggggctgttaactcatcactggatcacagcacaactatccttcccccaaggttataactgtacccacaaccttataacttgcctatttttctgtgatgctttaatcatgcacagatgtatgattaggctataggcaaaactcatgcaaaacgtaataaaaggaaaaggagaatgaaactaaaacagaagtccctatcattattacagaacaaaaaaagagagagaaaatggactaaccgcttagactagattttggaaaataattgacagttatgaaaaagaataagaacaaatgcttacatagtgttaaccttgagccagacactgcaggtgctttatatattttgcctttttatcctcaagaactctataagataaatactattattatcttctttttactgatgaagaaactgagacacagaaaggataagcatggtgcccaacattacaaattgggtaagttcttgggcctgggttcaaattcagatgattgcgtcagaatcaacactctggaccaccaccaggacatctgtgatacaaagttgagtaagtactgaccaagtcacccctctttgctggcaactgcacctaatgttatacatatgtatgagaacatgtggtatttgcttttctgttcctgcattagtttgcttagaataatagcctccagctccatccatattgctccaaaggacaggatctcattttttcatggctgtatagtattccatattcacaaccaatctataaggtaaatcttatccccacttgttaataaaggaaaactaagaacagataactattattgactgggtttggatgaaaacacaaggctatttgaattcaacacagtgtgcttttagggggaaattgtctttggacttcagttctgtgaaagtacaagtcatatcttatttagtttagattctaaaaccatagcatgtttttattaatttttaattattaaggatacataatgggtgtatatatttatttgatattttgatacaggcatataatgtgtaatgattcaatcagggtaattggggcatctgttacctcaagcatttatcatttatttttgttaccaacattctaactccactcttttagttgttttaaaatatagaataaattattgtcgagtatagtcatcctcttgtgctatcaaacactagattttatttattccatctaaccatgtatttgtactcattaactatcccatagcatagagccccaaagcaaggattttttttctactgcaaattgcatcaatttgaattaaaagtgaactaatctaagtcccttttttattcaagaaaataaatctagtaatgaaagaggaaaattatatggatcatccctaaggacaagttttataaagtactttaaaaaaatgtatgagatgtacttaggattcctgcctagtaagccatttaatggaatctttgcactggtcttaaatgcgtctgtgtactgcttgaaacctctatcactcctttccttttaaatctgttcctcatattaaataattcttacctaggttttcacatgaatggtgcctaggcagatgcaagaagctgctgctagggaaataaaatggaaactcagaaatgaaggaagctgagaattgccaagcagccacagactcccactctatacccgcttcctcaccccaccctttcccacatgtcacatacacattccaattttcccttgcagaggaaatgaagcaaaacacatcaatggagtgaaatggtttgtccctaagaatcagaaaactaaagcttctcttagcaggtacaaaaaaaaatagcttttcttttagttaagtaagactcctaggcaaaacatcaaaatcctgggctcttgataacttttttgacatagaaatatttatagagatggctctttatcaatgattccagaaactgtttgacttgaagttgaaaaatgacttcaaggtataaaaatctggcattagcaccaagatgttgaccctgaattctcttatttttaaagattaaaaacaaactcataactcctcaatgttaaatatgttttctggacccaaaaatgtttttcattttacgttgataaattactatgttccaaagcggactgcttttctcctcctgggaaaaaaaaataatgtatgtttcatattgatattcttctctttttaaaattaacctccaaaaaaagctacataaacacatgccaaaaagtgacatgttcaaagaagaaatgaaaaatgtcactgtgtgtatataccaacctcccgtgtgtatacttttttaatgagatcattattttgcatactgttttgaaacttgttcttttaatttaagaaatatgttctgagtatcttttcaacacagttgtatttgccattctcatgggacttgtggtgaatagatgggagaatttatcaacatgcaaatgaaacaaggctcttgcccgagctgagtgaacttgggccaaggaagatgacactgattaggtgagagaggaaaccaagcttagaaggggcagaagtctgggacctaaaagaggcagccaggaaaccacattggttatgacagagccttttcaaggtcaggaagggaagttcatgacctggcaagcaacaactaggtagatgtaagagcacattaccgtgcccttatgaggagccagaactagtcattgtaagctaagcacttcatgtctattaaatatgtattctttacagacaatagtccatgagctggatccagctgaggattttatagaagaagtagaggctcagaaaagttaaataatttgcctgagatcacacagcttgttagagcagggattgtagtcagggtgttttcctcccaaaggcacagcatgttccatttcaacccacagacaagctttattctttatccagtgccctttttcacaatgtccctccttctgcctctgtacttgtacacatggttaaatataaattcatctcccagaaaatcttcaacaggtcttggtgcaaaagactcagggttcttcaatgagctcaatgcatgttaactggtaaatctcatggcttatgttcatggagtatgtgtatgtgtgtggagtgtgctagagtgtgcacccatgagtctagcatatgtttatacaaacatttgtgtacaaataggtatgtgtagatgcacatacaaaattataaacctcactgatcttaataaccattttctacatattttcaaaggcagggaattaggtctatgacaactaggtatcaaactttccaaaagctaataagagatgatttacggctaacacagacacaagagaagtacaaatgcaccaccattaaaaatatctgatgatggccaggtgcggtggctcacgcctgtaatcccagcactttgggaggccgaggcgggtggatcatgaggtcaggagatcgagaccatcctggataacatggtgaaaccctgtctctattaaaatacaaaaaaaaaaaattagccaggcatggtggtgggcgcctgtagtcccagctactcgggaggctgaggcaggagaatggcgtgaagccgggaggtggaggttgcagtgagtcaagatcgcgccgctgcactccagcctgggcgacagagttagactccgcctcaaaaaaaaaaaaaaaaagaaagaaagaaagaaagaaagaaagaaagaaagaaagaaagaaagaaagaaagaaagaaagaaagaaaaaaaaagaaaaaagtctgatgaataaatcttcatcactgaaattcagaatacaagtagaaaattccgtctatgtattggagtttgactatatttgtgaaggcacagtatataaacacctttcaggaattcatctgttgctttaagagaagtctgagagttttttcttaagcattttcaacataataaataaactactatttgaacacattttgctgggtcttctccctgagatattttacaaattatttggatcgatagtacaaaattgcagtcaaaccactaggaaatgggattttaagtcagtgccttagcctcatcacacatctggaggacaccattcccatacccttcctaccttgttcaattttaagtcttccatggtggtacctccatcgtctgagctacaatatttgtttttgcaaatttggagggttgtactaacagatactctctacatttcttgcttttttccctattctctcatttgccaccgagtctttcccttctctttgaacacgtctgtaagaatgatcttgcagtaatatacccaagaaaatgcctcctttatctaagtcaggaagagtgttcttttaaaactatgactgcgaatctcaaatgggcactcagcactgcccggcaatcttctcacatttgctcggtaaattcacttccccaggctctgataagactatatggtatttcctttctccttgaaatatcaattactccccaccacacaaatgcttttcacctcaccctacttcatactaactaagaagaaagcagttggacacaatatctctcaacttcccattatggatacaccaatatctaagcctatattctctgctttccctagcatataatgcagagacagagaggctttgctgcaactaaagccaactcctttacaatatcagggacctcagtggttttttccctatagcatccccagcacctagaagagtacccagcaggagctcagtaattataaattcaatgaatgaatgaatggatgaatgaatgaatatctatgactatgaaagattctatctgtcctaaacggggaggaggacaagcatcaggacaaacagttttagggtgatactcgacatctgtaggacatggatagataaccatatgtaaaacaaatgataataaataggagataatattcacccttgcctcatctactctgtctgtcttatctggcttcttacattgtatctaataattaatggttacattcataggatatattaatagagccagctaccttccattcatctctataagtcttaacaacagtgaccaatttacataagatgaaactgaagctcaaaggagtcaagtatgttacccaatgtcaactcttaaatgaaggaggtagggttcaagtctatggatttttttaaatggtaaagtccatactctctccactcagccacgctgtcaatcagcccctgagaccttcctgtaagtccgagttcaactgagtttcttagccaatccttcgggaaataggactacattctactgcagtctactggaaatgtcatgctgtcaaataatcccatcctaattgtgtcaggcatgaagtctaaatggccacagagataggcagagagacagggggacccctaatgggaactttatatctaccctctgtcttataggattggatcttgctttctgtgttcccagtcatgaattttaatcatgtaagaaaagacaagatcttttaagattacaacaggagcagatcttggtattgtgggatctgaaacacatatgatttggggaagtggggtctatgagaaaagaattaaaaaatcatatgtaaaattgggcatggaagttaacatttatttagactaggaatgggaaggggtccatgcatttgaaagtctctgtagcttaatcttcatttacttcaaacctaattctgcctctgatcatgatctagccctatctgggaggcaggaacacggtggttgagagcctttgttctccaggtgggcagcctgattttgaatcccgccttgaccacttctagttatatgatcttaggtgagtggctgaaatttcacaagcatatactttgtcatttgttaaattttcaaatacaactggatcataaaaactgttaatatgaatgatcatataaattcttgatcatagtgcctgacatatgctcaacaaagtgctcattaaggtgtgtttgatattattagcatctaatgccatcttcttgcttaccagctctggaacctctctatttgagactcccctactatattcatttgatacctcctgaatgcctgagcaccaggcacttaggatttgactctgtgtcttcccattatgtaccttcaacaacaagatctgggccctaactccctgctgaaccaaagcctggttcccagcctcactacaactgtgtcatcgcattttggcatacctattagttttataagaatccttgtttctgcctgtgtaccagtaaaccttccccattttcctgggcataatccaataaaactagaaaaaagtaatatcatgaaaagcattcacaatagatttttaagtgaagagctagaattcctataattgtggctaataaggttgtttttacagggatatgcaaaaatttaatactacaaatatgtaaaatggtgaggtcctcacctagaatataatgatcactctattatagataatgtaattattacaatatgtatgctaccaaatagcattgtgatttctaacaagtcaattaaccttcctgggcctcaatttactcataaaatgaggaagctggactacactttctatgattcttgctagttccaataaatatgtattagtacatatacctgggatattaatgtatcattcacatctcaacttggaatgtgcccaatttgaatatttccctttgaagctgataagtgagggagaaggaactactcaaaggataacaacattgtcttctttttttgtgtgtgaaattcacctttttacctctactgtcacaatattctcactatggcaagtgttcaaggaatattatttgacttttcgaaattccttctctagtaaagtcctattaagacaattaacattgctcctaaaagtgtaattataagtgtggtatatatcccagcttgttgaagcaacctggtaagaagaaatgaagactagacctgctcaccccatgtggaaggtagagggaaaacctagatcaatgaagagcagtgaagttttggcttgcgctcacacgaaagattgggccacaggcagttgtttcatataaaggaagtctgaaaataagtgttgaatccatgccctggtggtatctggtgcagagcaaagaggtgtcttggagtaggcagctatggtacagaaacaatatcagggcgtataaaagaaggtagaatcaggaactgtgtagagactttctatttgaacccttcaatggctttccagtaacaaacagtaagttctaaagtccttataatggccctgtaggatatgaccttggctctccctccattgctcctcccattaccctggcaagctcactctgcttcagctacactagcctgcctgtgctccttggatatatgaagcacacttctaaccagagtctcttgtatgtggcggttcctttgcctggaatgctcttatcccagactctctcatgtctcatgcactcatttaagtattttcaaacaagtcagttctttggaaaggctttctctgacaaccctttgataaataacaccctgtttctgtccccatgctatattttgtgcttgtctctattaaatattggattatatattcctatatattcctttatttatatttttgtcttgcttccccaatagtatatacatttctcaaactctgcaactgtgttcatatactgtgcttaggacaacatatggaccacaatagaggcacatgcagttagtgaatgaatgaatgaatgaatgaatgaatgaaatccactacaactactttgattcttatttttgtagcatttacggtttgtatctcaaaactcagcagatgaacttgcaagaatggaggctttatctgttctgcttatggctgaatccccactgtctagaacagtagctggcacttgggagttctcaatagataatcttaaatgttgtttaccatgaaaaagttcttgtactctagttttaagaacggaaatgaattgttctttgattttggtaacaagtcaccatcagaaccagttttaaactcaacccaatcaatcaatgacaattttgcattagtaaccatgctttggaaagcctaaaactctatatagcaacagcagtgtttggttttgagtgacagcatcttacaagcacagctctcacttgtttaccaagcaatgaagcaacttttggtttaaggcattgagctgtggtctctctctctctctctttttttttttgatggaaagatgatggttcttagctataatggcaaaagacaaataacttattataatcttatacagggttctaagcatatagaaataccaactatattaatccacaaaacaagcaggagagggaggtgctatgattattccaatttagtagacaaagaaactgaagtactgagggttggagtgcttatccaatgtctacagccaaggtgtattccagctgggattattattaaatccaattattttggcttcagagtctgtgttcttagtttctacattctatggcttccctatgagaactgaaacacacacttgttataattccaggagccagatttgtcttgatgattagtctactgacttaatcaaatgcttttcaaataattgtcataaacagtctggccggtgggggtgaatttcaaacagagaggtaagggcagacatctgtgggatggtggcaccaaagcaagcagttaggaaggtacagaatttagaatttaataatcggcatgttgaacaattaaggtaactgccctcgtgacttgtgtgtgtgtatatatttatatatgtatgtgtgtgtgtatacatacacacatacataagtacgtatgtgtgtgtgcgtgtgtttgtgtgtgtataaatatatgaatttctggtaagtcaagtgctatatcaaatatgtgtatatatatatatatatatatttggaaaggagatgaataattgttatttgaatgtggtaacaaatacccaccagaccagttttaaacccaacccaatcaatcagtgacatatatatttgttataggaccttggccttccaaaaattcatctgtggggtatctgaactggctaccagatggtaatggctcagtattactaaacgtattcagacaagtcatagaggtgaaaaacacctcaatttatggctaagtccctcagcctgatagttctttgtaatggcacctatttctaaccttaaagttatgccaaaaagcaacttcactatcactcggccctaaattcttggaccataagcagaataacaagagagctacaatttgaataagcattttatgaaacaggttatgtttgaagtttatcttctgaatataattcattagctttttctttgcagaaaagagttctgtcaataaccaatcatttttagttcatttcgtctctctgggactcagtttccttatctataagatgatcaatttgaaactggcagtttctgcaggatgttttgttctatgaaaccttgaaaaatcagagctacaattatgtaaattactgatatatcttctcttatttttccctcttcctcatttttctgggttcactatagtacctatgcttttactaatgtctctacatagagctagaagcaaaaaaaaaatgaatcagattcttaaatacaatttttttaatgggcatattctgtaagagaagttcatactgtgtatgacttttatgtatctctgtatgttttatcttacttgggaatatttatcttgtgcagtcacaatgaatgccttttggattggcgctacaataaagatattggaattaatctagactccttcatttacttccttgtgatcttaagcaagttattattctccctgaacttctagtttattcatctgcaaaatcaaaatatcactttcagtcttgcatgattgagatgataattccaaggcgaggcatatgcaacactttttttcatcctctttgtcttatacaggttctcaactaaggtaagctttcttccctcccttgtactctgttctcaataactagaaccatcagtgctccttcttgttttttacttgctgagaaaggttggggtgtgtgttttctgttgatgaccatcttcatcaagccttaaaacccaattgatgcttgtgttatgctttaattcaatgctggatgcacttacttcaaaatattactccaatatggatcatcttactgccttcatccatgcttcagtcaacccaatccatacatctcagaccttttcataaataacagtcgtcctggattcaaggtctcactttttctcagtagcatcttatgttgaatttcctcctttctccaatcaccagcccttctctgccccatctatttccagccatcccatttgtctcccaaagcaaaacagatcgactctcagtttgagaataaacatttctgtctattttcttttcaaattttaccccagatcccaactaaagtgtgcgcttgatttgactgaaatttaatgctgatttattcatgttacaagagtttgtttaatttataacatggtgcctttataatattattttactgtgtttagaagattacagtacacatgcttatgcttgttaaataatgtaagtgattgagagtatttcatgcatagaatgcgtccaagaaaggcttgtggaaaaccattaatggatgcctaatttaacactttctcccctttgcaaaattattagccattgcccttgatgttgtaatgcttaggaaatgaaaattatgtaataagatacggagtctgatggcctgagtttgaattccagttttatgacttactagctgagttaaccttgatccaaattcagtggactctataggtctaagttttcttatatctaaagcgtaagtgattacctatctcaaaggatttggtgaagattaaataagatatagccatactatactatattacatgaataatatatctatactatactctgtttaacacatgtctgacatataggtgataataaaaagatattaatattatttataattgttttattttatagctaaaaattaggattatgtcagtcaaataatagtctaaaatcacatgactaataataagtgaagctgtgattagaatccaagttaaataactttagatcctctgagtgtaatctctgaatatactaaatctttttcttccaatagttcccttttaggcattaatgttcttgaaataagaaaagatgaaccataagagaccctaaaggcggtatatgtattccctttatttcattactagatggtgtaaaaagattgtatgtttaagttttctaatataaagtatttttctctttcttaaactttacagtttacaaagacttctctgataccccaaaacacataagcgttggcatgccattgcactggaggaaccagaatgctgggagaattagaacaagactctgtgaatttcaactaagctatttgagatggaaatcagcccctcctagtcatctctggccccttggtccttattaagcaacatggtctgaacacgccatcagtgatgtttttgaatttgcccaacttactgacagatccagcacttccccacttctgtcaacagcacagcagaattaagaacttgggttctaaaaatccatctttgtgtatacagctaatattttgattaagcctcttgggggaagcttgtattacagtattacagatatttgctaaataaggtgagttgaataaatacaaaagacagcctagtccttaccctaagaaggacttagattaccagttgatttctttttgtctttttatcaaagataattaccaataacagtgacttttttcaagtcatgtgtgataatgcatttttgtgaaattttgcttttattaagggtggtagaaggatggttctttcttaattcagtaactgcttcagcataatttaatacatatttagatgaaaagtagatattttcacagcccagtgttacatatagagataatgaaattgctttgccattaaaattttgattcaatttctccctggaatgcattaacagaaaaccactttcatttttatagttgaaagaaaaaggcaatttactgttgtgaagtttcaggagtattccaaaccagcataattctggagcctcctaaactccccactaagtagagagagtctatgaatttaaaacactggccacaggtattgtgttttatccttagaaatctgcttctcattattattttcatgcctactgcactggcattaagattacttttcttcaaaagaaaatgtaataaatattaatggaattaccaaaaaagttaataaatgagttaataaataataatatgatgtgcttacttgttattgaaactcttaagtttcgagaaacggtatcatgaggatgcctgaaacagcagccccacacgtcaaattctagagctacaggaaaggatgtttctctattctcttgaaatacaatgaatatttccctgaggtatgatgaattatcctactatggaagagaaggaaagattagtctaaccattatactgtatatcaattccaaaataggccgctgatatctattttatggtaaatgatatgtgttacataaattctcaaattttaatttcctgttacactcattgaagttttgaaattgaaagttccatggagattatcaagcccagttttctcattttagaaaactagagaggtaaagtgacttaatccaaggttagagaaagcaagagagtagcagaggaggcataagcatttgtgctccaactactattttatattctcaggagaaagaatgttacctgctaactgtaactcttgggttataaacatatgacatggatctctgtgtagtattatgtattcatgaatatcacacatagatcagaacaggacccaagactcaaggacctaatccccagtcttctacaatgaaggagaactcaaatcacttaaagataagcaaatacaaataatttaaacttttatattaccaatttattttgaagtacatgtattctacacatagataaaagcaaaataacaactacattatacaaatgtcatattttatatgtccttcagaacaatatgcatatttcaaatataataatacaaaaaaactacattgtgaataccatgtatactataaaacagttgtaagtttacatgaggaggtttaatgatttagggaaaaagttcacaatcatcctcataaggctttaacctaggttcaagattttctacttaatattcaaattctttcataggacaattgagcagacagaaataagaaaggtgaaataaatcattatcttctgaacttagacatgcaaaatggtgcaggaggaaaggaactctcaggcgaaaagaaatcggaatgaaatgagcatcagtacttttttttaagaaagtttcagaagaaaactatgaagatgctagcttgataataaacattgcttatccttctattaattaaaattaggctgtaactgtagagtgcacacattctgatctatagacttaaactacacacaatcagctatatcaatctattcatttgttttttatctccagctagcaaagtatttagtcaaattaaatcttgttttaaagggcttctcactctaagatttactttggagatttgtcttatacagacttccaaatgaaaaacactattgctttctatctctgtcaacttttattcattaaatatttcttccttaatgtggttatcaacattttactatttataattacttcctaacaatcactggaaatcatatatgaagtttatattaaagtttctgagatagtgcattctctccatagtattagtccaagattgtcctggagaatgctgatattgtaaaacgtaaagtacaagagagaaattgttcatacaaatcagtacagctttgaattcaagcaataataaaaaggaaagacttcatagaggttagcagctcttagaggaaggaaacacaagttctcatttgggagagggaatatttgtgctcctgaaacaagcagaaccaatactagagtaggtgtcatcaccaaatccagattcaaagccttccacacaagagctgaaagaatggccacacaacatccatgaaatgagatgaaacaagtccctcaacagagctaggaattctgagattgttccatgaattgtcagtctcacagagaataaaaaccagttcattaaaatgggacatcccaatcacatttgccaactaaaataacacacacaaatgaacagagaagccaaaccaagttactggtttcatgagagtgtacaacatgaagtcagttttaaagagcaatggccacttctagattttagaacttatcctctttctagaactacagatatttccatcagagagggctaccaaaagcattctgcaacttattttaaaattaaataaacaaacccagctctccaccatcccccgcctcctgcgccctgcatcccccgccccatgagttataaatgtaggtttctggtaacctacatcagagtgacacacttattttaatttgatgtttgctatttgtaaatgcaatctcatttatgttacactgtggcagccattctctggagggctggattagttgtggatgtaaatacatttataatgtattttcctttttacttaagtttaaaatttgaagcaaggaaaatatctaaacataactacgtcaaacatcatctagagcttcttttaaaaattgctctgccaactttagagaaacaatgactggctgtatgcaaacacactctcaaaatgtgttctgagcagttagaaaattataatgtaaatttactcagattcccagagaaacatttaatttaggaaacaataaggacaaatacaaaatgtattgtttaaacaaagaggtgattgataaggagaacaggagaacaagcctctaatgaacataaacagcaatacttgaaaaacaattggctacctggaatctatgttaaagtctgttatatgagttagagtcttttccccttagaatctctgttagcatgtaaaataggtaacattataaacacttctccagaagactttatgaaaagcctgtcattctcaggctccaaccttagaccataagaaattatgtctatttatttccatttgatcaatgtatttgcatagcaagaaatgagtgatctcacaatatacccaaataaaatttgccgatacaataaaaggaggtactagataaaataatcaagcatcagtatggactaaatactctcaaaataagcaggtagatccattacaaacccttaattacttcagtttttgttctgacatttttgatccaaagtgtttctcctagttttaacattctcttgtgaaaacattactgcaacttacaaaaagtttatttcattaatctttcctaccctgaaaaacctggcttccttcatgtccatcccagagtaacatttctctgatctcatttcaggtgcctcttacattcacctaagacattttcattgcaaaacagagaatttttagaagtcactaaaaagcactcccttaccttctaaacctgcttcaatcagcccaaactgttccaataatttaacaaaaagcacaatgacgatcagaactgctatcatttcaagcccttccaagttcatggtcagctaggtcatggtccgaccacagccactgagaagtgctcctctgcctggctttctttgtaaagccattaaactacattaagaaggctactgctggagaaaggggaggaggagagcgtatgagagagagagagagagagagagagagagagagagagacagagagagagagagagacagagagagagagagagagagacagaggagagagagggagagagagagagaagggaaaagagactagatggagatggagaggctgagaaaaagggcgtgagtgacagaaaatgcattcatcctgtctgctgtagcagaggccagaagtagcagccggataaagtcgggcctgtcggaattatcggcttcctcattatcactcttgcacagagagacagccacgcatgaagtcgcggcgcagatcacccgaggacccaggaggtcaccaggaacgtcccgaggaaacatgaggcccggcgcggaggagatggctctgcgccccgggactctgcgcgccgcgccgccgccaccagtggctttgttgggccggccagttgccttggaaacaagagaacccaaggaagggctggactcctgctgcagacagggagcagagcaccgcaccttgaaatacggagaaaaacctgaaaacgctgagaggtggagtgacaacttgcattcagctgtttcagaaacattgttgaccagtaaggaaaatccaaatgtgtattttgtcccaactagctgagtgcagattgcaacgaggcttaagggagtccttcaatattgactttctttcccatgagtcaccttatccgaaagctcagtcactgagcactaatattctggtttgagtagtaactatcatatctttttgaagcatgggaataataaactaataagtattcatcatatttgcatagtatcttagagtttagcagctacctcctctgcactacttcataccattcaatacaccaaaatatatacagtatttaatgtgtccttctatcctttataaataatgatgtaagtaaatttggagccaggaaaagtttgagaataaaaaaaaaaaatctgaaaaaaagcggaagtttttgtctctctcttgcacaaactgtttcatctttttctttcctcctaacactgcccaaatagattagctccacaatgaaatacagaatttaaaaaaactacaagagagagacagcatcttagaaagccaattaaagtctcctatttcatagatgaacaagctgaggactgaagagagcaaaagaaatgaggcaaaaaggcagagcaggatagaatgaaggcatccttcacttggggttggcttttgaggcagtggagtataagtttagaatataaactccagggacagactgctgggatctcttactagctgtgtgaccttaggtaagttacttaacatctcagtgtcttaatgtcctcatctatgaagagaggcataatagcacctagctcatcactctgttgagggaattaatgagtgacacttttagaaaagagtgagtgctcaatcactaccacctcgggtgcttttcacaagtgtctccatgctctactcagactttgctgggttgccagaggaatcaatctggaggaagtgcagtcctcctcttatcattctcttaatcagaaaccttccatggctccctatttgcctacagaacaaagttgaagctcctttgaagagcatccttttctctccgtgatccggtacctccttgaggattgcacctcagtggtcttactcctgtcgatacactctacctgacagctcagcttccttcacccaaactcattctgggcttttccatttctaggactttgctaaaattgctctatctatttagaaaaaccttcttacaccatctctgcctgtcaagctcttaaaactctttcatggaaacttcaaccagaattggatcaaatctctcttttttgtgtttttacggtacttttcctacttatgatgtattatatgatagccatatgggtatacattctctccattaaagggtaggctgccagagggcagagatcatgccttgctaatctagatagtcactactgtgcctccatggagggcacttcttacttcatagatgtttgctggataataaaagtcatcaatgattaggtgattactacacaccagatgctttaatgcattgctccttcctagacattctaaaagtagggatgatgatttgcaggtgtaacactagcctcagagaacctaagtagcaggctcaaggtcacacagctggtgaatgacggaaccaagcttcaaattctgatgtgtttaatgcaaaacccattacttcatcccattatccaacagggctttaaatgaattaaaaatccaaatattggcacaagtgcttatcagcatggggtgaaggttatacccaaaatgatcccccacactgttttgtgacattcttttttttgagagagagagacagggttttgctctgtagcccaggcttgagagcagtggtgtgatcacagctcactacagccttaacctccagagctcaagtgatcttcctgtctcagcctcccaaagtgctgggattacatgcatgggctaccgcaactggctgacacactgttttagccattaactccggtaactttggaacatgaaaagcatccaaactagtagttaattaaactcaaggatctttcttcctcctcattcacaggattaatattacttaaacacacaccacctcggaactcaaaagggagttgtttttctagtacagtgaactctgcagagcccttcagcttgccttatatatgaatgtccatagtcaagtgctttgtgttcacatttaaagttgatgacctggggctgagaaacatatgtaggcaggaactttttttttttttcttgagatggtgtttcactcttgttgcccacattggagtgcaatggtgagcgatctcggctcaccgcaacctccgtctcctgggttcaagcaattctcctgcctcagcctcctgagtagctgggattacaggcatgcaccaccacacccagctaattttgtatttttagtagagacggggtttctccatgttggtgaggctggttttgaactcccgacatcaggtgatatgcccaccttggacccccaaagtcctgggattacaggcgtgagcaactgtgcctggcaaccgtgccgggccggcaggaactattgaagagcatcagagtgagagtccttccacttggtctggatgtcaaaattacgggttcctttgctgttatgtttttcatcccaaggcctgagggtttttctttttttaaatgtttatgtcattagctccagcctttgtatttccctctcttgcagtgcttatccccatatcttcccatgagtaagtgacttgacttaggtcttagttccaaaattcctatcacagagaggccctttctaactgtactatatagaaaaacctccctcacctggccctggaatcactaccctctgaaccagtgttattttcctccaaagcattgtcaccacctggcatgtatatttgtttattaagtgtctccttctgccagaattgctacaatataaactcctacccatgagggtagagatttttgtttgtcttgttcaatataatatcctcaatcccagaatggtgcctggtgaataagagggagtgagtggttgttgaatgaataatctgattgatattctcacctaaaaagctacctgctctctcactgatctggcagagcccaatttcctgttaccagcatgcctcctctgcctggggagcctgagagatttccatactttttttttaggaagtcctattcctactgcttctttttaaggtgagccatgagcactgcatgctcacacatattagctgtgctctatcttcagcatttaatgtgaatatgatttgtggttcctgcccacgtgaacaatgaaagcaatacaaggaaggcagccaagaaggttgccctgcccaaaatatcttaaaatcactggtgtggatgataagtaccttggatagcatccactctcatcccttcattttcagctaaaagaacactgcagtctaaataagtaaagttacttaactacatatgcaactcttaccttcaagtcgcagcgtggattcaaactaaaatattaatccaatatattttcttcctgtagggccttgaattcccttttaaaagagaaatattaagagcatccaacagaaagaggaaacctaaatactggctccaaatctttgtcctcgtttggattacttaaacttgctaagctttggtttgctggtcttcaaaatgaggccaatatccctccttcagggaagtgttgtgaggattaggtgcaataatatttctaaatgatacttaatctccgtggagcacatacgttttcaagcagtgggcctaacacatagaatcttcctttctaaatacccctctttgaggaagagaggggtttacatttccatcttatggatgaggaaacaaaggcttgtgaaggactagtcaatttcccccacatcccaaagcatctgaagccagtggggctgatagctgcttgctgatggtcataacattttcccatgtgtctcatgtaacagtggccaggaatacccaaagcattcaatgaaacaaacatcaccagcataagtaacccaacacttgatagtgactttttaaaagatttctcgccctttctgcattaatgttagatacaagaaagttctgtgcccctgccgtgtgagtgtgtgtgtgtgtgtgtgtgtgtgtgtagcagataagtatgaagcggcagtgagagaaaagggacactgttgtgacagtttgccaaaattttcttctctgcaatgcattctcacgtaactactgaggagggtgagaggctgtttcaggcgcccccatttaaagaagtttcttcaaagcaattttggggagtccttcagctcaggctctactgctgcatgaaggttatctcttgcctgtccccagaaaaatgaacgtgcttagagacactcttacttttgcacttcagagcgtacccctaaagtgcagtttattcaaaatcaccagttaactcacagtaatgaacccatttctgctttgattccagcaatatggcttttggaagaaaaataatgtttataaaatgaaagattagtttgccctttgatgaactgaggcagggaacaaagggattttggcacgttatgtctctctagattccaggctgggaaggctttaaagagaagaagagaaagggggcgaactttctctacgctttcaccacagagtcccagtgagttggccttctcaagacctaaccttcattcagtttgtttctgattgttcatctttcattcaattgctaaagttgtggtccaggtactatataagccagtatgagtaataaaaagatgaatacccatttttccatgagctgattattaagtatttcatacctgtacaaaaatatcacttgtagcccataaatatatctatgtactcacaaaattaaaaattaaaaaaatatatccttagtcttcactagcttaaaatctattaaaaacaaaattcagatgataatagctcatgtgtgtagaataatcactatctgagagactagcacacggagcactttatatggattatttcactgtatcctctgtaaaccctatgaggcagctactaatgctatctccattttgcaaggggaaattgaggaatggaggcctcattgggttataccaggaaatatccagctcgggattgaaacccaagtctgactccagtgatcaagagataatattttagatgccattgaaaacacctgaaattcaaagcagcatctggtaaaagtctttaagaaagtatggaaagtaccatgagatcagggaaagctgacaggctctaatggtagtggcaggtaggggaatcgaactaagatcagctttatagagatcacgttgtgctgatactatgtagatactaggtggtatttttcttttcataggaaaggcaatgtatattacatgaccaatggagaagaaaactagtcttgccagatattttttggtttttttgagacaaggccttgctttttcacctaggatggaatgcagtggcccgatctcagctcattgcaacttccaccgcctcccaggttcaagcagttctcctgtctcagcctcccgagtagctgggagtgcaggcgtgcatcaccacaaccagctaatttttgtatttttagtagagatggagtttcaccatttctagggctaggctggtcttgaactcctgacctcatgtgatccgtccgcctctgcctcccaaagtgctgggactacaggtgtaagccaccacacccagccttgccagagaatttacccagagcctgaaagaacagtcaaagcccatctcaaatcacttgcccaggtgctcctggaaagtttcttcccctcatttttcagaccatctcctattctggtgcgcaaaatcagcatcagtgacctgcctttaacttcctttggcacttacttgatccaagagaagcctggctgaatcttaggattgagtgaatagaaagcaaatttgacccttcaaaatgaactgaaagaaaacgagcagaaggcaaaggcatcacataataaatgtatttctttcttcttcttttttttctttttttgagacggaatctcactctgttgcccaggctggagtgcagtggcgcgatttcgggtcattgcaagctccgcctccgaggttcaagccattctcctgcctcagcctcccgagtagctgggactacaggcacgtgcacgacgtcggctaattttttgtattttaatagagacggggtttcaccatgttagccaggacggtctggatcgcctaacctcgtgatccgcccgcctcgacctcccaaagtgctgggattacaggagtgagccactatgcctggtctgagaaatgcatttcaataataatgtgaaaagacaatgagccgcatttatggcagaggcagtacaatgcagaggttaagagtatgcttgggtttaaatccccactttgtttctttagagccttgtgactttgggcaaattgctgagataagtcatacaaagcacttagaacagagactgtcactgtgtaaatgctcaataaatagtagctgttattgttatttattgagctcttgctacacatcaagtactgttctaattgaattatcttaatatgtccatataacaaactcaatgaaccaagtactattattattcctagccactatatggataagaaggactagggcatctgcaattgaggtggaattctaaggaaaacacattgcttatacccacccatgaagctgaccaccatcttcaccacgagtaatataggaagaaattataaacttataatggcttggtttttaaattgttcttcttaaaaatgatggaaaccacctgttatcccagcactttgggaggcctaggtgggcggatcatgaggtcaagagatcgagaccatcctggccaacatggtgaaaccccatctctactaaaaatacaaaaattaactgggtgtgatggtgcgtgcctgtagtcccagctacttgggaggctgaggcgggagaatcgcttgaacccaggagatggaggttgcagtgagccgagatcatgccactgcactccagtctggtgtcagggcaagactctgtctcaaaaaaaagaaaaaaaatgtaaaaagcctgaaaataactatcttgaacactgatatttgaggacatctttgtcaccttccattctgaaacatttcacaagatgaacagatgcagtgaggtgttggcatgacatcagattacagattctactcaaattcaagtggggtttcaaagggtcctatcatcatttccttgaggaaacccaccttcaagggcatatttgactgcttcataagtctcatcagccccatgatctatgaatcacaatgtagttctagactagtctagtcttatttggtctagttccatgactagacaatatccttaatgatgaaggatcaacaccacacccagacttcaccacccatccttgtcctaagaataaatagcaaacacaagctgctcagtgggtaaaggtagttaaatggaggaacaatagacagggactcaaacaactcatttgagctgtacattaccacattcttaaaggactgaagacaaatgggaggaaaggaattggtagcaagagtgtccagcactggcaagagagaacagagaactaagctgttatacatatgtattgactcgtggtgctcaaactgttatgtgcatcagcattaactagaaagctccctaaaaaggaatcctcagacctttcccagagattctcatttcataggtcttaggtagagaccctggatctccatttttctcaaaagttctaatgattcttatgcaggacttctctggaccacactgtgagaaacactgcattaatctgctcaaacaccctcacccatgtaaggaacacattctcccagctcttcaaaactagctgagagtcacaccttttacaaacttgacatggttaagaatagacgggggttccttcggtttctcatacttctctggaaagttttttcttcgaataaaagtaaggcattttaaacagattgggaatagacacaagtttctattccatatttaaagggttttgtttgtttgtttttattcaggtcattcatttcctgcattcatgacaactttctctcatcaatgagctttagataccaactttagtagagacagaggactgtgaatgatcccacacttttctgcatcacttcataacctagctcccatctttgatctgtccctggagaatccgtctttcagctccaaatgtaatcacttaagtgaagggcagaactgatgtgcagccatcttaatagccaagctaagtgaagtaaatagaattgatagatacaaatgttcagaagtgtgaagctgatttagataaagtagatatttcagtttgagatctaataaaaagcaaaacagcagccacatggagccctttcccattactccctgggtctaatctttatctaaatcaatactataaaagtaacaaaagacacaaagttgtctgatgcataattcacttattatgaactcatgtaagatgcaaataattgaaacaggattatttatgtgatcattaaacccaagggtaatttcaacagatttttagccctggttaataaaaatcttagttgtggatacatatttagccagatttccttccaaatatcgtctcctccaacaaattattcctcattacagctgacatgctgtacttcctcactgtaatagagtataaataattgtttatcctattattttattgcaccaaagaaatataaaatgtaaaaagcaatatacaacaatctccttgacaattattcatgtttatatgctgtagtttaattactaacaattctaactactcacttgttattaactttgattttaaacacaaatatttcaaataaaaaacctatgataaccaagttaaactagaatcgaattatgaatactaattaagtatatattttatttgaaaaacacacaggacaccgttagtagaaccacactgaaaagaaaaattatcctcaatgcaatggaaatgtaacccattaaataatacaaagtggcctcaaagaattaaagattagcttgtatggataactgagagcatgctatgttaagtttattatgagcagactaaaactctcttgaagggtcatcaaaacaagccagtcaagcctgacctgctggtttgataactcaggatggcacctctctgaactacggtattgtttcacagttttctactgctgcatagcacatcatcccaaattgagtgacttagaacaacacaaatttattatttcacagtttctgtggataaggagtctgggtacaggttagcagagtgctctattcaggcttaaatcaagatgtaggctcgggctgtgatcatatctgaagctctgtgtcctaagatcacagtttgttgaaaggattcacttccttgtagttttatgactgagttcccctgctttcttgctagctgttggacagggaccactctcatctcctagacattgctcttggtgccgtgttctgtctgcaatgtggtaggttgctctttcaatgctagcaagaaatgtcttccatgcttcaaatttctctgacctcttttcagggcttggccgattaggtcaggctcacttgggattgcatccctttggattaactcaaagtcaactgattaggaaccttagttacagctacaaaatcttttcacccatatagggtaccaaaattatggtagcaatatcctatcatagtaacaaatccaattcacacttgaaggaaagggattatatagggtgtgtacatcagggtcattttaggtgtgcaatcgtgaggactattctagaattctgcctaccacaacaggtttccactgtaactgctgagtggcatgctaggtgttctgtggttgtaggaggctgaaggatatttttttttatctcatgcatttttcaaactatatctgaggggaggctcagcatagaactactggacatttggccactgaatgcacagaagccaacagaaagatgtaaagtcctggagtgtaagctctctattaacaagtcatggtaacaaggaaaggagaatggccagaaaatgccaatgcaaaactctggctacctagtgtggttagactatatgttgaatagctggcttcatccactgaaatatataaggcagaaagaactatctagaaaaggataaagagtaccatatttgggaccttaacactgtagcttggggctccatttcttttagagcagattcttcttgtatttatagttttatttttatttttcctgcttcctgttgctctgctctggctatgtttccactacagttatggctgatcttatgatctattcacttcctcaagttagatgatagtgaaatactgcctggacacaaatcctaactggatacttcactggctacacagctttgggtaaataccatctttcagtctcagttacattacctatacaacacagatagtagtaacatctcagagttgttaagttgaaatacagttgacccttgaacgacataggttagagccccacagaccaacttatacacagacttctatctctgccacctctgagacagcaagaccaacttctcttccttctccctcctcagcctactcaatgtgaagatgacgaagatgaaagcctttatgatgatctacttccacttaataaatggtaagcatagtctctcttctttatgatttttttaattttttttactagcttgctttcttgtaagaattcagcatataatacatatacaacgcatgtgttaatccactgtttgtaatagatcaggcttctggtcaacagtaggctatcaatacctcaatttttggacagctaaaagttatacacagattttcaactgtgggggggccagtgcccttacctctgcattatttaaaggtcaactgcccttaaaatacatcaagctcccagacagtaccaaatcgacattaaataaatactattgttattgacataattagtacaaggtgggtgttatggttattttgctcccaaggtatacccagaatctagggccatgtctgatttatggcatccactcaacacatgactgtcacaattctgtgaagcctctcttcccttctgatctacccactgtataccttgttgtcaaagtgaaaggaacatgtaattccccagcttcgattttcagtggtattttgctggtatatttcattttgcagaatgaaatccgaagtcatggcaaggcattcaaaacccctaccaactttccaaggaactatccatcctcatttcctgaccgactgtgttcacactctgtgttcaggtcatgagaaactactgctgtaacccaaatgccagggtgattcctccaactgcttccttttccttctgagaaattcttacccatcatttaagaatcagcttaaatccttccacttgggtggaggctttcatgagcccatcttccaaagacaagattaaccccttcttctttctgctttgtaactatattcaactactatcctttcaagatttatgagcaggttgacatactatgtcctgtacaaaactatgaatcctggggaggaagggccatatctgatttatatttctctcctcagtacttatccatgtgcctgaaatatattagttgatcagtaaatgttgcagtaaatgaaggaggaatggaaaggaacaaagaaagaaaaaaatgaatggcatgctatctggagggtacaaggaagatttaagccaaaagcataaccctgcaacaaaaatcaccatgtctagaattcaaccattaaagatttaatttttcacattaagcatttcaggtgtcctgaaaataactcaaatggcagaaaactttaatcattaacaccatgatataacagattttcatttgtcacctttgcgcatgaaaagtgagaccactggcaacctgggaacttgaagctggttggcactaatgtgtgaaggctatgttgagagtcagtctgatagcaagtacagaagcttaaccagcaaaatagctagctagttgaactggaaaatccagagttattttaagacaatgcagaacgttccaggacaatccagcaaatcaccaatatgctaaatgatgcttcttcctcctgttttattttctatattaactgtttactgtattgaacattcaaatgcattgtcttgaaataattatgtacttgctaccaccctactgattgatacaggctgccaaattattaaaccaagtttacagaagtcagcttctgttctgggaataactggctcggggttttataatatatattccatttctttaggtacccaaaaatgcccagcatggtattctcaaaggtaacatcagtttgttcttatgagctgctctggccttcacatttcttaggtggccattcaggagatacttacaagacgatttagtgttcttgtgggatataaatgcttgccattagcaaagggaaaacttggcaactggtatggagtatcaagtatttcaaatagtttttactattgagttggattttatcaaactcttaacttacatgccaactatccccttttcatattttaaatccttaatgatttaacataaagtccatcagcacattttgattgatgaacatagaaatcatttttattaactaatatgaagttgtaaaaatatgtttactattctgtgtccaaaaacacctttaataatttctccatgggtctccttattttgagaaaaaaaggtaacaatttatggaggaaatcaaatgagcaaatatctatttaaataaactaaggatttttcaaggggttgttaacgataatgttgacaacttggtaaataagcaaacactaactcctattatacatataaggtgacaatgtgtgactataaagaatagaaagtgtgcatatttatcaagaaatcattgagaagctatattatggttataatggtgctggccttgcagaaacattttggagatcctcttttgagaactgatatggtttggctgtgtccccacccaaatctcatcttgaattcccacttgttgtgggagggacccggtgggaggtaattgaatcacaggagcaggtctttcccatgctgttctcatgatagtgaataagtcccaggagatctgatgtttttaaaaacaggagtcttcctgcacaagctctctaactcttgtctgctgccatgtgaggcgtgtctttcaccttccaccatgattgtgaggcctccccagccatgtggagctgtaagtccaataaacctctttattttgtaaattgcccagtcttgggtatgtctttaccagcagtgtgaaaacagactaatacaggaactgtctttaaatccgatttataaatcatcctgccctgcctgctctagctgacacctggctgccctcagactcaaactttccaaacctcttcaaatcacattttgatgatcactgatttacttcttgtaaacagctttaccaaagagggagacattttaaaaaagacaggtaaaatgacacgcaagtaacttagctattctcattagctcatgtaaaggtttgctagggaaaaagattgaaattaatggttagaataagccttttgtgttatcattaaatttcaattatgtacaatccttgcttacattacctggaataattggaagttcacagcatcattgtgagtcaaagcaatcctaataattaatttcttgctactcaaggtagaaagagcctctataattctactctatttggaaaaggtatcatagattcactattcacttaagccactgactttgaatgtttgaaatgggattttgaaaaggtcatttttctatatattttatcagttatttgcttttatattttttgagagttatgcattgtgtatataagtactgtgccactattgtaccaccaaatagtggaagcgaaaacgacacactactcgtgtttttttctttctaaaatcctgggtttttttgcagtgctttttgatatgtgtcttattaactgcaagtttatacatgaacttaggattcatttgttaaagagcctgagcatgaagagaagcttatttttctcttcatgagtgtaatcctgcagttttacaaggttagtaaaaaccctcttgggtttttatttttcctggacattagaaacatgaagagtctttcaatgagaaattatttgaaagggaattatatttaggccataaacaagctgtgaaaaaaactcaacataatccctcctgttaaaaaggttgaactccagaattttactaaattgataatggttgtacacacctgtgaagaatgaggaacaactctaagcagatgacctatcacgacaatttaaagagagaacttatgaaataagttggagaaaaatgcgctaaaatacattcaacgaggcgcgaattctagcctggcacttagggcctgctctatccacaggcaaaggaaaatggaaaagataaatctaaagggagccaagacctgtctgcttcccaaggtctaccaggcatggcttgatcatgctggctttgcttacagctttgatcatttggttgcaattgacaggtacttggacaaatcatgtctgcagtcagaatggacttaaggaataacaaatcaacagacacatgctatacacagagtgaaccttgccttcagccttgctgtgaacttatgctgcagttcttataactagttttccccttatgtctaaatccatagtttattcctagtacctgcctctcaattacccagaatcttttcctagaaactcttctaatgctaccaccactctgcagctctggaggctgccttctcctggacattccactgttatgtctaggcccatcatatcttgctgaattcctcagaaatttgaatcacctagtagcctgataaatatctatgcacactggatagtcctccccttgtgaaggtaaacttctttctacccatggtcaagaccatccagtatattctcctggccaccctacacagatgcacacaagacacacacacagatccaaacagacatcagtcaaaaacttttccacaacaatcagctcacttccacaaaaacagaatcctttagggtgtgtttttgttttacaaaactggtcgtgtcccactaatggatagcaaaatcaacttgatgagttcatgattagcagtatggaatagaaaagaaaaagaaaaaagaataggatagaactggtgagtgttttgcaaatagaaaaggcattattttgtgaaatccttttcagttatatttatttgtgtttttctatatgttcctggttatgataaaaaatgcacttcttactgtagttcatcatcaggaaagttttctaaaccatgtattagagcatttggagagaaaagcatcatttctacagttaaccttattgaaattgtaaatttgtgatctgaaacagattacacattaaaccagtacttcattacagacacaacaacaaacacaatttcatctgataagcaagttatcttcaaggaagcagataagcagagtttggagggaacaggcatctaaataattacattttgatggcacaatgaggaaataatctctgtgattgaatggtttaccaatttaggtgctctggcctgaaggtgcctggctaagcaggggctagcatactcgggcactgggaaacttgaaagagtgagtcaaggaaactatagagaagggcttggcataggtgagctccaagtgtataatcattctattgctaacaaattgtgttgggtagaactggttaagaacaatgatggtgagatcttatatgtgtttatgtgttagcattttttaaaggatttttctacctactatattgttttagtgaggcatcttagatgcaaaatgtaaggtgatgctcattctcaggatttgcaattaccctgtgagctttgcttgcctggccccagtctaggtcctgtacatgagatatgacagtattgattcctaggccggaagcggtggctcatgcctgtaatctcagcactttgggagaccaaggcgggtggatcacttgaggccaggaatttcagaccagcctggccaacatggcgaagccccatctctactaaaaagacaaaaattagctgggcatggtggtacgtgcctgtaatcccagctactctgaaggctgaggcaggaaaattgcttaaacccgagaggttgcaacaaactgagatggtgccactgtactcaagcctgggcaatagagcaagaatctgtcttaaaaaaaaaaaaaaaaaagaggaaagttagtcctacagaattttagctgaaaggtcatgaattgtggtaaatctgagtttaaacctttggcctcctgagttctggaaaaaatgcattttttaatctacttcaaaagacctcagtaagaacttattctgcatacatttgcaaagtaatgaactggcaagataaagagccatactatggttatttgttatgaaatgtttgttcagaatgaaagaatggcaaaatgcagccagcaaggtttcagccttgaatcctgcatttagtttgaggcacttccattccagaaagacaaagacaaattaaaaaccatttagagaatgataaaaagatgagtagggaaaagaaaggtttgatttatgaggctagattaaaggagataaatgcctattatgtggctaagtgacaaccagggaagataagaatctacagatattgggaagatgtaaatataggtaatagagaagacatctaagtgttctacaagatagaactagtaagaaaaacggaataaaatattaaatgggtagacaatacgaagaaggcttttggcaaaaggattaagtgggtagcaatacaacatggaagatggaggggtaggaggaggaagagggagaagaagggagaataaaagaacaggagtatgaggaagaagaaaatgaaggaagaaacaaggaaggaggaagggaaggaagaatgtgaagagagagaaggaaggagagaaggaaggcaggagggaggcagtgggagaagtggggaaggagggaaggaaggaaagaagggagggagggagagaggaaggaaggagggagggagaagaggagggaaggagaaaaagaagaagggaaggaaggaaaggaaggaaggagaaaggaaaaagcaaggaaggaagaaaggaaggagggaggaagggacagagggaaggaaggaaggaaaaaggtgggaaggagggagggagggagagagaaaaggagggaaagagaaatggtggaagggaaggaagagaaggaaaaaaggaaggaaggagggagggagggacagaggcaggggaggaaggaaggaagaaaggaaggaaaggagggagggaggaagaaaaggagggaaggagaaaaagaggaagggaaggaagaaaggaagaaggaaggaaggagggagggagggacagaaggaaggaaggaaggaaggaaggaaggaaggaaggaaatgagggactatgttttgtcccactgtatttaacagaaaatataagaaatagatttctggcagttctaaggcagaatgaacatctttccagaaacctgagccagctgaggagatggtatcaacaaccaacctcaggggaggaggccacaactaaatcagaaggagacagtaatgaggagctgaagtgggcttgcaaagccattactcctattaagtccagggcttgtgcacaggctacctgccaacttttggctagcctataacacataacagttactgtaattgaaactgaattataataccatcctggcacacattctcccctaaaaatacaacacataataatgctgttaaaataaggacatctggaaaacaatctagagtcccattgtttgtagctggcaccggccttctaaaggagtccttcctgcttcgttcttctactgtataaatggtgacatggtgaaaagggacacttcatttaagtgaatccgaagtttaatgtttgttgagaagcaactagatgccaaacactataccactcctgtttttgttaaataaccatctatgtgattcagattcatatccctgtcacaagattaaaaatctggtgtcaaagaagttaagtaatacattctaaatcacttaaaagataagagaaataaccagaaatagaattctagactgcttgtccttgtcctcaaaatatttccattatatctaacagcaatttgcccaaggcataacatttagtaaatgttcaattaatatgtgcataattgataattgtgcagaattgaattaaagggaattgatggtataactgaaatctaaaaagaatccctaatgacttctggtgatgaattgatgaagtgttgccaaattttcatcaaatgttgaagtatgtatgagtcaattatggccacactgaaaaatggcatctcttttgtaagtatatatatatatatatatgtatatatatatggaatacatgagatatgtatgcaggcatgtggtgtgtaataatcaaatgagatatctctaacctcaagcttttatcctttctttgtgttacatacaattcaattatgctcttagtcatttcaaatgtacaaattagtgttgactgtagccaccctgttgtgctatcaaatactagaccttactcactttatagaatgatattattgtatctattaaccatccccattctcccagccccagtacccttcttggactcttgtaaccattattctactctgtatcttcatgagttaaattgttttaatttttaactcccacaattaagtgtgaacatgcgaagtttgtctttctgtgcctggcttatttcacttaacataattacctccagtgtcatccatattgttgcaaatgagaggatctcaatcatttttatggctgagtagtactccattgtgttaatgtactacatttcctttatccatttgtttttgatagacacataagtagcttccgtatcttggatattgtgaatagtgctgcgaaaaatatgggagcgcagatatctctttgatatactattataacttcctttcctagcagtggaatttatggatcaaatgagttttagtttttttgaggaatcatcaaactgttctccataggggttgtactaatttacgttcctaccaatagtgtactagtgttcccttttctccatatccttgccagcatttgttactgaatgtcttttagataaaaaccattttaactggggtgagaaaatatctcattgtagttttgatttgcatttctctaatgaccagtgatgttgagcacttttcatatatctgtttggcaactataccttttcttttgagaaatatctactcaaatcttttgcccacttttaaggtgtattatcagatttttttcctatggagttgttttgagttccttatatattctggttattaatcctttgtctgatgcagtttgtacttacttttccccattctgtagaagtttcttcacctggttgactgttttctttgctgtgcagaaatattttaatttgatatgattccttttgtccatttttgctttggttgcctgtgtttgtggtatattccacaagaaatctttgcctattctaatgtcctggggaattttctcaacattttctgttagtagtttcaaagtttgaagtctcagatttaagtatttaatccatttttatttgattgttgtatattgtgtaagatagaggtctagttccattcttctgcatatggatatccagctttcccagcaccatttatggaaaaggctctcctttcatcaatgtatgttcttggcccctttgtcaaaaaatgagttgagtgtagatgtaagaatttgtttctgggttgtctattctgttccattgctctatctgtctgtttttatgccagtgccttactgtttttattactatagctctgaaacataatttaaagtcaggtaatgtgattcctccagttttgttttgtttttttcttttactcaggattgctttggcttttctgggtcttttgtggttccacataaattttaggacagttttttctatgtctgtgaagactgccattggttattttgataggaattgcatcaaatccatggattgctttaggtagtatggacattttaataatattgttttttcaatctatgaacatggaatatatttccattttttatgttcttttcaatttcttgcatcagtgttttatggttttcattgtagagatctttcacttccttggttaattcctaggtatttgattttatttgcaactattataaatgggattattttctggatttatttttcagattgctcactgttgacatatagaaatactatggatttttatattgactttgtatcctgcaactcacataatatgagtttggaagtattccctcctcctaatttttcagaatagtttgagtaggactggtgttaattcttctttaaatgtttgatagagttcagcagcgaagccagtgggtcctgggtttttttcttggatattttttattacatctttgatcttggtacttgtaattggcctgctaaggttttgggtttctttgtggttcaatctagtaggatgtatgtgtctgtgaacttacctacttattttaggttttccaatttattggtatatagttgctcatagtagcctctagtcatcctttgaatttctgaatcatcagttataatgactcatttttcatctctgattttatttatttggttttctctcttttttgcttcattagtctgtctaaagttctgtcaattttatttatcttttcaagatacaaactttatgtttcattgatcttttttactgttttctttgttttcttttcatttatttctgctctgatctttattacttcttctactaactttgggtttggtttgctcttgctcttctagctctttaagatgctttgctggattgtttatttgaaatttttctactttcttgatgtgggcacttacggccataaattttcctcttaagactccttttgctatatctcataggtttttacatgttgtgttttcactatcatttgtttcaagaaatttcttaaatttccttcttaatttctttattgacacacttgtcattcagaagcctgttgtttaatttctatgtgtttgtatagttttcaaaattcctcttgttactgatttttagttttattctattgtggtcaaagatgatacttgatataatttcaattgttttgaatttttacagacgtgtttgtggcctaacatattgtctatccttgagaatccatgtgcttagaagaataatgtgtattctgcagctggtagagataatgttctgtaaatatctaaggttcatttagtctatggcagattaagtttgatgtttctttgttgattttctgtctagatgatcagttcaatgttaaaagtgagtgttgaagtctccagctattacattattgtattggggtatatctgccattttagctctaataacagttgctttatacatctgggtgctctagagttggatatacatatatatatatatatacatatacgcacacatatttgttatacccccttgctgaattgatctctttatctcttctttgttctttttatagtttttgtcttgaaatctattttgtctaactgtagccaatcctgctgttttttggtttccatttgcataaaacatcttttttcgtacctttttttttcagtctatatgtatctttacaggtgaagtgtgtatctttacaggtgaaatgtgtatcttgtagacaacagatcattgggtcttgtttttttgtttattttattttttttaattcagtcgtctactctgtcttttgattggataatttaatccatttacattcaaggttatcattgataaatagagacttacccctgccattttgttatgtgttttctggttgttttttcggttttctcttccttttttccttcctttctgtcttccttttagtgaaggtgtttttctctggtggtatgttttaatttcttgcttttaattttttgtgtgtctgttgtaagttttttgatttgaggttactatgagacttgcaaataataccttataacctattattttaaactgttgttaacactgattgcataagcaaacaaacaagcaaagagaaaataaaagttatgcattttaattcctcctctttttaaactttttgttgtttctgtttatatcttattattgtattgtgtcttaaaaagttgctgcagttatattatttgatagacttatcctttagtgcttttactcaatatatgagtagtttacacatgacgattacagtgatataatattctgtgttcttaatatgtttttctgtgtgcttactattaccagtgactttgtaacttcatatgatattttctcattaacatacttttctttcagattgaagaactccctttagcctttcttataggacatatgtggtgttgataacattcctcagcttttgtttttctgggaaggtctctatttttccttcatgattgaaatgtattttcaccagatttgctattctaggataaatttccttcagcactttaaacatgtcatgccaatctctcctgtcttttaagatttccactgagaagtctgatgccatacatattggagacctattgtatgttatttgtttctgttttcttgctgcttttaggatccttcctttatccttgacctttgggagtttgattattaaatgttttgaagtagtgttatttgaggtaattctgcttgatgttctataagcttcttgtacttgaataatatctttttctagtttgggaagttctctgttattatccatttgaatcaaatttctacccgtagctctctctctatatctcctcttcaaggccaataactcagatttgcccttttgaggctattttccagatcacgtaggcatcctttgttcttttttaattctttctgatgtttttgtcctatgactgaatattttcaaatagtctgtcttcaagctcactaattctttcttctgcttgatcaattctgctgttaagaaagtctgatgcattctttagtatgtcaattgcatttttcaactcaagaatttctgcttgattctagttaattatttcaatatatttgttaaatttatctaatagatttctgaattccttctctgggttatcttgaattaagttgtgtttcctcaagacagctattttgaaattgtcatctgaaaagacacataactctctctttccaggattggtaactggtgccttatttagttcgtttagtgaagtcatgttttcttttatggtcttgattcttatgggtattcattgctgtctgggcattcaacagttaggtatttattgtagtctttgtggttggcttgtttgtacctgtccttcagggaaaggatttcaaggtattcaaagagaccttggtgttgtgatctaaatttttggtcactgcagccacatctgcattagagggcatcccaagtccagtaatgctatggctcttgcagattcatggagatactgccttggtggtctcagataatttctggaagaattctctggattaccaggcagaggctcttcttctcttccctcaactttctctgaaacaaacagagtcactctttgtgtgctgaggtgcctggagctgggggtggagtgacacaagcacctctgtggctaccaccagttggactgtactgagtcagacccaaagacagtacagcactggtgccttatttactttgcccaaggcccacagtaaccactgcctggctacctgcctgtgttcactcatttctttagggcgccaccatcagcctgtggcaaatccagccaggcttatttccttcccttcagggcggcaagttccactggtcccagacaggtccagagatgacatccaggagccagggcctggagtcagaaacttcaggaatctacctggtgttctattctactgtgactgagctggcactcaagccacaaaacaaagcccttcctactcttctctgtcctttccacaaacagaggagtctcttccctaggccccaggccaatggtgagtaccacctggctaccccaggtgttcactcaaggccccaggctacttcagtcaccttgtggtaaatgctgctgggccatgactctccattcagggcagtgggctctagcccagtgcatgttcagaaatgaaaaaactgcatttcttgagagcaaagtatctttgccttctttggtatttaagttatcacaagtatatactaggcttcctcagtcttgcaaaagcaaaaaataaacctaacatctgaataatttcaataagtgctaagtctgtgtaaaacaatgcatgcacataataatgactttatgccttctacgattgtatgctgactgataaataatactgacaactaatatacaacatttaattatctacaatattaaaaaatactgttttatatacttccaagaggatacggaaaaacatacacagtttccatacttattgaacttatgactgtactggcaggcaggatatgaatgcatgaaaatataaaaataatcaagttttaaatacctatttgagattttcttttcaatagattttactctactaatatttatggaatacttactacacatcagagcttgtgttaggtatcagtatacaagaaataatacaatgaggttatttctttcaagaactccaccatctagaaggggaggaaaactttcaaacacacagttccaaaacatcatcagcagtacagagaacggtatatggtgctatggaattcagataaggaaagccttaattctgctgacagtgggtctgaaggtttatcaaggaaggcttcccaaaggaggcgagactcacattaggtcttgaagaatgagagtttcccaggccaaaaagaaagagcactccaagaagaggggatattacatacaataccatgcaggtagaaagattatcgaagagggtgacagactgggataattatgataagcattgttagcctaattactgttattcaatggggaagatgatataaaaacaacctaaaaatgtcaattttacattttttcaggtctaccagcttgtcagtataaattgagatgagctcaaggcctccttaagtagaatcttaacatggcaactaacatattaacaggtttcccgttcattaccgtaggataattcattaaaaaacaatgtattcagacttcataagcaaaagcataccttcctctttagtctagtatatctaattatatgaggactgctattaacattaaataaatcatctaatagataatttaaatgtgcagtagtgttcaaaagcaagtctactttttcaaaagtaatcataattgcagcagaggcatcacgaaatatttgattagtacaacgctaaggagtgagaatcatttcttacaaatgtacaattaaagaagttgtcaattatagcataaattgatcagcatgtatatgatacaaaaacatgttaacccgaataagtttagactatcagaactactgttgtgaaatattcctttgaagcattgactgtaaagaacacagtggaatcaaagttataagagctatagataataacatttatagttacagaattctgattatatgaattccatgaattaaacgttgcaccatccactttcatacaaaaacaaactggataaatgagtgatgacattcattttgccagtttacaaggtacagaaaagctttgtgtattaattctgtcaatgagaaaataataaataattttgtatttaatcctatttgaatttaattgaaaccctatagagcattccgcatgaatggttttcaacaaaaaagtgatgtccttaaagaataaggagcttaacttcctcttcaaacataagaagcagtgccattgaacttgcttactcttacctcaagtgaatgattacctcttgcaaatgaattttagcagaattttccaactccagcctcagttgtttctttttgctatttgttttgttgctttttgaaataaagcttctcttccttgtgctttgcccatcacttgtggcaggaatcaatggtaccctaaagataccgactcattggtgcagaaagctaaaacctgcccctttaaagcccaacctggatcaggaccgaaattaaataggattaactcctaatttgttcctgtgtcctactcttctattgactgtttcccagtccctaatagttgtccttgttcatgtgtaagacactgtgtcctcttcttccttagttaattgagtctttcgttttgactttctattctcaactttgactatttttttttgctctgtgggctaaaactaatatgcagatacagttttcccttcctgatctcaatagttcatagtttctattgagcagcttatactacatgtcacttcagagcaatttcctttaatgcttttatgaaatttccctcaagatgctttttaaaatttattttgtgtcttccttcccttcctttcttcccttgttctccctctctctcaatccttgcaaacacataaacacatatacttttactacattatcatgttcctgttgatattgtctctaggaatttcatatgcaagtatatattttgtatctcattttgacaacatgaaatctatgcacaaggagtcatctatttcctttgcccagaagctggggcccagtaaattgtattgagtaagcaaaattgtttggctcatttattcactagtttgctcattcattcaacagatatttattaagtgtttgatatgtgtcaggtcttatactaagtgctgaattcaataatcaatatcgtcacaagaaatattgccttacatatgtcctttttatggaacattctcttctaccttgtttttctagcaatttctgctcatctatcatgattcaacttaaatactaggttttccatgaaatgtcttctaatctttagacgtttatcagtttcttgtctttgctgtcatcctagaatatgggatgtttcatatttcacagtaattataaattcacatgtctgtttcctcccaattagactcactttgtgggaagagacatgatctcttccccagtacttgtaacaatgcatggcacatagtaggtccttagtcatttgtatacatgataataagagcatctatgtgtacaaaatttagtagaaagtcaacatccagcagtttaatagcattattcataatcaatcccaaaacaagtgattccaaggatctataaaattttaaaagctagtgttaatccagacaagtttatttacataaaatggaatcagaagcagcaaacttgattgccccgtcctctagaatataacctattcagaagcccattggaactttatattaacccctctgttgggaccagatagatactataagctaattaatatggtatattatacggaaattaacccaaggattctgatttttttttattgttagaagaatgaaacatccccaacaatttgcctatgcccattactatttttatggtgatgactccagatttacacctccaacagcattccaagtctcttatccatctcaatggataagacatgggaccagttatgtcccatggaataactcagagatattgtaaacattatctgtttaaaagagaactgtcaattctaccttcaaacctcccttcaatcccctctctgtaaatggcactgtccaacatctcaagtcagaaacacaggcacagcaaccctgacttggtcttgattccactttttctatctccactctcatccaatccttaacaagccctgctgtcttcatcccaaatagattaaacccttctctccatttcctgtaatgtattacatcagtggagagtcccatttcttcctgtgtttagtactgaaacaacttcatatctgtcctccttgtttctgatcctgctgtttccaattcaaagcgtttcttaaaatgtgtactatatcatactgttcctcaaaacaatccagtgacttccaattttatttagaataaaatttcaaattctttttatggtttatcaagtattacctgcctctctaattgttcttacaatgtttcagcttcaattattttctttgaactcctgtaatacaccaaggtctttaccagctcggagcctttgcacaagctgttctttcttcctgaaatgctgtttccctgaagtcctttcattattggttctttcttagcatttggacctctgttcatattatctggtcatgctcttgaaatagatgtcccttcaatcccacagaaacatgtaatttttccatttttgataatttgattgcttcttaattctcaacagaattggtgattttgctttaataatacttgtctttattcatgtcttacttgttttccctcctagagtataaattttttttaggcaagtactctgcctcccttgtaagtctttttacccccagggaccagtatggagtaaagcatctaaaaaaatgtgtgttgacaagcaaatgtgataaaataaaataacctaaaattaaaaaaaaatcagtaagccttaattgaacaactactttctgcacacagatatatatctataaattcatagacctttaatattcacaatagcactgtaaggtacgttgtatcattctcatttaattaatgtgaaaagcaagtttctcaaagtgttagtacaacttttggattttaatgtaagttcctgaatctaatcccagtcttttgtattttttcgttctatactcccaaagccataatttaatttaaatatagtttttacctcttgctgacatttaaccattaaatttttttccaccagttaaattaaaaagaaaaaaaaagtccatggcaatacatactggcattctgtctttgaaaacaaccaaaaaaaaatcaataaaaatcttctacataaacctgccgtaataaattaaagatgtgttaaaaggaaagaatggatgcttctgttgataaggatcatggccagtggccaaaaggcaatcttctgctgttctttaataactcggtgcaaaaacttcggaaatttttataccactactctatcatagcactttagtaatagattacaggaagtaataagcatgttattttcctaagtgtgctaaattgtgaaacaaagagttcttcatccaagtgcctactgtctgttgcaaagccagtttaagaaaccagctacaaaaactcatctttttttttaaatccaataatcattcatagaacacctaactggcaggcagtggcatggtggttgagagttaaagctcagaaatcaagggttcaagtctctcctccactctgtgccagctgtatgacactgaataaattattcctttttctcattattaaaatagagttaataataatgtctatctgatagggtcatggggggaataaaagggtgaaatgattaaaatgcccactatgtactaagatctccaaaaaaataatgttaactttggcttcagaatgatgtgttctgaggggcataagtttatgatactctgggtgttgagaatataagtattatggaagggagagcaaggtacccggcagagtgaatggagttaaataaccttaaggtcttttaggaacaagctattcccttaccattttttaaaatagctttttttgaggtacaatttgcacatcataaaatttacccacttaagtgtacaactgaatgatttttaggaaatttacagggttatataaccatcaccaaaatctaacatcagaatgttttcattgcctcaaaaagattcctcatgcttacttacagtaacagccgttcacacccccaccccaggcaaacactagtctacattctgtctctgtagatttgcctcttctggatattttatataaaatgtattatacagtatgtgatcttttgtgtgtgacttctttcagatcatataatgtgaaagtccaactctgtggtagcatgtctcagtttgcttctattgctacatcatgttccattctgtcaatataatacattgttttgatcaatcaccagttgacagactctggagttgtttctagattttgacttcgacaaatcatgctagtagaaacatttgtatacaagtctttttctacacctgtgttttcatttctcttcagtacattcccaggagctctccttttccattttataggaaagctctgcccctgaaagaccccagtgcaacttgttggaagtgggtagagttctaattccaactcaccagtaactactgagtagtcagctcacacaatttagtaggaaaaaaaaatacacatcagttcttgtctctgccctttttcccctaaatccccttgtgactttggaagataactggacctcatagcatctcggcatcttaacttgtgaaccaacggctgcaactagatgttctctgaactcttttaccttaaaaaacttataatgctcttagtaactaaaattttataaagaaatccagaaagcacaatcaatggattatctcccttgcccctgaaattttctgggcatagccagcacatagcacagtcacaaaaaaatatgataccgaaagcatttgaatattgtctattgcatgcagaatccaggatttaccagttgccaccttacacgtgcctgttttgctcttaaaattcttgcatatcactgtatttatctgtccacattttgctaaggcagttattttgttcagagttaagtgggcataaaacaaacattagtacaagaaaataggtggattgttttaataaacatttaaaaagtataaatccaagtaactactgttacctccaaaatagtcacctcactggatttacatttctttattctgatatcactcagagtatacttggatatttccctttggaactgccctccaaactagtggtatagccagtttctaaaattaattttcaaaccttattatgaaatgtttagcttgtagaaagaagtataaagaataatacaacaagcatgcatgtaccaatcacaaagctttaaaataattgattaccgatgctctggggtctattagtaccctctctactttctctgtccttatctccaataatttctgcacttaagcatgactgtcctcacacatatatttatatttttttgcatgtggatgttaccctatgtaatatatgatattgctttcctagtttgaatatttatataaatcgtatcaaaatggtatcaaactatatgtattatttatcagtttgctggattcactcaatatcatgtttggtgaatttatttacattgatacgtgagttctaattcgatattcaccttgtataacattaaatttttaataaaccacaattatttatcctatttcctattgatatatatttagatgatatctagtattttgctaccacaaacactttagctgtaaacattcttgtatctatcttctctgtgtacttactgaggggttccctagagttacctttacctagagtttcattacctaggaatgaaatttccagatactgagaaatgaacaccttcatttttactaattactactgcattttctccaaactacacccatttttattctattcatcaaggtataaagctcccatttgtgcacatctccccaaaactcagtactgttagacattttaattttcccagttgccaatttgattcttaaatatcaaatttaaccaacaatacatgactatgtcctctgaatatacctctgtgcttggttctgtgtggaatgcaaaacatgatatagtggcagtactactgaaattggaggaaccaaaaattgagccctcactcctgccgtctgtgaaaacctgagcaagttgtttaacctcttcaagtctcagtttcttcatctgtaatatgaagggatggacaggaaaaattttcaagctcctttcaccttccgtcctacttgactttatgatgctctctgggagcttataagactggaggagatgcaaaacacacatacgcaactttaacagcacacctaaatatacgtgtagaaggtactgggagaacacagcacacaggatctaaataggggtgaggaagaaactagaaaggtttcaccaagcagattgaatgagattcaccaagatggtatggatggaatggaggaaagacatttaaggagaggaaagagcatggcaggtggggtcgtaaaagaagacagtgaagggagaggggcaaggatagggaaaggggcaaggatatggagagaggcaaggatagggagaagggtgtggctggagcaaaaggtgtttaggtacatgctgggaagcggagaagatgaggccagttatattgtgatttttattatgtcaaactgtaataaatcttcattatgttatcgataacttgatttttaaacccctcaaagcaatgtggaatcaaatctgcaaataaggcagatagtcattttattttcactttaaaatgatgccatgaaaccaatttcttctgaggccaataggctgattctacagtcacttctcaagcagggctgttcagggggtttgagaaatggaaagaagcattgcagaaaaaagaatggagtctccttgcgtgcaagctttgaacagacatgctcctttggatttttgaattttatcaggtggtttaaaagattcattattttatagttatacttggtattgaaaattctcagaacctgatagaattttagtattcccacataaaatttttaaagtacaaacttctttttttattacttagaggaaaaaaaatgcctcctaagaggcttcaactggctatgctagaatggctgagaattttgaaaaagataattaatgtacctcattttgaataaactgatttattattggttataaacatggacctcacaggcaaaatacctggcttcaaatctggagtttcctattgtaaagtggaatattaatttaagcaagttatttaagatcagtttgttagcattaggattgcgtttggctacatgtaataaaatacctaaatcaatttcttccacccgtgtaagtgtcttgtttttcttatatcataggaagtcagaggcgggctgctgaagaccggctctatggtatcgctagtgacccatgctccttccactttctgctccaccattctggatatgtagcttttgtccttggcttcaagatagctcctttatcactaagcattgcttctggatttgaaaaagaaacaagggagaatgaaccaaaatccctccctttgtaagactttgtatttttaactcgggaggctgaggcaggagaatggcgtgaacccgggaggcgcagtttgcagtgagccaagatcgcaccactgcactccagcctgggcgaccaagcgagactccttctcaaaaaaaaaaaaaaaaaaaaaaagactttgtatttttatccagaagggtaccccactcaagagacttacttaagtcccactggctatacattgtgacatgggaacctggaaaaccattttttttaaatacattgctgagtgcatagtgcattgctatcctaaagaaaatcaggaatcttttagtaaatgatgtctagccaggcatactggcatgttcttgtagtccccgctactcaggaggctgaggcaggagaatggcttgaacttgggaaccaaaggttgcagtgagctgggattgcgccattgcactccagcctaggtgacagagtgagactctgcttcaaaaaaaaaacaaaaaacaaaaataataaacaaaagcaaaatgaaagtcatagcatatagtaataattcaataattcttactacccaaaggattatactaatgtgtaattaataatgttatatatataaatatatatattcctccaagcacacgttaatccttcgtggcccagatcaaataccacatctactaacacccttctctgattctgccactcagattctttttcttcatcacttaatcagttatatttgatgaaacacaaactaatctgacaagtaaacgaaaaaggatcgtattggaaagatacaaaactatagaattcagagtagagttagctcctgtaggttctataggaatctatagaaacatgggaacctaaataagtttcatgggggtaaacaccaccgagcttatgtttttagcttcttgagctaccatagcaggaagtaagtccttgattcctaccaggatccacaatgggattgctcttaaataggcaagtgctttgctgctagacagataaagcatgatcgctgtctactatagggtcacatgcaggtaagtggttgactttggtcaaatgacactatgatagctcagtgttatccaattgcagaaatgcctatttgttcactgaaattctgctgagtaactgtaataagaatgagaaggcaattgtttcagagaaaattgtgtgaataaatttagaagaagtaacacacggttttaattcatagaatgacaggtggaatgatacagtttagacgtaggatatggaaaggcacttactagcagcttacaaagcaaaacaactcgtcaacataatatgcaaattgaatatatttgaatagtagcatgacaaggttacaaccataccttaagagactttttctggtctgttaattgtataaagaagcagaaacaatttcctgaatataggtaatagacctaactatgggatctgaagtggggataaatagaaagggaataggtgggaaaattaggaagacatagtggggaaaaattgcaattggagattatatttaagaagcaaggatggaagctttcaagatctcctatgatttcaagcttgggtgaattggtgctgccagaaaagcaatggagaaacaaaaggcatgataggcagaggaagaagaaaagaagatgcatgtcatgtatgttgagtttgacatcccaatagaatatctctgagaaaatattcagaatttgaattacataactggtgcttaccaaagaacagggctgatggtatagaaaaccttttgcctttcttataattttctacagtttcctctactcttgtattctcatcaatcactcagttattttgcacatgtctagttctatgtaatttctacatttgtctgtataatgttatctttgtaaggtgacttatctctgtacaccataggcactattttccctactttacaagaggaaattgagtgtcagaaagagcctacttacttttcttcttactaacgaatgaaaaggcaatgttaatcatcatttttccccctaatcggtgagctatgaaaaaaatttggggtccatgcaaaatcatcattattatgtttaaactgtaactctacaaatttatgatctcctaaagctttccaagatgtagtatctctctcatctgttggcagatttttcaaatgaattcctactcaatgaaaaacagttcatttacattttaaaaaccttgtcagtattaaccagattattccttctaattattctttaggtctgatcttaggaaactatttgaagccatctgttatttaaattcaagtttattgcacgtaaaagaacagaacttgatttatgttatgtctgatttgttctgatatgtatagaataataacttggcaggatctcataaacagcagttatggtatagtacaaggctgtggtataactgccactgagattcattatcacacacatcttctaagggcatctaaagggcataaacatttcagaattctgtctgtaatcactatatgccctgctgatatgcaaccagaaaaacattctactctgaaaaaaaaaaaggtatatttctagttttcagaacacaaacttctcagatacacaaacaaggctgcagtttagtgtgagactcaatggccaagtatatttgtgggaactaaagcttcagtggaaagaagcattaggtggatttttcagatttgtctcaacatggccagctccgtatattacacagtctatattctatgtgcatagggcagataaaaggctctgtaatttgttaaatagtatcccaaaatattaacatcggtgggaacctcagaatgtgaccttattggaaaatatagggtatttgtggacaaaattagttttgtggatggatggatgaaagtgggccctaatttcaataaatggtgttccataagaccatgtgaaaacacacagcggaaggaaagctatatgacaatagagtcagattttggagtaagtgacaagccaaggaacactgaggattgccaacaactactagaagctaggaagagggagggaaggatttttccctagagctttcagagggaatatagccctgcagacacctttctttaagacttctgggcttcagaactatgacagagtatatttattttgttttacgccacccaattttttacagcagcctaggaaactaacactggttctaaatgacaaattgacaactctaattctgtttgcttcccttacataagcagagaaccacttaaggtgataccatctccacactcctcccatatccttggcaagtaattgtgcaaacatgtggataaaacacatgcattttgatatctttatgcaaaagtgtcttcaaataaaaaataatttaagagaaatgctaatcaagtttaatattacattttaaatcatttcctttcattaacaattcttattaccttcctaaattgcaaattattggcacccaagggacccaagggagtaagaagagtatgacatgatgacaatatctccttcttgaaacacttaaattaaatcataataacctgcaccttttgcttctttcttaccatttctgagatacatgaatcagttcttggcctcaagtctttggcaaagttttggtgggcttgtttacaaactacaaatgctttgtggtttctgctatcaccacagttttgatggccccaaatcctcaatcttctttatcattaatctgatttggagcctgatatcttcaactgctttccgtagttgactgacttgttacttcaaactgaacattgtgcagaatgcgagatctgcaatcaacaaggtgctatttggtaatattaatcacattcttttctttgtgcttgtgtcccctcttataaggactatttttcttttctgccccataccaataagaaacaaggatgcaacaacaacaatgacaacagacctaagtggaatcttggaagcatgcttgcaaagctcatgcttccccctgcataagctagctaagacaaggcacggggtaggaagaaaagagacaagattgtgactcaaaagtgtagatggaggattcaccaggacagacccaggaaggtgggatcctcaaaatgctagaaaaagaacatccatctcaagggtaaggagaggatgaaagagagacaaaagaatagattcatcccctaggggtaaaataattgaacgtcttgcatacatatataatatatacagcataggaaaaaaagttacttgtgactattcaaagctatttttatatcatttcctttaatcttcaaaaaactcattaataaacattgtcactattgctcactagaggaaattgaaagcttaaacatcatgcccaaggacacacagctactcactgctggagttagaacacacttcctctgacaataaatccactgtcctctttccaatttactttagtttataagccatgatttatttgcttttttctgtgctctgagaacttgataagtaaaattacaaatgccttacccaatcattcaaggaaaaaatgtattcaccccttattctctactaatttcatatatgaaacacctaatcgtgttgctaggctcacagcttgctatatcccctacaggaaagaaaaaaatcctgccacttacgtatatgcactttttttttcctctctgtgaaatgtccttttcctgatacaagtcctccctaaatgtcaatactcaaaacacatcattctctgtccattttcttagctaaggggcagtagtctaggtgaaggtgatttaagcctagagctaaggagccctaggtagtatcatgtgttttgaataaaaaactgttcatttttttttctgagccttgagttctccttccaaggactacttcctgctctccacttccataagaaaatgcttcagcctgtttggaaccagcaacataagaatagagaaagaaagggtttatgaaagatggacccaattatagcagtctgcattttcttataatactggtgacagcagcaaacttgtgaagctgcttttaagtctatgataaataggcttaaatagaaaaagttctgcaggtccaaagtcaataaaaatgtacataatgtacttggagttagatagtaaatgaggtcacaaatgcactgaaagtggaactattggaaagccacaggtatatttaggtagatactacttaaaaaaggaaagagagaaaaaaaataagaaaaagtgaggagagatgccagaggaaattcggaaagaaagaaatctatgtactatgtcaacctctacctttgacagggaaagcatctctttagggagttatacatccccatcttgcaagtttattatctctcctcagtcagtaaaatagcttctatcatgttgagcctgttctttattctccttgaaacaattcgacccatagaataaaaatgctgcttgtctatgaaagtctttaccaggatccatgagcccagggcatttccctagaagcagtctttctcaaatttattgtccatgagaattacctaggaatcacaaaatgtacactttctaacttcacccccagaaagtctcagggggagcttcaaacattcacatttttaaaggtcccctgtagattccgacgcaggctcttttttgccacacctgaaacttataggcaggaagaaacaaatgctcagagcccttcctatgtgccagttatagttccaagggctttctctgttctcctgtttttattaataactcattaaattatcacaaccacactccgaggtagatgctatgagacccattttaccaatactggtaaaagtcacagttagtaaataaacataattcaagtctctggtctgtctcattgctgtgccttttcactccatcacataggagtatgactgtctaggaaaataggttaacagaggagacaaagaactcaggaagcatacagttatgtgcacaagacatgtgctgacaaaggactataagtacagtcaataagaattagtggtggattttccaataaccacagaccctgataagtctataggaccaacctacaaaaggaagttgggtgttgggtgaaggactttattggaatccatctaatgtggactgtgagagaaacgttaagttgccaaggagaataaaagcttcatgtggcttgttcactatgggaaaggaaaggtcaagagaaaagtgggacttcagaggatgaggagtgaaataagccctggagccatctgtggatgtagcataagatccataagcacattatttcataggatttgcaatagccaaaggtcttggaaaccaaattgcaaagatcaggagagagttttaagaaacagtggggcagataaattatatttgttgaatctaaaaggagcagccaccaatccaaagaaaaaaatggaatttattgtattctgctaattctgagacagataggtatgatgcaagaaaaagaaaagatggaatgaaccaatcccagctgacctggcatattcccaggtactttcaagtacgttatcttattaaagcatcacaaaatccccgatatgtaggcagaataggcatcagtattccaaatttccagaaaaggaaattaaagtaacaatattgattactgttgttatttttaaaggtaattcttaaagtcatgttgttagtaaatgtaggatctgggactgcccacaggcattctgactcctatgttagtgctctcttcaaatattgacatacacagaggcatagatactacagaactcaagtctgacagaaagttctggtgtccactgcacctatgtattgtgtaggtgtgatggttttaaagatacatccatactgttttcgatattcttctcttccagtggtggagtttacttccccttgccttgagtgtgcattggacttagtgacttgcttctggacaacagaataatgcagaagtgatggaatgtcacttctgagtttaggttataaaaagactgtggcttctgtcttgggagggctctctcatactctctccttcttggatcttgctctgaaggaaaccagctgccatgcatgaggatactccagcagcttatggagaagtccatgtggtgaggaactggggtcggtccacaaccacctgagtgaacctgaaagtggatcttcccctcactcaagcattgagttgactgctggcccaaccaacagtttgtctgcaacttcatgggagatcctgactcagaagcactcaattaactcatgaaaacggtgagataaatttttgttgttttaagccactaagtttgaggtgatttgttacatagtaatggataactaatatagcagggaatcaaatgattttcacatcacaggcaattctgatttattaatcaaaccacatatttaaacagaaaaactttgtcctactccaatggaaacactttttaataaaaaaaaattagagctgtagaaataaggaagctttgactatcagggaaagcaaatggaggctgatggccagggtatgctccctgtcaaaagctggcctcctcaccaaatcacctcaacattgctgaacttgttcccattttctttattatattagcagagaatgcacaaattagagatttaattgagctaacaaccatctccttaaaaatatgaaatttctctgagggtgtttaaatgactagttatccactcattagttagaattaaagcccattacgctcctaataactcattgctaaaatggcctgtgttgagaaatggaggatttgatgaaggcaggtggcatggtatgatttcattttggagcactgtgggggcctgggtagaggtccacagtgggctgacactttggaaaggaatgatgaagtggagagaggcatcctgggtggagtggcacaatgccaaagcccaactcgggcagtgtaatatatatatttaagatatttaagatatcttaaatatatataaatatatatattttacactgcctgagtgtgtatatatataatatataatatatagaaatctgtaatatatattatatatatagaattatatatataatatatattatatataattctatatatataatatatattatatatataattctatatatataatatataatatatattcacatttgtatatatgtatatattctatagtgcctatattctatttatagtgcctataatagccttgtagccaagaataaagagccttttttctactttaaaattaacctggtactcttcatatcatgagttctaatgggccaccctctaaacctaaccaagattcgtaacagaatttgatgtggaaatgaatttcaaactcacactaacaaataggatttggaagacagcttatttgtaagctgggctaaagtctaaagcacagtgccttaatgtggaaaacttagactcacaaacaacttttttatggtgttatcttttaaattttaaggatctttatgcttcactcaaattacattctttagtacattgcttctcaaactttattgtgtatacaaatcacctggggaatcttgttaaaacatggattctgatgggactgaggattatgcctttctaaaaagctcccaggtgatgctgatgctgccgaaactcagaccacacgtacaacagcaaaactataacatacaatttaagagagcaactgtagattttccaagataaaaaagatgactcaatactgcacctcatggttttaggtttttgctacgatcaaaccaccaaatcaacatgatatttaatagtgaaattcatacttctagacttaaacctaacatcattttaattatttttaaatttaaattctggaacaccaatataatggttaagaatataggtttgaagttagaaacacatggattaaatgtttagttctgcaaccttctagctgtgtgacctgcgcaagtgaactagactgagcccaataaagagaaaaccacttcagatatttcaaatggaagagatttaatatagggaacttactgccttggtaatgttaatgcttaggagccaaacaatgaacaatgaggctaccaggagagaatcataatagctagataggggaagccattatcttccctgtggctagaggaaccaaaggagcaggcaatgctgcagtagcctggtggaagctggcaccccagaggctgtccacagggagctagaccctcataggatatgccactactactagagacactggtgaggtgagagctgggaattactctgtctgctctcttcctcccacccttcaatctccctccagtgtattccatgagttgaactcagccatacggctgtcagcagggaagtctgagaaatgtagctccttgtgatgtgaagcagagctagggaggaacaggaaatcaatctgagagcaaactggcaaaggatcaacacagtgagttactgatgtgctctcatactatatccaacgctctaacaggcatctgcagaatatgggtgttgtgtatttaagtaagatgttacatataaagcatggagtatagtgcttggcacattatttttatcagcagcagcatctttttgtaatgtgacagcattttcccccttcattccttcctctcttctcacccattttcctgctgaataagagtagggatcatgtggagtctcagggagataagaaataataaaataatacatccaagctatgccatgagaaattaagaaaaaaaatctgcttgttccatctacatgatagaatcagaaaagcttaaaggcttccactgggcacacagcaataacaagttctcagtgatgtagacttaggagtcatgctcatacctgcaggccgcttaaggaccatcttttggattgtgctgaagacatgggagaaaatgctttcatccacacataaaggccagctgtgtggcctggaaagtgactcaatggaaaggggcagttattcatggtatccttacctggatttcaggagtattgagcttgactggtatatcgatttttttccctcttgactaggaccatatgtgcatgcatttccagatgctgtggtcataactgagaagatatattattatcaagtcactaacagtcttcaatgatgaaaagaactgtttttctcagtagacttgttttccaagttaagttatcaaaagcttacaaaatagacacagttgtctctgccaggttatactgcaaagaaatcagagtgttggcaaatagctcctctgtggaagaaaacataagcaagcatatttgtattctggcctgtgctcctacagcatagggaatgcagcattctgtttagcagttccatcctggttcatcttgtttgggagttagcaagcaaagcctgtatacaacataacagtctccccctgaagacaaccatcacagcttcagctaactcattccaaccttaaaccaaaccatcttaatatagaactgtttaaatagcaaaaattttatggagaagcccattaagttatttataaatgagaagcccaaatgtatagctctgtaatacttcagagctgcgctatgatattttacttattcattacacatttattgagttaaaaaataaacacaaagcaacaatcctagagacttttaccatctggcctatgctaggagccaaaataattggtgcagaaaatgagtgccatgagttctggggaaagagagttagctgtgggttgaaggagtcagaaggtctccaaggtagagaggaatcaagttgggttttgatagtttggttgaagctggccaggtggaacaaatgaaaaagatgcttctgcctgagagaattggctttgtcaattactttgtggtgggaataaacgagttggttgagcaaggagattaaataagatatggttcaagaacctggaattcatagctagtctggctaagttagaaccttgccttcaccatttagtaatttataaataatattggctgcatcacttaatctcaatttcctcaagtccaaaataggaatagtactagtgcttgattcatggggttatttcaagtatctacaaaacaaatacagaggaacaacctaacatattgtaagtgctcagtcaataatcagctgctattatcacttccttcttccaacctatattgagtgcctgctatagagaaagcagaagagtaaattgagtcagaatatgaaatgctttgactgtaggtgaaagtacagacatgttttcctgctgaaatagaggagtcgctggagacactggatttaggcagggacatgacaagggctatttttaagaattaatctactagtatagtgcatgcaatgtgtcattcagcagcgtcttttataaacctttaatgaagccgtagagaaaattgagatgaggaatctcttggcaccatagaaggcatttaattactaagtaataaatttgggggcccttacaaataattgggattcccaccagtgactagttataccccaaggaacatacagactgctaacatggcagccaccagagccctgggtgtttctgggttcttaaaggtagagtgtgcaggggcaggtaacccacagttctccctgtactcaaaatgtggagcaacaaattgcaatggaagtagctaatatcacaggaaatgtggctatcgtctcttcagggtcttcaagtatggggtacaagcacaagggctagcattctcagggacattaactttgatccaaagagctagagcagcagttctcaaacttatgtttctgtgctgatttacgtaatggagtttctcatctagaaaacactcctgtgggtggactagagttatgagcaatgcccagccagctgcctttaactctacctccttctttctctcaataacatgtacctaaatgaaagtatattataattagagaaataattactctaatttatttattaataaagtaaattattcaccaattttggtatgttatcattagtaataaattatttgggaatccaaagaaaactggtatgaacataccaggttatcactgacattttaactaagaattttgagtccaaagactacttgagtcatgctctatcattcagcaacgtcttttataaacttttaatgaaggagtagagatgattaagatgaggaatctcttggcaccataaaaagcatttaattactaagtaataaatctgggtgcccttacaagtaattgagacccccaccagtgactgaatataccccaaggaatatgcaggctgctaacatggccagccacccaaacgcccagttatttatctggcaagtacaaggcatgaaacaaacttctggactcttttctctttgcagactccagtatgaatggtgaatgtaatttaatgtgtcatggaaatgcagagctgtagaactgattattatgcccagtataaatggaagagctctaatctacgagtggaggtgaagcatccccagtggccaggaggacaaccttgcccagtgacctttcctagaagaaggtattgaagtgctaagatgaggatttccacaaatttctgctcaggcaacaccacccatcatcaactgagttaatgcccatccctaaatgtgtgtaacatgggcgaagtgaattttttctttctctgtcatgctcacttcccacttacctgctagagtaagagtatactagcatattatttagacatctagtttttaataatattcattttcatacaacatgaccacaaagaagaaactgttatatcttataatggaagaaaatctgactgtggagaagttactgagaaatggtacatctgcattatgctttatgggtgatttaaaggattttcaaatattattttgactacaggtaaaataactgtataatttatcatacaaatttgaaagcatttgagtcagacaggatattaatgataattaggctgaaatgacaggcataaatgaagagccttctggtaaattaaaatgtagtaccatcctaaatattatgggctgaactgtgtttccctcaaatttatatgttaaagttctaagtctctgatatggtttggctgtgtccccacccaaatctcaccttgaattgtaataatccccacatgtcgtaggaggaacctggtgggaggtaattgaatcatgggggatagattttcccatgctgttctattgatagtaactctcatgagatcagatggttttataaagagcagtttccctacacatgctccctcttgcctgctgccatataagacatgcctttggttttccttcaccttccaccatgattgtgaggcctccctagacatgcagaaccatgagtccattacacttatttttctttataaattacccagtcttgaatatgtctttaaatagcagtgtgagaacatactaatacagtttccatagtctccatacctcagaatatgactatattttggaatagggcatttaaagagatagttaaggtgaaatgagatcatgagggttggccctaatccaatatggttggtgtccttataagaaaaggaaattaggacacagacatgcacatgcacagaggtaagaccatttgaagacaatatgagattatgaccatctacaagccaaggacaaaggtcccagaagaactctaacctgcagacacctaaattttggacttccagcctccagaacatggagaaaattaatttcttttgtttaactcagccagtctgtggtattttttgatggcagctatagcaaactagcatactaatgatagtgattttcattttaaccatcagccttgaaactaatcacatcataagttgaggctctgccataacatcagttatgtcctgaggccatttggttgaataattgataaactgcttgaagcatgaccctacgaatagccctaaccatccatctcaaggcagagatattttatcttgttttattgcctaacagcactaaaaaaagaaaaaaatcttggttccattccaagatggccaaatagaaacagctccggtctgcagctcccagtgtgatcgatgcagaagatgggtgacttctgcatttccaactaaggtacctggttcatatcattgggactggttggacagtgggtgtagcccacggagggcaagccaaagcagggtgggacgtcgcctcacccaggaagtgcaaggggtcaggagatttccctttcctagccaaaggaagccatgatagactgtacctggaaaaatgggacactctcacccaaatactgcaattttcccacagtcttagcaactggcagaccaggagattctctcctgtgcctggctcagtgggtcccatgaccacgtagccttgctcactgctagcgcagcagtctgggattgccttgcaaggctgcagcctggcagggggagggatgttcaccattgctgaggcttgagcaggtaaacaaagcagccaggaagcctgaactgggcggagcccaccacagctcagcaaggcctgctgcctctatagattccacctctgtggacagggcatagctgaacaaaaggcagcagaaacttctacagacttaaacatccccgtctgacagctctgaagagagcagtggttctcccagcacagcatttgagctctgagaacagactgcctccttaagtgggtccctgatcccagtgtacccaaactgggagacacctcccagtaagggctgacagacacttcatacaggtgggtgcccctctgggatgaagcttccagaggaaggatcagacagcaacatttgctgttctgcaatattagctgttctgtagcctcctctggtgatacccaggcaaacagggtctgaagtggacctccagcaaactccaacagacctgcagctgagggatctgactgttagaaggaaaactaacaaacagaaaggaatagcatcaacatcaacaaaaaggacatccaaccaaaaccccatctgtaggtcaccaacatcaagaccaaaggtagataaaaccacaaagatggggagaaaccagagcagaaaagctgaaaactctaaaaaccagagcacctcttctcctccaaaggatcgcagctcctcacctgtaatggaacaatgctggatggaggatgactttgacgaattgacagaagtaggcttcagaaggtcagtaataacaaacttctctgagctaaaggagcatgttctaacccattgcaaggaaggtaaaaaccttgaaaaaaggttagatgaatggctaactagactaaacagtgtagagaagaccttaaatgatgtgatggagctgaacaccatggcccaagaacttcatgatgcatacacaagcttcaatagctgatttgatcaagtggaagaaaggatatcagtgattgaatatcaaattaatgaaataaagcaagaagacaagattagagaaaaataagtaaaaagaaatgaacaaagcctccaagaaatatgggattatgtgaaaagaccaaatctacatttgattggtgtacctgaaagtgacaaggagaatggaaacaagtgtgaaaacactcttcaggatattatccaggagaacttcctcaacctagcaaggtaggacaacattcaaattcaggaaatacagagaacaccacaaagatacgccttgagaagagcaaccccaagacacacaattatcagattcaccaaggttgaaatgaaggaaaaagtgttaagggcagccagaaagaaaggtcgggttacccacaaagggaagcccattagactaacagtggatctcttggcagaaaccctacaacccagaagatagtgggggccaatattcaatattcttaaagaaaacaattttcaacccagaatttcatatccatccaaactaagcttcataagtgtgggagaaacaaaattctttacagacaagcaaatgctgagagattttgtcaccaccaggcctgccctacaagacctcctgaaggaagcaataaacagggaaaggaacaactggtaccagccactgcaaaaacatgccaaattgtaaagaccatcgatgctatgaagaaactgcatcaattaaggggcaaaataaccagataacatcataatgacaggatcaaattcacacataacaatattaaccttaaatgtaaatgggctaaatgccccaattaaaagacatagactggtaaattggataaagagtcaaaatccatcagtgtgctgtattcaggagacccatctcacctgcagagacacacataggcttaaaataaagggatggaggaagacctaccaagcaaatagaaagcaaaaaaagcatgggttgtaatcctagtctctgataaaataggctttaaaccaacaaagatcgaaagagacaaagaaggccattaaataatggtaaagagatcaattcaacaagaagtgctaactatcctaaagatatatgcacccaatacaggagcaccaagattcttaaagcaagtccttagagacctgcaaagagacttagattcccccacagtaataatgggagactttaacaccccactgtcaacattagacagatcaacaagacagaagattaacaaggatatccaggacttgaactcagctctgcaccaagtggacctaatagacatctacagaactctccacctgaaatcaacagaatatacattcttctcagcaccacatcacacttattccaaaattgaccacatagttgcaagtaaagcactcctcagcaaatgtaaaagaacagaaatcataacaaactgtctctcagattacagtgcaatcaaatgagaactcaggattaagaaactcactcaaaatcactcaactacatggaaactgaacaacctgctcctgaatgacgactactgggtaaataacaaaatgaaggcagaaataaatatgttctttgaaaccaatgagaacaaagacacaatgtaccagattctctggaacacatttaaagcagtgtgtagagggaaatttatagcactaaatgcccacaagagaaagcaggaaaggtctaaaattgacaacctaacatcacaattaaaataactagagaagcaagagcaaacaaattcaaaagctagcagaaggcaagaaataactaagatgagagcagaactgaaggaaatagagacacaaaaaacccttcaaaacatcagtgaatccaggagctagttttttgaaaagaccaaacaaaattgataaaacgctagcaagactaataagaagaaaagagagaagaatcaaatagacgcaataaaaaatgataaaggggatatcaccaccgatcccacagaaatacaaaataccatcagagaatactataaacacctctatgcaaataaactagaaaatctagaagaaatggataaattcctggacacaaacaccctcccaagactaaaccaggaagaagttgaatctctgaatagatcaataacaggctctgaaattgaggcaacaattaatagcctaccaaccaagaaaaagtctaggaccagatggattcacagccgaaatctaccagggtacaaagaggagctggtaccattctttctgaaactattccaatcaagagtaaaagaagaaatcttccctaactcattttaggaggccagcatcatcctgatcccaaaacatggcagagacacaacaaaaaaagagagttttagaccaatatccctcatgaacatcgatgcaaaaatcctcaataaaatactggcaaaccgaatccagcagcacatcaaaaagcttatccaccatgatcaagtgggcttcatcgctgggatgcatgactggttcaacatacgcaaatcaataaacgtaatccatcacataaacagaaccaacgacaaaaaccacgattatttcaatagatgcagaaaaggcctttgacaaaaatcaacagccttcgacaaaattcaacagcccttcatgctaaaaactctcaaaaaagtaaatactgatggaacatatctcaaaatattaagagctatttatgacaaacccacagcaaatatcatactgaatgggcaaaaactggaagcatttcctttgaaaaccagcataagacaaggatgccctctctcaccattcctattcaacacagtattggaagttgtggccagggcaatcaggcaagagaaagaaagggtattcaattaggaaaagaggaagtcaaattgtccctgtttgcagatgcacgattgcatatttagaaaaccccatcgtctcagcccaaaatctccttaagctgataagcaacttcagtaaaatctcaagatacaaaatcagtgcgcaaaaatcacaggcattcttatacatcaataacagacaaacacagagccaaatcatgagtgaactcccattcacaattgcttcaaagagaataaaatacctgggaatccagcttgcaagggatgtgaaggacctcttcaagaagaactacaaatcactgctcaatgaaataaaagaggacacaaacaaatggaggaacattccatatttgtggataggaagaatcaatatcgtgaaaatggccatactgcccaaggtcatttatagattcaatgccatccccatcaagctaccaatgactttcttcacagaattggaaaaaactactttaaagttcacagggaaccaaaaaagagcccgcatagccaagataatcgtaagccaaaagaacaaagctggaggcatcacgctacctgacttcaaactatactacaaggctatagtaacaaaaacagcatggtactggtaccaaaacagatatatagaccaatggaacagaacagagcccacagaaataacaccacacatctacaatctatgatctttgacaaatcttacaaaaagtataaatgggtaaaggattctctatttaataaatggtgctgggaaaactggctagccacatgtagaaagctgaaactggatcccttccttacaacttatagaaaaattaattcaagatggattgaagacttaaattttggacctaaaaccataaaaaccctagaagaaaacttaggcaataccattcaggacataggcttgggcaaagacttcatgactaaaacaccaaaagcaatggcaacaaaagccaaaattgacaaatgggatctaattaaactaaagagcttctgcacagaaaaagaaactaccatcagagtgaagaggcaacctatggaatgggagaaaatttttgcaatctacccatctgacaaatggctaatatccagaatttacaaagagaacttaaacaaatttacaagaaaaagtcaaacaaccccatcaaaaagtgggcaaaggatatgaacagacacttctcaaaagaagacatttatacagccaacagacacatgaaaaaatgctcatcatcactggtcatcagacaaatgcaaatcaaaaccaaaatgagataccatctcataccaattagaatggtgatcattgaaaggtcaggaaacaacagatgctggagaggatgtggagaaataggaacacttttacattgttggtgggagtttaaattagttcaaccattgtgaaagacagtgtggtgattcctcaaggataaagaactagaaataccatttgacccagccatcctattactgggtatatacccaaaggattataaattatgctactatgaagacacatgcacatgtatgtttattgtggcactattcacaatagcaaaaacttggaactaacccaaatgtccatcaatgatagactggattaataaaatgtggcacatatacaccatggaatactatgcagccataaaaaaggatgagttcacatcctttgtagggacgtggatgaagctggaaaccatctttctcagcaaattatcacaaggacagaaaatcaaacaccgcctgttctcactcataggtgggaattaaacaatgacaacacttggacacagggaagagaacatcacacagcggggcctgtcaggtggtggggggctggtggagggatagcattaggagaaatacctaatgtaaatgacgagttgatgtgtgcagcaaaccactgtggcacatgcatacatatgtaacaaacctgcacattgtgtacatgtaccctagaacttaaagtataataataataaaaaaaatcctaaacaaaaataaaaagtgattcgggtcctgtctctgacacttgttaagcacatgcttagttgtgcataatcaaatagatcctccgaaccttatttgattcatgattaccacagagcaatatttggtctacttgactcagagagttattacatagctcaaacaagaccaaaacagtgatatgcaaactgcaaagcagttgagattgttaattttatgcatcagcttgactgagccatagggtgaccagattgaacattatttctggatgtgtctgtgagagtgtttctgaatgagatgagatttgaacagtgtgaaaggaaaataaatcttggggcccccaaatcactaagctaaagggaaaagtcaagctgggaactgcttagggcaagcatacctctctttctattcaaagtcatccctctgctcactgagataaatgcatatctgattgcctcctttggaaaggctcatcagaaactcaaacaaatgcaataatttgtctcttatctacctatgacctggaagacccttccccttcaagttgtcctacctttgcttcgagttatcctgcctttccagaccaaaccagtgttcatcttatatatgttgattaatgtctcatgtctccccacaatgtataaaaccaagctgtgcttcgaccaccttgggcacatgtcattaggacctcctgaggctgtgtcatggctgtgtgtccttaatttcggcaaaataaacttcctaagacctgtcttagattttggggtttacaataggtatacccagtaaagtaaatggctcttcccaatttgagtggggttcatccaattcactgaaggcctgagtggaacaaaaggtaaagaaatacatctccttttattttctacttcactgcttgagctgggaaatttcttctcatcttctcctgccctctgctcccctggttctctggcctgaagacttagattaaattacaccattggcatcctagactctctagcttgcagatagcagattgtggaacttcttagcctacataatcatgtgagccagtttctcattttatgtatgattatataaatgatgatgtatgatatgtatatattatattctctagagaatcctaatacagtggcccatgctatcaggcatcataaaccgaatgagagtaagaaaggccataagtatttgtaaattttacaggataattatcacactgtaaacactgtaccctggttctctttttggatattaaaaataaatcaggaaaatatataaaataacactgaaaatgttcaagactgtttaaggtagttccattctcttaaactcatctttgaaacaagactctaataaatgtttcctatggtgagtttcttgtcttgacttttaactatgtcatcagctcatgatgcagttgtaaccacacagtgaaatagtgttcttggcaatcaaattggtcctgaggtcaaacatttcttggagagtattatgaagaaataagatgaatgaatcaattctattgtgcatttattgcaattcatataagatgaagaaatataatgtagaaaattggtcactgaattaccagccactaacatggtattataaaggaaatgagatttaaatctgagaaggggattgtgtgcaagaacaagaatttgcaaatagttgacattagatccatctactcattcattcattcataaattcattcaaaaataggtactgagctctactgtgcgtgtaactcctgtctcaaaatttaaactgttgtttcagaatttagaattaagagatatctaatctcttactgattgatagacatgaccttgtacttatttgattctggtagaaaatgctaataaaaataatcaagaattattaggaatcattgactatccttatttgaacaacaaaaataattttgataaattatccattatattctatttgtgaatgtattagaaaattaaaatcatttaataataaattttgtttgtatcttacctaattccaaaccaacagcgacaaaaaacaagaatataaagaggcttgcttatctattgaagtaaaagtaattcagaactcttaaaaagaatgttgattttggtctttagtttcttgaagtcttctttttgaagaagtgacatgctgtggggaaaacctcttttatatttaattgtcttttttgtccaggaagtattcctagccagtgtgtcattatcttttaaaagtatgagaatacaatgaaaattaatgggtttctttaaactaacaatgaaccttcttcatgtaccttatcatattcttcaaacagcctctaatggaaaaagaagattgtgtttctaaaaattccccacagtgcaccaccacttcttttatatgttaaaaaaattcaaattaatgttattcataaaaacgtaggtgaaacagcctaaaaatagacccaactttttacattgaaattatcagtccttgcctaaacggtcatgtttagacaacaggacaattattttcaaattctctcaagtaagaggccaggtgtcaatattccccagaattatttgcaagtttcaagtccacaaatccatttaattttgctttaaatcagcatccgctgctacaccctggcaacccagaggtgtaaactggctcaaatatgtgtttttcttgttctgaacatttatcatcattatcgtcatcatcatcatcatcatcatttaatttaaatgctttaagcagtcctctattttccagtttcttattctgaaattactcattactgacttattcttagataatctagacatgtagaaggtactcaagcttagggttaaagacaagcactggagtcagttgtcttggttggtgaccttaccttataacttgttagctgattgactcattttttgattcttcagattctccatctataaaatgatgataataacagtccctatttcatcataatgaaatcataatgattacatgcaatactacctgcaattacctcaggaaatggcacttagaaaatcctcaagaaatgttagtcattgttcttatctgccccctgacaatatttgtatcagcaatctctgctacagtggactttgctaaaagaaagacattatctagcacacagttaatactaaaaaaaaaattactcttattagtgtctggcttctaaaaggatttgttgacttgcaaatcctgctaaagtttactttgtttagataactaggtacaattaggaacaagtggttctctagctgtgcctagagaactagttacaatttttaagctgtctggaatcttaaatcctaaagtctctcagattgttttttttttcattctcctttttttttcccatagcaactaaatcaattccaagaatcacaaagagaaaaaagaatgacaaaccgagggttgtaatcctagaaaatttataaagtaacataacagcatacagcatacatattctacgttgcacttatcataaccctaaagagttcatatttgtaactaaaattagcaggaatttatactgtccttcaggagtaaaggcagctgtgagctccaaattcttccttctcttttcaaaactcctctataacccgtcacaccgtcagagaataaactcacttagcaaaaccccaaagaagtgcctgcctaaccacttgcaaattagatacctgctggggtaagcaagacagtacccatgcaagaatgaagaggagaggggagaaggctgggatatgctctgataaaatgcacaattcgaggaaatagtctaactgcacactcagctcctgttgtctagggaagacaaagaaatatgtaaaattcaagctgacatactatgaacagtttcataatgaagctatatcacttattagaaaattatgcagatgaaccctgtattatggcagagggagccgcagaatagccaagaagctggctccacatggagacagacctcatggtcacgaaagcagtgaaccttgtctcctgacccagaacttgccattctgccaactgctgttcataaaattgaaataataaggaagaaccactaaaaatcattaattttgcaaaactagtggtattagaaaaggtatgagctttggagtctaagacatgtgatttgaattatgtttcttccagttctagctaggtaatcttgggtagaatacattatatctgaacctcagttatagctggaaaacaagattatgaataccttcctcttggggttgagataaagattgaattaaaaaaactccccttcccaaagtaaaacacgttcagtctttgtcctcccctgcacaaatgaactcattgtctcaggagtacagccaggtagacagtcacatccttctgtggaagtgatacagacatcctcactgcatgtgaaatggaagaaatattcttgtatattgtttaactgaaggatgaaattaaagttagaaatgcagactaggtagcccttatcccgccgtttatatgcatccttcctgtctacagaacacaactcagggagcaaataggagaactacaatggagtgataagaaaaaattgtcattcttgcatctgttatttagccatatctccagctcacccattttattatagttaataacgatggtaatcattcactgagataaagtactaagtactttatacatggaatctcactgaattctcatagttgcttttggagatgagttctttctttatctcctttttgcaaatgagaaaacagagcctcagagaggtttagaaacttgtttaagatcatacagtagctactgaagttgaagtcatgatttgaatgcttgtctgattctacattctctcttcttgtccttgtgtttccatccctctggcctttgactgccacagccctgtggctctccttcattgaactacctagttaggtatacctctcaagatctagctgtgatcccttctcttggacatcacttcaggcttgtttctggctccaaatctctatgaatatagataagagatacactcaaaacctttacctagcctcacaggggtttatccttgtagcatagacatatcttcatgacaaagtgaaccaggagtgtttgaaggcctgctttgtaaccaactgcatcaacattagggaaatcaccaggtgctttcatcattttcttctgtaaaataaaaatttataatgtgcttacaaactacatagctctttgggaagtaggcaaattgaatttttcaaattctcagtggcaagctgggcagtaaaacataattactgatttttaatatgtactttgtggcccttgtaattcaaagatgatgattttgactatcatcactatcagtgtgaaacaacaggagctcaaagagaatccaaagcttgatatcattcctgccctcattttagtgttgaaataaaagttcttaaggatttgaagaacatacttaggagttctctccatagcattttcatagcactcaaggaagtataaggattagctacagtgatcccaaatgctaataacatgaattttccaaatcagaaagtaaatactcagggcatagaaagagctctcgagtaccactgtgagccccaagatatctgataaagcatgagtgtttgggttttggtggctggaaggatggaatggagctaagcttataggttaaaagttacttatctttattctaagaaaatgtgagcctcataagttatctctgccttgatgatccctcttttacaattctcattgttaacacttaatttctgtaacattagcttacaaggattgtttctcaagtggaatttctgcctccaaacataataggcttacaacaaccatattattttcttttttgaaaattcctaaattcatttacgcatttgctcttacacctatcaatgcatccaaaccatatatttattgagcagatatttattgaaagcctgttcagtgctaggtacagggagtttaaaactgaatggcatggtttctgccaagaggaatatattagaaatttatagaaggcagaatactattatataacatcatcagagctataacagtagtgcagataaattgttttgagaaaacaaatttgggcagaagaaattgtttcccatgcataggaaacaataaacatgtgttggatgaaaaaaagaacatgtaatccaccggttaaagatggaaggacctcagttaggatagtatctcatgataatttttttttctttttacaatatagcacttattttaatgatacgaattgatgaatgaataaataaatgacaagtcaatgcacctatattatggaacagtagatatcagaaaaagctaaaggaaatttcaagagccatataatcaaatagattataaggacacacaaaccaaattaactgtagtgaaagataacatgagacaagaacaatgagaaataaataacaaatatgggtgatttcatagtatgaagagtactatttgttagaggcaactatcttagaagaaaaagtacatgagttggacttcgatggttggggtcctttgcataaagtcagaaaaggacattgcaagtgaatataaagataggaaagcaagggaaagaagatgaggaattatggtattcgttcaatcttgcagaaatgcaggatggaatggaaaactggaaaagccaagtttatatcaaaggagaaaggagttttctcctaagggtttgaaatctatggtgggtaaaagggagatattaaagtatttggggataaagactaacatgattatctctaaaatccaaatatgcaattatgtgttaaatactaacttcattttccagattatattgaaatcatcaaaggccagtgcggtggttcatgcctgtaatcccagcactttgggaggccgaggtgggcggatcacttgaggtcaagagttcaagaccagcctggtcaatatgatggaaccccatctttactaaaaatacaaagattagctgggcatggtggtgtgcacctgtaatcccagctactctggaggctgagacatgagaatcccttgaacctgaagggtgcagtgagccaagatcacaccactgcactccagcctggataacagagtgagactgtctcaaaaaataaataaataaataaataaataaataaataaataaataaataaaaaataaagaaagaaaagaaaaagaaaaaaaaatacttcaaatctttcctgtacctaaaacagttgtatttttccatcatatttacatgtgatttatttgaagccatctgcagtttgtttcttattctattttgttttctcacccaatagctatttattctgttcccgttgttgttattaaccttggcagcaaaaatttatctacaacaccttcagaatagaaaatatacagattagcaataatttgaagcctgagatcaggatgatatgtttttgtccattaaggaaatgttcatattccagttttaagcagctcatatctgtctaccaaactcaagaatacttacattctgaaatatctgaaattacaagtgttaattttttatgcagattgttctgctattctgttttctcatgcttaccactcaggctgagctcaaactatgaataagtgattaactggtgtgaactatgtggccatggtgatgttcagaatggtatgcttgatgatcctatcatagatagtgttttgatataagcattagatttaaggcttaggaattgcacttttcacacatatgtttaaacgtagtgacaatttctcctaatgttaaaatgcattctctgataaataaggcttgaacgctaccggtgaatatgtggagctcagtcagctatctcagctgctgcaaagatatagctattacatggttggtttgacagacaaggagctatcctctttaaaaaaataaaaaaaacatactccagcctacaacccgcagaggatgctgcatgcaacgcagtgattatgaatcctaccaaattttcagccatgccagcaattgcctcttcctcatatggaaatctttgcagccctgtcttcagaagaaaaacaaaggcagaggaaaaacaaaaaggaaattcctgtggtaagagagctcaagattcttgctctggcacttaaaagaacaaagccagtaattgccagagtagaacagacagagcactaacgatgggactgcaaaaagtacttgggctagctagctcaagaaggtgaaagacaggttacacatgctagcccttgagctaggagaaacagctattatcctaaagctgaggagaacccaatttagctgtaagactagggatgagggaaaaaaacacaacaacaataaatcctatctctatagtacctggtctttacccagttagaaagcagtagaatgaggaacagagagaaatagagaaacagagacagggagagagaaacaaagagagagagaggggagggagggagagaggtagttccagtttattatgtcaattatgcactaaaaatggggttgtcatggtctaaatgtatttcctaaaacttatatgttgaagtttaatcaccaatgtgttagtattaagagctgaggcatttaggaggtgattaactcatgaggacagagcctcatgagatcagggtctttaaaaaggcttgagggagtgattggctctcttctgccctcctgccatgtgaggacacagcgtttcccttctgatgcagcactcaaggtgccattttaaaagtggagagaacagcccttatcagacactgaatctgctggcatcttattcttggactcccagcatctagaactgtgagaacatagcttcctattgtttacaaattacccagtctcaggttttttttgttgtagcagcatgaatagactaagacaaaatcttactttaccttttgaccaaattaacatgcatggactgggaaagtagatacataacctgttttcttgtatctgatttgtcttacttctacctttttgcacccacttgattcttttctatcttgttgtatgctgcttcctttatttgcctatcttagtgttattttcttcattagggtctgagccaagcactgtcctgtatgctggagactctacctaactggacatacttattgcctttcaagagcttgaaaggaagatcaaaaccaaggctgggtcaggatatttattcttagcaagtcatacattttatattgagaagaattttataatttgaagtatgttcatcattccagtggaattttgataagaatttcacccaacccatgcaactgtgtcaaacagaaaaatcctgatggaaaatcatggctccatgggggagtttgctctggtggaaatacatctgtgtaggagttcctgttaaaagaagacacatcactacattttacctgtcagggattttttttaagtctacatatgcaaaggcaaagttgtcactagcgtgtaaacacagaatctctgggaaggatttgcaatatgacatctttccatgtctgctgtatttgattcgagatagcaaaaatgcaagtggttccccagagactacctatacaggcaggtttggagctagtgtttgtatcttgcagggattgtgaaataaagcgtacccatgtttaactctcaacacctcttgccaggctgagacaaaatggtgaaacaaggtggtcagcctggagttgtgaaaagagggtgggatttggattcagcaagatgtgagtttgaattccagctctatcacttttagttggggagtctctacaatacactttgattagggtagtgatacctactgagttgcagtgattaatggaaacactgcataaaataatcttattagaatgactagaatttaagaagctgttacacacacacacacacacacaataaatatgacgttagtttgacaatactgactacactacacataaaaataaagttcaaatctgtggtttaaggttattcttatgacattaagaccatttgtgatttagaaaatcgtatctaatacacgtgcttatgtaagggagacatacactccccccaaaatagctaaaatgtatggaacacataatatgtgccaggtcctgttcaaaaaaatttacatgcatgattctcaaccatttatactaaatccaattattagtccaatattatcttcactctgcagctttggtaactaaggcccagtaaggttgggtaatttgcccaaggttacacaaatactaagtgatgtagccaaatagatgtaggcagtctggttctagagcctgtgaagttacttatcgtaccatactacctagattttccctaaaaagtcaacaattattcttagagcagaggggagcctcatatagtatcaatttaattaagaaatatcaccctttccttgaggagttttaagttgaataaaaaataatggatataattctagttactgtgtggttaattgctaacacattgcagcacaacctatgtatgttctggattatacaggtgaaagaataacagggcaaaatttggaatggccaagaacagtcttcattcatctgtccttctatccatccataaatccattcatccactaatccatccatccattcatttgtcaatccatccatccatccatctacctatcctttctgattgcagtaaagggatgcagagcaaaatcttacagttaggtagacctaaattctagctcctgttttatcacttactagctgaatggtcttgagaaattaaggtaacctgattgagtctcctaaaatggaaaaataattaaaatatacttaatggtagtgttatgagaattacgtttatagacttctaggcacagtatctggtacaaaattaacactaaataaatgatggttatcaatattaacattaaagcttttatgtcaggtaccaaattacagttatgttctgaagatataaagattaataagatatatttcttgccctctaaaagattccagaagtttagtagggactttacacaagtgtgataaatgtggaatggttagttctaccatcgtttagggataagggaatcaagaatactaatagtagttggctgggcatggtggctcactcctgtaatcccagcattctggggggccaaagtgggagggtctcaggaacccaggaggttgagactgcagtgagccatgattgtacctttacactccagcctgggtgccagagtgagaccctgtctctaaaaatttttttaaaagaagaatgtaatttgttgagattttctgatgttcagatgctgagctaagtagttgtagcacttacttactatctcatttaattccaatgagaactattattacctctattttacaaaagaggaaagtgaggcttaaagaaatgcagtttgttgtttggagtcatgcatttaagaaagggaagggccgagaccttaacccaaataattttttttttttttttttttttagacggagtcttgctcagtcacccaggctggagttcagtggcaccatctctgctcactgcaagctctgtctctgcctcccgggttcacaccattctcctgcctcagcctcccgagtagctgggactacaggcacctgccaccatgcctggctaattttttgtatttttattagagacggggtttcaccgtgttagccaggatggtctcgacctcctgacctcgtgatcctcccacctcggcctcccgaagtgctgggattacaggcttgagccactgcacccggccaacccaagttattcttaatgtggaaaaactaagaagactgcctctaagctacattttaaaagattaccacccatttttaagtagatagatattgaggtgtattaaagacacaggaagcagtaaggaaagtgacaaaaataaatcaaactatgtggcccagttagaaaatatgaggtgattcagtgttcattcaaaaattgtttattgagggtccattacatgtcagggatctttcctaggtactgaaggtgcatggctgtaaaacatagactaaaattcctgccaacgtggaccttattatccattctctgggagggagacacccaaagtaaaattaaaaacacatgattaagaagttcattataaagtaatatatacaacatataataaagtataaaaacctatgttctaagtgctattgagaaaaaaaaagaagcagagaagacatcaaagtaggttgaaagtagggagattttctggttttaaatggatagtcagggaaggcttagccaagaagatgatatgcggacatataagctctgaagcgctgagagtgagccatttgggatatctagcagaaaagcttgccaggtacaggaggtagcatttgcaaagacccaggaaggaaaaatgactggcatgttggaggaacagacaggaggtcatggattgaaatatatatatatatatatatatatatatatatatatatatatatatatatacacacacacacacacacacacacacacacacgtgtgtgtgtgtgtgtgtgtattagcagaacatagaaaaagaaactagcaatgcaagagaggaaaaggagaattctagagccaaatctttgagcagtggaaggggtagggatctagctcacaaatatggttgatgtatgaaacttgtgcatgtctggtgggggtaggggtgaaggtgggagtgtttgaggtcaaatagggcaattcagccagagattaaattagaggtgtataggaaccaaatcttgaaggctcttccattacaggcatagatgtttggactttgtgctagtaaaaatgaggatctttaagggttttaggtacaggaatgaaatattccaataagtttcaccaggaaagtgaaacttctgctgagctttgaggcatttatgggatttgaatacatgagaggtaaaagaaagaacaatgtaggcaagaaggtcaacagtaataatgacccagaattggaatagttttggcagatggggaaccagttgaagatgtgtgctggcagacacctctgggggaaagaaaggaaaatatgagttatatctaaaaggctctggaatcaatctgcttaccaggtgcacactctatcacatactatctctgtgagcttgagcatgatccctaatttcttgctatctaatcacttgatataataaagataataatagtaatttcctcataaagaaaatgaaattaaatcatatggataaaatattacctgtatgcctgacacacattgttctcactaaatgttagttgttattctatatagcatcttgggaacctggagaggatgtaagagattggttccagatgtatggaatgtactagaaagaaacatgattgaaagcactatgatttcaggaggctgattatattatgtaaatctaaatattgatctctaatattcaaattcatcattttaaaggtcaaggcttataacagaattcatctagactaaccctggagataatataagaatcaaaatagctcttaaagttcaacagttaagcagttgagctgtggaaataggatatttatgagtagcttacacacacacacacacaaacacatatatattgtaaataaacacaatggggatctccatactgctaccaaattttcatattttataagccacaatgtgctagaaacaaaatttggtgcttcagaagaatgtttgattaatgatcatttctttgtaattagttatttgaatggacagcaacatcaacatatggaagaattcagaaaaaaagaacacagcatcgtacttcaggagtctttacattttctagaaggccaaattataaatagagtcttatctcacctatcatgagagcagattgctacttatgtatccatttataatttatctgaaaattccattttttaaagtttctgtatattcaatgtatcaaactggatagagagttcttttttcaagttttccagtttggtgaatagatagatagatagatagatagatagatagatagatagttagatagacagacagacagatacagatatagatatagatgtgtatatatatgtgtgtatgtgtgtgtatacaacatattgcttttccttgttaaatagcttgttaaattcagttctgtttcatgcgttaaagattacagcaggtaggtttctaaaaagtcatcatagattctacactgtttgggaatacatagctaatatctgcaactaaggtgaacgtgagaaaaatcacttatttggttttgcaactacagatctaactctcaagcattaagatatttcgtcaaattgatgttgaaaggtatctagcaaattcatgaaatctcatcctttaatccaaaattactacaaggaatatgaactaaaaaagccaaaagaggctatcacataataattagatactagatcaggcagtttttgtgttcagttctcaaaatactgaatatctcaaaatagtgaggagtgaatacaagagtgttaatcaagttcacaagtaaaattttattcccaatttgacaggtaggtgggtaaatatgaaacttagctgtgcctcatatggttgtgttgataggatttaatttaagtgactggatgcctactagattattgggcagaaaatataatttaaacataatttggccattaattagtcttaatggattggataaaatggctcagtgaacagattaaaaaaaattttctaatggtaaataatcctgtaagaatatctttagcctgagcaacacagcaagaccttgtctctacaaaaaatgtaaaaaattatctggctgtggtggtgtgcacttgtagtcctagctacttgggaggctgaggcaggagaatcacttgagcctgggagttgagggttgcagtgagttatcatcatgccacttcatgccagcctgggtaatacataatctgtctcaacaaaagaatatccttaaaatacaaagataaaatataaaaaaaattttagtgagattttagaaagtagagagatagagtagacaatttaatacaactttcaactaaaaaggtctgagagacttacagaagtttgtgttgtagaaatctagtgtttggttttctcagcagatattttcttttcttttggtaatagcagttggggtttcctttgggaaccgattccatttcatattgtcatgttatttgatatcaataagaagagccaaaaaatttaaggccaaactacaaaggttcatggccaggttctggcccagtgtaatgatcaacaagtcatataatcttcataaaggttgggtttctcattttcattttatcttgtttatttatttatttatttattttgtgatggagtttcactcttgttgctcatgctggagtgcaatggcatgatttctgttcactgcaacctctgcctcccaggttcaagcaattctcatgcctcagcctcccgagtaactgggattacaggtgctcctccatacccagcaaattttttgtatttttagtagagatggggtttcaccatattggccaggctggtctcaaactcctggcctcaagtgattcacccacctcggcctcccaaggtattgggattacaggtgtgagccaccacacccagcctagggtttctcatttttagaatagaagcaacattagcactatgttagtaaaatgccaccacaaatactttgcagaattactgtaacaattgcaatagagaaaggattgctacatcgatattaagaacacctagggggtgcttgctagtgtaaaccaacatgactaaccacaataggtgagtgtattagttcattttcaccctgctgataaagacatacccaagactggctaatttacaaggaaaaagaggtgtaaaggactcacagttccatgtggctggggaggcctcacaaacatggcggaaggtgaaaggcaaaaggcacaacttacatggcagcaggcaagagagagaatgagagccaagaaaaaggggtttccccttataaaaccatcagatctagtgagacatattcactaccatgagaacagtatgcgggaaaccatacccatgattcagttatcttccaccaggtccctcccacaatacatgggaattatgggagctacaattcaagagatttgggtggggacatagctaaatcatatcagtgagcttcattacaagttttaaaaaatgaaggcaacaacaggtgaactgtatggtatgggcatgataacttaatagagtgttttaaaatatgatggcagtttattttcatcaatggttggtcttttcattatcaacatgagaataacaaatgtatcttatataaaatgaaggatcaggttgatgtctacttgacattccccatgaactacactggtattagggagacattagatactcccagatatactggctttggcttcctgggaatggagtgtagcttggtgacagctgggcagagagcctcaggcatgctccccattcctgtgcagagggcacagccatggaaagcatttcttggacttatttataccatcagtaccctaatgacagaagaaatacagcttatttcatattcatttttaaaagtaaccttaaacatcaggaacacaaaagaagtggtagagaattcggaggtaataggggaacaaaaagcatttagtgtgataatttagagggtgtgtgcaaacttcatgcagatttaaatttcccaacagcttgcaaataggttactcaagtattcaaaagcagaaatttctagaggtgcattagtcgtaaaggccatggaatgtagccttttatgtttattgttttcatttacattctgtccaaccctgagtcttgtagtctaaaagggtgtgacatgtgtgttcaattgcatccaagaatgtcttctgaaactgagtccctccactgtagaataaaaacagcctgggttcaaatagcagactcacttcccagtaaagctggcccattgacttgggccatttacttgtattttctgagcctcagtttcttcatctgtaaactgaggggctaataatgtacttacactatagtggtaaagataacatgggaaaatatatgtcaaatgcataggtccaggggtatagtgcatttgattaagagcacaacaaataattacaattatcattgttaccctttttgtgaatttttttctttttttttttttgagacagagtctcgctctgtcacccaggctggagtgcagtggtgcgatctctgctcactgcaagctccgcctcccaggttcaccctgttgtcttgcctcagcctcccgagtagctgggactacaggcgcctgccaccacgcccagctaattttttttgtatttttagtagaggcggggtttcaccgtgttaccaggatggtcttgatctcctgacctcgtgattggcccgcctcagcctcccaaagtgctgggattacaggcgtgagccaccgtgcctggcctggccattgttaccctttttgatacagttgtgaggagtgaaaaatactcacgttcaaaaaggtacctttcaaggcagagtctccctcctaagagataaggaatttcagaaacacaccaggaatcaaggtggatagagagtttctcacctcctgaaaattacagtctaaacttttgacttcttttaccccagagtatcttaagtttgggaggaaatgtttgtgttttctctaaaagaaaagcacagaaatatcttctgcctaaattattattatacaacttgttttttcttcttttgaaacctctgtggcagataaaacttgtatgttaaaaaggaatttaaaaagataacacttgcaaaattttgtgaaacctaatataatcttctccaaagtgtaacgcattagttttccttaaagtagaaatggtttccatttactcccttcaagataaaactaagaatcttaggatggtatgcaagttcttccatgatctggatccgagatttggatgctagcatgatgccataaagcattgccagccccgtaagcctatttgtagtttcttaaacatagccagatctttcagtaatccatgttttttcatttacagtattcttccttctgaacattcattcttccccagtcattcaagttagctagttactgcctatccttcaaaattcatcacaagtatatgctttttaaggaggtgtgttctaaatgtctccatctcccacatctgttaaattactggctcttaatctgtttaaagcatcccttcagacctgtatcatgaagtttattatcagtgttacgtttgcctttttgctggtctccacaactcatttgttcatgacttgagaataacgggtcttcatatcccaagaccaggcacacaggggactcagtaattggtcctgtttagacttgcggattgcacccaatacaaaaccatgataagcaatgttaaatgccacagcagtgccagagaatcagttaataaatgcatatgacagattattatatccatagcagaagaggttattttaagaactactgcttgttttgtgtctgagtaaagatggaatatcaaacataatttctttacgatcaaacgaagcttatttccagataggaaggcattttttttccttttttctttattttcagtaaggaattaaattagaaaaatcatttgcatttttacatttgtcttctctgaatatgcagggctggttgaattctgtctgacaccttcacagaactcgcttaagtaagctttccattactaaataaattgcatccattctaattaaagatatgtagagcatactactcggacaggagaagcaaagtgctatgaagagctagagcttccatggtaaccctgctagggataatataattgattcaaatggtctctcctgccacatactgattccatgccaacaagccttgaaaactgtccatcatttcacagagctagttatagaccaagtccagctaagacaaataaatggtgatagaacttccagagacaattactacaatgaatcatgaaagacactccttgctttctagctcatttagtgattgattaccatcaacaaggtttaaataattatgtagtgaatatatgagtaatttacagaaagaaagggaaatacgtgtatcaattctttttgtataggggatctgctgtgggagaaataactcaaaactcaaatggtataggcaccacattaggcttaatattggtacatcattctgcctcattgctggttgtttgcgtccaagcttgtcaggcaatgtgtgagaatattatgcacacataataggaagtgataaagccccatgaaaatgaagattcagaaagtgagaaaagcacagtactttttcattccccttacaacatattatagttcctctggtcctaaccagagtgagatagagaaatgagttgatttctgtaaaccaaacttctcaactctagtagctcatattcctgacattcgctttggttgctgaatttgtcagcagcactcgaggttgatcaggtggtgtttcactggaagattggtatttgtgcgtagtggtggtggtggcgggtacttgctatttaggatgccatttgcactaaaccaatttcatcaatatcctggttagactaacttgttcattcacttcactccaggtatttcccacactttaaatttgctcccgcattgctatctaggttacacttaatagcctgctgatttagaagccagtctctcagtcaatcatcaagttatcaggcaattcgtttagattaaacctagtggaatactcacattgagctctttcagcttatatttgcttttgaaaatcttgagatttcaagctttcatatatttcactgcctctttaacaaaatgttagcactatcttttaatatacttttttcaatatgtattggtacctaaagccataataaattcctttaataaaaatgcgccaatagattcattttcttcttttttgctgcacaatattatctcatagtgtcagtgatggaaatctgctctctatttttagagggtgggatgaagtaaagaaggcttataagttggctctaaattctagaagctgaaatccaaggatcattccaaaagtcggcaggtgatttcctatctttgttcttgttttgctctgaaagaattcctctcttaaatactaacctgttgaactactaccatacatttaaatactacctaaaactttctaccttttcccttccaattgcatttgatcatgccatgttctcaaccttcacagaattttaaaacagtttccagctatcccttaacacaagggatatttatgtgtgcatttatatattcaagtgatcatagaaatttagtcttttataaatctctatatacttttctatttttgtttaaattaaaatatagaaaggaaatagagcaagacacctttatacatactacgtagctatctacatatttattaacaatctttcaaattaaaaaaacacagggttgaaatcatatattcttttcttcttcagaccaagtccctccttcttcctattctgtccaacaggttaaaaacaatcgttaattcattatgcattatccttacaatccatttttgaaatagacacatattatctatgcatgagcaatatatcatactgtgagatttttttcttaatttacataaattctactctagtgtattattatgttacatcttatttttggtgttctacattaattttgagatttctgttatttcatattaacctagttaattgctttaacctgctgaatagtatctccttgtatgaatctttcactattttgaatactgttagctctaccttcaaaatatattcaaaatccaactacttctcaccacttccaggctaccactctgaattatcctgtcttgtttggattattgaacagtcttctaccgttctgcatgcttcctcttcagagaccttaaatctattctcaaaacagtcagagtgactcttttaaaaggtatgtcatattatgccactaacctatttgaaatcctcacgtggctttgcctctctttcactcaacacttccaacaatgctgcatttaagttttactactaggtgggagagtttctctaagatgaatgcctgtaaatgaaattctctctctttcatattattttcccaagtgattatagaaagatttatagtcacagcagtgacatataaactgttcttttaaagccttcatagaaccctagcacatagctttgtagacaatagatggcaaataattatttaaatccttcatccttcaagaaacagttcctgtattagccacccgccataactgtttttctatatctctttcagaaagattcatgcttggccttcctgtatagaaattttgtaagtgctttcatttttgcatcttcatgcttcttattgtaattatgtatgtctgctccccacctgcccacccccatcacccacttccccaccatattagtgctcgttctctggaactgggtcttcattgcaccctagtatctaagaagaaaatgagtatattcaaattggagatgatctactaccaagaacagaggaattttcttacatatgtaatccccttttcatatcaccatagttgctattggtgattgacagatattgctatttttttccattttatagatgacaaaattgagggctattattttcccattgataaagaagtaggaaaaggcagaatgtacattgtaaaaacgctacactaaaacctaagcatattttactcttgtctgggacatagaaagtgctttgtatacccttttactaaaaaacttcctaagataatactatgtaaatattgccatatttgattagccaatgtaagattttatttactttgatcatattcttaagtaaaaacagcctcaacaactggaaaaaaatacaattttcctgtcttttacccataggttgtgagtgtgtctctctgtgtgtggcagggtgggggtctgggggatgatgagggagagggagggagagggagagggggagagagagagagagagggagagagagagggagagagagagatcctatattgtgcttctagttttaaggtcaagtatagatcactcttaatttgagggatttttgacagttattgatggtttgactttcaagaataaatcaatgaaatgctgagaaacaaaaagcaccttaaagcttacttcgacaaagtggccatgaatgaagaaaatgagacattgttaatctgaagccataatcatatttttggctatagattaactacttactactcaccatattggacagacctactttgttcctatacaaccctcaaaactgattttcctccatgttccaatacctttccccactactcacagatacactatatttccattggtgacacacacacacacacacacgaattggcttgaaaaatagcccatttgttttcacaacaaagggagaggcacctgataagattgttgcaaggtatatgttctcagcacagcaccattagctctaggatgcaagccccagtgtgcttgcctctttgcttttttcatctgaagagtcaaagctcttgtttattgctactgaaaggcagctgtgggtgaaatcagcagtgtcattgtccaaagattctggcaatgggtttaagtaaacaactaagggatgttctgtgccttcgttaataactaaatgtcggtgtgagagaagggacgagatgtcatttcttccagttaccccactggctttattgaaaactcagttttgaacaatgattctctgccttttcactgtcacccaattaagcttgaagcttttattttaccttttcaagatctctatacctctccaggaggaacaggacacaatagagggttttcacagcattgcaggcagatagtagatttgtaatgattagcaatgacacattctattttgggactagatttatcattcatatgctttcattctccaggtagtatttttactcaacttttaaaaatacttggcattcttggctcattcatgtacatagaaaagatatgtagcattactcccacccaaatcctttcaagttatgttgaatgttgtcactgaaatcatgtgtcatgtgtaacagagctcaaccactgagctgacaattcctgcagatgagttaaagtttgaattcactatattgatttattcttagttttaaaagccaacttgggcttcatatcttgccaaagattacctatttataatcattataaccatgtcagtgggtgcaatggaattgggtcttctcagccattttggaattaccaaggaataaattaatgtttctacgactcccagctttattttctgtcaacagctattcattgaggaggagtaagtattaaattgtgagacgccctggagatacagcagtgagcgcaaagagacccagtaactcccacatatcaccaatggtctagcatggagtcatatattagtcaaacacatgcatatttaagtaaatcattgaaagtatcaacaggctgcaaaagagacaggagctacaggagcctaagaaaatggaacagcaaatgttgaggaaaggggaaacatttcaaaaagttatcctaagtaaatgttgtatgaccttgggatgtatgcaggatgtgggaatggatggacgaacagattttccaacagagataacagcacatgctgaaatatgtagtacttggaataagaacaggacagagaaaactctgccatggacagaggtcattgaaagagacagtatggcaggccatgagcccagtgaggtaaacaggaacattcaggacatcacaggccatgttaaagactatggcttttattctaagggcaatggaagatatagatgggctttaagcaggacagtgatctgaccaggtttatgttaaaagaagaatcactcatattaaaattgaggatagtcatatcttgcattgacaatatcaaaggagcagtataatgatccaagaggaccaataagttcaaagtaaaaagataaattccaagcatccagtagagttaataggtgcactctcagggtataattgtagctataagagtatctgcttcaatctattattcaaaaacatacatcaatgctcaaattttacaattcttcacttaaaatggagcaccaatagatgatcccaagatttagtaacatctacacctgcagtagcctttaaatctggttaataaagatgcctattgccacttaattgttttatctactgcacagcaagctgaacccatggctcaaatctgaattatccatgaaacaaaataccagaaactataaatgaagtattaccacacatcctttgatataaccattattaaaaccttaaagataaaatttattagcacatatttattgagtgcccacaatgttccagatactgtgtatacaacagtgattaccaccatttgaattgtgtctcccaaaattcatatgttgaagtcctaactgccagtacctcagaatatgactgcatttggagacagagcatttaaagaggtagttaagttaaaatgatgccattagggtgggctctaatccaatgtgacttgtgcctattgtcagaagaagaaatctggacacataaagaaacacctgggatgtacacacacagagaaaagatcaagactcagcaagaagtcggccatctgcaagccaaggagtgaggtacccaaagaaaccaaccctgctgacaccttgatcttggacatgcagcctccagaactgtgatcaataaatttctggtgtttatgccacacagtctgtgatagtttgttatggcagccctagaaaggaatacatttagcaagttataaatctttttttttttctaacagtttacgatctggtggggaacagagataaaggtgcaaaaagagagagaatagcttctttgataaggggaatataaggtgctatgggacacctacccttaatttcggggtcagaaaatgatcactggagaaatgtatctctatgttgaagtctatgtaggagtagcaagacaaaaaaaaaaaaaaaaaagagggtggaagagttttagaaaaagaatgcatgcaattactcatgcaaaaacccataagacaggatgacagtgtgaggatctggatactttgcatggaggggatcactaagtgagtatttgctgattttttaaatagatttatctattacattgtggttaaaataccttccgattttacctggatttatgcaaatgcctattcattggttttcctgcttccattctctgtccctactacgctgtatcaccacaacacccagagggttcattaaaaaatctgaattacatctagtcactgtccttaagtaggcttgggggcttcctacagcactaccaaataagcaaatacatagataaataagcaactaaatatattaataaataacctcttacctgcaaagtttgatatgatctagctcatgcctacctctcatacctactttaattctactctctgacccaccctacctcaccccatccccagccacatgggcttcttgcagggccacaagagcacgccgagctcagtcctacctcacagccttgtacttgttcttccctctatccagaatacactttcaccaggtttttgcatgtctatctccttatctcatcacctcctcagaaagtctctaactcacctgtctaaatactccttccctccactcctctatggaattatgtattgtatcaccatcatttattttttatgttaaatagcatttatcctatattaaaacatattaagggcttttttctcctatcatctctctttctacccaaactaaaatttaaactctatgggagtagaagtctcatctgattgtatattgcaaatcaaagtgactggaacacagtagatattaaataagtatgtgttgaatgagtaatattaaaccatccaagttgactctgattgtaaattcatataatctatcctaaacatgaaacagggaacaatgggaagattttgaaccattcctagaaagtagagacaaatgtaatcccatggtacaaaaaaggcagcattaaaactacctcccagattgatgtggaataacttgtagcatgttaagcctgtgcctgtaagaacacattgaacatttaccgtgtgctcacatatcacagtgaatcagaaaggacagaattgatccagagaatttgccccagagaatttgccaactggtattgtcatttgattctgagtaagatgcttaaccatataaagtgtactgtaaattatggatgacaacactggccacatctacatcacatagagatagtttgggaggtaatgagatttttacttgaaatagctgagctccctggggagaaggcagaaaggggagatgaaataaattgcagccaaataccattaactctatatatttacaacataatttacactgatatactaagctatcgtgtcattaagaggggcgctttgtctcttttctgcagattgcctcccttattgatctccatttatttatcttctacactttatggaacagggtttcctggggctttgtcaatacagactttcagggttgacagacagtactagaagcaactgggtagaggatagtactgccacaaaggcacatctagcccaaagggtaatggcattcagagttttggaggcatagatttagatgaaagtgttgcttaaaattggagtgagagaggtgaccaatattgttctggttaaagggtgttcatggccaaactctatttaccagactatgagagcaaatgctgggtgatttaagtaggagtcaagacagaaccaccagcaggaggtgggataaatgttaacagagaatgctccacacaagactctaaggctctacaaagggttctgggcctagcagaaaataagaatacaaagatgaagagtatatagtacaatggttaggactgtgggctcccataccggaatgcctgtatttgaatcctctgtctcttccacttcctaagttaagggacctcaagcaattgacttttcttctttaaaaagaagattcaatttcttaatctccataagcgatcagtgctaaaacatatagaatgattgcgaatagcaaaaggattcacatatttaaaacatctagataggattcagccacataaggaatagtaaattttgtttttcattgtcattgtcatcaccatcatatcccttatcaaggtactagattgtggccgtgaagcttagaccgagagattagatggggcaggtgctgatggagccaaccagaaacatttcaaaccaggtgccacagatttaactgtggaatatcagatacaaaagtctattggacaaatgagtgtgtcccaagtgccactaaattatggaacctagttttccaataattttgctgaccaagtcaaaactagctcaaacaagtgattgagtagatacaactttgggagaactgggacaaaccatgggaacttgatgatctaacggtcatcaatcaaggaaaaaatatcacacttgtctctttcaaaggctatattttagtctgtaatgggtcgtataaatatggggaaattactttttagtagcagataatgtagaaacaataaagaaattaactaacttttcagaaccttgtggtttgtatgcaattgcatttttcattatgttcttgtatccttgctctttcttaaggcggaattacctttcctcttagacaataaagagaaattgaacaactgctgagacaatcattttctttactaaatagacatgaagttcctcaaatagtatataagagagatgatctttgttttactgtttatggtgccagtcatctggcctctaaattgacctgcaagcagggctatactttgaccactgtttatattccaaccagatgcaagtggagttatgaaagactgtcataaaaaaaaagaactcaggaaaatgctctccatattctctgtatctcctgttggcaaaacacataatttcccctgttgtgatacaccttaatcaaaattctcaatgcatttgttaattcataaaatatttctgaggattactattagtcacacatgtgtttggcaacaccaaggctgcaatgaacaaggaacatttagtcccagccttacaaaatcctactttctagcagattcagtataaacagataactaaggaacatgtacattttcattcctcaggtgagggaggggacacgactaacatttttagagtgtttatggtgccagacaccacgctggacactctatagatctttggaggggcagcttatctttttgcaggtatactcagtcaactacatcaccactgtagctgcctatctagcctcaaaatcttcaaggaaataagtccacaaagcttgaaaggaacaggacatccagaaagctctacacatactatccttcctcctgcacagtgtaaactttgaattctcattttagtagctaacccaccagagagcgataacttcattttgctatgggctacaggaggtgaagatagaaactgcattttggaggcaatggcctgaaggtaggttatttccatgcctagacttagaacatgttatctttaaacagagcaggcaggagaaggaaaggaaggaatatcaattgatgccattgccttcacaaatccttgatgaactgctcagtagggactaaataattggtaatagctattgtgtttattgtgtatagctaaaccagaaatgagtgttcatggaaatgtcattctataaccaagaaaaaaataaggaacaatgatcagtttgacattttaaacaagaggcatattttcatttggttcaataagaaaagtttctaagcaacgtttaattatattttacaccagatttcaggtgtgcttaattgcagtattaacttctttaccaaggtctcctaaaatacacttggttactattctgagaatgtcttcagtctctcttcatgaaacttggtgagacaacaaacaaatgatatgtcatcaaaattaacttgttaaagggaacaagaattaaaattataccttaaaaacttttccatttctgaaaagaaaaacaacgcacactattaaattcctggctcagaaggtgaaccaatatgaatcctttcttgaatctaatcaatcattttggcttgcttgggactataaggttttgtggacagtggagtttcagtgttaaaatggcagggttcccagaaaaccagaatgagttagtcaccttcctctcttcatagatttgtcgtgataattaaataaaataatgtctatcaaaggcatatcataaaatactttgtactcacaagcattgcgaaatgtcagccattgtcaaagtacttactatgacaggtgtggtgctaagcagttagttttacaagagacctttctgctcctgaatatctcagcttgcataatggacgtcagggacagctcagagaggggaatgagtggagagcaatagatatccttttctctgggacgggatgaaaggcatttacatacaaaattgcaatagtagggacagctagagagggctgctttgagcctgagaataggctcctgagaaagatttcaggtgtgctgaaagatttcaggtgtgctgaaagaaagaatgagggaagctagtgaattatctatagctgagtaaattataacggattaccatcactaaaatatatttattttatagtctaaaagcaaatgttatattttacatatatatgtaaccatatataataaatatatatgtaataataaatatatataattttaaaaagcctcaactgttccacactaactatacctctgaatctgaattttctaggctgtatatgacataagaagtgtccctatttcataatgaggctttcttcaatgagtaagtgagataatttatgtctatcacttttcatgttttaagtactcaatatacccatagattattatctttttatctttttataacagttttattggggtataatcaacatatcatataatttaacctgttaaagtgaattatattgagtgaattcaatagtgttcagtacatgcacagttgtgcaacagtcaccacaattaattttagaagatctttgccctccaaaacatccttctatccttttagctattaccctccacttttccccaacactccaggcctaggcaaccactctagagaattgcctatcctggatatttcatgtatatttcatttaattaaaattaaacaatatgtagtcttttgtgactggcttcattcatttagcataatatgatgacccatgttgtatcagtaaatcatttctttttattgctgaataatatttcattgtatacatgtaatatctttatttataacttgatagacatttgggttgttttcatcttttgagtattataaataatactgtcatgaacattcatgtgcaagctttatgttgacatatattgtcttgttttttttttttctttgagacagaatctcactctgttacaccagctgaagttcagtggcacaatcaaggctcattgcagccttgacctccctgggctcaggtgatcctcccaccgcaacttccttagaagctgggactataggtgtgtgccaccatacctaactaattttttttatagagataggggtttcaccgtgttgcccaggcagttctgaaagtcctgggctcaagcaatccatctgcctcagtctcccaaagtgccgggattacaagtgtgagccactgcacccagcacacagacatatattctcatctctatttttttttaaattatactttaagttctagggtacatgtgcacaatgtgcaggtttgttacatatgtatacatgtgccatattggtgtgctgcacccattaacttgtcatttacattaggtatatctcctaatgatatccctcccccctccccccaccccacaacaggccccagtgtgtgatgttcctcttcctgtgtccaagtgttcttattgttcaattcccacctatgagtgagaacatgcggtgtttggtttttgtcctggcgatagtttgctgagaatgatggtttccagcttcatccatgtccctacaaaggccatgaactcatccttttttatggctgcatagtattccatggtgtatatgtgccacattttcttaatccagtttatcattgatggacatttgcgttggttccaagtcttttctattgcgaatagtgccacaataaacatacgtgtgcatgtgtctttatagcagcataatttataatcctttgggcatatacccagtaataggatggctgggtcaaatggtatttctagttttagatccttgaggaatcgccacactgtcttccacaatgattgaactagtttacagtccccccaacagtgtaaaagtgtttctatttctccacatcctctccagcacctgttgtttcctgactttttaatgattgcccttctaactactgtgagatggtatctcattgtggttttgatttgcatttctctgatggccagtgatgatgagcatttttttgtgtgtctgttggctgcataaatatcttcttttgagaagtgtctgttcatatcctttgcccaatttttgatggggttgtttgtttttttcttgtaaatttgttggagttctttgtagattctggatattagccctttgtcagataagtagattgtaaaaattgtctcccattctataggttgcctgttcactctgacggtggtttcttttgctgtgcagaagctctttagtttacttagatcccaattgtcaattttggcttttgttgccattgcttttggtgttttagacatgaagtccttgcccatgcctatgtcttcaatggtattgcctaggttttcttctagggtttttatggttttaagtctaacatttaagtctttagtccatcttgaattaatttttgtataaggtgtaaggaagggatccagtttcagctttctccatatggctagccagttttcccagcaccatttattaaatagggaatcctttccccatttcttgtttttgtcaggtttgtgaaagatcagatggttgtacatgtgtggtattatttctgagggctttgttctgttccattggtctatatatctgttttggtaccagtaccatgctgttttggttactatagccttgtagtatagtttgaagtcaagtagtgtgatgcctccagctttgttcttttggcttaggattgtcttggcaatgcgggcccttttttggttccatatgaacataccttgtgtatatttttgggagtgaaactgctgggtaatacagtaatgctatgtttaattttttgaggaactgtcagatatttttccaaagtaaatgcatcattttacattcctgccaacagtgcatgaaggttctaatttctccatatacttgccaacatttgttattatcattgttttttattatagccatcctagtgtgtgtgaagtggtatgtcaatgtggtttttattttcattttcttgacagcagatcatgttgagcatcttttcatgtgcttattggcatttttatatcttccttggataaacctctattgaaatcctttgcccttttcaaattgggttgatataaaatactattaagtaatttctatacttagtcagtacttaaagagtacctactatgttccaaatactttataattataatcactaacatgtaaaaagtaatccttcaaaatagtattgtaatttccatttagtttatgttgggacactcaagatcagcataaaaaggaaaaacttactaagctaacagaggcagatacaggattaggactaatgttcagctaacatggaaacccaaaaagctcagtaattttttgatgctaggtggccacctgagcacactgaagtaaatgaactcatcctctcttctgataccttctgtgatcctccaaattttatcaggaacgtgccctaaatgcacatctttgatgctcccctaacgtggagaataaaattcacactcctcagcatgccactgagacctacccatacttgatatgctccaccatcccagcctcacttgacgccattccctaaccctgtacatcactcagctggaaaaccacaagtttcccagtgtcctacaggaaatttgcacttttctgtctcctggaaaaattctactgattctacgggcagctcaaaagtcttcatcagctgtgctaaattcttcttgtcccctgcaatcacattcctttccctcttcagcacacatactgttccttaattcaaccagtactgctgtgtaagtgtgatgttcctgatgtgtacaaagtaatggaggcataatagtggacatagtccggtccctgacactaggaagctgaaagtctagccagagtctgtttccactgctatcctgtaaactgtctgagcccagggatagtatcattaacttttatcacctcaccagcaagcacattccctggtaaaatctagattacaaaaaaggtatttctgatattttactgagactaccaacactcatacatcttgcaggagatagactcttctgctaatgacaataaatggaagggaactctggcaataaactgctgagaactgcacagcagcacttcccagctatctgccatatgagaattagaacaaaacaatgcaacccaaatgggaaggtggaagtgcacaatgaatacacaaagctataaactaagtgataatttttgtcttgattgtgtgagctaactattaagaagattataattaagagttcatttcttatagtaccaacaagcattttaatcaaccttgatagcattagctccaattaccattagtaaactataaagattctgttttaaattgcaatgagtcaataaattcaagatggcactttaggagtaaatgttaacaggaccttgtcattttcctgagcactcacaagctatggatgggggcttcgtgaaggcacaagcaacagtgggatttacgaagcgctgtgagcttcacaaacgctgtttgtactctggtgtgaaacgaaaaataattacccttaagaatgtttgataactgtttgatctatgaatttttagcttcatagctttaaagaaagacattttatttagccaaacaatctaatagactaacaaactcaaaacaaaggctgacaaagagagtcatctgaaattctcattattaacttacaacatttgcataaatttgaacagagatggatggctttaaatgacggtcactaattaagagaccgaaacaaacaaaagactaacaaaacattatgtacaaagacaagcacattagcatattctatctcatatctcccttaaaatgacatgaagacaaatattcctgattacacctgaagcaataatgtaactaaggcaataaatcacttgaagaaacctaagggggcttctttttaaacacattgatttgggtattaggactgtcactgaaatataaacataaaatggaatcaaatttgttgtgatgatgtatcactgaaacgtttgcctctttcctggaaaaatttaatcagtaggtggacatgtgactataacccagatgtatttgtttaaaaagactgccagattattagaaaactctctttcaaatgtccatcagaatagacatttatccctagtaaggcacatcacaggattgaaagtcaagtcaaaagtggttaaatgcttgggtgttgcatttttttgcttcccttaagagaagatctagaagtttttttttcaatgaatttaactctaaagtcttatttttaagatgtgtaacaaagttcacattgtgtgggaaaatttgacagtagggaagcaaagaaaggatagaacactgggcagagtctagctataactatgcaggggtggcaccacccattttcagaaaggccaccacaaagagacatggcaagaaagaaagtcccttgttggatgagccacgggaaatctgtgatgcaaggatttcagtatctcagacctgatatccattagcaccttggtacgcaaaacaaatttgttttacagactaatggtaataactgacataaaccctgaaaatttcaagttatttagaaatgaatttttttcaatcaaaattttgttctaacttttccaactattagaatcacactatgatgttatctgttagaatgttttgtaattttcttctctaatgtgattatccagttctccactgccatcattgaaatttcccaccaattctatgtataaaacattttacatttaggtaaacttaaaagacaccttagtagagtgttgataaacactccaataattaatcttgtaaatacccagaatatgcagaatctgtataaaaaatttatggtccagataccctgatcaaatgtctggataattcattcatttaccaagtgttggttcaatccctacttgcctactgcgtgaagtgttattcttagggaagttacttattttccttaaaatcaacatctacttttttgttaatctactgtgcagtctttagagaaaaaattatgaacctatagaatgtttcagattctttcaacaaatttaagaaaagagaataacactgcatggttccataataacaatttcagtactaccatcatttgcataaaggcaatgtctcttttactatataagaaggaaaaatatatctaaaaattcagtgctccttcagaggccacagtatctactatcctggcaatctttacagttttctcacttcttcgggggacagtctaccctctacttcttcagcatctccctatccctgatagacacaacctcagagtagttaagtgacccagaactgaccaatcagaagtttctgcattcctggtttcagtgattaattcaaaaactaaacatatttaaaaatcaatcatggccagtcaattttcactgggattactcatatggaacccagtataaatatgctgtcttatcctgcaatgttgctaacctgggaatgtagggctcctgtgttccccatgctacttttaaaaagctaactgtcataggctcgaacaagagcaatatacactgggaaactgagaaatacatgatggaacactgatagaaagacagtcctactctcactgagttctagttctgttctccagatgcctgctccctatagatcatcctttgacttgaactacccacaatgtgcttcctagtaatatatgtcaataaacttcacttttaattcagggtgtacattttcaccctgtaactgaaaaagtcttgattgacacttctcctttaatgatgttgaataaattagctctcatgctttggcattcttttattacatttccatttattgaacattgactgggctcacaaagcactgggctcacaagcactgggctcacaaagactaagccacaatccttatatttaataattaaataacatttaattatttgataatctttatattgaatatagaaaacttaacacgtgtggggacccactcagaaccccagagttggtatgaagattatttgatgctgaagaaatttgaaattcgacaaatgcagaaagaaatcttcttaaaacttctctcatctgagcagaagcagaaatttgtgagaaataaggcttccataaatccctttagggcaggtctactcccagaagagaaaccaagggtaaactaccacagattccctcttgggagagtttctaggccaagaaagagtggaaaaggccactcctacctccatacacaaacattattatcatacatcttttaatcttctgtctgttttcctaaaaatctatttgtctttcctaaataaaccatctgttcttcctatagaagccttttctcccccacccctttcctttagtaacttaggtatataggcctctaaccttagtcacctagctagcttgctagttcatttattagttctcctattcatgggaataagccttttttccccctttaatccatattttgtcagtttagttcacagacctcagagagcaaacttaagagggtaccagaaaagttttcctccctgacacacataaaccattaacataataaaaatttgtatattttatttaaaaatgtatagtataaaaactgtatattgaggaaatgtcctatagagacaatcacatacacatatgtcatcatcatcatcatcattatcagcttcatcaaagggcttcttttaaatgatgtgggggtaaggtaatcttcaaaacaactataatggatcttgacaaaataatttcaaagttctgaatcacttatttggtttaaatgagatttattcatcacaaattctttgggtctcatctcatccaaattgatctcaaatagaaaacatgctttttattctgatcatttactttacgtaaagggctaacacatgtatacttccctttgcaggcagaccatgctgaatactatatatatacatatataagactatgtagagtctcctatatatagtctatatatacatatataagactatgtagagtctcctatatatagtctatatatacatatataagactatgtagagtctcctatatatagtctatatatacatatatagtccttctctagaaatacatacaaaatatcagttcagtcttccccaatatgactgaggtagtcattcttattatccccttcttaaaaatgaggatcctgggccgggtgtggtggctcacgcctgtaatcccagcactttgggagaccaaggtgggtggatcacctcaggtcaggagtttgagaccagcctggccaagatggtgaaactctgtctctactaaaaatacaaaaattagctgagcatggtggcagatgcctgtagtcccagctgctcaggaggctgaggcaggagagttgcctgaacccgggaggcggaggttgcagtgagctgagatctagccactgcactccagcctggtgacagagcaagactccaaaaaaaaaaaaaaaaaaagaggattctgatatttaaagtagagagataaactatcaaaagttagagagatagttcaggatggaactaggtcttgtcaaagtaaccaatatcctctgggtgggctcaaagttgtcactatgactcttacaagaaaacaacagcaagggggtcagagtcagagatgaagctggaatggtgaaagcagtgttggagtaatgagaagccatgaactgaaggctacggtcagacttcagaagctggaagaaggctagaaaacagattctctcttagagattccagaaggagcccagccttgctgacaccttgattttagcccagtgaaatgaattcaaatttctggtgtgcagaactgtaaaaaataagtgtgttattttaagctgctcagttggtggaaatttattatagctacaataggaaaccaacagaatctcacaacatcttttcccagtggggaaaataaaaagtaatatttacatggcatctgccttggcaactgggggtgttctttcagaacctatagctgaggcaaaaaaataaaaaataaaaagaagaattaagaagatagagtcacatattcaggcctcattagaaattaaatctgaagcaaaagcccttatacttgatatgctaagtattaataaaagttatatccaaatagcaaggtgacaaattctggaaaacctttcatctgactctgcaatatcaatttaaaacactccattgatgtttcaatattacaaaatgccctggaaacacctgggatgatggagacattggtattaatatttttttccatgaataatatcatcacatttatcaatagcatactaagagggagagcatcaagataaatagctaatgtatgcagggcttaacacctaggtgatgggttgataggtacagcaaaccaccacggcacacatttatctatgtaacaaacctccacattttgtacatgtatcctggaacttaaaattttttaaaaagcataccaaatcactgagtttttttacaggatccttcaaaacaagatattaaatatttactaatcagtgttaataaatattctaaatatttttaaatataacattgcttctgcctgatccaatgatctagagttaatgaatttgatgatgctatcaaaaagctaaatatggcaatagaccattgatcactcttgctatgaaagaatggggactataagtcaataaataagtgggggctcctgttttcaatagttcgctgcccttgagtatgccatttttccctaaaagggattgaagatgggtgatggactatatgattaaaattcataaaaatgacatgttattctaagatgactgggtacagaaaatctcgtcagctcttacttaagcaattttccaaaaactggaaggaaacacagtcacacacaccgtggggtcacttcctgcagagatgacttggggacatagctgaatgaggctgaaaagtcagacctcacaagttcattataggtttagctgaggctggggcctgtcggactcttttttgtttgtttgttttttggtcaaggttaagtctgggtaagtctattcaggtatgttttcccagaatttaagctaaaatgatgaaaactgcctttgaacttgaaggttctgcggtaagtgcacaaattaaaagacatctgaaggtaggaagaggagacgttgcctttcttcttaatttgaatgttcagaaaaaccagtaattagattcattacgttaaaattgaacttaattcctttaatctgaaaatttcaaagggctttcaaaagctcacaaattgctgttaatcccaatggcacaaagatgacctatgtcattttaatggtatggtatggttgaaataaaaacacaagagtttgattattcctctgagggttcagtttcgttttgctctcccataaattaatttgaagagaaaaatcaacttggtgtcagtgattaagcaataattttaatgcatacacatgcacatgtacgtttgcatacagagtgaaatttattctttaaatagctgtagagaatctacaaaagcagagtacaaactacccagagtgaatagttagtatcaataaaactcatattccatttttactgtggaccatacttctagcaccagcattttgatcccaaacacaaaaagcacactggaattcctctctctctttctttctttctcactttttctctctcgtaatctccttcttgctatcattcatagcgctagagaattttagactagaaaagacttaagaaatcacttatttactagttcttctttttatacctgtgtaaactgatcaatcaaattaaagcaagttgactgggtaaatggagttgctagttaggaaaataggaattaatgcctacaatgactactgtcatctctttcaaaatctgtttaaaaaataattacatagtttaggaacacatagtgtggcaaaagggttttctttttgtatttttccttttgtttctatcacatagcatccatctttccttctcacgttagcacctcaacctagattgtagggaactactgtcccaccacaagcccaggcccctccagggggcttccaggttgaggcatgtggctcagaagtctaaccactcagagcatggtgttgccttggccagggtgtaggttctgttagggcatgtggtccaaagagggccaatgaggcatgaggccgtttcttctgaagccactggccaggaggtagctgctcttccccactgagactgaccctcacaggatgtgatgcaggcattgtctgcaaccacctagcaccacgtgaagccagaaaataaagccattagagtagaagccagagctgagagattaaatggattcctaatgacatattaaattaagttccacctgaagcccagaactaccacctgggcctctcaattatttgggccaagaaattgtgggtttattttttgtttttgttgaagccagtttgaactggcttttaagtcactcaagtactaactgggcttgccagataaaatacaggaggcttggttaaatttgaatttcagataaacagtgaataactttttttttttttttgagatggagtctcacactgtcgaacaggctggagtgcagtggcacgatctcggttcaacccaacctccacctcacaggttcaagcaattctcctgcctcagcctcccaagtagcggtataaacatttcctatgcaatattaggaaaatctgacaattctaattctaatcatacagcaagctatttctagacgtggagcagggccagtagagaaaggagagagacccatgacaatagcacagagacaggtgctgtcataagaagtagtaaggtgttgtatatactttcctggagaggagaagagctagttagttattacagtgtcatagagaaaaggcaatatatttatcaagctggtgttccaaatccctttttcctgctctgatcccatctcttccttggattcaacctcaagtcctggaattcatccagtaaggaaagaggtagaaacagcctctatgtcaatcatgacccactatgagttcagtttaattcattgtattccattaggcatttgcagacattgtgcagaacattgcaggggagcgtgggtgaaaaggtcctaattgccctattctaagggctctaatatgtccagaggaacaaatataggcaaagacaacaagataactgtaatgcctgatggattagtatggatggtggggggaaaggccaactctgaaaaaggtgggagttgagctagaccttggtggagaggtatagtatgtggggtgggtgggagtggtcatttcaaacacacgtcctcttgccatttcctatttttctttctgttcctctcctctcctctcctctcctctcccctcccttcccctcccttcctcttctcttctcttctcttctcttctcttctcttctcttctcttctcttctcttctcttctcttcgttctttctttcttccttcttttctcctgcttttctagtaattatgatgttgtttatcaaattagcatcaagtgcaaatctattaatgggggtgtgaccaagcatccaactggtgctggattggttagggctcatgaatatataattaaaattctataagggttgcattcagcaaatatgtagaattttaaagctggaagagacctttagcaagcccctgattttgtaggtgagagaacgaatgtgagatcaggtaactggtgatagttgcagatctgggactagaaaccaatgaagttatgctcagcatggttgctcgtgcctgtaatcccagcactttgggaggccaaagtgggaggatcacttgaggtcaggagtttgtgaccagcctggccaacatggtgaaaccccgtctctactaaaaatacaaaaattagctgggcatggtggtgggggcccgtaatcctagctactcgggaggctgaggcaggagagtcgcttgaatccaggaggcagaggttacagtgagctgacatggtgccactgcactcagccaaaaaagaaatcaatgaggttgactctagaatccaagcttcctcacctactaaaggccattaaactagcaggctttatgtcctgattttgttctctattaaagagtaccagggggaaatatacagctgaagtttattttccattctccatcagtctagaataatctcatttggatatttctcaaataaggaaaaacatggactttctctttaaggaatgacgatttgtgaagactgtcccattttacaaatctccgatgcccatgtacaatgggaaacccaaggggctccccaaacacttccatttgtctttttctggggcagacctattaaggtgccactgttcagaaaactcagcagcaagttaatttgcccatgttgaatgtgagtctgctgaacttggggtaaattgatatttccctatttcagatataaatgtagcaagaaaaaaaatccctttcagattcttaaaacacttggactgatttgctgagaaaaagccagcaacagggaattaaggagcagagtatcccatctgcaatgagatgtacagtgtaaaatcaggttatcagtgaaaatgagtctgatgtgctaattcatagcacattccctatacttacgttgtgagcccattatataatttagcaagattctggggcctttctcaagggagggcaagttctagaaaacagaggttctaggcaagcatgaggaaagtcctttaatgaaggaagaagtcaggtctatattttccaaaagcccatgctatttatacctctagcccctgatgttttaatagtgaaagaatggtgctgattttgacttttccctgaagcacacactttcacatgcaaggaaatgaatctttagcatatcctggatgaaaaagcaagaaatgtcctattaacttgaatgaggcattaaagggtctttgatgcagttcaacttctaaaacgcatatactttctcctccaggttacttatggtagacacattcttaactcctttgaaatgcagaatgagaaaaaattatttgtcttcttcaaattcactggctagatggattctctgcatgtacttcaatttccccaaaccttagtgctatattttttaaggaagtggagttattcaaaaatgataatacactcatggttgcaaattcagatttcttcagtggaagcataaataactatttcttccgtgaatagaaaaatgagtccgtgtaatactttgtctcttcatattatcacagttgtggatattataccaaatggtaacacagaataggaatagctcatcctggacttctgttcatagagaaagacaaagcatttagctgctaacaggccttgtcaattccccaaggcttccttgtaggcgggaataactccattcttttgctggtttcctaacaatggtagttgtattcataggctaactctcttccttttgctcttgccctttactgctgtattctaaagttttcagctctgcaatgaaaccttcagcatgaaacatccacacaatcccaccaccaaatgtctcacctgtacctgcttacacagcttgctctctctggtcatagatgcacaaccaggatctgatcttaggcctactttttcactgttctctggatcccacctcctctgaatgatgtacctgctctcttcttcatcattattcttccctcttcactggattattagcatataagcattctataatacatcctattttttaaaaaaaacaaaagacttccatgggtcccctcatccctgtgtagactgagatgtcctatgttctttataattaagttcttttgctctggcatcccttcttaggcattcctgagcccacaagcccattccagtgagactgtggtctacaccactctattgtcatgatcaccaaagacttttactagcacttatcttattgaactgatcagcagcatttgggagttggtaactgtttcttccttgaaatgtcttcttcccctggatacagtaagatactcttgacaaagctttctgtctccagggtgtttcttctcagtctccattatttattaagtataagcttaaataactttacatcctggaaggccccaagggctgtccttaaatctctgttattgtccatatccacacccattgaaattatattggctatatttgaaatatatctagaacctataaccaatttccactgctatcatcctagtcaatgtcaccatcttctcacttccatacaattgaaataggctcctgagaagtggccttactgatggttttgccacctacagtctagtctttcccaagaggccagatctatcctttaaaaatacgtgccagatcttgtcagtcttccatttgacactgagtataacctcattcctccacttttcatctagaataaaatttaaaatttccacatgatccactctgcatcatctctataacctaatagaacgacttccgtgtccttcacctaataccttaatcaattcctgttgctatgaccaaataccacagactgcataatttataaataatagacaattatttctcacatttctagaggccaggaagtccaagatcaaggtgcaacagattcagtttctggtggggacccatgctctccttccaagagggtgccctgtttctcctctggaggggacaaatgctgtgtccacacatggaggaagaccagagaggcaaaaagggactaaggtgctctgttctgcttcttttatacgagcactaatcccatccatgagggtggagaactcatgacttaatcactctcccaaaggcctcacctcttaatactgccacaccagagattaggttccaaccttagaattttgaagacacacaggcattcaaaccgtagcccatactttccggtagccatgctggatttcttgctgttccttgaatgctccaagcacactcccacctgtggttcttgctctcacagtttcctctgcctgggggggctctcccagcagatatcagtagcttgcttctccaaataactcagatatcatccaatacatttgtcccttgcatcctcattactctctgttctcacccaccagcttcatttttcatagtacttactataacaaaaaatttcacttgtttattatttttttcctgcttcttttagaatacaagctccttgttagcaggaatttattttattctcttccattccctcaagtctagaacacttctagttccttagtaactgcttagtaaatatctatggttgaatgcatctccatctctgtgatataacctcatccatatctaccttccttactgccttatgatgcctctggatgtaatttagattttgagtattttttctattcccaagtattccaaacttacacacacacacaatatgagcttacacatacacatcatatttttataaacatgtacacgtatacatagcatattaacaatcttcaatgatttattcaacatctaatataaaaaagtattattatataggattgtagacaaattctaagaatgttaaagcaattaaaagctattatgttataaaccaaccaataagtaaattgtatacattattttagtgagaaaaaaattctggaatgatggttaaatattagtctgggacagatggcaactgcatatgatttgctacatatccaagaattaactggtaactacactatgacattagttctaggataactaaatcttttttaatagctttataattgacaaaaattctttgcttgaccaaactttagtcaggcttttgaatcttctcctaggcctatctgtgcacttccttgtaaaaaccagttttagcaagaaccttgatgtcagtttagaaggaacaccccactcacactctgggttcatctgatcatcccctcaatatctaatctcatcctccatcctctgacctctcccaggtctgatcaccctggcctgccttcagcaagacacttgttaggttggtttggccagaatcccgtctccctgaagttcttagtaattttccgtccactaacatgtcacctaaccctggctccttaaatctaaatccccactttctcatgccatgtttggagttgagctcagtctctctcccccactgcaaaaatctcattgctttggtagctatacccatcacaatggtcatgaataaaatcttccttattgtgcatccttattgtgtatcattgagtaattctgtctttaacataactaaacaaaaaaaaacctctgacagtttgtcctttaaactagaacctctcaaacacgtcagcaggtatttctttcctattattggagcccggtatatttggcaaggcagtgcttaaggtgataaggatgaagactgcagtctgtggattcccacagaagtgactatgtgccactttctagttcagcaacttgcttttcctctgtatgcttcctgagaagtcaaagaaataacatcttttaaacacccaggatcatgcatgacacatggaaggacctaataaatatcagccattatcattatcattgctatttctgttagtccaagtattagcttcaaatatgtaaactgcatatagtttgttggggcagtctgaggttgctctatctcatcatcagggggtctcagtccatcacagctagtggcctgtcatcttttattttatgttatttatttttgttttgagacagagttttgctctcgttgcccatgctagagcgcaatggcgcgatcttggctcactgcaaactccgcctcccgggttcaagcgattctcctgcctcagcctcttgagtagctgggattacaggcatgcaccaccaagcccggctaattttgtatttttagtagagacggggtttctccatgttggtcagggtggtctcgaactcctgacctcaggtgatccacccgcctcagcttcccaaagtgttaggattacaggcatgagccactgtacctggccccgtcatcttttaaactgtaaagacagaggggccttgctctgtagctgaaagtcaatgcttctcggcctcttgcagctaagtagataatgtgtggctgaggaaagggaaacttactgaacttttaaagactatttttggggaaaaatgtcaaactctttaaaagagaggcattaaaaccctctcctatctcttcctcctaatctaatagtgcaaaaggcataaataatagcatcaacaatataggaatattttctaactgctagcattgtagcagtggcatcaaacagcactagtaaccactgtgttcctcaccatcacccacgggcaaaaagcaaataggccagtttcaattagtaatatacataatgaagaaaattatgacttttattaaatcacaactcgagctcatctttataatattctttgtgacaaaatgggagagatacataagataatcccattgcctacataaatatgacaattatctcaaggaaaagcgctgatgtaattgagttttgtgctgaattagccatcttgttcaagagccaatatttttacttgagagagtaactggcaaactatagttattcagactcagatatttggcagcattttcttaaagatgagcaaagttagcctgtaccttcaaggaaacaattgagagtattcgtgaataatgatgaaatctgagctttcaggcaaaaattattttggaaaactcatatctgctaccaggggcttggcagttttgtgatacttcaagtctttactgacttttaggttgatggttattttaataaatactgatttttgatatcatagaacaaaaactttgataacacttggaaatgtatataacttagtgaatcaatattttccaacattatgcatagagaaaagatacattcaaagttcaacatagaccttaaatgatttttatgaccacaatgatatatggagtgacaaggatctcctctcatcttttctgtgtttactgccttctagcaagattggactcttaatttatattttgctttgttttatttagtatgcctcttggctctactcataaaattccctctgcctagagaactttcccccacagagagtcacatggcaggctcacctcattcaaatctctcaacaaatgcaccctccataaataaaccatccaggttagccctatccaaagtaacttccctctatatctttattcttcctcattttactcataattgctgggcatttcctaatacatttattaaatattgctagtcttttccaagggaacgtaagtgccatgaagtaggaaatttgtctctttttttcactgtgtgttccacagccttgaacagtgtctggagtaaattatgtactcaacagatgtttgttgagtgaatgaatcaatgaataaataaacattgtaagttctaatacactcagggtgagagcagctaaatatcttaagcaaactcacatagctttgttggctaagctagaattggtatcagtttagtgccagaacctaaactcttaactaatacactattgcacattttgaactccctaaaaatttacaagtatacattccctcatttccattgccactttttattttagtcagataatctaatttaattgagaaagtcctgctttttggtagacaagccgtccctctttcaattcatacagttaaggagaaaaagaataaaagttatagtcagttgtaaggaaacttcaaataattatacagatataggctatcaggaatgctgaaataaatttgctcatgcattgcaacattggccaaactgatcaatatccacaggctaaaaaaataaacaactgaatctctctaggccacagctgtctttctatggataatttacagagttagaaaatagctcaaaacacacaaaggctctatagaatcagaaaaccaaacgaagccggtagacattgaagacttccaatatttttggtccatttcaaaatcttgtgcaactttttatatgtatttttaaaccaaagggcaataagtgtcttctaggagcaacaaagttaagatttgtattatccagtaatatgataatatagaaatattgacattcagagccttcccaaattctttgtcacaattttatgccctccaaggaaaactcagtgtcaagtggttattgagggtagcctgttttgttaatcaggagaatgttcaaagagacaaatcgcaagaatgaatttagagcaacgtaaattataaagattctgcaaggaggcacagaggagaaagagaagccaaggaaatacaggctaaggattttgagagagagtttcagaaggagaaaaagagtagagtagtgacattagggacagctcctgtggtgtgaaggtttgaggagagaggtttcaggatgttttgctgtgtttcattgcaaagtaattgttttcagtgcaattgtttcaattcaatggtttcaatgcgatgcaatttaattaatcttttagactttttttgagaaatgttattaaagccaaattactttgctctgttatgtttagacttggaattatatttcttttagattcaacaaccaagttgtgggtcttgatcagaaggaagcctggtgtgattctcgttacagtgacttgctgaggaaatttcatcagtggagtctgatcagatatagtgttgacacaagctgtatttctttctactatttcacttttaagtaatacttttagtaaaggttagttcacaaaccagtgacatcccaaatctgtttctttcttctatgatcttgggtttcactgtcaaaaatggcaaccacaggccccatattgctattgggcactttaaatgtggccaatgagactgagaaacttaatttttatgttatttggtttatatttaaatttaaaaaaggaacacatttagttttaggaaatcttcaagtttttttttgttttttacttttttttttcttttttagagacagggtcttgctctgtcactcaatctggaatgcaatggcatgatcatagctcactgcaacctcgacctcctgggctcaagccatctccccacctcagcctcctgagtatctgggactacaggtgtgtgccaccgtatctggttaattaaaaaaaaaaaacttctattttggagaggcaggggtctcactatgtttcccaggttggtctcaaactcctggcctcaagtgatcctcccaaggcactggaattacaagcatgcacccagcctcaagtattattttgaatactatgtttgtggatccgcttttctgaactgtaaattttgtaaaatttcaataaagatcaagcatctgtgctgaaaatttaccatatgaattaaaataggtaaaaaaaatactgcaacatttataaacagtgcagaaaagaaaaaataatatgttattagaaatgttatattgaagacatgttgaaataatatactttggataattgagttatgaaatattttaatctaatattcattctgtcgtgcaacaaatgtttaatgagtgcttgctataaaatacatcgttaggaaaaaaggggtcgataaaattgtgctgaactgaatataataaggtaaaaataaatgtatgtgagtgtatgagtgatgggaactgaggggaccatgcatgacagagatatgagtcaacttttcatggggaatttgagattctagtttgcctgtcatcagtcctgagggttttgaatgccagaccaaagcgaagaggaagagtctctgtaaagccatggaagcagcatgaaaaacaatgagcatgagaagagtaggaagacctgcctggttgaatgggaacatattttgggaacgtgaaaagagcagaaaaataagcacaatttgtaccaattgcagttgatggcactccttctacgagagtacagtaaatacactgcagagtttaaaaagcctagaaagacatggaaaataatagtatacttactatattttgttcaaattaacaatgagacccatggctttgaattcaaaagtgttctacctaaagagatactggagactgtaaaaaaaagtatataaagcatattactagaaattgtgattaaagttgtagtgttttaaaatagttctgcaaattctttgacggtcttgccttgcacaggtgttgcttgcttcccctcccctggaatgtaggtcagacttaatgatctctttggaaccacagaatgtggcagaattagtattctatgacttgcaaggttatcaacgggatgtagcttctgcctggtttttattcctgcatcactgtctctgggggaagccagctttcatgttgtgaagacattcaagcaacactatggaaaaacccacatagtagaacggaggccgcctgctggaagccagtaccaccttgttagccatgtgagtgaaccatcgagtggatcagccagccacagttaagcctgtaggtggcagaagcttggaccaacaccttgactgcaacctcatcaacaacaccaagctagaacctcccagccaggccatttctgaattcctgacccatgtaaaactgtgtattataatcagtgcttattactttaatgagttatgtggtacttatttttgcagcaataaataactagtaaaagcatgttatttaaggagaaatttatcctatgttttctgacctttcagatatcctgtaggtacctgaagtggcaaatgttgggatgagggtactatcttggcaataatggtctggcaacattgacaaagggattggatggcccacagacagacaacactgaaaggtgacagggtctattttagtctttcaaggtagaggtgacctggagaaaggcaatggcagcagaaatagagaaataaaagagatgaagcctataaatgccaggaattattcattcaaagacgatatcacattttttgagctagagtgactaattggtgctgccttagagaaaaatttttaggtgcttaggaagagaggttcgattttagacagtgaaatttagggtaacagatgtcttgaggctggaaaaggggcaaagagtttgtgttgatgtaaactgaactttgatgtaattgtcaagaggctttcttgggaggggtttgttgatatttactaaaaatagcaggaaagcaaacttttagatagtgagggccattgatcaatatttggccagtgagttggtttgcttatgaaaccctggaatcaataatgatggaaaatctacccatgaacctttggctgatggttctcaacaatgttacagaaagtaaatgaagttctataccactgatattaacagaaacagtgaagaccaaagaaaatgtctttcctcagttcctgttaataaggagtcagagttggccaggcaaattggctcacacctgtaattccagcactgtaacagtccaagatgagtggatcgctggagcccaggagtttgagaccagcctggacaacatggcaaaactccatctgtccccaaaacaaataaacaaacaaacaacaacaaatacttagccaggcatatggaggaatgtgcctgtggtcttagctacttggggggccaaagtgggaggatcacttgagcccaggaggttgaggctgcagtgagccgtgaccatgccactacactccagcctgggtgacagagcaagatcccgtctcaaaaaaataaaagaagtcagaattatcttaccagtttttgttttctatttcattcacattaagtagttaaaatcttgccctctgttcattcattttcatcataaagctccttctagcatcctcatcaaaggaggaagaggaagagctacagtgtactgaaacaaattatccccacgtatggggcacttgacatactcaatttctcttagctctgaagtactctaccatgtaagaaagggatgcttaccctcactcacaaatcagaaaatgaagtgtaagagaaatgaattgtccagagcctggattggaaacactcaagcctctagtctaaccattttgtagctctttgacagctgcttatcatacacacaaccaacagtcattctcccctttgttcctgctcataccatgttcttacctaacctgctgcttgaaaacctgcgatcccattgcatctcatgaaaaagccctctgatcctttccatggattccacatggattccctttccaagctttctccacattcttccttctttcttgaagatttctgctacctcagttcctcacagaaattcatctgacctctaaattaagagttggtgacacatggcttggcagtgaagaactctggattagccatttattagtactttggttaattgacttgactgtcttctggaaaacagggagagaccataacttatgctgctgtgaatttcttcataccttgctgattactggcaatcaattgcttttatatgtgtatttgattttaaaagatccaaacttgaaattatgctcagaaccatctcatttgtttctatgatatgtagatgccttttaaatctgtctatagcctcatactgggttttatttccagaaactccaccagctttcttggttaacaaaattttccacaatggtgcatgtcttttatatttctatgttaattttatatggtgttctgctacttttaacatgacttttctccattattccctggaaaactgcatcctttaagattgtaggtcatgctgacattggtatacaagcattcctctatcccttttccattcatgtagctactctgtgtttagataggagtgaacatgacacattgcctcagggggagcttcactgctataagccagagaacactgatatatctccttgccccagggttatgtgcaggactggcaagtagcccatatatatgtcgattcactgatggcatttcctcgctacaataactggttacagaattggcaggggcctcaggtggtcaagttagactaaccatcatatttttatttggttgttagggggaggctatctcttgatgtagacaaagtggcattagggtaagtagatgtgagacgtggtactgacagaaccatttccaagctctgagctaagctaggctgaggttggaactgccacatggaaaaggccagactcaggaaattcatcgagaaatggccatggaactttgatccctagccctgaagtctgctttacctctgggtgtttttagctacatgaaccaataaatgcttttaattgcttaaacctaattgagttgagttttccattacttgtaactgaaagcaccttaaaaaaatccagataaaatttaactccctttgtaaagccctctcaaatctctacaggcaggtcagtttactgacccttcttttcttccccataactttgctcatacagcactcatcccattggaagtgttgcactgcaatgaactgttttataatctgtttttccagcacactatgagttcagtaagaacaggaactagatcccattcagcgtcacatccctagagtgttacacattgcccagttcttttaggaggcatcaataaaggaaggaatgaatcttcagctcctttaccctggttcttatttcagtccctgacaagaacccagatattcaacagctgaggaaagttagagtttacgtagtgtctgaactgttgtattgcagtctgcagcagttcaacctatttatcacagggttattagtctttcccccaaaccacttttaaccaagtcccattacactccaagtccttctgaaattacttacagcttctgcagaatagaccatttttatgtccattcatttatttactcagcaaatatttatcctgcgcctacctgtgtcagtcagtagtgtaaacacacaacattaacgaaaaaatcttggccttacattctagcagaggaagttataaacaaaatctataagtaaatatagagtaggttagatgatgatatgttctatgaaaaaaaaagcagcgaagtgaaacagaaagtactagaggtggttttattgcaattataggcagagaggtcaggacagtctcaatgagatggtgacaactaaagaaggtaatggagatgtatacatatcttagagaaaaaaagtattcagagagagtaaacataaagtgcaaagactaccagacatataaaacaatgtccatagtcattaatcgtcaggaaaatgcaaaacaaaatcacaatgacttatcacctcacatgtatcaggatggctattatgacagaaaacaaaagacaagtgttgacaaaggtgtggagaaattgaaaccctctcaggctcctgtggaaataccactgagagagcagttgctatgataaacattatggaagaaccaccaaaaattaaaactagaactaccatatgatacagcaattcacttctgggtatttatccaaaataattgaaataggatcttaaagacatattagcactcccatgttcattgcagcactattcacaatagccaagaggtgaaaacaatctaagtgtccatcaatagatgaataggtaaagaaaatgtggtacatacaatggaatattattgaatctttaaaatggagattctataatttgtgacaacctgaatgaatctttaattttttttcttttttgaatatttaatttttatgggcacatggtgtatatatttatggggaacatgagatattttgatacgggcatacaatgcaaaataattacaccagggtaaatggggtattcacctcctcaagcattcatcatttcttttttttatgatcattctaattgtactgtctcagttgttctaaaaggtaaaacaaattatcgctgactatagtcaccctgttgtgctatcaaatgctagatcttattcattctacctaactatatttttgtacccattaaccatccccattcccccccagtccccactacccttcccagcctctggtaatgataattctactctatttgaaggagtcttaggacattatataagtgaagaaatacagttacagaaagacaaatactgcatgattccacttatatgtgggtacctagagtaatcacattcatagaatcaaagagtggaatgaatggtggttgccaggggctggaggaaggagaaaatgaggagctactttctgtccatggacagaaagagtcagtaaaaatgaataagctttagagatctgttgtacaacattgtgcctttagtaaataatattgcacaactaaatattgcatatttaaaaaggtaagggacacattaggaggctgaggcaggcagatcaccttaggtcaggagttcgagaccagcctgaccaacatggcaaaaccccatctctactaaaattacaaaaaaaaaaaaaaattagccaggtgtggtggcgcacgcttgtaatcccaactattcaggaggctgaggcaagagaatcacttgaatccgggagacagaggttgtagtgagctgagagtgtgccattgcactccagcctgggtgacagagtgggactttgtctcaaacaagcaaacaaaccaaataaacaaataaaaaggtaagagagtagttctcattttaaatggtctcactacacacacacgtacaaacacaaatggacacaaaacaaagaccctggatggagcacctggtgtgggagaggaaaaaccaggctggagagaggctggagcagagtgaatgaagaggagatgggtgggaaagatatgggatgataatatcagagagataaagcaggtcagtaaaccactgaactcttccgacgtaggcattttaatcacggtaaaatgagaagcttctgtaaagatttcacagacaacacaggatgacagtctcaccatcagaaggctggaaggcacagccatgtgcattattctggggctaagaaaagcagttgctttagctccacatagggaggttttatttaattaggatttgaaagtcatatcaagtggctctatttctttctaacaaagcccaatgtatttaattcctataaatattttagctaacctgtcagtcacatactttttaatataagggtagtggcacataagtgaaaatggaatacacaaagagtttcaaattatgtgtaacttggtagagggattaggaggcatcttgtaaagatgtggcatgtctagtgtttcactttgttttccctaagagaagactgagtaatagaaccacctttttattttctccttctgcaggcctgctgcctgtgattgatagctattaaattaggttttacctccccagattggtccagattaaatacacttatagcacagcaagccactgagaacaaaggaacaagtggcaattactttgtctattttggtcttcttcatagttaaccatcatttaagcattcaaaggaaaatggttggaagacaggaacgaaaggaaaatgaatgaaatgagaattaaacacatttcattgtaagttcctcaaatttataaatataagcttgcacacaagcatatttcttaagagaactgacttcaaatgcagaagcaaaagaggaatctcctggaatacataagtttattgaggtgatttgtagtataaccatctttcctgacctatcatgggactatatgtcagtcatatttgaaaagaatttatttgggaagaattccacttgttcaggactcagacagaagacagaatcacatgcttcctagacagtgatgccaaggttattactttgaaatgagtagggtcaaagtcatgctgatgagagaaaaatgcttttctcatgtgaaattgtgttctcttaaagataaataaatgaaatcatatttgctgtttcaaagtgtttgccttccgtgttttgtaaggaaatgatggcagcctccactcttggaaaatcgaactgggattgtagcacccatcattcttctctttctcaagagatcagggtcttcactccctctcactctatgaagccagtaaagtgtagacatagggaatccatatttcacatactgcccaaacataaggtcgtgcagagcacaagaaaagagagagactgtatttccatcacatgttggaaaattatgtttcttgaggtgtgtgtgtgtgtgtgtgtctgtttgtctgtgagttagtgtgtctgtgtgcttagtgggtccagggatgcaccagataagggacttaggtaaaggtggtaagaagattaaaaaaaataaaataaaaaataaaaaataaaaaaacatcaagaggaaaatctgtgtggttatgtctgagggtctcgtgtgtgaatttcctcccgttttgtggcattaaaaatgagttagttaaataaagtagcatttgcaagttcttctcctctgttctattttcagaaagggtcagaggaagctcatgatctcctggagagactcaatcagagctggatctggctgggaggtcacattggcccacccgatgtttgttactcaagggagagaatgctccagagagcacggtgtttttagcatgagatgtcatgaagtagtcctcggatttttctccctttgtggggcagaaagtagagctttgccatatttgctcacagataataagggacatatagaacaataaagaattccacttctacagtagatcttgggacatcagctagggtaggagtcactgtgccaggacatacacttctgggattgcctctccttcccagaaatgtgtttctcagtttggcctaagttggacattgtatcagttgaatggaagtaagtatttaaagggaatgcagaagcaagatccaatgctctataatgttggattgatctatgttttgggggcctccatgcagaaactcaaatagtagaacaaaggaattactctagaaagcagaatgtgtgtgtccagccttgatttctgtagccagataacttaagtctgaaactgtgaaggctctgtgatgataactatctatttgtctatcgatctacacacacactctctccctctctctctctctctctaacagggacataagacttctggatcatggatcagactatttagtcacagagcagcctgcatccgtgccttatgcccaaacacctcccgggcagtgcagtaagaaccagatctccctgtgcatataataggtattgtaccattaaaaaaggaaccccagttagttgggcatgatggcaaaagcctatagtcctagctacttgggaggctgagacagaagtattgcttgaacccagaaggcagaggttgcagtgagccgtgattgtgccattgcactccagcctgggtgacaaagcaagactccatttcaaaaaaagaaaaaataaataaataaaaggaaccccagaattatgaaacacagagattatatagggtgcttttccatctgtccctgcatcgctctggagagatataaagagacttttgctatgcaattttaaaaaatcatcttttgggagggaagaaagaaggtctttcctccaacatcctgccatgtaagcaaatgtcttcaggggagagaggaagtgtctatgtctccgaagctctctgcctttacacttttggacagttggggccattacagttgtccgtcaatcaccctttaacctgggtgctgatgttctttgctcagaaggctccaatcatacagaaacatgaaaatattcataaagagttgtttccctacaagagccagataataattcatctcttcagagtgtggttgtaaagtagaatgagattattcagggatggagataagaagtaatgaaaatcaaggaccagtcaaggaatagagaaagtatgtaattccttcagcctctaagtggaagtagctttgcctatgtagggccttctactcgggagttttcacctgtcctccataatgcactatgcatggaatacgaatcaaggttgatgcatccttctgctgcagttgccattctgccatattatattttcctgttttccatgcttcattgagattgaaactttcctatttatgactatagtccaagctctagcatcaagcatggtacttggaatgtgaagcatgtttaataaaataatgacctatgtgttattcccttccatcccaaacaatagcttcctagctggtttcctagtgcatattcctaactttcattatgtgatatatacaccaggaaaatgatgatgatgatgatgacaacgatgatgatggtgatggtgattttggtggaggaggtggagattattgagttagggaggccaaatttaatatcgcctctattattaagctacttgattttcaaaggtgttgcttctccacctataacataaataataatatcaattatatttaatacagtaatatctatcttaaaataactaaataaaattatgtaggtacagtacttagtatggtgcctagtgcccagcagggttgaaaaatgattagtgactgttatttatcattgttgattttctttttaaaaagcagtaaagcataggaggaaaagtaaggagagggaggaaaatattgagtttttttaggttaattctattaggctttgctccctgccaagtcattgttataaacaatccaaggagagaaggaatgtgtagaagagatttaggaaagaatattatgagaccaaatcctccaaatgaatcccagtccatgcagaaattgtactggcgacagctgttagatttgggcagagactaatgaagaattataaaggaggtataatgctgattttaattctgaatttgcacaggggtcattccaacgtcaaaaataattataaacaaagagatttcagttgtagttttgacactgtgcaagagctaggtcagacctctcatgagggctacagcctcccttatctctatttttacaatctgttctatgtatcctcacgaaatagacagacactgtatacctacttgtcaatgttggtgaaatgtcctaagttccactgaaaaaaacatatcaaaatattagcattactaaggaatgcattgcactggatatcttatttctttttctaattcaactgtaaaacacaaaattaaaatggcgaaataatgttctttgaatatctttgtatccctacatttctccccctcccactgccacctctgtacttcactgcaatctaggctgtcatcatcttgtttatgaactgctgtaatagctgcctacagggttttctctctcctgttttgttctgtcccctgcctccagttaatctattgtccacagcagtcagtacgatacatacatcagataaatcaatatcttgctgaaaagcattcaatatcttcctattagggagattcaaaaccctcaacattgcatagatcttccagttcctactctgatttctttgcagtgttctttatcatttcctgacactctaccctctgtttcatacatctttcccactctggaatatgcagtttcttctaagtggaataactgctattcaattttaagaccttaccttctgtgaaactactagaagaaaacataggtaaaagcttctcgacattgatctgagcaaactttttgatataatctcaaaagcaaaggcaacaagcaaaagcagataaataagattaatttaaaccaaaaagcttctgtacaggaaaggaaacaatcaacagagtgagtgaagagacagcctatgaaatgggagaaaatatttgcaaaccatttgataaggggttaatatcacaaatatataagaaattgaagtagttccatggcaagataacaaaaagcatgatcatataaagagcaaagaacctaaatagacatttctttaaagaagacatacaaatggccaacgggcatatgaaatgctcatcatcactaatcattaggaaatgcaaatcaaaaccacaataatatatcacttcacacctgttaaaatggctattatcaaaaagagaaaagatagctagtgttggtgaggatgtagagaagagggaacacttgcacactgttggtgggaatgtaaaatggaaaacagtatgaagaatcctcaaaaagttaaaaatagaactatcacatgatccagcaatctcatttctgggtatatatccataggaaaaaaatcagtatgttgaagagatatctgcactctcatgttcatggtagcattagtcacaatagccaggatttgaaaacaatccaattatccatggatggataaatggataaagaaaatgtggtatatatacacaatgcaatattactgagcctttaaaaaggaggaaatcctctcatttgtgataatatgaatgaacctagaagatattgtgctaagtgaattaagccaagcacagaaagacaaatactgcatgatctcacttatatgtagaatcataaaaagttgaactcacacaagaaaactgtagaatggtggttgctaggggctggggtggggatggaaagctattggtcaaaggataacatttcagttaagataaataagttctgaatatcttatgtgaccatacttaagaatattgtattatatatttgaaaattgctaaaaagaccataaatgttctaaccacaaatacacaaaaagataaatatgaggtgatagatattttaattagcttgattgtgttaattatttcaaagtgtatacatatatcaaaacatcacctctatatgagaagtcactcttcattctggatcaatataggacctactgaaactgtcatttcctccatcagaattcatatttcttctatcatattacttttttcaatattatctgtagtctctgatacactaacaatatcagttatttgcacctaacctctctgttctatgagacatatctctgttacagaaaaattggaaggaatgaaaagagaaagagatgatatttagcattttgtttcataaacactaacttgaagctcacagcctgcacacaatcatgaaaaccaagatgccgaaattacagacagaagtattttatattataaaatttctgcagcctactttttttttttttttttgagacggagtctcgctttgtcgcccaggctggagtgcagtgcagtggctcaatctcggctcactgcaacctccgcctcctgggttcaagccattctcctgcctcggcctcctgagtagctggaattacaggtgcctgcaactatgcctggctgatttttgtgtttttagtagagatggggtttcaccatgttggccaggctggtctccaactcctgacctcacgtgatctgccctcttcgcctcccaaagtgctcagattacgggcgtgagccaccgagcctggcccacttacctttttaacaagccataggatagagatgattggcaagattgctttaagggaagatctcataaagcaatcttgggggtgatgcttcaagtgagagaaagcaaggatggtcacaacattgaagtagttgggggaaacatcgtttatgtgtgtgtttgtgtgtgtgtgtgtgtgtgtgtgtgtgtgtctgcatatgtgcttgattcctacttttcatttcgtcacctgggaaaactgcaagcccagcagagaagctactatatttaccacaatgtaacacagtgccacacggacagaagtttacaaactgagaagccttacttagagaactatggcatggagaaagcaggtaagggctccagagtcccaagaaatgttgtgaccactggttgaccagaagatactacgagttaagatgaagaagtcacagaatgcaggaacttactaccatatctagaaccttagacttcagtaatgaatgccattacataccaagaaaaaacaattatgcccaactttatctcagtaggctacagttcaacataaccagggcccagatgggaccaatcacacttcatctgatattcttggaagtcaagagatagcacctggacaagggaactctcttccaatgatgagatgatcagtaatatttcttttgcactcagacgctatcttagataggtaggaggaaaagcaacaaaacccttttacaataagagacaaagtcttgattgtcactttcaacattagactgagtatttatgtaaaaggcactaagttgaaaaataattaaagcaaaagaaactgcaaaaaacataagtttgagttctattgctactaacattgcaagcgagaacgtgagttcacttaaatgagatataacttctaaatttccattttgctctacttacagaatgcattgttcctgataaggctcatttttttccatatgtaacattatacctagcacaaagaagctgccttctatacatttgttgaatgacaaagtaaatgagtaactaatgctgatttaggaaaggtaacaaattagtgattaacttctaacatgtcctcttaactgttagccacaaatcactatttctacacctcctcccatctctgttctccatgtccatgtcacaaagttcaatccaactgattttttttaatttcacagaattttaaaatatcagccatatgttttcactaaaatccatagagacaaaaccatgctaccagccagcatttgctctttgtttcaatgtacagtatcctatatttgagccatatgacttatgagaatttttttttttttttttgagacggagtctcgctctgtcgcccaggctggagtgcagtggtgcaatcttggctcactgcaacctctgcctcctgggttcaagcgattctcctgcctcagcctcctgagtagctgggattacaggcgcgcgccaccatgcccggccaattttttttttttctttttgtatttttagtagagactgggtttcaccatgttggtcaggctggtctggagctcctgacctcatgatccacccgccttggcctcccaaagtgctgggattacaggcgtgagccaccatgccaggccgagaatttttaaaaatgtagtgtttccttattttcccaagacttgatggaggatgggtaaagggatgcataaaagcacatttaccttttgtactagaaaaggcctggggtccatatctggactatctgatcttttccaatatgtgtaaatttcttaaaaacaaatgaggattggctgggcatggtggctcatgcctgtaatccctgcaatttgggaggccaaggtgggacgatcacgaggtcaggagttcgagaccagcctgaccaacatggtgaaacaccatctctactaaaaaaataaaacattagccaggcatggtggcatgcgcctgtaatcccagctactcaggagactgaggcaggagaattgcttgaacccgggaggtggaggttgcagttagctgagattggcaactgcactccagcctgggtgacagatcaagactctgtctgaaaaagaggaaagaaagaaagaaagaaagagagaaaaagaaagaaagaaagaaagagagaaagcaagcttactttttttaggttcatctcacaatattcttacaaaatataagatttctacaaaacctaagatttataaaatctaagaaagctgaaaggcaaactcaagcattaaaaagtggaactttagaaaatcacagaatgttatccatttctccactattatatcattttaagttagcagatgtcaatcaaatattttccagataagacagtcatagtgccacatgttggaagaaacaaaaactgggttggacaatcctgtccccaaatgtgcataggctattttaatgtattttttatttttcaatgattcttcataaattctttgtccttcacaacaaagttcttttggcaaaacactaaggagataaaatgtattcagtacagacatgagataggacaaaataatatgatgggggaagggacattggagaggagaggagaaatgagcactcgggagagaggaaagaaatagaatgatcctcaacaatctatttttacttgacctttgaaggactctggttatatattcttttctctatcttgccctaacccttctaaaattattaataaaataaaattataggcataaaatactacctaacttaactttaaaatcaatattatgagagattaacaaaatagccaattttcctaagtaatcttaactcaattaagcacttttcattaaacattttgacttgttaggggacaactaaaactgtctgcgataataacactatagtattttttataatgtgaatcagcaggacattaaaacctaactttctctaatcttcctaaacatcatatctgaagtgaaatatgtgttaaatatatatatgcacataaagtggtaagaatttatttaagtaaaagtaatcctttaaagaatggagtatgaaaaaataaaatgaatatgcaaatttttggaagatattttgtatattcaaattacatatttgaacgtatatgcacacgtcattaacacatatatatgtcattaacctttactataattctttcagaagttatgatgatataaattacattttaaaataaaaaagaaactcttgtgaatgtcaaacacatttgccttcactgttgtactgcatgctaacatatcttaaaagtggccggacatggtgactcccgtctgtaatcccagcactttgggaggccgaggcagtcagatcgcttaagcccaggatattgataccagcctaggtaatatagcaggaccccatctctatagaaaaaaatacaaaaaattagctgtttgtagtggtgcatctctgtcgtcccaggtactcgagaggctgaggtgggaggatcctttgagcaggggagggagaggttgcagtgagctgtgatcacgccactcactgcactccagcctgggcgacagagtgagatcctgtctcaaacaaacaaaaataccaatgtaatatgtggaaacattattgagcaataaaaagaaataaagtattaagacatgctacaacatacataaacctcaaaaactttatgctaaggaaaataaagaggcacaaaagaccactttattgtgattcaatttacatgaactctccaccaaaagcaaaggcatagaaaccagagtagtttagtgaccgtagatatggacacatggagtctttcgggtgtgatgaaaatgttctaaaattggattgttacaatgcttgcacaactccatagatgtaatgaaaataattgaatcgtatacttaaaatatatacataacaatattatgacatgtaaatgacaccttaataaagctatttttaaaatctgaccatttactcttggataaaattgtcaaatatttagactacacagaaaggagaaaaatgtataacaacagaatacttaaattttggaaacatttttgtggtttttttattctttgaaaaagcaccctttccgaggagtatgtaaacatgtaacttctttaggttaaatggagaaaaatgtatcctttgataaagaggataaatcaacattaaacatcgtttaagggaacagtcagagttagcatttatttatttaacaaatatttattgagcatctactaagagccaggtcacgttttaagcactggggataaacatgtaaaaaaaaaaaattagttttaaggcttttaattttttctccattgtttccaaaccttcagtgaaactacacttaacttctgtaaaatccaagctgctttttaatgaaatattttaattaagcatgtcacttttttaacttttttttttttttctttttcatttaagatgcctttttcagatcattcccattctcattaaacttcacacggatcatgacttttctgttctcacaaatgcaccccaactcagtctcagggcaagaccagctctttttgtgcaatggtagggtttacctaatttgggttggaattttcaatacatgactgagagaatgtttcagtctacttagtaggaaccttaacaagaaaagtggacctcagtacagtgatgttatgctaggaaatgggtgtgtctgtgaggaaattttagaaaaaggtatgatttacttttcctaggaatagtcagacttagcgtttatttatttaacaaatatttattgagcatctactatgagccaggcaatgtgttaagccacgggaataaatatgtaaaaaaaaaaaaaattaaggcttttattttttcttcattatttccaaaccttcagtgaaaccacacttaatgacctttttagcagcattgtgactaattaaaaaagggaccataccaatggttgggaaaggctaatgaaaccaagtacagtcttccctacactgcacttcctccgtggtccctcagaggtagggtacagtagtgagaacttctaggggataccctgcagggagcaggcttggtcttcagcagaaacgcactctgagcaagggtaactcgaagggactgactgagaagcaatggtgctcaattatgaggttcagataaatcacctgcagactcattaaactaaatccccaggatccagtctcagaaagatgaatacagtagaaggagtgagtaggagctaggtcttgacatgataggcataagaactgtccgcgtagggcagaagcaggaaatgaatttcgaggaagagttagccgtcctctttttcaaagtccttaagaaaactgacagccagaaaccatcatagccaacatgaattctctttccaagttgtaaacaaataaaggcataccagctatataggtttatgaagctgtaggctgattttcatggcagccaaagtaagcataagtcatatgaattgttcttataacttaaaaaaaatgttttaaacataaattaagccgcaagaatggagggtaaaggagagagtattttttttattaattaaagggaaatttgatacagtgcttgagcagtgacaaatacggtaacctggagaaactggggctggcagtatctgagtgggcttttagaggggtaggactcggtcaaatggatggtaaaacaaaacaatgattattacaggcatagtgctgtctctgtcattttctcatgctgttccttctgagtcagagaatgacatcgtatagtcgtttttaaagtaggaattacttgcatgcaatcctttttaaatgtaatgtcttgttttgccagtaacacaattgtccagtaggctcattagaccaccaggacactgatagagttccacagctgagggaggcataaaagtcaacccaaataaaagttaagtttcttcaactgatattttttacataagaataattcatatgacttcaggttactttggccagcattaaaatcagcctgcaggcttcaaaaaccactacagctgacatgagggatgatgcccacaatgacacttggtggtgggaggaagctatcatggaatcgcaatatttgggcaatttacaacgcgatgcccatagacgcaattgaaattggtaacatccagatttcatttatggtggtatgcttgctgactagccacaaggaaagatgatatcctgtgatggaaatggtaggaatcaaggtgcacattttctaggatgattttaagcttagctaagcctgtacaataaggaggacagactagactcatttctgaaatgctatttgattgtttttatgaaatagactttattttttagagaagttttagattcacaacaaaatggaatgaagagtagagagttcccatatactctctgcccccacacaagcacctaccccattatcaatatcttataccacaatggtatactggttacaatggatgaacttagattaatacatcattatcacccaaagtccacagtttacattagggttcatgcttgatactctacattctataggttttgacaaatatgtaatgacatatatccactattatagtatcatacaaaataggttcactgccttaaaaatcctctgtgcgccgcctattcattgatttctctctactcttccctggcaaccaatgaactttttactgtcttcaaagttttgacctttcaagaatgtcatatagttggcagcatacattacacagttacacagtcttttcagagtagcttccttcacttagtcatatgcatttaaggtccctccatttcttttcatgacttgataactcatttttttttagcactgaataatattccattgcctggatgcaccacagtttatccattcactactgaaaaatatcctgtttcttccaagttttggcaattatgcataaagctgccatacacactcactagtaggttattgtgtagacataggttttcagctcctttaagtaaaggcaaaggagtgtgattgatggatcatatgataagagtatgtttagtttgataggaagctgcccaactgtcttccaaagtggctgtaccattttgccttcccaacaacagtgaatgagagttcctgttgctccacatcctcaacagaatttagtgttctggattttggtaattctagtgatgtgtgtaatagtgtcccatttttgttttaatttgcaatttctgaataacttttttattctgataatttataattctgcaaatttatttatttagccctcaaactgggaaggaaattatttttaaaacccgtatctttaattatttgatgatttattcttaccaaatcaaagttcctaacttttctttcaatacaactgtgtccaatgtaacattaattaagcatttttaatcctgatctttctgttcatttaatccagtatgcactgagcatctatctattatcagtcactgtgaagataaagcaatttcccttaaaagaaaattataaaatcatcatttttgacaaggctgatatactttggtaccaatgacaaacctaagatagtatcttgtgcataatgtttttagcattagcagaattaatgtggttttctcctcctctggacttttatcaggcttgtgtttttatctagtacaatttatttccctattgacatatcttttatcttaatgaactaaaatattaacatgattcaatacaaacagtagtctattcttgcatcacgttttatacttactagcatgtattttaatcattgccacaaaatttcaaagtgataacggcttttacaaattactttccttcaaagagaaggtaaaaagaagaaactctcccttgataagggagggtttatcagtggtattctattagcaaagtagaagagatcagaacagtatgggggggtggggtcatgcaattacctttgaggaagtaagccatatacccgctatcaacatagtacagccatacttatgacagtgaagaatcctcaattacatcaacctgccccggctcagttctatgggtgatgcttcaaaagccattttaaaaatatcactcaagtagatattagcataatttagccattatttatgaagggtttagggtatgtcaactgttcttcctttttaatctttaatccttacaatagcctccgaaggttaaagtcactatagataaaaatggaacactaataggtaagaaatctgagtctcagagaggcttagtaacttacccaaggtcattgaggtggctaagtggctaacctaggagtcgaaatccaaatagatggtaaactcagctcttttcacccacactatactgcttctaaattggatcatggaatacgagtgtggagccaaagataaaaatagttacgcaatttcaaataaatccaaagactttccaaaaaaaaaaggcattgatttaaggttttatttacagaaaaacttcaaacaaaacatcaaagcaatgtaaaaaatggaatggaatatgcttctggtgtgcatttcttaccagaactatttcattcaataataaaaaatatggaggctgaggttgattgtcacaaacttgccatgagcatttcttcaataatatatattgaattaaagaggaacgaaggagaagggcaaggatatccaataaatttaaaaaaaaaggaaaagtaaggaatatagaactgtgtctatgaagatacataagaacatcaaagaggaccatgaaaaattcagggaaaagttaagagtctgaagaaccaaaggatattctaactaaattcaagaaagcttttcttgagaacattccaaccacgaaaaagtgaaatatggaacaaatcataaaggcaaaaagggcataagcaaaataattatttttataacctccatagtaccaaccataattctttagtttgctttgacgtcgacccttccgaggcttgatgttatgaatatttatatactgcataatgatagcaaaagacattcataaatggtagtcaatgatgttcagacatttataaatgtagaactggtctccaaaggcaatttggtcatagattacatgctatgtatcccagaaattatccagataaggttgacatattaccagagaggtacagagcatgagttagcactaaaatgatgcagaatggggatacctaagaaaatataggaggatattcaaatagggattgaattccaagatagattaatattttatggacatatagccaatggattacaatgattaaagactgaactaccactgccaggacagattagtgtccacgaaccccatttctaatgagaaacacagatagggaacattttaggaaaaaaaaaagtgactaatgatcttaatcacaatgtttggtacagttgaccccaaaccacaatgattagtcatttaataaaaagctactgataaataatatttctctagttactgatcaataataatggagtgcaaatatgactaaatgccctatacctgccctattgttctcataatctcattaaagaacaaagatataagaatattcatagtgtattcaatgtgtgaaaatggaagcatatatatatatatatatatatatatatatatatatatatatatatacaatctcctagaagcacacacatatggtggcagaaacagtaacctaattgtttactggagaaaaccacatcaagacattattccatgtgaaactgaataactccaaataaagcgaggaaaaatgtagattaggttcaagttgctcaatgaataatcacacttatttctcccaagagcccgataaacattgttagtctacattgcttctcaatctttgaccataaaaaagcacctcaatttagcaaagcacaatggttcccacaaagtacttaaggaaatcagaattgattctacttatattgattttggggaagatatgtgctacaaatgtggaacaaaaattatgatgttcaacagtcctaatgagtgcgtctatttacaagtgcaaaacaaggagatacaatcttgttgaaattttagtatctctgctcaaattagctgggaaaaagaccagtaccaaaggcgaagcaaatgatttttctgcattgtgcttacaaatgatgctcaatgaatggaaggtgaaaaaccagacataaaattcctggaggaaaaatttaggaaggcaaattgatgtgtaatcaatagctccatcaatgtgcaccagcattcttggtaaaagcaaacaaataaaaaacaccaagatcaaagcaaagaatttaagagtagcaggctacaaacagaaggtaacatggaccaggtcagatagttgaaccacagttataatcaggctgattttttttttagtagtgccatcgtcattctattaccagaatagatgattatcaactccagcctaagtttcatttctgaattctgaaacaaggtctcttgcaagggaggcagaagaatctctagatcgaaggatcagccatacctaagtctttctgtcatctcaaaggttaaccttgtgtagtagattaacttattgaccccaattctttcacctatcataaaattgtgtaccaatattattgccttatagtaggtggagtataatttactatatgaagaaatgagattcgcttaaaccaacaggatattaaaagacatgatgcaagctgaagcttgaaatatacatacgtaactaagttttctgttatgatttagtgatcagccatcaaaagaacattccctaggaactgttgtctattcagtctgagcccaaggacaaaaatatatggggctgggtgcagtggctcatgcctgtaatcccagaactttaggaggccaaggtgagaggaacacttgagaccaggagttcgaggccagcctgggcaaaatggcaagacccccatctctattaaaaaacaaacaaagaaacaaacataaaatagacctaaactgaacctctagcctttagccacacctagctaacccgcaatgtgaagaagagctatagcttcagccaatttagatcagacaaaatgagtgtgagaataaatactcattgtagtttggagttggttctcagcattattgtggctatagctgactgatacacatactcctaggtgtcagtaattggtaccttaattatcttctcttctcaatcatgccccagccttctagtctatctccaataaccgggtttatcctctgctatagccaatttccttcctaatctgaatctctttagctggatatttgctaacacttgtcacactttcccgatattctgcctaatgaaacttactatcgacttgcttccatataaataattatcaactgatttataaataatacaagacaaataacaattattaatattatcatttgttaataaagagttacaggtcaggcacatttaaatatgtgttttgtttaactttcacaatactgcaaggctgattttataatcggtattttctgggttcaatttctttattctttactactatttttattccaggctctcagctcagaagtaacctgcccaagatatcccagacagctggaagagatgccaggattcaaacccagatgctgctattcatgctcttctatgtcacattgtttaaacctcagcatgacgttttcaagtagtaaaacagatattcatgttacaattgaataatttttaaggataagatttgtccattacatagatctaaggatactgataaaattccttttctcacctgaaagacagtataaaccatgttatttggcaagtaaggtcagaggcataaagagggttggataagggacaattctcataaaaaatgttatcaattgaatatattctaagaaaaattaatagtaaggttttagaatttgaactttttttctacctgggaaactgcctagaaacattagcatcatgtaacatttgagtgctgggactctgggaccatataggaccctctccccacccaggaccactctgtggcctgttaggaaccgagcagcacagcaggaggtgagtggcaggcaagtgagcattactgcctgagctctgcctcctgtcagctcagcggtggcattagattctcacaggagcatgaaccctgttgtgaactgtgccatgccggggatctatgttgcacgatcctgaggagactctaatgcctgatgcaacagtttcattccaaaacgatccccgcccccctccccacaaccctgtctgtggggggaaaaaaaaaaaaaaaggctttccatgaaaccagtccccggtggcgaaaaggttggggaccaccgatagagaactgagttcaaattctgtgtctaactttttctggctgggtgttctagataagttactgctttcttgacaccttagttttctcatctgtaaaacaggtctaagagaagtaataacttcatagagttgttgagggagttagatgaaaagtgtcttgtaatttagcacagtatccagaacaggtatattgtggtcatctcaaaacatatgcactgaaattctacagcatcattgaaaacaggggtcgctcttttctaaaggagattggccctttcaaagcacagagaaaggcagggactcatgaacaaagatggggagaaggtaaggagaggagcaaaaaacttaaattgttttgatatagtgtgttgaaaaatgtaaaccaagacatgatagagacatgcggacacgtgaatatatgtttgagggggtatagtgggtgaagctttttaaaagatatgactatgggttacatttcacataagcaaccagatgctattctagtcagtgggactaaggaagggctttgtttaaaggtggctagaagcaatttaaaatgcagcaacttccactttgtgctagcaagatcaatccatgttttgagctgctgttttcacctcttcattgtttatcaggtttgagtctaattgggcttgattggaatcatgggaagccactaattaaaatgattaacaatatcaataacagcaaagagaatagaaaagaaagcctcttatttttaatgggcagaacacggattcttggtgtctgaatgaatagaagttaattgaggactgacagtggataacacatttctgaaatgtctattttcatgcttttaataaaggcacattttctagaagaataggagctaaaccaaaattataaatacagacaagatttttttttctcctccactaattgaattaaagccaattcttaaccgcagaatgtttgcaggcaccttgttatcaacgacttctactggataccgtgcttaacactggttatatttcagctttgccactgacctttaaattgctctaatctgcttttatttacaaatgtggtttctgcaaatgagcgttggatagaacagattcgagacacactaacaggacacaatccaggctcaagcagaggaggaaacagcgagctcccagatcgtcttcttactattctgtttgacaatgtcaggatgccttatttccagaacacaagggaagtcatttagacggcacatttctctacttaaagtgttcactctctggctaaaagggggttcatcatgttgttcctgatgtctaatccaagttctgccttgaagtagatgagctcaatgtcaagaaaatcatgtgtttgcatttggatagtcttactgactgctgagactgatatatacctagtcagagcctgggaaacacctgagccttcctttccttcctactaaaatttaacccagaaggactctgaatgaaggcacaggaatgcttgataaagttacttaggttccaggaacttgaggttgccttatactttgcttattacatctttactctttttttggatatttacttcccattgatatctaacttctgaattatttctctcccttggtgtaaggataactaacatttgcacagaacaccattgtttctaaaatgcattccaaaaatcactacacattcccttctcgccacatctccattcaggtaaagcgatggagtgactttgtttaggaaacaggttctggagttctgtgaactgaattcaaagactgtctctgcactttctgtctgtgtaactttgagcaagttatttaaactctctatacctcatgtccattcctgtaaaatagatggacctactgagatcgccctgaagattctaaagagagttcttgtaaaggtgattagaatattgcctggcccagatcaattatccaataaatgtcggctggtttactacttgaattattatcactattctgtgagttctttcaggacatggtagcagaccacacttatctttggatacccctatgcctaacacagtgcctggcagatagcaggtgcttaatgaacaactgtgccatcgttttacaaaccaacaagtccatattctaacaccttcaatccttcagatggagccaggataggaaaacacattttcttattcaagtgcaatgcttttcctgccccagctatatcccatcaaggtgataacttatttattttgcctcatcccctggacatattagaatgctcagcaatggaaatgctccttccatacttgctgaattgaattttctcttttcaatgctgtcttctggtgtggcaaaaaaagcagaaggtaattgactgtttcactatgcctctctcactacattgtttctcaggcaccctatatattttttctttttaaaaaatatgtatccatattcctttagcacagctgttttcaacaacaataacaacaaaaaatttcaaagcaaggcatactttctttaaataaaatcttttccagaagccaatttttataacaaataaaaagcagttcttggatatctctaggaatttcaaaaagcaagactaatggagccttgaactcgccatgcagctgttcttcctccatttcccattccgttctcctaagcccctgaggcagttttgttgaacctttagggtttcagtgaacgctattttaaatccactgtctcaggcccagcaattttggatgctcctaggtgcaacttatatttaccgaacttctttgtgttagtggaactgcttccggttttcagagagagtaaattgaaatatacaaatgcagtattaaggatcttccaaagtggcttaactaaatacgcagtgatagtgttcctaagccagatggtaaagaaaccctaacttttttgtaacaaaataaaagggctgatacatctcttacttttaatcttgttttaattaaagctgcagtggctaaagtgattagccaacatgaagtcaatggaacttaaggttttatgtctttttattttacaagtgtgtgtgtgtgtgtgtgtgtgtgtgtgtgtgtgtgtgtgtgtttggttactgatctgaaggagaatactgatttaactttcatgctcttgttattttagttcatacatgtaaactctgttttccagcaataagttctctgagtcttgttatgatcataaaatattttgcttttgaatcattagatagtgtgccttgccagatattttcaaagcgtgtgttcatttaaaggcaaagtttctgtcttataaatctcgctagctcttcaagacaacctgcttataactatttacatacacctcaaagttcgaatgaggcccaggaaagagacacgagaaggccattttggtggtggggaaggtaatatttctttactagagctaaagatttctaaggattcttaatgcgatttttaagcaatctgctgctgtttaataaatgtatataaagttactgagctatgcaatatgttgtatagagatatgtgatctttttaaaacttaagccaatacagtgaattttgtcattttaataaaagtctagaataagaaatacatattactgtaacagattctttcctgtgggaatatatgattcaaatatgtcttttatttaggaatctttttctattaagagccagctgttatgaatgtgagatggtctatgcacaattatgttaccaatattgtatgctgaaaataatcagaagggaattttcatatgaaatctagatggttatatgaaaaaaggtaataatagactattaacagaataccagatatttaaactaatgtggacttgtaaataaaattaattcaaatttaagttcatttacataatcattttattaattatagataattaacatatgctcatttaaatgttcatttgaggttataacttaggcaacattgctttaaaaaaacaatttcaggagaatttcaggggtacagccaagttatattaacagatactggaaatgattaaaaagtagagaaaggacggggcgtggtggctcacgcctgtaatcccagcactttgggaggccgaggtgggcagatcacgaggtcaggagatcgagaccatcctggctaacatggtgaaaccccttctctactaaaaatacgaaaaattaaccgggcgtggcggcgggcgcctgtagtcccaggtactcgggaggctgaggcaggagaatggcgtgaacctgggaggcggagcttgcagtgagccgacatcgcgccactgcactccagcatgggcgacagagcaataatctgtctcaaaaaaaaaaaaaaaaaaagtagagaaagaagccaacaagagggaggtccttgtctggccatcacctgcacctgcctatgtctctcctatgatgtgggaatgtagatggctttttcaaggctatgtttatgaatatcgccattaaatatttttcctgtatatccgcattagtaaacgccctcccaacttctagtggaatcttaaacagagttaagtctatcacagtaaatgaaactcgaggtatggaaactcttccgtataattcactgatagtttcaaatatgactggctgactaatacaacaaagccccttcccaacctctcttccttgccaatctccactgcagaggctgtgaaatgtacacatcttccaagacttccttgcaagttaggatgatcatgtgatacattcctggccaatgggaggtaaacaggagtctgctaatggctgataaaggcagtgcttcctgatcaatgggactgacatggtcagagctaacacatcccttctcccttcttcttgctttgagtatggatgctatggctggaatcgagacagccattttatgagtgaaagatgctcacaatagatatcaaactggctctaatgtggttgatccgtaaaactgaaacatgtcattagcttccttcaaatttcttgatacatgaggaacttaaggcctgtttaaggcagtgctggtttgcttttctactgcagaggaagcacctatcagtagatctgttgacaagctatctattcatagtccatctactccactttataagcaaatttctgtgaatacttctaactctcacctacctcaccttagagatcacaatccaagctcaggctcctcaaacactctggtttaaaaacccagtgaacttgcttattctctgacccaatgacaaaggaaaatgaaagcattaaattcagaaccctagccaaaacaattagggtgaagaaaatggaaactttcaaattcactagtatccagcttaacattgttgcaatatcattaatagtacaagccatacaaatttatgtataagtaatccatttggactatacatttgaaattgtcaagtgagtatattggtgagtagaacctttacatgtgttcactgtaatgagaataaccttctcttaggtaacctactacacagaagtacagatcaatactcctaatgcagaaaccatttcaggaagtatcaaaagctatcaattgtcatctaattggaagattgtttttctaagtgaacagctataaaattctgactgttcaaatcactgtaatcattttatttgccctattctctagaggaaccttaaacaaaccctgcagtgattgctttgttatttcaaatcagcctagtaattttccagtgtattaaaagacattcagtgttgacactgctaggaaaaaaattgggcgtccgccggatggaactgttcattttcagtcaacataattactctgtattaacacatctgctatttaaacatatcacacttttttgctaataattaacttgatgggatcatacatctctattcgacttgaataaatatcagaatcatttttatattgttaaaatagtgccaagccaaatgaaatgattgggcttgagctatttattgtcagtaacataactcaattgcatgacctcctttaacaaagcaaaacaaatcaaaacaaaccagcctaactcctagatatatagcaatttatgtaatatcaggaaaaagaaaattaataaatataaaatattttttccaagaccttgaaggctgttttatgttatgaaatatgcaatcagtaccaaaggctgtcaaaatcatcttccttgtccacagttctgaccacattcttcctttctcaaacctccagggctgcctgtcatcttctgtatcaaatttaaattattctcactgcttcagggtcttctatctgcccttgtttatgacacctttcttttttttttttttttctttttgagacggagtcttgctctgttgcccaggctggagttcagtggcgtgatctcggctcactgcaagcttcacctcccggcttcatgccattctcctgcctcagcctcccgagtagctgggactacaggtgcccaccaccacgcccggctaattttttttttatttttagtagagacagggtttcaccgtgttagccaggatggtctcgatctcctgacctcgtgatccgcccgtctcggcctcccaaagtgctgggattacaggcatgagccatcgcgcccggccacgacacctttcttaatgtccctttccccattgttcactcacaagagtcctaatttgtaggactttcacactgcaatataattgattagaagaatgaatgatgcatcaaaagtcaaaaagcacagaattaggcaaattatattacccttattgttttttgctcctcccatgggaaaaaatcaagaactactaacagatatttttcctactatgtctttctgtagtaaccactcatcctcctacgattactttcaaatctactgcacattcctcttcatttcaaataatttgtcagatatactaagcaggattttgtcattttaataaaagtctagaataagaaatatacattattgtaacaatttctttcctgtgggaacatatgactcaaatatgccttttatttagggatcttctgtaaattgtaaagtaggtttgaggctttggagaaagatttaatatttgttgaaaatctaatatacttacattacttcattacttcatttaagaaatatccactaaatatcatctatagaaaaagacaagatactcaagactggtcctactttccactgcttaattatttatgctgattttcgttttgtgttgtgttgtattgtttctttgcttttagttttcaaaatgtattctccttttgcattgttgctgagatcaagaaattgtactctgcactactatcttcacctccagaacctgccagtgaaagcttattgagttagagggtaccatagacatcttcctctcccaggcttgcagagattcgccaggaggaaaaaaaaagtgagactcttcataattttttccttcctagcacttgtggttcatcatgttaccaagcatcagtgccaaaagccctgactgatttttatccactggggtaatcaaaatcagttaggattcaagtaaagggcaaagatctttagtctataccctatggctttccatagttatttttgttgtgtccaattcatctcctcatattctaccttgaatttgtctagtcagaaaccactgttagctaggttgataatgattgctgcattgctaaatacaagagataatgttagtccatctgttacttggcacttcaggaacatttgatccagttgaccactctcttctcctacaatttgttgcttctttagcttctagcacacaatttcctaattttctaccattttcactgatggctttccatatccctttgctggttctttgtacttttctccgcctctcaacacttgagtgtctcagggttcagctcatgtaccccattcttcttctatcattacttattatcttgatgaccttatccagtctcatagctttaaatacctttgatatgctagcaactcccaagttcacctctatgttatggacagctaaggttcatattcaactgttcttaaatatctaataggtccctaaaacttaacatgaccacagccaaactcttaaggattcatctgtatcacttccatttgatcttttcaatctcagttaatggcaaattccttctttcagtttgtttccacattgcttaggccacattttcttctttttctctcacaacccatatccaatttgtcacaaaagcatgtgttgtcactacgacaaaacttatcaacattggaacatttctcatcctttccagctctatcttatccaaaccccactctctctaatctgtatcattgaaataatcttccagctgacctgttcccagctcaagcctagtgaagtcagtcatcactattttctgtgcagagcctccactagcttctcatcattctcaaataaaagccaaatatcttgcatggcctgaaagtcctgacactcctatccctccctctgtgtgaatgtacttctcccagataagtgcatggcttgccccttcactccatactgctgtagaatatgttagtataatggttaattctatgtttcaacatatctaggcaatgtcttcacagcctagacattgctgtgaaggtatttttaaaatgtgattaatatttaaataagtagactttgaataaagcagataacatgggtcgactatacccaatcaattgaatgccttaagagcaatgacaaaggttttctgcagaaggaattctcctcaagactacaacctagaaaccttgcctgagtttgcggcctgatgctctaaagaatttggactcaagattgaacattaaccaggctcttgtaaccccaccacactgggagcctgaggtaagagaattgcttgagcccaggagttcgagaccagcctgggcaacatagtgagactccatctccacacatacacacaagattagctgggcatagtcatttgtgcctgaaggtccagccacttgggaggctgaggtgggaggtttgtttaagcctgagaggttgaagctgcagtgagtcattacatcactgcactcgagcctggaatcaaacagacacaataaaaaatgataaaggggatatcaccactgatcccacagaaatacaaactaccatcagagaatactataaacacctctatgcaaataaactagaaaatctagaagaaatggataaattcctcgacacatacaccctcccaagactaaaccaggaagaagttgaatctctgaatagaccaataacaggctctgaaattgaggcaataattaatagcttaccaaccaaaaaaagtccaggaccagatggattcacatccgaattctaccagaggtacaaggagacagtggtaccattccttctgaaactattccaatcaatagaaaaagagagaatcctccctaactcattttatgaggccagcatcatcctgctaccaaagcctggcagagatacaacaaaaaaagagaattttagaccaatatccctgatgaacattgatgcaaaaatcctcaataaaatactggcaaattgaatccagcagcacatcaaaaagcttatccaccatgatcaagtgggcttcatccctgggatgcaaggctggttcaacatacgcaaatcagtaaacataatccagcatataaacagaaccaatgacaaaaaccacatgattatctcaatagatgcagaaaaggcttttgacaaaattcaacagcacttcatgctaaaaactctcaataaattaggtattgatgggacgtatctcaaaataataagagctatttatgataaccccatagccaatatcatactgaatgggcaaaaactggaagcattccctttgaaaactggcacaagacagggatgccctctctcaccactcctattcaacacagtgttggaagttctggccagggcaatcaggtaggagaaggaaataaaggacattcaattaggaaaagaggaagtcaacttgtccctgtttgcagatgacatgattgtatacctagaaaaccccatcatctcagccccaaatctccttaagctgataagcaacttcagcagtctcaggatacaaaatcaatgtgcaaaaatcacaagcattcttatacaccaataacagacaaacagagagccaaatcatgagtgagctcccattcacaattgcttcaaagagaataaaatacctaggaatccaacttacaagggatgtgaaggacctcttcaaggagaactacaaaccactgctcagtgaaataaaagaggatacaaacaaatggaagaacattccatgctcatgggcaggaagaatcaatatcttgaaaatggccatactgcccaaggtaatttatagattcaatgccatccccatcaagctaccaatgactttctcacagaattggaaaaaactactttaaagttcatatggaaccaaaaaagagcctgcattgccaagttaatcgtaagccaaaacaacaaagctggaggcatcacgctacctgacttcaaactataatacaaggctacagtaaccaaaacagcatggtactggtaccaaaacagagatatagaccaacggaacagaacagagccctcagaaataatgccacttatctacaactatctgatctttgacaaacctgacaaaaacaagcaatggggaaaggattccctatttaacaaatggtgctgggaaaactggctagccatatggagaaagctgaaactggatcccttccttacaccttatacaaaaattaattcaagatggattaaagacttaaatgttagacctaaaaccataaaaaccctagaagaaaacctaggcaataccattcaggacataggcgtgggcaaagacttcatgtctaaaacaccaaagcaatggcaacaaaagccaaaattgacaaatgggatctaattaaactaaagagcttctgcacagcaaaagaaactaccatcagagtgaacaggcaacacacagaatgggagaaaatttttgcaatctactcatctgacaaagggctaatactcagaatctacaaagaactccaacaaatttacaagaaaaaaacaaacaaccccatcaaaaactgggcgaagaatatgaacagacacttctcaaaagaagacatttatgcagccaacagacacaggaaaaaatgctcatcatcactggtcatcagagaaatgcaaatcaaaaccacaatgagataccatctcacaccggttagaatggcgatcattaaaacgtcaggaaacaacaggtgctggagaggatgtggagaaacaggaacacttttatgctgttggtgggactgtaaactagttcaacaattgtggaagtcagtgtggcgattcctcagggatctagaactagaaataccatttgacccagccatcccattactgggtatatacccaaaggattataaatcatgctgctataaagactcttgcacacatatgtttattgcagcactattcacaatagcaaagacttggaaccaacccaaatgtccaaaaatgatagactggattaagaaaatgtggcacatatacaccatggaatactatgcagccataaaaaaggaatgagttcatgtcctttgtagggacatggatgaagctggaaaccatcattctcagcaaactatcgcaagcacaaaaaaccaaacaccgcatgttctcacttataggtgggaattgaacaatgagaacacttggacacaggaaggggaacatcacacactggggcctgttgtggggtggggggaggggggagggatagcattaggagatgtacctaatgttaatgggtgcagcacaccaacatggcacatgtatacatatgtaacaaacctgcacattgtgcacatgtaccttaaaacttaaagtataataaaaaaaaattattcccaaacataaaaaaaaacttatttctttcacttagcatattgcatttgaaagttatatatgttattgggtatattaatagttcattgctttttattgtcaagtaatacattctattgtatggctatatcagaatttctgcaatcactttagttgaaggacatctcgattattccagtttcaggtgattataaataaagctactataaacaggtgcatacagaaaaaaaaaaagaaaaagagactgaacatcaactgttatctgaatttctagcctgtcggcctgccctacaagttttatacttgccatagacatattagccaattctttaaaataaatctgtctctgactctctgtcatatatgcatctacatccatacttttatctttatctttaacagaaaggtagaaggagatttgataattgaaaaagtaggccatgtgaaggtggagcagaaagagacttgaagatgctggccatgaagatcggagtgatgaggccacaagaaatgccagcagccacccagaaactagaaaaggcatgaaaaaattctctcccaggcctccagaggaagtgcaacctgctgacaacttgatcttggcctagcagtgttgatttcaggcatctggactccagaattgtgagagaataaatttctgttgttttaagtcaccaagtatatgctaatttatcatagcagccacaggaaactaatacagtagtgacttgctcatctgcaggggatacattccaagccccctagtggatgcctgaaccacagatagtagcaaatcctatatatacaatgttttattcctatacatacacacctatgataaagtttaatttataatttaggtacagtaagatattaacaccaataattgataaagtagaacaatcataatacactgtaatcaaatttacatgaatatgatctcactctctgtctttctcaaaatatcttattatgttgtactcaccctttttttcttgtgatctgctgacctgcttgaactgagagctactaagtgattaacaggcaggtagctatacagcatggatacctttaacaaaggaatgactcacatcccaggcaggatggagtgggattgcacaagatttcattatgctactcagaatggcaagcaactttatacttacaaattggttatttttggaattttccatttaatattttggaccaggttgaccatgggtcactggaactgagaaaaatgaataaggggaactactgtaggtattttgatactgctttgggaagcaagatgaggctataacaaatgcctaaaaatgaggaagtagctttggaattgagaaactgttggaggctggaagcattttgagaagcatgaaagaaaaagtctagattacttataatagatttttggtagaaatataagtgctaaggattctgccagtaagggatgagaggaagtgaggagtacaatagagaaaggttctagcatcttagagaatatctgtatatcatcataaactgattgttggtagaaatatgaaagttaaaggcttttttaagggctcaaaagaaaatgagaaacatgttactggaaactggaggaaaggcaatccacgttttacagtgtcagataactgagcttaattgtgcccttcataattggaaagcggaacttataaactataaacttagatatttagctgagaatatttctaagcaaattgttgaatatatggcctgatttcttctcatggcttatagtaaaacgagagaagaaagaaataagttgaggaagaaactgttaagcaaaaagaaaccaatagcagatgattcaggaaattctcagcctacccaatatacaaaaaatgctaaaattatgagattcagtatcagaaaactgtgctctggacagaaggccaagggtatggagggacatcctttttacttctgctcaagagattagacatatagctgagggatccactcaactgtctcagcataagtcagacatagagaggcagttatccaggaaagatctggggagaacttcttgtttgatgatgtaaatcctcctgacatatataggaggtccatcaagtttttgagaatattataccatcagaaacattgccagcctggactgaaacggagagagacaaggcaaaaataaagaaggttattggacttccaaattctacaggcaggaaacaggctgaaatgactactcagctgcaaacattttctattcttcaagaaagaagaaaaatggcagtgggctttgtggtgtggcaggcctagcagtcaggggcccaggcccagaaggtgctggtgtcagcccaaagagcagaggtatgggctgaaaggacataaccttgagccacagagagttattcccagcccttacacactaatggagcttacttggttgaattttaaaattgcctgtgactcttctttaactcctattttttctcttttaaaataggaatgcctataaccattatcttatgcctataaccatgatcctatgctggtcccaccatttgtatgttggtaacatgttttctagtttcacagttccagagatagaaaagaattttgcctcaagatggatcatatttagagtctcacccatacctaatttcgatcattagataataagatttaggactttggagctgatgatattgtagtaatttgttatagcagccacagaaaactaatgcagtgagaagcacttttttaaaaattgcaacactcagtcatgctttctatatcctcccctcctttattttttccacatctccatatcacatatatttaaattactttaagaataagaaaacttatatatatgtatatatatatatatactactttttactctttttaaagttatttgtctccctcaccattgcaatataaactccataagtgcagcaatttttttatctttttgttttttcactgctgtatccctggtgctgtgaatagtggtactggtacataagaggtgctcacaaatgtttttcagtgattaaataaaaattttccttacgtatatcctcatagaatttgtccatccctccatctacattccatccatccatccacccaaccactttccatctctgtataaatccatctaccctcttacatgtctatttaatagcaaacattcttttactcattagccccaggatctgtgcaagaaattcaatggtaagtaagacttagaacaagcctacagagttatttcctcttcattgggaaaacagtagttgaacttgaactattaaaacaaaatgccataattatcactagcggggaaacaaaggatgccagggaagcaaattagaataatacctaatctagatgagaaagtcttcagaaaatactctctcattatacaaacctggagtatcatctttcttacaaccaacagataatgtaaatctatagagttctcaaacttacttctgactatactatagtaaaaaaataagtatttgtgaagaaatgagcatttgctttaaaattcatttcagcttaaataatattcatatttatgtaaagagagatgggtgaatctaactgtccacttaaatcttccttttaattcccaagaataaatgaactgtccaaagcacaatcaatattaaagacaatccagaatactttagactttccgtaggtaaatatcttgagataagaaggaaagtgtttgtctttcctggtgttcagcatttttgctgaccatgaaaaaagatgacgaagtaaagggtgggggcaagagaagggagaggaggaggaagaggaagaaagcaacagcagcattttaaaggcagacagcttgtagtatatttgaatttagacaatctcggttagcacgctaaattggaaacctgatagttcaatggatttagataagccacttcacacatcagtgcttcagtttatcagttacaaaatgagtttgacatttcccttgcctatctatggaagtattataagaaccaaatataagcacgtgcagatactttgaaaagtttaatttccttacaaatgtaagttatttttcacaaagacattttattgagattctatgatgtgctgatcaccatgtatagttatttgaaaatcacaaataatttgggatttgcaattatgagaattgagggcattaaactttagatattctgcttacagatataaggacaaatgtgtggttttaaacacagagcaaaaacgacataatagtgaatgtgcaataggataacaggtgtttcatacattgagaacaacaaaaaaattggggtaatggaaattcaatgtcctagtcacaggcagtgggggaattttcttagatctgtgataacagcaagtggttttgttaatgtgaagctagtttttgttctgtggttattgccattcctgagtaatgagcaacgagatctctttcccatctggcattttgtggctgagaatagcagcagcataaggtgaaatgtcagtggtaagacacagtggtttatgtcatttgtaaaatatgatcacagactcaaacatccatggtgatgtgatatcccagaaaatatcccaatgcaagtgaatccaactccatgggggcagtgaaaagagattaaagtcaaaaaatagttttgaattttggttccactaacttaattgcctgttttgctcttggcccttgatttttctcatttgtaaaatagaaatgaaaaaatccctatttttcaaagtcatttgaagaattaaaaatgtgaatgtcctttaagttgtaacatgctgtatagaagttagtggtaactgctgtttttgtagataaccaaaaaattgattttgtccataataacagatgaaagcttccttaatgaagttgcattacacagtcccaagctttaccaaacacgtcagtggtgttggtaacagttatcaaaactaccttaaggtggtgtctgtaattttcgctaaaggacatgtgagaaaatattttgaaaacgtctttactgctaacaacataccaaataggcttcaagtccattttcaagcccaaagtcaagttaggatttaaggaaaaggaaactagaagagaataattcttaggacatctgaacattcaagatgattggagattctcattcatttaaaagaaaagaatgttattccttacaaaaccttatttactgaaataagaatttcatactttgatagctaaatcaaataagggttctgtttcttcccccccaactccgccttccagaagctgggaaggataatttacctccctaactgcttgacttaacccacagggacgtaggcactgaggggatctgtgattatctacacaagatgataataagccagataatttcagaatttagaattttaaaagaaaataaaaaattctccctaatgataccactgcattgtaaattctacacatcactttccgtagacatcttctagcatacagctaagtgtcttatatcaaagaccctgccttcatggaggtgggagaaggaagttagaagctgccaagagaaaagaatcttggagagtaaagggtagaaatttctggaaaggtttgagtctttcctactgccattggcactgctcagtgggttgggggcttgggctctgtcatcacactgctttggttcctgtcctggctatgtttaccaactacatggcttcagatgacttaacctgaatggagataataacacctccctcatagggcagttttgacaaataactgaagaagtaaagcacttaaaacagcccttagcacaaaataagcacatggtaaatatcagttaccactattgtaactactaccatgacacccatggctaaaattatcatcaccattattagtagtactattatactattatttgtcctgcatgttaaagtgtttcttcaaagaagtcagagcatgggaagaaagccacattgtctgctatctctgaaaaaaaaaaaagagaaggaaaaaaaacagaaaaaaagaagtcctttttgaaaaagtccttcataatacttaataccatgcaagttttcagggtaaaggctgtatgccttaataaagggaatgcattcttttgttcttattttaattaatagtaataaacctgtttcattctgcatatatacttattcaagaagaggaatgtttttagtagatgagagtcttgtggcaacccatagtttaggcaccttttagccattattacattattttctaattccttatggccagtcattttagaactacaggctcaaagaaaaggtccccttgttttgcaagtgaagatttgtttcacaggaatgtgtgagtcagctgtctgatagagtgtgcaggtttgagggggaggtatgtgggggtgagatttaaagcatctaagatccctcccaatgttgacacttaattatctggaagaggataatgacttaaaattccagaaaagaatgattatgacaggaaaacataagtagtaacaatatattgaaccctttatatgaaagaggtagaaggtcttgtacctagtgaacataatctcattgaattcctccagcaatcttaaaatatgggttttatttacctcatattacaggtgaggaaactgaggcacaatttggcgatgtctctgcagagaactaaatgatcagcagaactgaaagccccatctaggcttattaaaatccaacaccctcactctttccaggatgtgaaacttcctggagcccttcttcatgccagtctcacccttggccctttgcctcagggagctcactcaagcctcatcacagagctagaagtgagctatgattatccacatgacacatgtgagggcactgagaccccaaagaatccccagaaagcagatctggcattcatgatcagcaacacaataaatgctgccttatagtgtttgattttctggtggcaagttatgtcttcttaaattgccagatgaacgcaatgcccatctcctttcagctagcacattttctctttgccagggaagcagtgctgcgtgatggctgagcacctaagctctaaagtcagactgcctgcctttaaagcactgtcctgtcactcaccagctggtgaacgtgtgaagtttcatccatttcttcatcttgaaacaatgacctctgaggcttgttgggagcatcaactgagtcaagtcatgtgaaagcattgggataatgcatggagcctaatgaacactcaaaaacattaactactgttgttgttacagttggcccagctagaatacactttgtcaatatggtcctcagaccattgcctcagaatctcacagggtaaggcacctctatcattaagctaaaaatcccattttaattcaacaattgaagacgtgtcccgagattttacttttctcacaatctcccaacagtgccaacgctgctgaacgaggtgctttaaatagcaaggaaccagggaactttattgactacagatttagtggaccctattccagacctagtaaatcagaaactctggggaggaaacccaggggaataaatgtttaactcactctctaagagattctaaggcatgtaaaagcttgagaaggccgtgagagaggcttcagttggttctaacattatttgacagtgcaattcactggagacacagtctgatcgaattcctgattcatcatcttgactccagggtaaaatgcttctgatatgctaagaaaccctcatccttttctgtaacaaaggtaatgagttaattttccaaatagggtaagtagataatccttctcaatttaccaacataactcacccaatattaagaagcattagaaaaggcatccattttgccagtgcaactaagcagtagttttctagcacaaatattagaggcaataaagaattttattcaaggttgacagctttagcaaacagtttctgttttatattgatgctctcttattttccatgttttctcagcattctggatatagcaccactaaaaaaattcttttggttaaattctgaatagtttaagctttaaaatgcaacttattggaaagatacaggggtaggaatccaagaaatatttggacaatcctcgagtagggcagtgaccaggttagctcatagggtgaccaactgctttagtttactcaggaccatcctagtatcagcactgagagtaccaagttctggagaatccctcagtcccaggcaaacaaggccagctggtcccactagtgccaacctggcagtaggctttctatggatctcttaatatgagtcagattacattgctcttattctgtccttttccaaattccagattcctgacaaagagaattttgctggattagcttgggtcagatatctacacctggcccaatcagaagtaggcaaataacaaattgtgctgtcctcccttttcctcaagctgtccagggcccaacactgtgaaatagggaccaattcgtagagaagacaggatccaggcaaggaccctaaagggcatctattacagtctttcagaaagtgtctccaattactttataaactcacctttcctttgctttgctttcctgaatgcacccagggatctatgagctactaaaatcaaccatgcttcactaggtcacagcagagggcttggttgtgatagaaaacaactaaaacgtgactgacattcattgagcacttgatttatacaacagatatatagatgacagatagataaatagatagatatgtagttttatcagataaatccagtgatgtaggttctattgcactcattttacagataaagaaactgaaggtttttttttttttcagttatgaaggctaggaattgaaccaagattttctagccctcaaccaagtttctatctacaacacccttttttttctttttcctctctccctccctttctttctcatcctctctgttcctctccctatatatgtatagtcatattaatgtgatagtcttacagatattcatatatatatatatatatatatatatatatatatatatatatatatatggacttagatacaattgtgtatgcttaacagttaggattttccgtattaggctcagagagaattggctaagttgaacatttagtaagtggaaatctttgacactgcagattaaactcaaatattttaattctatatctagtcctccttccatcgtatttctccatcaaactttttaatgcctcattatctgttgcttaatacgaagagaagaaaacccaccccatttttatatctgcaataatggctgaagaatttcttctatgtcttctctgggcaaagcatttgctgagcacttgatatggtattaccttcaaagaaactctgccagttacagggacattaagtaatttccccaaatccatacagcaaaaataagggcagagcaagccatctgccctgaaattccttgccctttccagttcaccaaattgcatctttgaagtcggatcaagatttgcgtacatatcctaccagtctaagcacgtttgaatgatggcacattgtctcactatattgaggcaactcttccttgcttggctgttactcataattaggaatacagttacatctttcactttggtccaatttttatcatatcaatgtactacccacctatatattttcttaatttatatttctttaaatcaacttattttttatgtctggccctagtaattatatccataaagtccaagacgtagtgaacttatttcataatttataagatgaattacaataaatatgtaaacattttaaaatgcatgtcttaaggaaatgtttgaatcaacatctaagaaaaattggtttgcccagtaagtcgcgtatttgtggggtcagctagcctgatccagcctttacagctccatgtagatttgctcttcttgactattgctgggtggtccccactgttctcacatagccaaataagttattccattacaaaattataactaattttttacagaatgaattatagattagggtgctctgcatgaatttgcagattcccaaagatctcaagatgtgtcaagaactccaagggatctttcacttcgtatttcaccgccgggtcaccctgggctccaggctatcttgagctgttttcacatcttctctgatggaacattttaaatgaggcaaattctgaatctgaaaatctttggtggcctttgcacatatcctcttcagttgtggaaaaaaaacatatccattgtatctgacttttcctttttcactctccttccattttactgtctgcttcattgaggaaatctttcatttagtggagtctagatttcttcctttgctaccatcttcatttcccaccaaataaatcaggtctcagcttatgatcatttgtcatctgctgcttcttctccgggaccgcccctaacagcctagcagagctctgggctgtattccatgatctcttttaattccttgttggcggcttgctggccctttctctttaccttcctgccaggtttaatgccttttagcgtgccagctctgtttttcacaatttttccaaaatgaggtggaaaatcaaatctctagctcctaattctcagtgggcaatattttcagagaatccttcaacatcattcactctctcaattcctcatcttctgagcttctccatccataaaacaatcagaaatgtcttcctcttaataacatagctcttctggtattggggagtggtgggactagaaaagagtagaggtgtaagcaatgcaatatgagttcattcatgcaaataaaaatcacactccctggacagaatccctctttcccgcagatctatctcttctagagagtatggacagatggaagaagtgagggtatgcagagctggcgtatggcagtcccagaacagggtcactatcaaaaagcaaatgccaaccatgtgatatataggactgctgggaatgtagtccatcattgctctatggtaaaaaagaataccttctctaacatgacattctctgaaccacatatagacatacacacatacaaaaataatctctaatcatgaccatcagtttttgcctgactgtctcagcatcctgttagctacgttcctgccctccatcttattccctgtgaatccatcttttatactgatgacatggtaacacttttttttttatactttaagttttagggtacacgtgctcattgcgcaggttagttacatatgtatacatgtgccatgctggtgcgctgcacccactaactcgtcatctagcattaggtatatctcccaatgctatccctcccccctccccccaccctaccacagtccccagagtgtgatattccccttcctgtgtccatgtgatctcattgttcaattcccacctatgagtgagaatatgcggtgtttggttgtttgttcttgcgatagtttactgagaatgatgatttccaatttcatccatgtccctacaaaggacaggaactcatcatattttatggctgcatagtattccatggtgtatatgtgccacattttcttaatccagtctatcattgttggacatttgggttggttccaagtctttgctattgtgaataatgctgcaataaacatacgtgtgcatgtgtcttttatgatgtaaactgaaccatgtcaatgtcccaccgaatagctcccacctatgactgaaatcagtgagcacttcacaaagagttttggatggttggcaagaggtatagtaggaaaagtagtagtgtgcttaaatcacacagccatgatgacaggtctcacattaacttcctgatcgctaacctaaaaaagccctcaatgctgcctggctatctgactactttactttagacttttcattcccctattctcacagccaactgattcttgttgtttctcacctccaatttcttacacctgtcccatcctcattctcagcttaaaacttgctgtgaaaatagaagcaatcagaagagaacttcctctagcttctaccactagagattttcatgtacctgtatctaaactcatacacccctcttgtttctcttaatatggactaactgaacccttttctgggaaagacccattcttcacctgtgcacaagactacatcccctttcacctgctctaagctccagctctcctcttatttcccctacgttatcactgtttttaatcaatatataaaaacagcattatcttttaaccatcatcatcattatcatcatcaaaacctcacttttctcattttccctccagctactgtttcaaacttctcaaaagagtttctatggccactctcttcaattcctttactccaaattacttttgaacatgattcaatctggctttcacctttgtactcataaaaatggctctctttaaagtcatcaacaacttctcagtccagatcttacctaaccagtggcagcatttgataaggttgaaggatccctcctggaaacacgttctgaatttggtttccatgacattaaactgtattagttttcctatttcttcccttgtttttcttcctgtctcccttgctcttcctcctcaaccctataagctcttaatgaagcagtaccccagggactacatttagactttccagtttgtctgcactcacactctcactggttttacccagtctcatggctttatgattaacactgacagctcccaaaagtatagctcctcttaggacctctctcctgccctccagactcatacatccaattgcctgcttggcaactctgttgggtatctcaaacttgtcaggttcaaaacagagctcccgatatttcttactcccaaatatgctccttctttactctccccccatttcaggacaggtgaagtcttataattagtgaggtcaaaaatgttagtatcatgattgtcttttcttttctcatgcttcacatctgatctatgagccagttctgtcaggactaccttagtagttttcagcatattcagaatccaaccactttcaccatcaccattgcctctgtgctgctctgagccttgttcatctcaagcttaaattattgcaatatctttccaggtggtctccctggaaagtcacaaccttgtaatctcctctctacacaagggccacagtgatcctgtgcaaacgcaaattggatgatatcactcctctggtccaatcttctcatgtctttcagtctcagagtaaaagccacgatcttgcaaaaacctacaaggccttgcaaaatctgccccccgccccccatctcttgtgttttattttctttcctattgctctttcctccattcattctgttccagctctttgcacagttccaagcatcctgcggccttggggcattcacaaaattgcttgctctatcttatcattcccccaatcccttacccatcccatatattcatggtttttctctcacctttaaattttacccaaatgtcatcttctcagtgcaattttatttaattgcagctctccctgttggaccccttcttgctccacatttgcttgtctccattgcacttaccactgcctacttgactcttgtcttagctcagattgccataccgaaataccatagactgcatggcttaaacaacaggaatttatttctcatagttctggatgttgggaagatcatgatatggactgattcagttcacccttatgggctctattcctgacttacagtcagccttctttttgctacgttctaacatggcagagagagagaatgctctggcctctcttcctcttcttataaagatgttaatcccattatgggagtcccaacttcatgacctcatttaattacctaattaccatccaaagtccccacctccaagtaccattccattgcaaattagggcatttttactgcaaaatttctcagtaactttagagaatgtcatgtatgcatctcctgggggaggtctgggcagataaaattcccaatgtttcacacatacatttgaccactgggttgtcagggaatcttttgggatgtatcctttagacccctgctagtcatgatgtggtttgtggaccagtgcaggttcacaaattatttattgattgtctgcaataagagaaatacagaaacggagagtcaatatttagaaaacgctataacaaattgacaatgctgccaagaatagtcatatggtttggctctgtgtctgcacccaaatctcacctcaaattgtaattctgacatgtcaaatgaggggcctgctgggaggtgaatgaatcatggaggtggtctctaatggtttagcaccattgccctagtgctgtgtcctgagttctcatgagatctggctgtttaaaagtgttcagcattccctgtgtctcgctctctctccactgctccaccatgggaagatgtgccttgcttctccttcaccttctgccatgattgtaagtttcctgaggcctccccagccatgcaaactgtgagtcaattaaacccattttcttcttaaattacccagtctcgggtagttctttaaagcagtgcgaaaatggactaatacaaatatgaacagtagcttgtgaagtttttttttttcacacttcatttttctagtaattcatctttattgtgttttacaaaagtatcagttcatggcagatttaaagtaataagaagaaaaatctttcacttactgcagataatttgggaagcacctcctccaggcagattttaggaaatattggttaaattccaaaggtagaaaaaaatctcttgtaagtccagtctctagactttttcctaacattcccagctgcaccttgtatgccaactgagtcaacttgctcctctaagccctacgtgtgtccgggctgttcatctgcttgccatgtctttcctgcctcacatgcctgatgcacattttatccttcagaatttggttaagaggttaatggtgctagaaagagtccccagattcctctccataaacttgatgacctcactttacctccacgactttctggtaatcttatcctcaaatcagtgctccactgttgtttttgtttagattttatttttaattgacacaaaataattgttcatatttataaagtacaatgtttcaatatatgtatataatgcatgatgatcaaattagagtaattagaatatctatcacctcaatcacttatcatttctttgtggtaagaccattcaaaatcctttattctagctgttttgaaataaacaatacattcttattaactataatcaccctactgtgcaatagaacaccagatcttattccttctaagtaaccgtaactttctccccatgaaccattttctacccattccccttcccccatgtatttgtgtgttttcaccctgctgataaagatatacccaagactgggaaatttacaaaagaaaaaggtttaattggacttacagttcctcattgctggggaagcctcacaatcactgcggaaggcaagggggagcaagtcacgtcttacgtggatggcggcaggcaaagagcttctgcaggaaaactccctcttataataaccatcagatctcatgagacttactcactatcaccagagaagaatgggaaagacctgcccccatgattcaattacctcccacctggtccctcccacaacacacgggaattcaagataagattttggtgggtacacagccaaaccatatcatcaactactcttcccagcccatggtagccactattcaattctctacatcagtgagatcaacgactttagattctgcatatgagtgagattatgcagtatttgtctttctgtgttaggtttatttcagttaacataatgtcttccaggttcatttatattgtcacaaatgatataggattttattctttatggctaaatagtattccattgtgtgtgtgtgtgtgtgtgtgtgtgtgtgtgtgtgtgtgtatgtgtgtctatgtgtgtttgtataccatatatatgccacattttatttattcatttatttattcattttatttatccatttatttattcattttatttatccataaatgttaatgaacatttaggttgattccataacttgactattgtgaatagtgttgcaacaaacatgagagtgagacatctccttgacatactgatttcatttcctttggatatatatccagcagtgggattgctggatcataaggtagtcccagttttaattttttgagaaatctccatattgtttttcataatggctaaactaatttacattctcaccaacagtatttaagggtacccttttctccacatccttcccaacacttgttatcttttgtatttttgatagaagtcattctaactggagtaaggtaatacctcattgtgttttgatttgcatttccatgatgattagtgatgttaaatatttttttcatatacctctttgtcatttgaatgtctttttttgagaaatgtctagtcaggtctttcgcctatttttaaaccagattatttgtgtttttgtgattgagttgtttgagttctcttttctctccaacttcatacctcatccctgggcaaccattaatctagtttctgtctctatagatttctgtattctggacattcatataaatggaatcataaaagatgtggtcttttgtgtttggtttctttcacttagtataatatttttcaaggttcaacaatgttgtagcatgtattcgtactttattcctttttattgccagtgtttgctagtattttattgagaaattttgtgtctacatttataagagatactgctctctagttttcttttcttgtgctgtttttacctggttttggcataaggataatgctagctcctagaatgggtttggaaatattcctttgtcttctcttttttgaaagagtttgtaaagaattattactaattcttctttaaatgtttaatcgaattcaccagcaaagccatctggaattgggctttaagttgtgggaaatgttttcgtttgaaattaaatcattttacttgtaataagtttattcagattttctatttcactttgaatcaatggtggttgtttctggttgtctttctagaaatttgtcatgtcatctaagctacctaatttgttggcacacaaatgttcacagcattcctatatgatccttttttatttctgtaaggttggtagtgatgtctccactcccatttttgattttatcaacttataccttctttcctttcttcttcagtctagctaaaattttgtcaattttaatttttttcttaaagaaccaattagaattgattgattttttgtttttctatttcctattttatttatttctgttctaatatttactattttcttccttctgattgttttgcatttagtttgctcttctttttatagttttttaagttgtcaggttagattattgacttgagatgttattatatagacatttgtagttataaatttctctgtaagtactgtgtaagctacattctataatttttcgtatgttttatcttcattttcatttctctcatagcattttctaatctttctggcatttttcagaccattgattactcaagagtgtgttgcttaatttccacataattgtgaatttctaaatttccttctgttactgatttctcatttcattccactgtggttggagaccatactttgtataattttttaaaaatttattcagacttgttttatgccctagcatataatctatcctggggaatgttccatatgtacttgaaaagagtatatattctgctgtttttttctatcacgcctagttggtgtctatcacatctatttggtgtatactgttgttcaaagaaatagaggacttgagcaacgctatacaccagatagacctgacagacatttacacaatgttccataccaaagcagcagaaatacttgactagttgttcagaatttatttttaattttaataaatatatttcaatgcatccatctcacttactcatttctcataaaagtaatatgagtaacacccctctacgaccatggaaaaagtggctatttttgattcctctgattcaatagatcactgtagaacatgaagtcaccaaatattcttgtgtaagagctctctgaaaattaatcttgacaggattgttgggggattactggcacaggtgtagactgccaggctgtctctcctgctttgcacatagccttttttgagtataaatagaagaagaacattactgctttctgctatttcaggaaagaacacacccatttatttagtcattcataagcactgagttgaatgcctactgtaagacaagccctaagagtacttatagtaaacatacacttgattctactatgacataaaatccagaatctgatggccaatcctactgacagcagctaagagtaagaacttgacatgctcagcaggtacataagatatactttccagatcaatgctggattatgaatgctttctgtccacaggattctctacatgctcctttccttacctccatcaatttctgatgtgggcaagaaggattgttgtacccaataactgagtctacaaactcaactctcttcattatgtctagggcaatgcccagtgtcctaagaccaccagttgcaacctcctacaataaccccattacattggctaattttgttgatatatctgaatacatacatatctgactataaaacatgactctgaaacttactagatattggacattgacttgttcgcctaacttctccaagctttctcagtcttttaatttggagaccaggcatgaaaaatatttatttcacagaattgtagtgagggttaaatatttaagataaggtacctgacacatagtgggcactctccaagagtggtagcttaaaacatgcaaataacaattcttggctccttattctgtgctctggacttacatgtgagttctcagctaggagttaaggctcattctgaaactaagctagtgacctggtccttcatgtgctccagcacctgcaaacaacgtgtatactcttccctggagcaagaacaccaaagaagtgaggtggagtgcttccttcttttagtcctctagttgtcagctggaatactgactgctatgaatgaactgaccacctggtactatgcttctggtggtcattatcatccagcccttacaacacacaagttcactatgctctacccactacccctagagatcaggatcattgtcctcaggcctgtcctgcctagttcttttgcttcctccttttcccatttgttcagggtattaaaatcccaaaaccctgcaagactctgcccagtcaaattatgaacactaaacaccgaactccaaagtctaacccacaatgtttatagtatgctgtggatacatctgacttatattaagacacttcagggaacttatgtgactcaacactcaatgctgaccaagatggccccctaatctaggccagatggcaaactgatcattaacttcattctgatggacttgttttccccaaaatgagctgttataattaatcctctgttatctggcattttatcaacaaatatcattcattaactaacattttccctgccagttcaactacaattaattatcacaatgataagctgtggcactaagggattctgaaatcatctcaggattcagagagtgacagaaagagaataagagagagaatgagagacagcaagagagagaggtcaaatcatgctcagtagaattttaatattaagggtataaagcattgcttctgcagtgtcctggaaaccccatcccatttatacaaatgccccagataacgtctcctaatggggctgtcatgtaatatatagaaaatcaacatactttagagttggctgaatttcttcagcaagcatggcctcatccccaccctacaatcgcagtaccccatccctggcataggtcaagtccatagaggtgaagcaaatctatctaatcctggcagagacaatatatcactcagtatcattgtatttaccatcctacactttaaaagaaaacaaactccttaccctgatcctacagcttttcagaatgattaaaaatcttttctgaaatatgtcatggccagaatctcaatgaaaaaaatgtgacaaaccaaaaccaaaccaaaccaaaccaaaacaaacacacacacacacacacacacacacacacacacacacacacacaaaacagaacataataaaacaaactggatacaacaacttttcttctgggttttggaattaatttttacttcttaaggattgttaacttcagcaatgggatgagtgccccatttggtacatggtaggcattgaaggcattttggtttgtttgtataacaagagttaataaaaaaatgtaggtttcctgcagccaacttccaaaaatatataataaatatttgaatgatacgtgtttccaagttggaagcggtctgtttttctggatttgagtctgttgtaggagctacacgcagcctgcctcattgctcacaacactacaccacaactgtgtggttgacgctggaactgtggcaatggagccacttgagggctacggggttaggcagagtaaatgaaccggcctcaaaaccaaggccgtctccctctgcaaaaagataaaaggaaggaagcaacaaaaggtggatatcttcataaaaacattctcagatagagcatctcatgtaattcacagcagacacgccaagacatgataagattcttgttattgggattttaatgatcccagagtcctgctgcgtcagtgtcctgtcatatcagctctgtggcttttggaaaaaaagagcatggtgttttctgaaagtcggaaggccattgtgactcatttctgagactctctcccacttaggtatatcaaataggtatgctgctttgatcaggttaaatttttaaagcccaagggcactgaggatgtggccatgttaataatgcagagccgcaaaaactttaggaaatatcctgttatcccatcagtgtgggcagcaagccttgggtagcaccagcaaaccctgagagatcctgccagatggaaagctggcactgatgggaacaaattctgccccagaggatcttctttgagagtaacccttagggcaaatggatcactctgcaaaaagcttactggagaaatataggggtaggtaatcacatgtttgatttcttgcaatccaggttccaagctcaagaaaacctattcccagatataaagtcaaaaagagagaataaagccaaaaactaggatgaaggagaatgatcacatagttactaaaagaattaaaatgtacaaggaaagacaataaacatcagaaaggaagaagaagagaataaatgtgtgaaaaagacctgagatcaggcccttgattagcagggagaaaagaatctgaacaaggcaagtaagggaacccctactgcaaggtactgcctcggtaccggagcacagcaggcaagaaagactgctcgcaatctccaaagaaaacatttcagaacaagagaaaatgaggtaagttgtgctttcatcgcttgcattacgcggcggacccaagttcgcttgaatggtaaacgagcgatgatttgtaataaacggtttaggctgtggggttggctcttcagtcctaacacagtcccactctctggggacgagtcatactagtggccacatgccttataggatttggtgtcacccagagaaagagaaaaaaatctaagacaagcatctctcattgtcactattaataggaacttagagactgatttttggatcacttgctcttaaactgtattcagatgttgtgaaactggctggctgacaaatctaatcaaattaactccaccttaaagcaaaaccctgtttcgcttttttgctagcgcacttttttaattattcaagcaaaacagctttcttattcaatttgaaatctgtatttgtgcacaagtttgtctcacattgctcaacatcatctattaactgtttacacacagcagtgattctccaaaactatttttgatcttctaaacacatatttaaaacacatacaaacagaagaaaacactctgaaataaaatacactttattctattatattattatatacactattttatttatttatgttattattatttttctttgagacagggtctcactctgtctcccaggctgggatgaagtggtgcaatcgtgtctcactatagccttaacctcctaggctcaagtgctcctcccatctcagcctcccaagtagctgggactacaagcacgtgccaccatgcctggctattttcttcccccaccatattacccaggtttgtctcaaactcctgggctccagtgatctgccagccttggcctcccaacatgttaggattataggtatgagccaccgcacctggccaatatacattatttttatcataaccaatcctccctttttaaaatttcctctgagacttcttcccaagttaatcatcaattactacagagtaaattttttcaaggggaaaaaagtccttctatttcaaatatactatgaaataatatcttcatcttaaaaacatgattacaagcatcttttaaaatattatcctttcctttcaatgaaaacgttttgtacaaataacttgggaaacaaaaatgcttttcctggtcaagtagggatttttttcagacagctcctctgctgccctctaaagttcaagaaaaacataacagctctactttgcagacagcattttttttccactgaaataccaggattctctaaacttcaaagataattggactcattagtctctgctctcaatacagtgtggccaggcacgtctgctcaaagtgtacatgtgataataccgaaattaaaaaaaagcttaaagggcaggtgttgatggtatttttaatgccattgctactaaatgtgtccctatgattcatgtgttactacacaacataatcatgtaaatagccagaattttatgtttggaaaataatccataacttttgggatgttcataatttgtgttttgcgcttttctgttaactacgccacaattgtggccgaaatataataaaaatgaggacagtaggcataatattgggactgtctgctaagaaataatacataaagctatgactcagaaagtgatgtatgttgcttcctgaactcacccactttaatgacagagccagggccttgacatcgggacagattattagaacgtgaaggttggtactgccggttcagagaaaggaggcaagagattagcaaaaagcaggctgtataatgactagtctggagtggagaagggagggagattagctcctttctgttctttatgttagggacaaggcagagagcaaaagaagaaaagaggaaaggagaaagggaagaaaggaaagagagaagcaagaggcagggaagaaaatgcaatatagaatattcattgagcctcttctttgaactaagtactttaacttgttcacaataatcttgtaacatgctactctctgttctacagatgagaaaattgaacttcaggaaaaatagataatgtggtttagttgtacaggttgtgtacagtgcagccaagtgcagaaaggaaaggcaaatgcactagacattgcttcctctgcacttctctatgctttaaccaaataaccttctgagttccagctagggagctggcaggagagatgaagaagcatatgaaaaaataaagagaggcacacagtcacagacaagaaggaggattaagggtaattacaaccccaaagagcttgtggtgactcactaaaaagccacagggagaagcagttagttacaagagaattcttggccaaacgcccaattcaagggccagctgttgataatttaacaaaaaaaaaaaagtcctctttgaaaacctaaaatcattagagaagtacttttcacttcagctctgcatcagcagttagtttggatcagcagccaggatggggcattaatgctttaggtagagggggtctcaaaatatggctcttggatcagcagcatcagcatcttctagggattggtataaacataaattctcaatgctctccctacctccaggctcacaaaataggcatatctaggggtggggtctagaaatctctgttttaacaaggcttgcaggagattgtggtgcatgcttaaatttgagaactaggtttgtataagtcctttaatttgtttggcaagtactctctgtggcttttactatcaaggcaagtttgagaagttctgtttttaggaattgaggaaaaacttttgccctaggcccactgaaaaatgcttccttcctctggagaaagcgatagtaattcagattctcttccctcatttcagctgtggattcattgaaattagggcagtagagtactaattcccagagtcctaataaatttgacttcctacttctgggtggaggaacagaattgggagagttgcagaagctagggaattaagagaataataattagcaaattttatcggaatctttatctctgtatttcagttctagaaattgagtattttatatattttatcatgattatataaatggagctaaatgagtttcctgaaatttacattttatgcacagaaaacaggctctgccaatatttatatgttctagttcctatagattgtagagaaaggggaatgagacagtaaacaatgggcttaatttccttttcaacagggcttcataattcagtatcaatcttgtggaacagatattcccatttcacaggtgaggaaactgagtcttctctggctacctactcagctatgggcaagattcaaaaagaattcctccatccctggattttaaattcaaatgagaggacctatggtatccctttggggtcagaaaatacatcatactttattttatgtccctaataatatctggtaaaacatctgacaaaccatttaatcgatttctaaataaaaatattcttctttctttttattggttgcatttggagaaagaaaacaaatacttcatgaactgaaatgtatctgcatcttttcttggcatgaattcactttctactttgtatcatcacaaagatgacaatgtcccatgtggcagaggtgccttgaagttaaccagaaattcctgaagctttttccataatgtagagttgttgctgggaatggctgcccagtcagggactacattcctaggcatctttcctagggatctataacaaattcttgttaatggaatgagagtagacacaatgtgtgtcacatttagggtggagcagataagaagcaagcattacctccatttcccaatccactgagtgcagaggaccccgagatcgtaggagatggtagagcaaatagggggatagaacctggaatcctgaaccatgagagagaggaaagtctccagtccccccagagtgctcacaacatgagtgagaaaaccaatttcattatgttaattggctgaaatgtgtgtgtgggggggttaatattactacaactatcattaccttaatcagtgcatttcatttcttctcttagattatcatgttttatgttagatgatgaggtttttgagggtagtttccatgtttggaaaaatatggattatatagctgaatcaggagctgggtttttcactcatgagttttgaggaaactggtgttttttcttccccttggcttctcttcaaggagatactgattacaataagttgactatttgaaacgcagttcaggttatcggtaaaatctaggctatgcagtcagctagatctgtattcaatccttggtttttctctaattaaatgtatgaacatactcaaactgcccagtttttctcctcttctgcaaaatgagtgttaaaaatccctatattctaagattattatgaagatgagagttaatatttataaatgcctagtatagtgcctggctcatagctagcattagccactggtggtagacttctaaaaatatgtcctctacttttcaggagagaaatatactatgtcaaagccatcaggtttggtcatgtgatttaacttggtcaacaacgtgtaagcagaaaagatgtgtcacttgcaagttgaacctgatctctttctttctgacatgatgattggcaacgtttcgttagaaattgctccattatactggatatcgaaatgaagatgacttggagcaaagccacaattaccctacaatagggcaaatgttacttttgctgctgtaagacattaggatttggggaccatttgttactgcagcataacccaacttttctgaaaaatacataaaatatatatttctcagtcagggaatacggggaaatcctttaaactgtcaaattctctatcgggaactggggcatctagccctttccctgtccctcccaccttgcctcctaagaatgactaataataaaaacagcataggctttgtccttgctccccttcctggagaggctgtaaaactctacaaaatacagaaaatgaaatattttctgatggtaaaagagtttttttaaaaaatctgaagacagaatcagatctccatgctgtcctttgggagttcagattttagaaaaagaaattggagctttacatacatttaacatacatcatttaattagagtatatatcttcagtgagcacaagaaaactttagataagagtttcatactttgtagtgaagcaaagttagtattggagaagtcttgtggggagcaacacagaagactgagaattcttttttttttttttttaagacagagtcttactctgttgcctgggctgaagtgcagtggcgcagtcgtggcttactggaacttatgactcctgggttcaagcgattctcctgcctcagcctccccaagagctgagactacagacaggtgccactatgcctggctaatttttgtatttttagtagggatcaggttccaccatgttggccaggctgtcctcaaactcctgacctcagatgattcacccgcctcagcctcccaaagtgctgacattacaggcgtgagccaccactcccggcccaggcaacttaacagagctgaattcttaacagggctgagaatttttaacagggctgtggagtaacagaacttgatggaaaattggcatctgtgtagaatgattctaaagctttcagacaaatggcagaatcctagggtaaaaatatcacctttattttctttcatgaactctatcagtggaatatatttagctgaatttctacttaagagcaggcaagacgaaaaaaatgaaggccactgagaattgtgtcaattactctaacttttctgttattattattattgaaactgccacagtgcacctagcaatttgctgctctatggtcctattaatccagagtctgcagatgaaaaaagcaatgtttttatgctgactttactataatcacagtgaaacaaaaaacgatcaattcattgaactccaaatatgcctcaggttatgatcttactttatcggacattctttgtaacactgaagagatatttcaaaactataaattgtgaaagtctccctactctcccttccacagtggctaagacatcttaaaaagaaagcctttccccaaagcattatctatagtgatcatacctttctgcagaagctgtcccaggtcaggtaaggaaaaaggaaggggcagaacagaaaggagggagagacttcacatgaggaggaaacaagcacattaaaaataattaaaatcggccaggcgcggtggctcacgcctgtaatcccagcgctttgggatgccgaggtgggctgatcacaaggtcagcagtttgagaccagcctggccaacatggtgaaacccagtctctactaaaaataataaaaaaaaaattagccaggcatggtagcaggcgcctgtaatatcagctacttaggaggctgaggcaggacaatcgcttgaacctgggaggcggaggttgcagtgagccgagactgcaccactgcactccagcctggacaaaagaatgagactccatctcgaaaaacaaaaaaaaaagacgttaataaaataaattaattaattaaaataaaaataattataatcaatgctttgttctatgttgcctaccttatattctttacagtttttgttcatactctctcctaacatatttttattaggagtttaacaggccaatatattctttctaaaatactgttaaaagacacacaggagaatatatatatctctacttttatgtaaatcagctttaccattttctaagtgtttacacattagagttgcactttactcccaaaggtacactgagttgtatccagattgatgctaattatcatcttacagatgaaactggggcttagagaagatgtgacagaagtgaaagcggagcccagaccaccgtaccacagctcattccacatggaaatgcctttacctacctatgaactgatactcagagcctggcaacaactttcaaccctccactcaccgacttttccaaataaaagcaagttacgggtcaaaatgttgtcatttgacattaaccattatttaaccaatgtccctataatcaagagacacttagagcatatatttaatgttgatcacccttggcacactgttcaaagaccagttcaggatgatgaaaatcaagttctcattttcaggccttacaaaactatactctggaacagtcctcgaaatgcaaatttggctatatcgcagctacagagatgaaagctttgtgaaactctgatattctagttaaagactattcatatccatttctagagtgacttctgattttgacatataaaaatatgttcatatttttcacccattctggatgatgcaaaatctagctggtataaccatgttatttaatttttaatttccgcaaacctcactttaaaatgcataaaccattctatcatgaagagcacctttttttccaatgcgctgttattaaattcttattcctgcagtgccttctcacagactagttttctacaaaagaaaaaaataaactcattgcttttcatatgaagacccagggttctgccttctagattaattacatttgattcaaaggtggctctctgtaagtaaatatctctagctcagaagcaaaaggaagggttcacttcaggtgtttttatcttcgctcaagagtcaaaataccttctgcattttatataggtaaagctagaagaaaagtaatctatacttatacctatacttacctgtctatctatctatctattgagtttttcattatgctgctgaaactagcataagaaaatttgctatctctgctatgaattaaatgttgtccctcgaatatcatatgttgaagccgtaacctccaatgtgactaaatgtggagttagggcttttaggagacaagtaagtttaaattaggttataaagatggggccataatctcatagaactttggcctcataagaagaggaagatgtttctcccctaaggccccatgtgaggatttagtgaaaaggtggctgtctgcaagcaggatgagccctcaccagttggccagcaccttgatcttggacttacaccgtccagaactgtgagaatataaatttctgttatttgagccacctagcctgtggtatttctttacggcaacccaataaatccctattttaaatattaagactccaaatctcaaagacaagttaatatgagtctatgtgctaaacctagaaaacctcaaatctgagttgttaaccagacgctgtgatattcatgtttctttttgttaggcttcagcatcttcctttgggggccaaaataattgtgtgtgtcccttttcttaagtgaaatctgtccctaaaatgtagagcactgtcttctttgtgctccagggttttcttccttttctccttggctccgtccttgcttacctcctttaacaaatccaggcaggactctgtcctgggcactgtcctaggtgctgaagatgcaacagtgacccaaatatggtccctgaccttaaggagtgtcctaagagactgcttgttaccagcggtttctcgcttcaagaaggtttcctgaataaattttaaaaatcaatgtgtgttgttaaaagctcagtgttacagttctgatccatgggttgagttataatgaattagagttccacaatttatgttgaccatattcccaaagccaattattcttcagtttttctattcaggttttttcttttgcaaacaaccatcttggctaaactttatgcagctccctagggcaactttgcattgccaaggtatttctcaggattgtgcctgacagacaccgaagcttagtgtctgaagcaaacttaatgagctcattttatagtctctcctctaggtcttgataaaaatattaaacccaaggaccaagactgaatacctttgaatatcactgtcttttctggattctgaagttaaaaatagccagtttctcagtagaacaccctagtcaacagcatatcaattaatctgtgtattatgggggccacaactccacagcttactgataagcgtatcatgggggcaaaatcagtagccttgccatggacaaaggtgaatatatatataactaactttccttgactctccaaactttttcatttaagagagcaataaatgaagatgtgctacttgaaaaatcattatgctagttctcaccaggctccctcaaaatatttatgaatgggtgttataattaatttcttatgagtgcaccatgtacagaaggtgcctaattctctgcaaaagcaagtcccattggggacttattctcccagctccaagccagtctgaagcattccccaagtgtcagaataacagtagggtattttagccaaaggaacacaagcctggtggtattttcttgctgatttattataactttcattcaccttttattctcttatttttctcttattgaaacgttgttataaaacaaacccatgaacaaaaatctatcttcaatgtatctagcctgttagtgtcaacctctcaacatatcctcctacccttcaacaaatattctgttcttatttattggaataacctttgttcttctttttgtatattgcattttattttattttttaaaaaatctttacttctatttgatatgttttggacttttcctttcttaatctggttaatttcccaatgttgaaccatttcaaattaacactgaaagatacagaaccctaggctctttttactatttatttacatatttatttatttatttatgtgttatttcttaggtagcatttgtctcaatggagatttcatgtccccctttaacctaggacttgggccttttgaaatctaaaaattttccttagtgccttctaaagtcataatactacacattctatatcatgcaaaacccacaagtatctacaaggcagtaaggttctttttaatggggtgggggaaatagcaaacaaaacaaaactgcagcaatcaaatgtttagcattaagatgttttccaaattgttgaagaagtgctgaagaaaacgttttggcgctccccagatggcagccattctgactccaaatgttaccgttattttggccctcataggaagtactttccccgtaagaccttgattcagtgattgaccttggttttgataatgtctcattcccttttagattaggaaagtccaagagaaagcaagacggggaatgcactaatgataagcagtataaatttcggaataggtttctcatcttttctagtgtgattatagggtttctagattcaatctggatcccttatacagttctgatggagagcattttactagtatgttctttacaatttgatcatctggatggcaatatcatatacagaaaagagaattggatttcagagctaggtaacttgggttaaaattccaacattttcacttactttgctgttttctaattttaaaatgaagggtagacagtccttttattacttcatcatttccacaaatacatacagactataacatgccaatcacttttttcaggttcagtaggtgaactttaaggtctcttattatttctctgtataaactgttcagctagacctctgggcttatatgtaagcttccgtgattcaaagcaaaccaaaatgtgggccagcccagtatctgcagggcataagtctgccagaagacacctactatcaccaactccttgtactttagattgtctagtctcatcctgctgctgctcaaaaagaacaaaacataaagcaaaatggaaaatattttaaaataaggtataaaatgtaataaataatgaggaaagctaaaaacaatttatttagcactggccatttatttgcataactctgtgggaaagtgaataagtgatgtagtttttattctctaatagcaaagctcacatggaatgagatatgcatgctaaaggagtgtacacggcatgattaaggctataaagctgtatggtttaaggagagaggaccacatgaacaaagggtggcttcaagaagaaagatagtgcttaggccagtttacaagtactttataagcttgctctttacaacatgcacatacacacacatacaggtaatctcaacatcattgtcatacaaaacaaaaatcaggtaaaataaaaaagcattaaatgggtggcaattatttcacagtgaaacatagtttcacacgtattcttaggaaaaaaaacattgaaaataaaccaaatcttcaaattaatagcagagaaaatatgcacaaaataaataaaatttttaaggatagatacaaactagtaaaatatacaataaaactcagaaaagttcaacaatttaaaaagccagttatttgaaattatcaataacaaaaatgaatagttttaggcacgagaatcatttaagaagtgagaatattaggaatgagaaaccaagataaataatattaggaatatgattgtatgttaaaacttagaaagacacaaaagagattttattatttttataataatatataaatttaacagtttaaatttgaaagcagatgaatttcataggaaaatttaaattaatcacattgactaagaagtttagaaaacctacataaatactgtataagaaattttaaaactggtcataaattcataacctattgcatcctaaaaagtcaaataaaattgttttatgataaaatgaaaccaaatttccaaaaactagctattccttacattattgaacaaacagaaagatgaacagattcccaattcatgtaattgtacaaactaatcctaactttgatactataaaacaaacaaataaaacagacaagactagttagaacaacaataacaaagtgaaaacacgaatcttttgtcaatagacaaacagaacaaattatactgggcttataaggaatctccttaacttgataaagagtaattaagagaaccttatcaaaacatcatactttataatgatgattcatgagaagcagtcagtttcactaatatgacaagaatactcacttgcatcaagcaaagcaaacataaaatttagaaacaatgagacagttgaataaagtggtaaggcacaaaataatcattgagaatctataactttgtatacctcagcaatagccatacagaaaatataccaaatattcagtttataataatggcaaaatctataaaacacatagaatatgtctagttaaaattattaaagactcatatgtagaaactgtaaaacataaatggagaacataaaagaaaacctaaataaatgaaaatacataaatattcctggtgcaggatattcaatattgtagagatgtgacttagttcttcatccaaaaaatttataaatatttaacagtgccaaacaaaatcccaaaggatgttcttttattgcacacagcatggccacttaaaacagggtgatagaataaaggcaggagaaaagcaaaagaaattaaacagaaatatgaaaggagaccagtactgccagatatcaaaaccatagttaggcactgatataggtgtagataattcaatcactggaacaggctagagagttcctaaataacacaacggttatctggaaagttgaaattagtataggaagtagaaactactcaataagtgtcccaagaaaaactggctattcaaatgaaatttaaaaacaaatcctgcagtgagttcaagggttttgggggactaaccaaggaaaaagatatgaccacaaggtagtaatagaacacaataaggtctatttgagcagtgctttgacaggtttacaggaaaaggtgagtccctcacaacatgagaactttcagaggcaatgctgcaggaatcactgtccaaaacagaaaggaaggaaaggggacgcctggagaagacccttccaggaccagagagggggcttaactaaatacatgaaggtggggacgctctgggtcagagaattctgaagggtcatagtggcttgggatctctcatagccctggagtttatcttatccatgtctaacagatgtttggtgcagtttcgtgtgatatgcaaaacaagcagctctaaatggctaaaaatgtgcttaatggggttatgtttaaaacaattgaatgtgttaaaaatttgagcttggcactggtgggcttctggactaatggattccagcctactgcgaagaagggaaaaacacacggcaggtccactatacggggccacttgtggctcattgaaataacaaagccttacctcacttttctttgcatgcctatctgcttatgcacacatctcagatgtattagaggtaaacatgaaaaaataatgtgagaaatgtaggaaattacatttataatattagggtgataaaggctaaatctaaaagtcacacatttatgaaataaaaggtctcccattattattgtgtgggagtctaagtctctttgtaggtctctaaggacttgctttatgaatctgggtgctcctgtattgggtgcatatatatttaggatagttagctcttcttgtcgaattgatccctttaccattatgtaatggccttctttgtctcttttgatctttgttggtttaaagtctgttttatcagagactaggattgcaacccctgccttttttttgttttccatttgcttggtagatcttcctccatccctttattttgagcctacgtgtgtctctgcacgtgagatgggtttcctgaatatagcacactgatgagtcttgactctttatccaatttgccagtctgtgtcttttaattggagcatttagcccatttacatttaaggttaatattgttatgtgtgaatttgatcctgtcattatgatattagcaggttattttgctcgttagttgatgcagtttcttcctagccttgatggtctttacaatttggcatgtttttgcagtgcctggtaccggttgttcctttccatgtttagtgcttccttcaggagctcttgtagggcaggcctggtggtgacaaactctctcagcatttgcttgtctgtaaagtattttatttctccttcacttatgaagtttagtttggctgcatatgaaattctggggtgaaaatccttttctttaagaatgttgaatattggcccccactctcttctggcttgtagagtttctgctgagagatcagctgttagtctgatgggcttccctttgtgggtaacccgacctttctctctggctacccttaacattttttccttcatttcaactttggtgaatctgacaattatgtgtcttggagttgctcttctcgaggagtatctttgtggcatcctctatatttcctgaatttgaatgttggcctgacttgctagatataatgtggcacatatacgccatagaatactatgcagccataaaaaatgatgagttcatgtcctttgtagggacatggatgaagctggaaaccatcattctcagcaaagtatagcaaggacaaaaaaacaaacaccgcataggtgggaattgaacaatgagaacacttggacacaggaaggggaacatcacacactggggcctgttgtggggtgggggaggggggagggatagcattaggagatatacctaatgtaaatgatgagttaatgggtgcagcacaccaacatggcacatgtatacatatgtaacaaacctgcatgttgtgcacatgtaccctacaacttaaagtataatttaaatatatatatatataaagaaataaaaggttgaacttgatgacataaaatgtttaaaattcttcatcaaattaataataagaactgacgtttgttaatatggtttggatctgtgttcccacctaaaactcaggttgaaatgtagtccctgatgctacaggtggggcctggtgggaggtgattgaatcatggggggagtttccaacgatttagtaccatccctctagtcctgttctcacgatagagttctcatgagatctggttgtttaaaagtgtgtgggccgggcgtggtggtgcacgcctgtaatcccagcactttgggaggctgaagcaagcagatcatgaggtcagaagatagagatcattctggctaatatggtgaaaccccatctctactaaaaataaaaaaaaattagccaggtgtggtggcacgcacctgtaatcccagctacttgggaggctgaggcaggagaatcccttgaacctgggaggtggaggttgcagtgagccgagatcatgccactgcactccagcctgggcgaaagagacagactccatctcaaaaataaaaataaaaataaaaataaaaataaaaataaaaatgtgtgtggtacctcccctgtctctctcttcctcctgtgctggccatgtaagatgtgcctgcttcctctcaatcttccaccatgattgaaagtttcctgaggcctcccaggaagctgagtagatgccagcatcatgcttcctgtacagcctgcagaaccatgagccaattaaaccttttttttttttatagattacccagttgcaggtatttctttgtagcagcgtgataatggactaataaatttggatagcatttataataatgcttatgtatattgaatcatgtaattttcactatgatttatgagaaaggggctgggtgtggtggctcacgcctgtaatcccagcactttgggaggctgaggtgggcagatcgcctgaggtcaggagttcaagaccagcttgactaacatggtgaaaccccacctctagtacaaatacaaaaattagccaggtgtggtggcatgcacctgcaatcccagctactcaggaggctgaggcaggagaatcgattgaacctgggaggtggaggttgcagtgaggcgagatcacgccattgcactccagcctgggtgacaagagcgaaactccgtcacaataaaaaaaaaattaaaagataggtagttattctcatttgactgttaattacataactcattaaatgtatcaccacgactaaaataatatgcagaagtgtcatataatgttgtgcaggttataggcatacactgtgcaacctgacatctgtgagtaggggttgagggttgtttggtcgggggtcattcccgcagcctttgatgctacagaaatgccctcactcatctacctcattgtttatatgtttagcattcaagaaaatccaagggccactttctctagaaagtctgtcctggcccaacttggcacatacaacaaggtaaaactgacctctttcttctccaatggcccattgttctttccacaaactactctcacaggaactttaacattttgtcttgcttatttatttactcatctgactccttcaccagattgcaggctacttgagggcaggaactcttcttatttgtctttgcataaatgtttcccagcataggtcacacacatagtgttgaataatttttcgttgaataaataccaaggtccagagagatattctactgaatggcaatttgcaagatattgattttctttgctcccatttggtgatattgttaaacttttactggagggcaaaattcatagttgtcgcttcacatgtgaattagcaaggaggcaatctcagctctaaaatctttacacttatcctaacacccccatcagctcacactattaaacattatagataaatactgcaacattaagttttgtggcagtgcaaataaaagcagtaacaagttatgtaattataccactcttttttaaaaaaattattaaatgctaacacttctccaattataaccattcaattactactcactgcctaatgtccaaaattcttaacatgtcctagaatggtctctaaaacctggctcttgtctatgtctctaaatttatctcctgctagcccctcctactccccactcccatccatgccacagcatacatgtgccctatattcagataacattttgcaaattgaaattgcaagttgcaattgccctaatccaatctcaactctttaaatcatctcacaattttacgctctggcatattctgccacttcagctcagaatacccttttcacttttgtagcacttcaagctgtcattcataattcaagtctcagcttaaaagccacatcatatcctcaatgaaacctcctcgcccagccctagcagaatcatgggatccttgctgaaaacttctagggttcaaggtgcacaacttgtatccacagtgtttaacacaatattgtatttgtcattgtttatcacatttctcatctatcttccacctttttgaaagcaaggattgagtttggcttattcctgaatccctaatgtctaacgaacgaccgtcataaagtagccacttcaccaaggagggatgaagcagcaaacaggaaagcctggttcaggcccatctttaatcactagttttgtgaaaaagttcactgctgcttcccacagcctgggatttggttttgacatgattatttttcttttgcagcataggaaggaagctcatgagaagaattttagaaaaatcaacctcgatttttcccatggctgtgcctcacctagcagactatctcaggacagcttcctggaaacacagcagcagaaagtaagctgcatttatttacttttttaaaaatgtgttctgatactttttgattattacaaagaatcttgctgggtgatactgcagtggactgacctgatatatgtttccttcttttttcagtgaattgttcagttcttttttggaatactgtgggtgagagcttcaggcagcacagagccttagaagtatgctttgggcttggattgggacacggatttagtaattccacaactcaaaagcaacttctgagataaaagctgaatttgtaaatatgtgagataccctgaacctagaagatgagatataagtaatgtagtttaggtggttttggtgtattatctatctccaaaatcaaaggaaatggaaggattcctctaagaatcatcagtaaaaatgtgagttttgctcatatttgcattttgcctaattctaaccctccataatttattgactgaaagctaaagaatattaagagaaaatgacaaaggtaattttccttccactgtgtcatttcctatcaactatgcgatttctttattttttaagttttgaaaaattttagaatagttttatgtttctataaaaattgctaagatagtacagatttcccatatatgctgtatgcagtatcccttcttgttaacattttatattgctatggcaccttggttacaatattgacacatatttattacctattttgagatggagttttgctctgtcacccaggctgtagtgcagaggtgtgatctcggctcactgcaacctccatctcctgggctcaagtgatcctcggtctcctgagtagctgggactacaggtgtgcatcatcacacctggctaattttttttttatttttggtagatacagggtttcaccatattgcccaagctggtcttgaactcctgagctcaagtgatcctcccacatcggcctcccaaagtgctgggattacaggtgtgagcctctgtgtccagccccatgttttatttatatttattaactttttctcttaatcccttttctgttccaggatcccatccaagataccacattgcatttagttgtcatgtctccttaagctcttcttggctgttagctttctcagactttttttgttttttgagacctcattcgttttgaggagtaaaggtcaggcatcttgtataatgtcctttagttggcatttgtcatatatttttctcatgattagaatacgctcgtatgtttttgggaagatgaatgcagaagaaaagtaccatttacatcccatcatgtcaaggacacatcttatcaacatgacttcactgttgatgttgaccttgacttcctgtctggggtagtgtttgccatgctactccactgtaaagtcattcttttttatcctccctttccatagtgctccctgtggaaggaagtccctatgtgcagtccacatttaaggaatggggagcaatgttccatctctgtgaggttaggaaatccacattatcagaaagtctgcaaaatcagatacctacagaaattattcggaattcttctgcatagagacttatctattcttcccaatttatttattccataatttgtttcaatatagacttggatttttaatatattgggttgtaatacaataccacatagcttattttattgtgcaaattatcccacctttggtagttaggagctcgttcacttggctcctctgtccttttggcatcattgtagattttttaactctttatttatttatttaacacttccttactttttggtactatataatgattcatgttcaacttgcttatgttctgccctagttctagaatcaaccatttctccaaggagtcctggttccttttattgaaaaattgtattagaaaccaaaatctgtgcactagatatgttcattgctactgtggtattcttgcttctaggccctcttaattgacatagaaggagaatatatgtctgcatactaacccatctatatgtatttacctatatctatagatatttctatatgtacttatctgtaccgttattaagcaaaacatgaattcatactgatatatctgactctaatccattaccacacagatcattctaaacttatccctttgcttatccataacctcccactccaactgtgagaaatatggctcccatattcaccatccatttatttaattgttcgattccagtatacatctatagcagcaacagaattattaactgtgtccccatgaacaagaactcaattaattttaaaactaccatttttaaattatttccaaactttttatttctaactttgaattttcttaagcctgggagaaattttgtaggaaaaagaggaataaatgccaagacaaatgaaatgtcacaaaattaaagaatatgcatatggctaaaaaaaacctctatattaagccaggtagaaattcagtaagcctgataaagaacatggaagaagatatttacatttaggatatttagattagtaagctataatagaaaaataaaaccaatacgtcacaatcacatgggaagtaggaattaagatacacacaaaaagcatcagtgttggcaggtgggtaaatgaatccacaccagagacacagattccagaaagcagagaaaagtaaaattcctaatgattaatcaaactgtcagaggccaagagatctactgaaaataagaaagggttgaagggttgagatatcagtatccagatatccaagccaaggaaaaatttgatggtattcaggcacagggtcttgtcagcacttcacctcagggattttacagggtcctttgaggaaatgtctaagcatgtatgaattaaggcttataagaaaataatttaagaggatttagctaaaattaagcattgaagaatgttttttacgatgcaacacaaagctgtctccctcaagaagccttctgagatagccttttagacacagcacaatagaatgttcatatgatagttttcatcaaatattatttgcatatgtttgtgagctagagtgaggtctagaggatcaaggactgtaacttagttccttttgatcatcagcacctagcactgtgcttggcaatgagtgataactcagtacttttgtatcgagtaaaagaaagaaagaaaaagagagaatcccagccacataaacactcagtttatgaacatagagttgaaaaaaaaaaaaaaaaactccttccagcactaaatcaatacccttccaattgaataggaagtagggccttgccatgttgagttctccaatgacttttcaaaaaacctttattgctgcaatcataggtaattcagtgactgtttaaaacctatgatgaaaataaattacctgagttcttttcattaatcttattattctgtagtcccatcataaatagctcactagcatcttttatctttatttttcagagtggtacagctaagaaattatatcattatgcatttgtgttgtgttctaatttctgcctgatgcatcaataatacatttaattgtgttattcttttctgcagacagttccatctttggaaattgctttagtgatacaaaggactggagggtagatattctgggtttgtcctctaattaaaatatgtcactggttagactcagaatacagacaattttttatcactgggagtctttaatcccaaactgttcatagaatgagcttatataaacactgagatttgacacattcttccagacttgatgaaaaaaaatatgatatcccaaagttcttgatttgaagaaaaagtgaactttgataactttggtgagattttcaatttcttggccaactacaatttatttctgagcagttaatttactttttgcataatgctacagaagaattttgagaacaaaggatatgtggaaagcgctctttttattttttgctttgaatgatactcataatattatgcagataatcactgaagttataaattttatgcatttaataatttttatacatttaataattttaacagataattttgaagtctattcattttcataaacttataggttgggaacattgggaaagtcgtttagttccttgggcttctgccaacttatgtgtaaaaatgggctaacattaattcaactacttttcttatttgaaaaaagacatacctgaatagaagcacttgaatttgataagggagaaatcacctagtgtgacatatttacttactttcatggagcacataaatctctgttcctttccttctcacaaccccattgcatcctcgaccccaagaaacccacacattaaagcttttctctcttaacaagagacttctaaaaatacttccaaggtagtaaggctgaaggaaaaacaacaacaaacaaccaccaacaaaaacacattacatatgtaatttaggaatcattagaaatatgaactcatttaggaaataagatttctaacaactgaatcaaatccatttaacaagtcattctgtaaaaccacaaaaagcccagaagtgcacactattcatttaatatctgaaaaaactctttgtaacaaaaggtttttacttaacccaaaacatttctttagccttggacaggaattaaggcttagtacagcttgatgcaaatgaaaggaactggcatttatcatgagtttcccatgaagctttacagatgcatagaggatgcaggaaaagtagagagtatgttagtgtgtgtctgagtgggtggccaagttgcttaacttggaatttaaggaatgtcctctttgaggaggtaataagtggagacctcaggttctatgggaagattactcaaagcataaagaacagcaggtgcaaagatctggaaatggaacagaaaatctccacatcactccccaatttaaagtaaaatgtggcttatactattttttttaaatgcatgattataggaacgacagtttgcatacaggtagaatatgccagatgtgacagagattggccagctagtgaccaatctcctttgttctccctcctgagaacatgtcaagacaatacatcacaggtacccttgcagcaggtatggtttcgtgaataaataaatgatgaccagtggactctggtggaagtttctggcccatgaaaacttccagggatgatccttcatgggttttttgcctttgccaacaactttgaaaggcatgtgtggaagactgcagagcccaagatgaaagagaactgggtctctgaaatgccacttgttttttgtttgtttgagacaagatctctctgttgcccaggctggagtgcaatggtgtgatcatagttcactgcagccttggtcttctgggttcaagtgatccttctgcctcagcctctcaagtagctggaactacaagtgtgtgctaccatgctgggcaaattttttttatttttattaaagaggtctggctatgttgcccaggctggtctcaaaatcctgggctcaagcaatcctcctgccttggcctcctaaagtgctgtgattacaggcataagccaccacacctggcctgaaatgacattggaaatagagctgtatgcttaccagaaacacttttgttctgacaaacatctacattttaaggtttgtttgttttatcagtgttggcctcaactaatgtgataagaatcattttctataggtttgggtgctgttctaaataacataatcataattaagctaccagcaatttaacaatgaaaaacccaggggaatatcttagatgcagagcaataacttattaaatgaaaagaataaagctgatgtatgttgggacagtcacagactcattggataaaatttcatgttttccaattccctggcacaggatcttagaagtggccattttacctccaaagatagattctctactgtatccaactaattgtgatgttaaacgtgagtatctgagagaaggtttgttttatagtggaaatccatggagttggccatattaacaaaaaggactgaattgtaaatatcagtaaataaagaatatctattgatacaagtcattttactaactcattcctcaagaatttccttgagcagatatacatatacttttttgttttgagacagagtctcactctgctgcccaagttggagtgcagtggcatgataatagcttactacagtcttgaactccgggactcaagtgatccactcacctcagcctccccagtagctaggactacagacatgtatcaccatgcttaattttttattttattttattttttggagacatagggcctctcttttttgcccaggctgctctcgaactcctggcctcaagtgatcctcctgccctggcatcccaaagtgctgggattacaggcatgagccatggcactcagcccacatatcattattggttatgcattattggctgttttgccaagattttgttttgttagttcacagtgttgagtgaatatatgtgtgactagttgattgaatggtcttaacttcttgaggcataacagaaaaacaattattttcctaactgctacctttaaaattctttgaagcgtatttcttccccaactctggataatctcttgtgcaaatcccaaactataaagccaattatattttaggaaagagtctcattttagtatctatgtcacaatttcctatattgcatgaagccatgaaatacagtctaataaacatttcattctctaatgcaaatgtctcccctgcagtttccattcaggcctattccagacttgtagagccacagtggagtagagaaaaccactctttactcttctctccttttgcttctttatcccacttgctctgctgcttcagattcttccaaaatctgggcaggagaggagcttatgagagaaacagcaggcaatagggtttttgttatgtggcacaccttatagctttctcgtctttggatttccctttaggtcaggaatccaaatgctggctctctcttgggatataaatggagtccccatggggccatctgtagtgcattcttctctgacatgtgttgtacatttccgggctgacctctagtaacagctcgtgcacctgttgtcaattcaatttaccccacagcctctaaacactggggcttctttgcctggtagatagccctcttagctgaagtgccattaggtgtgttgtgattatcttttaagacatccgctagaccaatgggaaatacatacatccaagctgcatcaagtgcaaggaacttcagctactgcattccctctctatcctgctccccatcacaagaagctctagacagacatccatcttcggaattctctagaaaaaaagcatgaccagtctatgcttacatgcatttgtaccacataaactcctacaaacatttttaaggctctcctcaaattgtgtctttacattccattctaatacactggattagcctttgagtttctgctgcttggaaagtttctggacaagcaacaagagtcctttctctccatctagcagacaacttggtatctttgagaagacctcttgaaaagcacttctttcacatgaacggagcacaactttccaatctacagagggcaggagaaaggccaagggtctgcctcagtagatctaagactccctaccataataagaaattccattccacaaagacatttggcttctctttaatagggtgaatgggagttcaaatatcacttaggcaacctcaagctctagggggattgtctggtggctcaagcactattatctggggctagagcccaaatataaagataatagagaaggtttcattttccatcctattacagttttaaagcaaatatttattatgagctctgtatgaagaattttataatcatcatctcctttaatcctcataacaattttatgtggtagagaggatgagtccccaatttcaggtttaatcacatggcaactcagcaaattggtccaggtcatcaaacaccttgtcagtcagcacactaggaatctgacccagagctgagtaatgtcattcttttaactgtctcaatgttagaagatttatgagaagacaaatattataaaatcacatttaatcagcatgagtgttagtgttggctatataaatccaagataattaactcaaaactttttagatgttataaggattgacttagaaaatttaaaatttataattttctaaataccaatgacagccaaatggaaaatctaatgggaaaaaaaaagatctaatgcaagactgcaccaccaataacattaataacaaaatttacattatttagaaatagccttaactagaaatctgaaagtttatataaaaatccctattaaggtgctgagtgcggtggcttatgcctgtaatcctagcactttgggaggctgaggtgggcggaccatgaggtcaggagttcgagaccagcttggccaacatagtgaaaccctgtctgtactaaaaatacaaaaattagcctggcatggtggtgcatgcctgtagtcccagttactcaggagtctgaggcaagagaatcgcttgaacctgggaggtggaggttgcggtgagccaagatcgcgccactacacatactccagcttgggcaacagagtcagactgtgtaaaaaaaaaaaaaaaaaattagtaaaatatacaataattatccaagagatatgttatagatttatttgaaaagtctgaatatgtcaaaattactaagtctgttaaaattaatttataattaatcacaattcaaaattaaaatatcccagtggaatatagttgtgaatctgacataatatacttcctggaagtacaggtgagcaggtgagagaaaaaaagataaccaaagaaatacattaacaaaagacagtacagcaagttgtaaatattcaatctatatatttttaaaagcatcatgtgtttgctggtcatcagtttattgactctgaactccatatccatccttctttgctgctctgtgaaaatggagctggtacctttcactattcgttctttgttggctggctggatgttaggatgttgggtttggtcagtaaagggtgctagagaggaactgcaggaggaaagggttttacttctctgttctggtattcttgcttgtttgacaaaactccacagtgcacctgatttttctagcactattcctgcagtgcagaacagctagcagattcctggaccaccccactttgacagttttgagtcaagtgcctctgagataccttctcatgagctactttccctaaaatcactgctctgctctctccaatctttgtgagaattggaggagggcaggagtctggatcaaacaaggatatggaaacaaccttattatcattaatgatccgatgatgataaaagataaagaggtttaggattttgtggtatgatgaccacagtgattgttaaacacttacctttttttttttctgttacagattgggttcctacacaattcagaactcaacacaccctttgcacttccttcctgtacagacatgttattatccacgagttccagttttgttacccctggaggctgcttaaacaagtagacctaatgcattctctatttcttccacaagagaaaatgtgagctacacagagtaagacagagtcagagaaaagagaaagaattattcaatcaaaatatcatttcagtactgctaagtccttgattagaatttctcaagtggggtctgttgattgtcagcatcagaagtaactggaagtaccaggtaaataactctagctcacctcctaagattctcattccagaagtttgtgggtggggccctgcaatctgcataatttgagccttcagctgattttgatgcagatggtccaagagctactctttgagaaccaattctgagataaatgaatgttttagaaatattaaaacagatttcaagacatcactaaattgaacaagcaagaaaagatgtcttttatatcaacacatcatccaaaagctttggattccattccaaatggcagtttatgcctgtatcaggagctaaggtgattgagagtgagactacaggtaattagagaaagaaagaagagaaaacctgagtgctagagctagggctaatgtatattgctgagagtcaacaaagaaaaaaaatagaacaagtcagtggcttgtaataagactgaatcaacagcttcctgtccttattgcaggatctagtgggacagctcagcttggggacacagaatcagaaagtcaggcctctcaagtcctaacagcaataaagagtttagcccaattctaatgacagggtagatatctggtaatctccacactggtgctgtcatcttgatcttggtttggctttcatcagctcttgactgatccaacgtgactagtctccctgcctccaagctcaatccacttcaatcgtttctctcccataatatttcagtagcctcccattgcctacctacagcaggggtccccaaccttggggctgtggactggtaccagtccatggcctgttaggaaccggctgcacagccagaggtgagcgactggtgagcaggcattactgcctgagctccacctcctgtcagatctgggtggcattagattctcacaggagtgtgaaccctgttgtgagctgcacatgcgagggatctaggctgcattctccttataagaatctaatgcctgatgatctgagatggaacagtttcatccccaaaccatccccgccctgctctgtctgtgcaaaaattgtctttcacgaaactggtccctagtgccaaaaaagttggggactgctggcttacaggataaagtccagtttctctctaaggggcatgtggagggggtcacctctcctctatctaaagtagattagttggatttcaatccattttttatactgacaactgtgtgatgttaggcaaatgatctaacttccctggctgaagttttctcatctgtaaaacatagacatgagactcaatgggacactattcacatgaactatgatgtaaagagcatcctctggaggagggcaatgaagcagcctgaaaatacacacttcacatgattgccaggaagattgatatagtgcacacaaagtctatatgatagtgcttggcacacactcagtcttcagtaagggttgacttggatcattattgcccctctgttatttcttacatacccttgctttccattcttaccaagtaactcatgatttttcaaatgatgctgtttgatacctcacactttagctccactgttttttcagtgcaaatgccctcccctcttcacatgatgaactcctactcatcccttaagtcctagctcagatgtctaatctctgtggcactccctgattccaccccaaacagtttttaaacctgtattttcattaaagctatataaagtccacacctccattattacaataaatcctctccacagtaataagcctttcatgttgacagtcttctacaggaagagtatgtctcaaactgtgccattagttataccaccttcaaaacggatgccatatccttctaaaattttactgtaatctacttaatccttttctgtaaatcaattcataattctacttatataaatttattttaaatgaaactttatataattcataaaaaattaatgcatagttattctaaagtaaataataattacaatacaataaaaacgtcatatccatctactaactcatccattagcagcactcttatgggaaaatctgtactgatatataaaagctctttcagtgcaaagatatctgtctttatatccccagtacctattataatgttggtacagagcaacatcttgacaatttgaattgccatactccttcagaaagccctggcttcaaatcttgactttaacaaggagaaattaatttacagatatttataaatttaaaatctactattagaatgagattttgcagaaaataaaattcacccgaatattgtttatctatggaaacaagattctcaaatctgcaactgagcatatagaaaactaatacgaaagaatatcctttgaattaactgagaaaaaattttcgttacccaccaagaaacttttttcttttggttatttagaactatgacattcttcttggccaatagttacatcagagttaaatatgtgcctcacaacagctgaaagcctgtggtgtttgtacactctttctgctagtgttgacttcacttttgagttttctcttgtccatttggggggttatgttttactattaaaacttttaaaaagtcatttatctaatatttttattgagccagagaaataactaattcattaattaaataagcaacccaataaatcaatggatgaacagattgatggataaatacacaaggtcatgagcagtccttagatatgctaatgcaattgaccagctcagctgggggaaaatgagtaaacagacaaaccttttgtgacatgtaaattaaaaagcaccttgatggacatatttttttcacttcttagtctcttgttacaacaacttgaaggcacagcctgttgacaccaaaaccagttcagtttagcaacttgggacatagactgtaagaaataacaactgtgcagatgagaaacaatagaggtgggtgttggatctgctaagaaagtgaaccacatatctttctctccgtgaagcacaagacatatgaaaagaaaaaacaaacaaacaaaaaaacccactaactctgatgcagaagcaaacagatactacaattgtgctggcaaatggtaaactcacagccaggaaaggggcaactgattttctttgctatttatgtactaaaatcactggtcccattgggaactagcttacttaaaaggctacataggctgggtgcagtggcttatgcatgtaatcccaacactttgggaggctgaggtgggcagatcacgaggtcagaagttcgagacaagcctgaccaacatggtgaaaccccatctctactaaaaatacaaaaattagtcaggcgtggtggcatgcgcctgtaatcccagctactcaggaggctgaggcagaagaatcatttgaacccaggagacggaggttgcagtgagccaacatcatgtcactgcactccagtctgggtgacagagtaagactccatctcaaaaaaaaaaaaaaaacaactacataatattataattttatttattaaaatcgcttccacgttttttatttcaaagcttgaacaatactacatatgcattgattacaattcaaacttaatggaattctgtggtagcataaatgctgatttgtttttaaatgatagcataaatgctgatttgttttaagtataaaacaaatcactcagaaaaaaactggaataaaatactttcttcttctccaacagaaatctcataattatatctatttggaaaatatatgaaacataaatttacatgaagtagaaaataatttggatgtcatgtaagaagtcttatatattttagtatatagaaggattctataagcatatgaacactatgatgaaaaaatttctttttcagaaagcttatttaaaaccaacaattacacagtcactttgaaatagcacattataattttgcatagacactttgatttcagagttaataaatgtaaccaatacttcaaaaagctgacttattttccaagtaatatatccaactgtttatgcacattttattaccatctttctctcacacacttacatataaaagagaatgaatattcacaaatcagaatttatcctaaaaattttagaaaatgaagcatccaggaacacagactaaaaatctgcaagtagaatttacaacttcctaaaattaatttgagataatcaaaaattcaagttcacatacaaagtcagtgttattgaaatccttttatgaagcccaacatgtaggaagcaagcaaaaaggctacacaactgcaatagcaaataaaatcaactaaagttatttaagcattaaattcctacaatactagcgtttcgaaaaagcgttgtctttttattcatctcgaaaatgcatgtttttttgaagccatcatggaaaccaagagacaatttcacttaacttttaacgtttatcaccttaaaactgggtttttataggtgagagaactgatttgggagtcaaatggcctgggtcttagtttctgaaatttactactcattagcttatttgacctttagcaacttcatcataaaaaacttctctgagtcttaattgctttttctacaaaacattaacaagtatctttgccaccagaaggattaaattagacaaagtatatagagcagatatggattccaatcacgattttttagttatgaaaaagtacatgtaagtaaaagtcattgcgttattagagattgataagttcattacagtagaaaacttgtttaaatgtatgcaaaataaacctaggaaatgaagggtacattagtgttttctgttttttaatttcaaactcaacagtaaaagtactgtcataaattctatgtaaaacacatgtgactcttcatatgagctgattatttagacttaaaatatcacttgggagcttgtcaaagtaaaacctgttgaatttaggaaagccagattaaattttcgactatgggaagttaaaaattatactgtgagttgaagaggaggatgacatcaatcacatcttcttttgacccattcttaacgtgcactatgatgtacatcacagcttcatcttcttaactcctgtgttcaaagcattgttaatacagatcagtgtcaaaataaaaggtgcttttaagacacttttttgggaacagtagcataaatttaggcaagacctctaatctctaacttctgaatttcttataaatcaatgtatttttgcattatttacattcatgaggcacctcctcatgttctcttgcctccccaagatgttagagttctatgcctaatcatgaattcttgcctgagtcagtgacaatatttaagtctaaaaaaaaatttagtttatcaactgcctttctctctctctctctctctctctctcacacacacacacacacacacacacatgccatgtcctaacttgagcaaatcacagttcaaggaatccacaaataacttgtcatcactttgcacatgtagaaaagaagtgacagaaatcacatttggaacgggacacagtactaccctcttacctttcatctgtctcgttggctttatttgaatgaaaacagtcaccatcatatccaccatcttctcattcatgtttaagatgtcgcaaaatttcttatcaagctgatacattacattttcccaaatttcacatttagaaaaaattttaagaaatagcgagatgaacaaaaaggttttgtttctccaaaggtctttcgcagtcttcccagttctgaatggcaatggtcttcaactctgcagcaattatgggctgtactcctcaaattcacattttgggaatgcagaagccttgtgtgtgtgtgtgtgtgtgtgtgtgtgcgttggaaggggcagtttatatgtaataccatgcagatccatagtctatgaacatcaccaaggttaaccaaccttaaatgcaactatcagccccttgccagaatctgcagcaacctccttttttatatatctggttcaaatttccccttgctgacaatttaaaaataattctctctctctctatctctccatagctctctgtcactctgtctttctggatgaatacatacatagacaaatgagggagaattttctctctctctctctcatgcacacgcacacacacacacacacacacaagcacacacacacaatcacccaatgcaggcagcttgctaaaggatataactctaattatggtttcgacccaattccccctggagtccccaaattaaggttcaaaattatgagagcagtataaaggagaaatttactttataaaaattgtaatatcttagtagcccaaatccctttactatcaaaaagaagctgaaaacggcacattcatccctatgtcaaggtctgatacatgctcaaaatgggaaaaagaaaaagaaaatgagttattttcttctaattaaaagcttagttcagaatgagaaaattgaggtggaaggagtctgctttttatgaaagaagtaataaccaggcacaagatagtttagatcttgcctaaatgaattgaaactgcacagttaacataaaagagagatgtcaaacaatctttgccattgccaatcattttgccctaagaatatacaaatccccagatatcaggtttttagtgggcacagattatattttcaaaatttattttttttctcagatcttttgatttagccacacttgcctcttaaatgttccctgaatacacgacactccttccttctgtgaaattttgcctaagttatctttatccgaaatgttgttacttcttgtctccaggctcctccatttcaggaataaattatgaaatcagaaatgttaattttccgtaataagggaatcttattaaaaagacttgagagctggaataatttagaccaaaagttacaggtcctattccgttttgccacagagtgcgggctcactataacccttagcatgctctaaggggttattagggtctccaggtaatattgcataattgctaatgcattataatttttggaagacatttatacccatagtttgttgaatctatatttaccagttcttctggataaacaccttctgttttctattaaaaatgattttacctttacatctaacagttgtctcagtaggcaggcatgaaattagtatgatcttaggaactgagatttatttaatgtgacaaaattccagtccactgtcttcatctgggattaacttcacattttaaaagtgtatgctgcttctatacttcatttttataaagaatattacatttgatggggaataattaaggcaaaatgaaaactgagctataattttacacctatcatcttgctaaaaactagtcttgtcttgtattttcttgccttagccactctcttttgccaaattctcctaaatacacctctctcattatataaagcagtcacaacaattaactattggggaggtaaaggtggaaagaggtattcaaagcaagcaagtaccttacataacctgtaggtccttgaggtacatatgcaaacaaaactgtaatcatagacctcaatcatcctaataagtcatgaatcatataatagcaatttcaactgtaataagtaacataaccagttatattttgcactaaaaatatcaagtatgaagaaggcatctaactatttatttgtcaaactagacacttagatggactgttcatttcaaagcatgttttgggatctttttttttcttttcaccaaaggtagtcagtggctgaaatgtctatatggaagaacagaaagcccaccctgctactttttaaatcttttatagcagaaaagtgactgatagaaggatttaccagaatggtcatagagcaagtgagcagggacatagtttagcattaattccctagaatgctaaggccagatgaaatcagatggagtgaaccgtgttgatcaagctatgcttcatatttcatgagagcagtgtcttagtgttggtgtttgctaacagagaagctatatcaaaaacagctttcagcttttgatttctgaaaagtagtgaatatccacatagaatagtgactgacatttaattacatagatcatgtctaaaccacaatccagtcctaagcttctcaaatcttctaggatgtctgttaaaaatgttaattcccatgctccaattccaagcactctcatttactggctctatagggctcaaagatctacattttaaacatctcctgagcaatttaatccacccatcatcatatattgcacgtctgtacccagcctggtcaacaatgtagtcatgatagagtggtagaaatgggctaggtgcagtggctcatgcctgtaatctcagcactttggtaggccaaggcgggtggatcacctgaggtcaggagttcgagaccagcctggccaacatggtgaaaccccgtctctattaaaaatacaaaaattagctgggcatggtggcgcgtgcctgtaatcccagctactgggggagctgagggaggaggatcgtttgaacctgggaagcagaggttgcagtgaacggagatcatgccactgcactccagcctgggcaatagaatgactccaactcaaaaaaaaaaaaagaaagaaagaaagaaagaaagaaagaaaggaaggaaggaagaaagcaagcaagcaagcaaagcaaagcaagaaaagaaagaaaggaagggaaaaataaataaatgaatctctgtgtggctgatctaagttaggggcctttctttagggaggctaattcacctgttatccagtttgaggaaacatccaggctgaacctttctagcttctcaagttagaatacaatgatttggggtttcacacgggatactatcagatgatattttagatacaaattgatgtccttttaaaaagtcatgaacaaaatgtaactgatattatgttttaattagcttcagtcagcctacaaatatatgcattttgacgatgttaccaaatttgctgcccattttacttaaaatcaatagaacagtttgttgtgaattcaacaatccttacagaaaatctgtcctctttgtggtaaggtagccaataaaagtttattaatattcactatagtaacaagtaataaaaaggcatctaaaatttttactttaaaagtaattgctctagacatttaagtaatctgattgatttaactctcgagtgatgatggtatcatatagcctccatctaatgagcattgagctgctttcaaagcagtgtcatatatatgaattcatttgatatttacaaggtccacagagcatcttaaagtttagagagacatgttcttgaactggttctgtgaactgtagtttcatagatttttccccccattggattttcttatcacataaaatagcagtactacaggaaaaaaaaaaaaagatcaagccaaactcagaacttatcagctctcatacacaatcattttctcctacaccgataggttgtgaggctggcaaatttctatgaaagaactttgtgacagtcccattagacaatacccttatgtatcccaacaactttaaactcaagcaatattgaactattctagttttctgcaggtgccatgctgtttcatgattacatgactttgtccaactgtcccctctgcctgggacttctggcttccctctcttttctgcctggacaaatcctattttccctctaaaactctgtttaaacatcatctccatggaaactttcttctctgttctccatctgtattatttgtttacaaacccaacttcccctgactttcagcactcaaaaggcaaatcatgcatcttattcatcttagtatcttcatggtgtctcctaaggctaaaaaatcaatgaccaatctgaaacacaatattaaaagtgactacttttctcactaaatccatttgaatcacattaataagaataaaataactaggccagatgtggtggctcatgcctgtaatcccagcactttgggagactgaggcaggtggatcatctgagctcaggagttcaaggccagcctggccaaaatggataaaccccatctctactaaaaatacaaaaattagcagggtgtggtggcaggcacctgtaatcccagctactccggaggctgaggcaggagaatcaattgaacctgggaggcagaggttgcagtgagctgagatcgcaccactgcactccagcctggtgaaagagcaagactccatctcaaaaataagaatacaacaacttaatagaaataatttatgactattatgtggacatgtgcttaaagcagttatcctacagccagttgattttttttaatttttcatttacattttcttttcagtaggaggatatcagagcagttcagaatgtagatgttgaagccagactgtgtgcaaagcctgactcttcctcttcatagccacctgacattggagaaggcattcagttatctgggcctcactctattttgtgtgaaatgactagaataacagtacttgtctcactggatttttgcagggattatgtgagtaaatgcatgcagagttcttaaaacaatacatggcacctagtggattctcaatactggcaatttaatagttagtacatctactaaaattgttaattacctatgatcaaaagtatacatacaaaacaaccctggatatatttattcctgtcacatccattcatgttccaacatgttcttttgaataaattcagatggttttcattcatttctttacccccatacttttactaaaggagctacatgggtaaaactatgtaattaagtatctaagttatcattgttccattaaatataatgcaaactgcatgtacaattgtaaatgttctaatagtcacattaagaataatataaacttacaggtgacacaaattttaatattgctttttttttcttttttgagacagagtctctctctgtagcccaggctggagtgcagtggcatgatcacggttcactgcagcctcaaactcctgggccaaagcaatccttctgtctcagcctcccaagtagatgggactacaggtgtgcaccaccacatccgtctttttttgtgtgtgtgcagatggagtctcactatgttgcctaggttggtgtcaaattcccagcctcaagtgatcctcctgtctcggcctcccaaagtgctatcattacaggtgtgagccaccacacccggcaataatactttttctttaaagaaattttaaaattattttacttttaatattattaaatattattttaaacatgcaatcaatataaaaactattgagatccattgtactagccacattttaggcactcactggctgcacatggccagtggtctgggcactggcaatggctttatttttattttaattttttttttttgagacagagtctcactctgtttcccaggctggagtgtagtggctcgatcttggctcactgcaacctccacctcccgggttcaagcaattctcctgcttctacctcccaagtagctgggactacagggacatgccgacacgaccagctaatttttagtagagacagggtttgaccgtgttgcccaggctggtctcgaactcctgagctcagacaatctgcccgcttaggtctcccaaagtgctagaattacaggcatgagccactgcaccaggccaggcaatggctttttaattcaaagatgctatttcaactcaataagatgcagctttttaaatttgtcactaggtggtgttggagacaaatacagtactgctccttgactagaggaaaagttcttaaaatgatgcagtcaaatcttacagtacagtgtgcctttggctatgctgattacaaattctacaaagatagttatgatgaactaacaggataaaattatcatcttataataagaaacaagcaacattaagaagcaaatacatcctaattctcgtctaacagctattctgaagtttgctgggcccagtttatgtgcaagaccatgaagttttaaaatttcatgaagttttaaaatttctgcaattcctgtaaagtgtttaatttcaccatataagttgcatctgatggaatctctttttatccccagaaggcttagggtgtttaaatcacttgtttagaactacagtttatttagccaaatttcttttccagttacactcttgaacaatacttcacacagcatccaaacaccatagcatctgcccttgaggtttgaataggtgatatttattttgcttgcaaaaactaactaggaacaataggatattttcacttaaggatgcaactctcaaaggtacatgtatttactttctcatcaattacaacagaaatggttttcaagggaatcattatttaaaactaatttctaactccattcctttaaccaattcaaaaatgcctctatcttcagttacttgactgtgttctttgcttctcagtctgaaaacacgtagacaaacaactcagggttccaagctcaccggaaatataattatgcttattatgttacaaagcttctgcacctttaatcagaaatgtcccctcttccaccaagtatgaggattgcacagtggcaggcactgctagctgcttacccaatcattcttcccatgttctttgtaaatataactcagattttgctcagattagctacgtatctaattaaatattcatcttcccactgttggttgaagctaggagtaagtcagacatactctgcttcttaagatataataatttgccaagaaatactgagggaagcatttgctgcttttgcaaggaacagataggtctggtaccattcttctctacttcttcctgccttgaacatgctgtctgctgccctgaggcaattagcaaggggatgaaaactatgaacagcaaaagagagagatctgggcctctaatgcattgttgtgagctgatcaactctaggataccaccttccttcaaacttggtatataaaaacacattaactcactattttatgctgctgttagttgagcgctgttacttatagctaaatttattcctaacatggacaccttcttgcttctgctccctaaccctcactttccttctcaccattcaataggagtctgtatgccctcccctcggagctgatttcatagggtttttcccctcataggtcactattcatggagttgagctagcaaagctcatcccagctaataaatatatttaatattattgttatatcataattctgactcataagtaaattcaaaggtgagatttctatgaaaactgggaaggaatagaaatagatagtgatgctaaccagcatgtaaggggccctttacattttacagaggccttttgcaaacactctttcatttgaccccacagcagctttgcacaataggtatgattaatagtcagtcctcttttacaggtatgaaaattgaaccttagaaagattaagttactcctcactgtcatacatccattataatataaacctcctgctggagacttggtatgacaataccataatttataccatttctacttaattcctttgcttgttgggatgataacaaagattaacatttatcaaagagataccagtgctgtaggcatttgctggaacaagagtgttatatgtgttattgcatttaatcctcacaatcctatagcctgataccattaatatacccattatagatgaggaaagtgagccattatccaaaaacaatccaccctcctcagccactcctcaggctgttcctgacttaatgcctacatagcatatccctatctttagctcctaagatgttggacttttgtttttgagtgaaaaccaagcttctaaactagactcacctgatcttctggcctgtgtttgtacaattatttatttccattgctgttagactgtaaatatcccctgtctttaagaacggcaacaatctggccaggagcagtggctcatgcctgtaatcctagcagtttgggaggctgaggcgggtggatcacttgaggtcaggagttcgagaccagcctggccaacatggtgaaaccctgtctctatgaaaaatacaaaaattagctgggtgtggtggcgcctgcctgtaatcccagctactcggaaagcagcaagccgagatcgcaccattgcactcccacttggggcacaagagcaaaactccatctccaaaaaaaaaaaaaaaaaaaaaaggcagcaatctgtctcatatcatgtaaaattgcagcattaaactatttgattttattttcctattgaaatgatgttaatgaattttggctctgaaagcctgtacttcaaaaaaaactcattggattcctgacttttaaattagcttacagttttctttcaactccaagaagaaggtttaatttaaaatgtacttaataagaaagtatgcacttcaaagataagcaaatacagttttcatgtggtttaaaacaaggactttattgatcaatacaaaggttggggtgggggaagaaaagtcaatacataaaacaagatacttgtacttattctactgatactattgacatcgtattactcttgaacaaaaaaaatcaggcagatttagacagtgggtgtttttttttacttggatataaatatgtaaatgattcctttttgttctgataacacaatggaataatgtgggttctagttttatccaaattctgccatttactggttgctagttactagaccattaacaagttgatgatactctctaagcctcagtttcctcatctctaaaataaagctaatatgttgacccctcatttttatttggaactttaagtaaactaatagatttaaattgtttggccaggcatggtggctcatgcctgtaacccagcactttgggaggctgaggtgggcagatcacctgaggtcaggagtttgaaaccagcccggccaacatgatgaaaccccatctctgctaaaaatacaaaataaaaattaaaaaaataaaaataaaaagttagctgggcatggtggtgggcgcatgtagtcccagctactagggaggctgaggcatgagaattgcttgaactcgggaggcagaggttgtagcgagctgagattgttccactgcactccagcctgggcgacagagaaagaccctatctcaaaaataaaataaaataataataataaatcgtttgccacatgcctgtatatagtatgcattcagcaagtataattcatactcttctctccttaaatctcccaaactaacttgattattttaaccatgcttctcaggtttgttagcttttgaaataaaggtatttctagaaacctgatactaggaaacagtgtattaaagaaataataaataaaagtcatttttaggatatagctatcacttttgtgacctaaataaatagtataggcttcatattataatgacattttgtatgctctttaaagcaattttatttattttcattttctttttaagccctggtgaatgtcctcattcttgggttttactttctagaaatgcttgaaaatagataaataacaatattgcattatgtagatgacaaaagacacgtacatgaaaaagtgtatatttccaaagaaaattggaaagatctccatctttctatataaaactttgaaatgacattgattaaattatagagaaaggctttgtttggtaattttcttaatccctagaaattccaatcatcttcaactgaagatggcaataacgctccttgtaagtaggacaacgggagctcatgacatccacagttgttggagaatgagatttctgactttcagaaaatcatgtgtctgaatttactgcaaataatttaaactgtggctttcaaagctgccccttagagtcccgtgataacttgtgcataagtctctcaagcctgctttacattctattttctttttatatatacctttctttatcactacaaagtgtccctattgagattcagagacaagacttaatttgattttgtgttaataataccatccagcataatggctgacacaggctgatagacagtcgatacaattttaatagagtaaaagagaaagaaaaaaaggaaagatggaaggaagtaaggagtagggaaagagggaggaagagaaggaaggagggaaggaaaaagaatgaaggaaggaaggaaggaaagaaggaaggaaggagggagggagggaggaaaagagtgaggaaaaaaggaaggaaaggaaagaagaaaggaagcaagggagggagggagggagggaggaaggaaggaacgaacgaaggaacgaacgaaggaaggaaggaaggaaggaagtctcctttgtatcagaattgaaagctcatatttatttcagtctgcctttcttaaagtgaccacattttgaactgagttcattacccaagcagtcattaaagcaatcctattgaaatactattactcctttaatttgtaatgacttcacctaacatcatcttttgtctgaaaggtttttatttgcagatggcattcagacaaaaggttagtcattttttaatcaaatttgaagcacagtaaatgacaattgctccttggtaaaagatgacaaaaaaaaaatctaagaaacttatgttttattttgtacttctccacagtgtggcagcagagacttaagaagtggaaaaagtcattcagagtctggttcagggagactcaggccacagagatattctcaacacatatacatgagaatcaaatggcaataggttcatctgtgctcacaagtcctgaacagaagaaaatattgcttaacaagcatcttatgtttgctgtaagatatgcattggcttagctgaagttcccgcagcatttaataggtaaaatctattggaaatgttaatatttcttttggactgaataaaggtctacataattggctgatttatatgatattaatctactgaaagaatgtccagttaattgcagcaaacctttattaaacaatgaacacaatctcgctttatggcagttctgttaaataaaaatagcagcaatcccatatgggtgtcacaaggattagatgagataacacactaggaagtgcatgtggcttgtgtggagtaagcggaagataaatgctgttacattgttaccattttctccactgctaccattgccattccacctccactcacctgataccactatgttccaggcagagaaacactagtcatttgtggagaaacaaaaatgactaacaggacagccctgctgtggaagagttccttctccagtaacagagatgaaggtgtaattaaataaccatgtcattgtatgatatgagaacaaatccatctacctccacatgtggcttgggatttgcctttacctttactattccagaagactctcgttcaggcaaataacttaacagctcattacgttaaagaaacttcctgaaaaatccatcagctcttcatgagaaagcatcaacagacaacaaactcatctttatcaacagcttgtgttggtgatatgtgagaagctggcattggacagataagtaccagaaggtagcataatacactatgcatcctttatcactggcatgaagaaatcagaaaaacatgggtttgaatcctagatctgcctcttactatctgcaggattgtgttcaatgtattaaataatcatcagcatatttttgtattcaccaatagtattttccccagtggtttgctgtgagagtggaatagtgtaacataggcagaaccttcagccttcacgtggcatgtgctaaatgctcaatacattttttctcatcttcctcttaatcattctctattaactgctctttcaacgttgctactttattgtttttagttagctgtcatttagataaccacaagaggaatgaaaagaatccaaatccttggatgaacaacggtacaaaacatatttagtccactctgttgggtctatggatctgtacgacctgaaggtaggagaaggatttaggagagcttggtttactaataagcctaaaatagcacctcctacacaagaaaacaggttaaaattatgatcaaacactagtcaggtttcctttcacaaaataggtgtaggtcctttcaacaaaagagctttgtaaattacagcagatgacaaagaccttgagaaaagtgaaggtattagccttgtgttgtcactctttctaacgtgaggctgtcagaccttctaaaaaaccagaaaaatgttaactgtaagatggtccctgaccctttggagacaatgcggtttccctgatgtaaccttacaaatgaaccatttgggtaatttgcatgagctgatattgtttctaagtggtatttatgctttcaaaaatgacagtaacatgatgtctttagtaacatttcccaaggagtgaacatgttcagttcagcagagaaaagcatagtgtcactaactccaggcaatcagattgctacaagcctaatgtttttcaacacagcacacagaggaaaaggacagatattttagaaaagacatcattgtattattgatatccacacaataaaatataactgcttcaagtaaagtgtatgtttccacagagaactcagagccaacaaaaacagccctaatgggaaaaatagtaactaaataattatggctcttctttcctcaaaagaattaaaattgcatttatggataagcaaacccaatcaacacagggtcgttggagggttacagaagaaacaagataaaaataaaaacggaaaaattcaaagtaaaaggagggatagaaataggaagcaactgttaaattaaaacaaaaaaaagtgaaagaaagactctctctcaattagatattctcagatatttgccctcacctctcacaaagagagtagtggaaaatataggctctccactccttcccaaggaaagcatcactatctaagcctgatgtattcatcttctgggggagatgtgtgcctgcaagaagacatttcattatttaccaattaattaattaactcattcatactttcttacttctatcctaaacatgacctatgaagtccatttgatttagccactacctatttcccagtattacctaacataatatgttcttacattctagctatcctaaatttctttcagtggcttcaccatctccctccttttctctagaaatgatttcttccttctttaccaagctggtttccacttatcctttaggttggtgcttaaccatcgcttccctagagatttccatatgcccctcaactaggctggagctcagtgatgggggctcctgatctggaaaaactctccacttctgtactgccatactcattgcatttataagtttctttctcaatgggtgctatagtttgaatgtgcaaagatcatgtgttggaaacttaattcccagtgcatttgtgttaagaagtaggaactttaggctgagtgaggtggctcatgcctgtaatcccagcactttgggaggcagagacgggtggatcacgaggtcaggaaatcgagaccatcctggttaacacggcgaaaccccgtctctactaaaaatacaaaaaaattagctatgcgtcgttgcaggcgcctgtagtcccagctactcaggaggctgaggcaggagaatggcgtgaatcctggaggcggagcttgcagtgagccgagattgtgtcactgcactccagcctgtgacagagcgagactccgtctaaaaaaaagaaaagaagtaggaacttgagtaattagatcataaaggcttcagtctcataaatagattaatgtcatcatcacaggactggttcattatcccaaaagtgggttccttagaaaaggaggagtttggtccttcttgccttctctctctcttttgccatctgctcttccaccatgggatgacactacaagaaggcccttgcttgatgttcatccttcagccttggacttccagacttccagaagcatgagacaaataaatttctgttccttatacattacccagtctgtggtattctattatagtagcacaaaattggctaagagaatgaggtctgtctcttgtgttcaccagcgtgttatcatcttcttgcagaccagctgcaaagagtagtagctcaattgattattgttcaatgacagaataaacaaatcaagaaactggttgatgaatgaaaaacatctagcaaggaaacttatgttgagctctaaccttgagcaaagtgctatgagaagcaagggtgtaggtaagggaggaatcatagtgtcttcctaaatatcttcagaaaaagttgtcatttccccctttgttgtcccacgaataatacttgtatctcatgtataatatacataagttctcttcatatagcccaaagttgagtcaatgtacaaagtaatccagctctattgagtcatctaaaatctaggtcagaaactgtcacatgtgcatatcaaagggcagaataagtcctaccacaacaatcacccttttcctttcacccactgaaaactaatgaaaggacctggggagaagtacaggagagacaagattggtggatgttctttttctctctcaaactccccaaactaaattggttgttgacatctgtcagagtcactaatcaatatttagggtacttataaaaaggaaaggcttgcatcagtttcttctcctgtagacagctgagctgaagaatactcaggtctccctcagcacgagtcagaaaatctgtgcagaaccctgtggagttgtgtctgggaagagttttcgaacatgaagttatgcctgggaagaggaagtttaggaacatgaagttgtatctgagaagattttagcaacacatgaagtttaggaacatggagttgtgtctgaaacggtttaggaatgtgaagttgtgcctaggaaaaggaagtttaggaacacgaaattctatctgggaagagtttagaaacatgaagctgtgtctgggaagagtttggaaacatacacaatattagagactggttcctgattgcactctggagaataccaaagactggtggaggattggtacagcagcccatgtgtgcagagaatgtgatgtagcatgcctgggaaaaatgggtacagctcatcccaagtccatgaaacactcaggggatgtcagagaagatcctcatagctttttgtgaagaacaatggaaattctaaggcttcatgaacagctgaaaagtctaacatagataaaggggttgtacatcctccatgaaggcagggccacagtgaagctgaatatacactcccaggaaaataatgagtacaacatactcagaaacaaccacgtcagagtgggatccaggacccccttcctgtaaataaccataaacacaggtatgaagtatttttctccctccttactctgcctcacataccagaggagcccagtcataaatgacacaggaaagaaagcagagagttttgaacctgaaatgtgattgggaatttcaacgtcctaactttaataactaaaattaatcagaaagttatagaagattcccaatatgtgaatggaggcaaagaagcaggggaggtacatagtaaaattggagacagtttgtaaaagaaataaaaccgtcttgtgtttatgctccaatgaatcgaggtatttcaataaactggtatgtttctgttaatcattgattttttttatcctgcctaatacgagtcattacatgcctacactccttcagggttaagattatgccttacttatttctgtaacagcaaccctgttgctgacatattgactgacattcatcaagtacttgttgaagaactgctgtgcacataaattcaaatctcccttaacaaaaggttaaagaaacaatcatgggagtacaatgccaccactagtgcacctgtgcttggtaattaccctctctgcatgcacagctttccctgatacattgtagaagacctaaactaggaaacttctaataacctctaccatttactgtggggtttgctatgtggatgttatcctatttattccacacaaaagcctacggtggtattattcttcccatctcacacacaggacaacgaaagctttcagaagacaggggcttgcttcaaggtcatactgctagtaagaattgaacatgagatttcccatcccaagactttgagattccaaatcctgctcctattccaccctcccacatttttcatagtgcctcatccctgaatttggaataagatcaagggtagtacacacaccccctactccatcaaacattcactggctatccatgggatcaatatattggcctggcaagtccatagacagacacagtaagcacgaatgcctcaaatccggcatcaccctggggagttagttgcaggaaattgctttcttccctttcttcttctttttttcttcagcagtcagttctaagacacctagtagaaaccatttgcattttctctacagtggaggagaccctaaccctctaatcatcaaggaaacacatataggctgaacagcaacctgctggtgggagatgcagcgggtgaaggtgagcagaggaatcagtctatgaaaacttgaagctctcagccccattcagctctcaaccactcagggaggcctgaggacactgaaaggacctgaagaggtaggacctgccgaggtaagccattaccacggcggatgaaaatatccctacgctgtggtggagaagagtcatttttcatctgtatcaggaatggggttctactaagcttgtatttgaaattacacaattgaatcccctgtaagtcatctctgttctctgagcaggccagtgatttctaaatgtagaccacataggatgtggccgaactgccaggatattttcggggacactgaaacagctccttgataaacccctgcatagcctggagcccaacaggagagagtttgagccctactcaaaatcatgttcagtttaagtaacagctaagagttgactgcctcttatggaccatgcactgttttaagcactttaattgatttagtgaatcctcccaacaagcctataaagaaataccattattacatccatttatcccactgagcaaaccgaagaaaatggggcttgagtaattttcccacggtcacggttatcgactgattatttatgtctctccaccaaattcacatgctgaaatcctaacccccagtgtgatggtattaggaggtggggcctttgggaggtgattgagacttaagggtgaagctctcgtgaatgcgattaatgcccttataaaagaggtcccagggaactttgttgctctttcacccatgtgaggataccttgagaaatcagccatctatagcccagaagagccctgtattagtcagggttctctagagggacagaaataataggagagagagagatacacacacacacacacacacacacacacacgtatatgtatgtgtatatatacatatgtgtgtatatgtatgtgtatatatacacatatgtgtgtatatgtatgtgtatatacacatatgtgtgtatgtgtatgtgtatatacacatatgtgtgtatgtgtatgtgtatatacacatatgtgtgtatgtgtatgtgtatatacacatatgtgtgtatgtgtatatatacacatatgtgtgtgtatgtatgtgtatatatacacatatgtgtgtgtatgtatgtgtatatacacaaatgtgtgtgtatgtatgtgtatatatacacgtgtgtgtatgtatgtgtatatacacacgtgtgtgtatgtatgtgtatatatacacacgtgtgtatatgtatgatacacacgtgtgtgtatgtatgtgtgtatacacacgtgtgtgtatgtgtgtgtatacacgtgtgtgtatgtgtgtgtatacacacgtgtgtgtatgtgtgtgtatatatttatatatttatttatatatataaattatatataatttaattatatattaattttatatgtatagttaagtattagctgatcacaaggtcccacaataggccatttgcaagctaaggagcaaggaaagccagcccaagtcccaaaactgaagaacttggagtgcgatgtttgagggaaggaagcatccagcgcaggagaaggatgtaggctgggaggctaggcctgtctctcctttcacgtttttcggcctgctttatattctagccaagctggcaactgattagatggtgcccacccagattaagactgggtttgcctttcccagcccactgattcaaatgttaatctcctttggcaacaccctcacacagacacacccaggatcaatactttgcatccttcaatcccaatcaagttgacactcagtattaaccatcacaaggcccctcaccagaaccagccatactggcactctgatctcagttttccagcctccagagctgtgaaaaataaatgtttgtcgtttaagccaccaggtctactgtattttgttatagtagccagaattgactaagacagtcacacagctaagaattagtgcagctgggatttgaacccaggtgacctcattcttaagagctacatcatactcaagtgaataatgtctctgcttttacaggtcttagttaaaattcacagaagcgttattttctgtgggggtatctaattaagaagtgaactcagaacttggcttgatgtttcagtacagtgtgtagccctgagtaagcaatgtgttatgaagaagcccacagaggaaattttgcaagacaatctatttctccttttacctttaacttggatagtttatttttaaatgaaaaatgctgcctgcccacctgagaaaataatttaggaaaacatttctaccattcttgtttcaatatactttatccaaaatgtgtgatatttatagactacttcaattggggtaagcagtattcctgggttgacttttatgtggggaaaatgtatgctcttaaggcatataaagataccggagcattcttattccattatcttttaattaaattgccctctattatcatcttgagaagtagaattgtgaacttgttgaagcatagaattgggcatccagtacttttgtcataatcactgcatcttcttcaattcatttgtccttcagagctttatctcttttgtgcctttaattaccatctacaactacacccagctttgaaacacagtgctccttccacagggcagcatccaacaggggcatccagtgacatccaaaatattttcagtgaatattctaagcaagaaacagaacagatacacttttctcaatattaataacacacactaagaactgttccatgtaatttaatataaactctcattttattgtgtatacaactgccttcatgtgaaaaatggggccaatgatagaatagtccctttaattcccacatatggttgtggtaaggattcaatgaattcatgacataaacttcatgaacggacttaacacacagcatgttctatcaagtgtcagctcttgctctttttctttgatctctctacttggaggcttcacaagaatatcaaaaataacatatctaaaactgaattcatcctgttccctaggactacttgccatgccactactcccctaacttctctaactcaggaataacatcatcatatcaaaaatctggttgtagggttgtcatctaattattcctttcttgcattgcccaattgcaagtctcagagtggctgcctcaaaaatatatcttgactattcattatcttcacccaaagaaccacctcctccaatttggactactgaaatgccttcctaagtgctctctccaatttcattcttaatcatctcttacctttctcttcatagcagccagagtaatttctacccatgcaatggatggaagttgtttcaatgatgtgtctttctcagatgttccagaacaatgtggaaagcatgtgtgaattgtacaaaagcatcctcatccatggagagcattgtaataaaaaaaaaaaagctccatttaatagttcttagaagcagctgtctttcaaggcatgataccaactctacctcctctagagggtgatggggaaacatagcagttttgagagacaatttaaacactaattacttcaacatgtgtctgttatagttactgctgcattaatagaggcaaataagttgacaggtgattgtaaaatacaagactattttaatataatatgtgttaggatattttacttcagtctacacataatcatcccccatgccaattgactgaggagattcatttaacacttcagagactccaggaaaaaaaaaattgcaggcaccacattttttaacctctttatgagagctttctaaatgaataacattattgtacaaaatgttttaggcaaatatgtgtagagcaaaatacattttcacctgccaccgtatattctgcagcctcaactttttttttcttctagagacagagtcttgccctgtcacccaggctggtgcactcatagctcactgcagcctctaactcctgggctcaagcgatcttccggcctcctgagtagctatgactaaatgtgcatgccaccacacacagcttacagtatattctttatgactaatcctttctacccaaagcagtaaaagaaaaaaataagacaaaaaatgcaaactgctcctcaaatgctcctacccttaccccatccatctgtagcaaagtggctaaaatcatgagctctggagataaatcctacctctactagttactacctgtccaaccataggcaaaattctccattcctctaatgttaaaagcgttatctgtaaagtgaggatgaaaaaaaaatcacaatatgtatttcattagattattgaatggattaaataagttgatatttgtaaagtacttagaacattgcttagcacatagtaaaaaatatatatatttgcttatttttattcctgttgctaaggtataaatgtttgtgtccctgaaattccatgtgttgaatactaacattcaagctgatggtgtcaggagatggggtctttaggaggtgactagataatgaagacggagcccccataaggggataagtgcccttattaaaaaaaaagggggggacactattcaccaactgcagagagctagctagccccttccaccatgttaggttacagcaagaagattggtcctcattggacatcaagtccagtttgatcttgaacttcccagcctctagaaactgtgagaagtaattttctgttatttataaggtaccaagcttatggtattttgttaaagaatcctgaatgaactaagacacctatggtctttattttttatgtgtcaatgcctctgtgctagatgaggtgattaattctataggttgtgtgtgtgtgtctgtgtgtgtttaccaccgtcaaatgctatatttagtatgagcatgcactgttaacagtgacttgatatgatttagtcataaataatattccctggagccaggttaaatgtaaatatgcatcaattttggtaatttgaaatgacttagtcctcaataatattcactcatctttttcttttctcgtttccttttccttctttgcttccttccttccttccgtccttccttttactttccttctttctctttcttttctttcagacagaatcagtctctatcacccaggttggagtgcaatagtacaatcatagcccactgacacctcaaactcttgagctcaagtgatcctcctgcctcagcctcatgagcatatgggactacaggtgtgtgccaccacacctgggtaatttttttattaatattttcagacaaggtcttgctaggttgtccaggctggtctcaaactcctggactcaagcgatcctcttacctcagcctcccaaagtgctaagattacaggtgtgagccactgtgcctggacttttttgctttttgacacctttacatggaggctttgaagtactcttttaatgatatattggataatgtatttcttccttaaaacattaatatggatttagaatatccaaaatgtatgatatttctgccatgtttctttgccaacattttttccatcctgtgaaggggctcaggtttggtatgagtctgagcctctctcctcctcctttattttctccactcttgaaagaatggagagacatagacatatctgggtggtagtgtgggaagaataagctggcatgctcttctctgctcactcctattttcacctgcctcactgtggtagcctttctttgctccagcccttcttatggatggttaacagtgtctatcattcttggggttagggtgtgagcccatttggctctcacactaaacagatgttttggcttccatgttttccctattatttccccatgtttgtccagaatcagataagaatgaggtgctatttattgtgtgtcccctagacattcccaaaaatgtttatgtgactgtaagctcttgcatctgatttttcctgaagtgttgtctcattgagcttctttctgacttatgcaatagccactatgacttttttttcttatgcttctttcaattctgtgaatatatccagttctttttcatttttggcttttacacctgctaatgttttgcctttttactcttcacttacttaacacttattcgttctttaggtttcattttaaatataaattcttcagggaaaccttctaagtcagtctcgtgttattcccttccataccatctaatctttttcttcctatcacttattttttgaaatattttctgtctatctccattatcagattgtaagggccatgaaagcaaagagtgctgtctgtttgcttgactagtgattttttttttattttttgcatcatgcgtagtgccttgcacataacaggaagtcaataaatatttgttgaatccatgaatgacttctgtcttaatttacttgaacaaccacaaattcaacatatactatgtgcaaagaagtcactttgctatgttagttatgtgctcctgccctctggaagactgttttccaatagagccagtagcagcccagcttgaagctatcagaaagtcatcttctccttctcctaacttggggaatttccatgctttatttgacaaataataaccagcaaagtgcacatcaataaagagccacttattaaaagaatgagcaatttaaccaaaaatatctcaaaaagagacttctatgttagattttataaccacatgtaaatcacaacagtatatggaaaaacacttagatcattatatttcatttattttgcatagtttatctttccaacaatatggaaaacttctaggaggcaatagtcctaatttcatctctgtattttttaaatgcttagtattagttggacaatttgtaggtattctgtaaacacatgttgactttactgttcagtactgaaaagtaaaataaggatgttctcattacttatgaactcaaatgtgaagaggagtagagaggcttacatttgaacttcaggcaaaatactcagccactttcccaacccccataaaaatatttaaaaaatgacagatgcctcacaaaataagtggtatcctaaataatttactcattggtatagcggcagctcatttcccagaatctgtaatgacatttgtttttttatttaaaggataagaatacagcagtgctcatgttatcactagggtaataattattgttgcaaaaagcagctcctattcttctggttgttttaaattggggattcagaggtgtaggaagaaattatagattattattctttgcttcttaagtgatgcactctttatatacaactgaaataattaatagaaattcaatcttcaagttattgtgacatattttaggaaatcagcagtaattatttcctatctaatttttataatcattagtaatcaggtaagagtttatcttgttttgaaaattaaattttattgagcttataaactacattacaacaaagaaaaataaggcaattttcttattactaaatcaaaaacattatccaattttttttaactggaagttttcttcgatgaatgaatatgcagatggcatatgaatggatgccatcatatgatgaaaggatccatcatgaaaggatggatatgtagacaaacatatgaataagcacctgatatgttttggatctgtgtccccacccaaatcacagcttgaattgtaataatccctacatgtcatgacatggaccctgtggtaggtaactgaatcatgcaggtaggtttttccagggctgatcttgtgatagtgaataagtctcataatatctgatggtttaataaaggggagttcctctgcacatgctccctcttgcctgccgccatgtaagatgtccctttgctcttccttcatcttctaccatgattttgaggcctctccagccatgtggaactgggaatccattaaacctctttctttataaattatgcagtctcgagtatgtcttgattagcagcatgggaacagactaatatagcatttaataatattctcatctgtatgtaacaaaattgaagttatgcacctttccttgattgattgatatgtatatcaatctattcatatatatagatttatatatatatagcttataactttaatttgtcttaataatcatgtatcacctattgttcttgatattgcaccacaaggaacacaagtgtgaaaaagaattctatgagatctaggggttcatattccagcacaatggaggccatatttacagagactaagttaaactccatacattttccacaaacaaaatttaacaatttttaaggaaatattattaaagaacgctgagagcactccaggttgtctatgcttctactcattgaaacaactcactcctccagtagcagatgagttttaatgaaatgcctgggcaatgtgaggaaatgctttttccttatcagatataacccacaacaaatcacaaaagggtactttttaatagtgttttcagggaacgggtctacccctacccttaggctgacaataatgctttaagcttttcctacatacatctgcacacttaagaggaaagaatttggcttataacattttaaaactcattaattaggatgccaccattacaagggttatggcattcagataatgcctaggctgccgtttccatttgagtaaagtaatggtagtaagtgaacatatactgtccaagataataatgaatatgatttgttgggttgttgattatattaaacataaatacaaaactgaataggacctcctaagggagaccctcagttattctgatattgttctactcattcccttaccttggctaatattttttttaaaacaagcaataagaaaaagatgaaagaatcaacaattcctaccacattgagacgtggaatccttggcctatattacttttacactcatggaagatgttgcaacataatggaaggggcatggacttgggccgcaggaaggacttggttcaaattctggtcctgacatttctagtggggttgccctattttttaatcagtaaaattggactaaaacctatctaaggattagtataaatgtgaaataaatgatggatgtaaagagcctaccacagtagttggcatataataggtgttcaaaaattgttaaatgactcttacattgtagctgttacagacgtaaaattcaatggatagaatagaaaccatttacaatgccttgaaaaactcaactacgtcagatttaaaaactgatttgtataatcacgaaaaggaaaagtaggacaatcacattaaatattgtataatcagactttgcaaattcaatctgaatttctttctaattagtcaaaattagtgaggtatggttgttgcatctcttaactactgtaccacagggtccggtcatcacctgcttctatttatgtttgctgttcccgtaaggaatcctcctaggtacaagtcccattaatagaagctggaacattgcctaaatgaaaaattttatgtattccttacttcctgaaggaactgccacggggtcggtcctaatcagcacttcattttaatacagtatcatcgagttctaaggattaattttataaacgattaatgaaagtacttaattgaatgtcactctctgctgccttcagctattacaggttgttgctctcactgattccagatcgatgcttttttaaacactcagctttgcagtactttaaactactttgcagtctctaaacttcatttagagactcacctgtggctcaaataaaacaatctgggatttgagttattgttgttgttgtttttggaatgattgtacaatgcttgaccagcgacagttcatgttgatttcctccaacagttcatgtttgctttcctccatagaaacagaaactcaaccgggcatggtggctcatgcctgtaatcccagcactttgggaggccgatgcgggtgtatcacgaggtcaggagtttgagagcagcctggccaatgtggtgaaaccctgtctctaccaaaaatacaaaaattagctgggtgtggtggcgggcgcctatagtcccagctactcaggaggttgagacaggacaatcacttaaacttgggaggtggaggttgcagtgagccaagaacgcgtcactgaactccagcctgggcgacagagggagactctgtctcataaaaaacaaagaaagaaagaaagaaagaaagaaagaaagaaagaaagaaagaaagaaagaaagaaagaaagaaagaaagaaagaaagaaagaaagaaagaaagaaagaaaggaagaaaggaagaaaggaagaaaggaaggaaggaaggaaggaaggaaggaaggaaggaaggaaggaaggaaggaaggaaggaaggaaggaagggaaattcaattttgggggttgtggcaaacactacagctaagctgcaagttcttgcacccttacaagtggtcatgtggcatggctttcggccaatgaaaagcctgcttaggatttctgcaaaagttttgctgtccttttacaggttttgccccttcctccatattgcttctgttctttcctcctgcccagagcatgaaggaagatacagtgcagcagctatttttgaattaggagaatgaagactaaggagactggaatagaatcaagattaattcagcagttaccataataggcagcagcatggatttggcccatagacattatttgctgacccctactatagacaaatggattaagttcagcccagaatcaagacagaataggaagggaaatgataatacaaactgtgcaactgcagaagaggagaaagggtgcaaaatacattaagaacacctgtgtccacagctcactcagtgacggaacatcaagtaccaaggatatgtacaagttccagacagtggttaaagcacacttcctcaggttaagataagttcaggaagtggaaaagttcacactacagctgagataattcagttttgagataacaggatgagttggagctgaaactaatggaatgtgccataaaattgtatagaaatcaatcttagttttttttatcttctttttcttcaaagagggtttgttataataaaatattctcagacctccttctatccttgttatactttttaagacaccctggatggtagtaaatccttggattccatttcaggatataagcagaaagagatgggaagagaccatgaaatctctcaagagagaatgtcaagagaggcattatcatcattatggtctctcttgcatgatctcaggtattatgagataaaatacaagtgtactattgctttgtgaatctgaggctatctggcctttcttaacatgaaatacatcatggcatgtcttgaaaacttaagctttgatcatgttcagtgaatagagaggattgaacgtttgatcaatctaatgaattgaaacacagttcgcgaggaactctgaagacttttcattctgtcatcattccactatgtggtaaataatagctagcacatattgatcacttattaggcatcaggcactttgtagtgcgctgtatacagtctacaattgagcgcatctaatcttccaaacagcagtataaggtgtcatgaccatgctaacttttcagacagtcttatagggaaagggcaagtttcttaacctcaatttgtatgaagcactaagatatttcaatgaatattccggatcaaatgtgtttctccttataatttttggtggcaaaaaaaatctgctgtcaaatacataatgtacttttgtttcctaggttatacagctctagctacagtcttgagccctacacaaccctgaaactgggagtaaacaaatgtcacaaacatgactgtattattctttaaaacattttatttacaattcagtttggtgagtagttgtctttaaagtttttattctttaaatatttgcttttctttctattttataatatatcaatacttaggaaaatacagtctgaataaatgtgtataacttttcaaaataatttttaagataccagcaaaaatttggtaaaaattgggcaaataattgttgatataatatattaatgcacaaggaaggcaacgcatagaccatgagagctctcagctctttgtaaatgtcttaaaagctacataggactcattgtttaagctaattctatatcattggataaggagttatcaaaagcttccaagtaccacaataaaataagtatattaatttatttgtttattcattcagtaaatatttattgataatttttaaggatcagactaaacaagatggaccaagtcctggctttctcagcacttgcacatcaacagacagctgtgtccacaatcagtaagttgaggatggcaggacagatcaccagagcataagcaaaggtatgagctacactcacagctaagacactgaactatctgccctgggtctaagcaaaggccacagggttggttttccagaagctccaagataggtgcatgtatatccagatccaatgttcacagcttggaactgtaatctttaaaagctaagttgagggctcaagtcaaaacatttctctcccaataaaaatcatgactacttgcagaaggaaaagcctggctatttggtttttagggagtcaggagcactaacctgctctttcagcttgcaagcttgcaattctaggcttccaagtgaaaaccaacctgcttatcttgcctcatctagaattagaggggtgacagaggaaattgggaagtagttttgaaagctgcagtgccttccttcctttccttctttctctctctctcttttcttccttccttccttcctccctccctcccttcccctccccctccctccctccctccctcccttccttccttcctttttctttctttcttgacagtctctctctgttgcccaggctggagtgcagtggcacagtcacagctcactgcaacctccacctcctgggtttaaacaattctcctgcctcaacctcctgagtagctggtattacaggtgctggccaccatgcctggctaatttttgtattttttagtagagatggggttttgccatgttggccaggctggtctggaactcctgacctcaaatgacccaaccacctgggcctcccaaagtgctgggattacaggcgtgagccaccgcacccggcctaaagctgcagtttctttaacttgttatttactataatgtcaggaaagggcaagaatcttgaatctgaaataataatgatgacaatggggttgaaaaaaagtaaaaagttattgcctggaggtaagattattttttttaacctagtattttaaatatattattttattctactttaggtgttaaatacatgaagtagttaattgtcagcaataatataatgtaaagtcaaagtacaagaaagtcttatgctttcaagccttgatgtaaaaaataattatatgaagtaagttaggaatgaggtgggtaggaaattgagggtgccttgctattttcagcaactgtcagagtgttcggtgcatgatacatattttctgaatattttcagaaaatcatttctgatgtgtcagtatactttgagtcttggaacacttaactgcaaaacgaagtcgctgtgatagagaaaaaggaatatgtatatataaatgcagagatataatgagatagatgcacatttacattttgaaaatcaggttttcttcactgcaaaaatatgtggggttcttctgaggttaataattattacataagaccaatgataaaactgcatttctttgttatgaagcctaagatattaggtgtgttttcatgcaattgcattttaaaaacaattcttgcaatcatcttattttgtagtgatgttcatgaacatacttaataatagatacattttttattacaacaaaatactactttaataaaaacaccaagttatttcgaaatgcacaggaaaagtttctctccattgttgtgcatgctgaaagaccacagtgggaagcacacaggcagagggaaatctcagaaatatgaactgtaacaccacacatagcagcattctggtctcacaagtcagtagatactttccccactaaaattttgtttcaataattaatataagcttttttcatctgaagtatctctaaatcagagaaggttaaaatcaatctgtatgtatgaacttgctgacaagctagtgtagccacttgcctttaggtttttattattttcccagtggctgatgggcaggcagcagtgttaagcctgctaactgaaacatattctaaattatatggatctctggaggggatgcattctacttaaccttggcgtttgttttaaattacaggaatctaccatattatattatccaagatttttaaaaatagcttttattccttttctaaattgcatctcaaggttgttagatttcctattaaaagctaattaattaaagagaaaatacatacatatgtgtgagtgtgtatatatatgtatatatacatatgtatatatatactcttctacacctgccagccagaaccaacaataatattgtcccaagctatatagtacctgcttccaaagaagtttaaaatccattttagagagccaattattgatgtttaaagtctgtaaatcatgaaggtagcaatacttctaagtatcaaaataaaagctatgaaatgccatatcatgaatatatgctctctcacttaaactgttagaattttcattttttaaataaattttattgtatgtatttcaggtatacaacacgatgctattcctgctctgtttgctattcaaaatctcccccttttgaaataatatcactaaaaggactaaaagcaaattgtttgcttaatgggttgactgatttttaaagactaaaagagtcaaatatagatgacaccaaaatgtggtccagaaccaatagcttgtctagcctgaagaccggatgaattattttaccccattttagaccatttccatctgttatttccaacacaaattaaataagtcacaagaaggtatcatgatcaaggatacctttctggagaatagccatgttgattttaaactaacagaaatttatttgtggggtaagtatggatacttaataaggaaaaacagaaaaaaacttttaatagtcccttatttatttcaggtactgtgttagctaggtattttacttattccttctcagcgaatactataaaacccatttattaagaaattgaggctagacgatgtaaaagaaatgaatctggaccaattcctgcaaatcatgttaggaagttacaagaaagtaaaaagattcatagtcaatcaagtgctgtgaatagccattgagctctggaaagccatagaagcagacacattagatacaggatagatggttcctgtagaaagctttacagaaactgaaaaagcctaaagctacttaaatgatggtaacagtagggtagagtagtacttaaccatatgacctttggctagactactgtatttgaattacggctctgtcacacactaaatatatgattattgataagttattcaccatctcagtgcctcagtttccttctttataaaattgcaataggacctactgtataaaacctgtgataatttggtgtcaaatgcacataaaacatagcatagcaatgtgtataaagtacacatatatcaaatgttagctctaattatttctgtgaagacaaatatattgcttgtggaacacatggggagatcgatgttgtctttacagacactgcagtgcactagaagagcatatcagtaatatcttgttctttaaataaattactagcattcatatggtatttatcctgaacagggaatatgataaagacttttatggattttattttcatttaattttaatgggattttgatgaatgtactattcccattttgcaggtgaggaaataaaggtaaagtgaatcttaagaagttgcttgagtccatagctgtagtgatagtgcccatattgaaaaccaaatcatctgataagtccagttcctgaccactacattatggtgcctttctaagggataatgtgacacaggtatagaatggtgacaattgtagccataagtgccctttccattttcagccctccagtgcttcatgaagtactgtgttcatgaggggctgctgaatgactgcctgtaggacacatcttcccagagcacacaccctggcagatcacagcccaggagaaccacgagcccatctgaaacctcagaaatagcccagtgcctgcaggggatggtgctgcagcttcagacaggacctccatgaggggcagaagtttggtgaagtatccctgatcacagtcagcttcacatcgtagggctttgaaacatgatgctgtcaattcatcttgaattgttcaaggtcaaactcaggcattcaatgctgtatcgttcctctccactcaattccatccctttccattccatctcattccattttttccattcgctccactgtattccattccattccactccactctactccattctgcgcaaacttattaactacttactacactacttagtctgtaagcaaaaagcagctgctgctctaaagatgaataaaattaggcttaacacaggcttaaattaggcttaaatcaggctgaccaagttccattcagtaggcaagtttaaagagccaaaatctataattttaatacttttagctctaaagctagaattggacacagtgttcttccaatgtatagaaaagtctactcagaaggctttatttttgaggacttggagagagttaaataaggtattttcgacatatgttttcaatgaagcatgaaaactagaaaggtgtgtttcactggctgaggatacttcccggtaagactcaaggtctaccatctcaaattagagttctctcaaaggtgctaaactctactgatttttttatgaatcgcatgtttctatattttttttgccaaactctcccttctgtaaagaaccatgatttaagctagcaacgacaaatgaagcatagttaccctcatttgatttgcggcatttcagactcaactatttttctgaaacatctattttatttcaatagagacaagaagcctgctagtttccttaatcctgcgttttaaaaacatacttctatatgaattggagaaatgaaatgtgctccatagtttatgttattccttacttttggaatgtatcctaatctcaggattcttcattactctgactacatattatatttatttccatcctaaggtttttcaaagataggcatgtggattatctagatcaacaatccctaaagggcttttaaaatgtcaattcctgggccctactccattcctgaaaatcaaaattttgaagcagaaatctgagtctccaaatcatctcccttggtatatctcaccttctatctccctttgcaatcacaagacagtgaccaggtccagtgatgatatcatgggctgtctgtcacctgcctgacagtgattcctggagactctcacccaaacaaactctcacagaaactaggcaacgtaagagacaggaaggttcagctggggaggcttcattgcgtcaggaatgccttatataattccagaaggtcaacaagagaaaaccaggccaacagagcataaatgtcaacatttatgggcccagctggtgtcctgctgaggctacgtatttgagattttgcaagccaggcaatattgcaagttaacatgctgtatagattctgattctgcaggaaaattctccttcagtgttgcatagttgcatttactaattctgctttcttagtattttgtgtatttgttttactttgtattttaagtttcagctaaacaaatgacaagtaaccaaaatacgaatgaaaggactatttcctatgcagctactgtgtttacatatattacctcatttaatatggttaacacgtcagggcacggtggctcaagcctgtaatctcagcactttgggaggccaaggcaggcagatcgcttgaggccaggacttcgagaacagtctggccaacattgcaaaaccctgtctttactaaaaatacaaaaaatatagctgggtgtggtggtgcgtatctgtaatctcagctactcagaaggctgagaaatgagaatcgcttgaactcaggaaacaagggttgcagtgagccgagatcacgccactgcactccagcctggctgacaggatgagactctgtttcaaaaaaaaaaaaagtaacactttgagaataggttcttattatctctatattaaaaaataaagcaaacaaaacgaacagtggataattacttacccaaagttaataaatcttagcattggatcttgagccctgtttctttcaaagccaaaatctatattttattctattacactctgctgtttccaaaacaggccaaataatttctacccctcaaacatttaccagtggcagaaaacaactatgaaatcacactgaggccataaagtaataagaggaaatttctataaagccacacaaccatctcatttccctgtggccacactttacattcattcaatgaagaatcaggatctacactgcaccacacattgggggctgaataagcacagacatacctggtaatctttgatttctcagactctacaggagatcaaggttctggcaaatgtagaagtacctcaaacctttctggtcattttcaaacttaaattctgtatacagtacaagcatactgttgagggtggctttaatgtgtaaaactgctgcttatggatagtggcgatgggtgatgttgccacacctcatcactgcatgccatttaataccttttatccattaaagttcaggccaccacatcagcactacaatattttaaatccttatatctgaaagtacaggaacctctccacttttctgtgtgtataatgtagcccttggcacattgcggaaaacaaaaacaaagaaaaaatacaaaaaaatatcaccatctgtactgggttgaatagtgttccttaaaatttcgtgtctacttggaatttgtgaatataaccttatttggaaatagagtctttgcaaatataatcaagtcaagattaagtcatactgtattagagagggccctgaacccaatctgacttgtgtccttatcatccttacaagaagagggaaattgacctggcgcagtagctcacgcctgtaatccctgaactttgggaggccaaggcggccggatcacgaggtcaggagatcgagaccatcctggtcaacatgatgaaaccccatctctactaaaaatacaagaattagctgggcttggtggcacatgcctgtaatcccagctactcgggaggctgagtcagaagaatagcttgaaccagggaggcggaggttgaagtaagccgagattgcaccactgtactccagcctaggtgacagagtgagattccgtctcaaaaaaaaaaaaaaaaaaaaaaaaaaaagacaagggaaatttggagatggagatacagataatgaaaagaagggcatgaacagatggaggcagagattggagcgatgcatttataagcctaagaatgctaaggattaccaccaaccatcagaagctagaagagataagaaaggagacttctacagcatgtttagaagtagtatgtcccaccaacaccttgatcttagacttctagtctccagaagtgtcagatagtaaatttctattgttttaaaccacacagtttgtgatactttgttatggtcaccctaggaaactaacacaccatccataaatatccatgtaccacatgcaaggtgctatgctcagcgttgagaatatggaacaatggagaggtatacctggaatctgggacacgtatcagtgtctatagacatagaggaggaaggtaaaagagtgttccacttcattttaactccagtgtgttgcttcttttctaaggagccacagacaatgacttctcatcctcctcttcctcattattccttggcttacaagctaatgcatacatcatggggttcccagtatttccttttccccccaatattttatgccccatgcttgtgtttatattgtgatataataaaatggcacgaagtagaaacacacccttcacatggagcacacattacccagtggttttattaagacttgtgtttcggcatctgagctatgtgaaatctcactcaaggctctgtaatgccggtatgttctctatatgaatgtggcacgactgaaaacataaaactgttatcacaaaactgttacatacattgtaaaacaaacagctctctgatgtggtttggctctgtgtccccacccaaatctcatctcaaattgtaatccctgtgtgtcaagggagagacctggtgggaagtgactggatcgtaggagtggattctccatgctgttctcctgacggtgaatgacttctcacaagatctgatggcttaaaagtggcagtttcccctttgctctctctcgctcctgccgccttgtgaagcaaggacttgcttctccttctgccatgattgtaagtttcctgaggcctctccagccatgcagaactgtgagtcaattaaatctcttttatttataaattacccagtctcaggcaattctttataacgtgtgaaaatgaactaatacactctcaaaatccatccaatgcataaaagcaccatttgaactgccacaaatgcaataaggcctctgaagttttctagttccaccctttccatcacctcagctaaagtatcttctcctaaactccaggacctccttttgtaagagtgagaattcctaaattaaaataaccaacagaaagtgccaaagaaggaagggagaaagggagggtgggatggaaacaaaattgatgagtgcagttgtaagtttcagggattctttacattcctaacattggtttatttggtattataaattaagaaaatttaaaaattatccataatgcccaatgactttgtttacagatttgtatcagatcttacaggaaatggatcactgaaatagtcatgtccagattgagctgacatttactgagttccccttccacttcaaactcagtgtcagataccattttatatgctgtgtaagaattcttttgtgaggccgggcacagtggctcacgtttgtaatcccagcactttgggaggcccaggcaggcggatcccgaggtcaggagtataagaccagcctggccaacacagtgaaaccccgtttctactaaaagtacacaaattagctgggcatggtggcgggcacctgtaatcccagctactcggaaggctgaagcaggagaatcgcttgaaccgggaggtggcagttgcagtgagctgagattgtgccattgcactccagcttgggcaacagagctagactccttctcaaaaacaaacaaacaaacagacaaaaaaaaaaaaaaagaattattttgtgcttatttacacaagctcaaataggagtgaacaaagttttattagcttgtatgtagtcacgcattattataaccaatattaatactgggtcttaaacttaattaggccttcagatttgaaaatctcaatatttctttctactaaaccatgtggcctcaccaaatatatttctgtatgaatcctagagcacatgttatcttgggaggagtctgttttttgcttttacaaaacagtcatattgccaaatatttaaaagaagaagttctacaatttatagtatacggtcacactgtcacctgacaacctttaataacaaaaatagacaaccttacatgtacatagataacatttcagcaacagttttctaacagtgagccacagctaaaattgtgagcatgggtacttcagcatgaaggctcaaatcaggagaatacgtacaagagagaggctcatgagaatttaaccttaccttgcatttcccctaaaaacaatggctctggattcaccaattcagtgttcaagatgactttataaaatataactaccctaaataatgatgattcactgtactttatcttactcttaaacatgtacaaattttagtagcttatgaaaggatcaaggtaactcctgtagaaagaaaaactagtttaatcttgtttgatccattatttaccaaacgtttttgactacagatctaacttataaagaatacatattatcacctcacaggacaggaatgcattgtttggaggccctgctgtaggtgttcagaggttttttcagtccttcttttgaggccacatgatctattatttagagtgttttaaagcatcactcatgaccataaatcaagagatgaggcctggcacggtggctcacgcctgtaatcccagcactttgggaggccgaggtgggtggatcacctgaggtcaggggtttgagaccagcctgtccaacatggtgaaacatcatctctactaaaaatacaaaaatttgccaggcatggtggcgcatgcctgtaatcccagctacttgggaggctgaggtgggagaattgcttgaatccaggagacagaggttgcagctggccgagactgtgccattgcactccagcctgagcaacagagtgagactccatcacaaaagaaaacaaaaaaaaaaaaaaaaagagagagagagagagatgaaaaaattacagagatcctaagacatctctcatccacttggctatcaatatcaacctgagttggtactgcagtctgataaaattcccaacttgttctttgattagtagtgcttcagccttatcccaatttattgacattcctatgctgataaacctactcttacccttttcctttccctgagggaatgtttattctagtcttaaacttgagccaggcagtcaggctctgggagtgagtggagagttcactgtataaaagaatgtcaaaggtaacctttaaggaacgctgtgccacctccagagtcagatttatagtgaagttaacgaagcttaggcttcagacccctccactgcacagtccagtatcctacccaataaattctagcaaaatgttcaagtcatatagtcttataagctttctatttatttcttttcttttcttttcaagacagggtctcactctgtcacccacactggagtgcagtggcataatcaccctcactgtagctttgacttcctgggctcaagtgatcctcctgtataagcctcctgggtagctaggaacacaggcacctgccaccaggctcagctacttttaaaatttttttgtagagatggagtctccttatgttgctcaggctcatcttcaactcctgggctcaagcaatcctccaacctcagcctccaaaaatgctaggattacaggcatgagccaccaagccccgcctaattttctaatatttagaaagtaagatagtttaactataattagttaatactgctccttttctgctacaagttttctatggcacgctttctttcatatcttttagacttgaaggcaactgtggacatttttagaatgcagctaagtaagagaacatgtagttttatttatgggttcatagctttttatgtacagtcaggttatggatgagtgtcctagggtaggaatggcttccacagatgtgtctaccacccaatgtgccaactcatctagtgtcataattcaaaggcgacccaaaagtgaaatgagcatcactggaagtccccaactctggaagaacaggaatagtggatggactgctcatttcaaagtcagttaagcctaataacttagagtcaaaaatattttaaggcttcaaaaatatatttttaaagacttgaaaaaataactcaaataaaatcgagcttgaaaatattcaaaagcttgagaaagctcaaatatatcattttaattacaatttataaacatgttttaaaatttcaataaaatagcgaaaaatataaagctcttgattaggacgttatgaaattacctttattgatatttataaagcaagttattaaagaagtgtggtagaatttagattaaagtaataatacaatgtaaaacaaaagtgatcaaaataaaaagtgaaattgtgaacttacgaattacgttgcatgaagaagaaagttgtaatagcatcaaatatatataaaaatatatatataaatatatggaacacaccaaaagaaacaatcattagtacaagagagagaaatttttacaagaagtaatgaagaagctcttggattcagaatagtgaatctaagtaacaaagaggaataaataatgaatcaaataattacattaaaaattaatttcatgttgaaatgaaacaaagtactaacatttattaaaataacaaaatgcaatacaccaccaaaatgagactatcagaagtaaactgttcaatgaatactgtcaattcaatgatgattttaaattaatgtacaacaaagcttaaaatgtcatgaaatattacaacttacgttactaaaggaaatcaatagacattcccaaatttgacaacaatcctaaaaatgtatataatattacaaataatgaattatgaagtaaaataaagctttcctattgacaataaaaaataaatgtttatcaactctgtgataagcctgaattatttttctatcttctatactaaaagtagtgcaaaatcattcaactttatgcaagcaagaaccaggaaaactatcacacagatctataaggcagctattttattttagaatgttactcttttaattttttcatatgtatatcatttgtcagttttctaaaaactgtaatttcaaaattgatcattcctaatcctaactattcatttttacacttagttttatattttaagcatgtatttttttttcataagagaatcctaaaactgtgtaatctctggaccccatgaaacctaaatttgctctacaatagaggtattagatgatgtaagtaaacttcaaagccaattcaaaaacagggacctaatactgtttatgttgtttgctttgttgtagctaatatgtcagctgtgaaaataagtaattcaaaatttaagctgctggaactttaaaatattttgagcttaaagggaatgtgaactaaatctcataagcagacagttgtaaagtcagcaggtgtaacctttgtttctccgattacagattagccttttccttacctacattgtcttgtaaaatgttgcaaatgactaaagggtgccagggaagaagacctttttccttttaagtgttgattttcattatagattaccttccatctttcttctctcacacatacttcatgactaccgcattgtctacgatggaatgttaaatatactcttaaattggaaaggaaataaaaataacctttatggataagaaaacgaaccataatttattaaattgttgtgactcctaaactagccttgtacaaaaaatgttataatactgttaaattgatttattttctgcctatataagcaagaccttaacttttaacatctgagtactgatcccatttctctggagttcatattttccggatggtctttcccagctttttgcatgaataaactcttcaaacctggattctggtcctttcaattatttcaggctgacatagcattgaaaaatagagtaccactgacctagagtcagcctatgagaaattctctctctgtctctttctctctctctctctctctctcacacacacacacaaacacatacataaaaaatttaagacattgtattaactttatagctccacataacaaattaccaaaaattgagtagtttaaaataagtatctatttattatctcacagttctgtaggttggacgtctggacacacttgactgggttctctgctgagaatctcacaggctgaaatccaagtatagctggctgggctcttatctggaagttccaaggactaatccactttcatgctcattctggttgttggcagaagccaattccttgacattgtaggtctgaggtcacaattgcattgctagctgtcaaaccgggtgctgctctctgcaaccagaggctgccctgcattccttctcacacagagcctccatcttcaaaccttcaagtgcatcaagtcctttgcaaaacccttagttctgggaattgcccacccttttcctggaaaactcatgaataattcacctcttgtttaatgtgtaatcaagaatcataaaaatgggcaaccagcagctgttggggctgttctgcccatggagtagccattcttttattcctttactttcataataaacttgcttcaaatctttctggcttgttcttctgccactggttggagaaagctttatacttttaagttgtcggaggcatttgaactagaacgactccatcttgaataggggctgggtaaaataaggctgagatctgctgggctgcattcccaggaggttaggcattctaagtcacaggatgaaataggaggtcagcacaagatatacatcaaaacccaccaaaagcaagatagcaaggagagtgacctctggtcgtcctcactgctcattatacgctaattataatggattagcatgttaaaagacactcccatgacagtttacaaatgtcatgacaatgtcaggaagttaccctacatggtctaaaaaggggaggaacactcagttctgggaattaaccacccctttcctggaaaactcattaataatccaccccttggataacatgtaatcaagaaccataaaaaagggcaatcagcagccctcggggctgctctgcccatggagtagccattcttttattcctttactttctttttttattattattacactttaagttctgggttacatgtgcagaacgtgcagttttattacatggctatacacgtgccatggtggtttgctgcacccatcaacctgtcacctacattaggtatttgtcctaatgctctccctcccctagcccccaaacccacgacaggcccggtgagagatattcccctccctgtgtccatgtgttctcattgttcaactcccacttatgagggagaacacgtagtgtttggttttctgttcctgtgttagtttgctgagaatgatggtttccagcttcatccatatccctgcaaaggacatgaactcatccttttttatggctgcatagtattccatggtgtatatgtgcccattttctttattcagtctatcactgatggacatttgggttggttccaagtctttgctattgtgaatagtgctgcaataaacatacgtgtgcgtgtgtctttatggtagaatgatttataatctctaaggtatatacccagtaatgggattgctgggtcaaatggtatttctagttctagatccttcaggaattgccacactgtcttccacaatggttgaactaatgtacactcccaccaacacttgctttcactttactctatggacttgccttgaattctttcttatgcgagacctaagaaccctttattggggttttgatcaggatctcttcttggataataaaggaattataggactagatttaatcacaagattagattagacccactcacataattttgctatttgaaggtcaatcattggggacctataatcatagcaatgacatttcaccatattcttaggttctacccacaattattttgcaagggtgaggggttattgggggccattcttagaattcttagaattctcacagactttctatcaggattacaagatttatattgaatgggtagtctaaactaaggaaaagcaaaaagttgactcttcacagggagtttgagccctagttcatataaagcaaagaaaataaatcagagatagcaagagaccaagacagatagatgtaattcgaagagagagaaacagaaactaacttgccatgaaccgaaagattgtatattctttttcctctctgattcactaatgtatgctttctaggagaagacataacatattctaaaatgtttgtttttcttaaaaggtatttgcatttcctaattggcatattatttcataattatactcatactaaatctgaatgtttgagccattcttatgtcttccttccatgataagttgtttatgttgtggaatgtctgagtctataattaaattattgtctctaacaagttaaccatatccatgcatacattaacatatcattataatgtgggaaaacatagatgtgtaccatagaacatcaagctgaatggggctctgcagatctgggttgacgtttctggtaactggtctccattctggaggtttcaaggggcagaactaaaaactccagaagaaagagaaaatttattcttatctgaaataaagagaaggtatgataataggaaatgttattttacaaatatctactccaatttctcttcctttctaccacggaaaaaaatatttcctcatcacattcatattgctgggtttggcttggctcttgtgctgtggtgatccactgtgatcaaaccatgcccctgagactgggcactaggacaaatgaatgtggagtagaaatgccaaaatctgctgttcaactgagtctcccagcagaacccagtctagatcagctgaaccaagtcacatacagacctgtgaatctgaagataaatacttggaattgcaagcccactgtgttttgggacagtttgttacacagcattgatgcagccatagctgactaatacaacaaagaaaagaaggaaaaaatcttcagatacagaattatgtttaaatttaattaaactaaatatatacatatttatgtctgtacatttatagattatatctatatatatgacacatgcactttttaaaaatagctcctttggcagagttttgtgttaatattttcattaaaagaggctcttatatgataatattgctcacaatgaaatgtaacaactgtgtagctggaagcattatctctcctctttgggcaacagtccctgtagtctcttggttattcagaattttaaagggaccatattaccctataaacttaagcatatgcacaaaactgcttttggggaaggctacgatttctaaacaatctcagatacataaggccgaatgtctgttatctgaaacgcttgagactacaagtgttttagatttcagattttttttggattttggaatatttgcatacgtatttgcagatagaagctattttatagcttggggatgagttccaagcctaaatctaaaatttgtttatgtttcatatataccttatacgtatagcctgaaggtgactttataaaatattttaataattttgcgcctgaaacaaagtttgtgtacactgaaccatcagaaagcaaaggtgtcccaatctcaaccacccatgtggacaatctgtggttgtttggcatcattatcattcctgactctgaatttatatgctattaataagcatttattttcttacatttattcacacataagtacttaacagtaaaatatatggcatattgttaatgcagtgaaaacataatatgttcagggtaaccaaggagcacagcagtgtcaccagaatacctgttatctgtttaaaaacaccagcaatcaaaaatggcaagtcttcacttattcaaaaatgtttatattctgcagcatttcggatcttaagttttcagattatggatattcaacttgtagtacatttaattttgtgatttcttttgttaaataaaaagaaaaatccttgcagattatatgaaggtcagaactgtctctttgcatcaataaaacatcaaaagaaaaagaggaccactgggatgggaagaacacttccaatgcactactgaaaacaatgtaaatggttgggaaagttggccacaaagtcttctatttcaatagttgtaataacacatcactgttgcatataaaatgtatctgcaaatatgtctataatgactgctgatcataagatttcttgttctattcactctgaagtctaaaaaaaaaaagcaaactatctacataatccaattgaatactcattacataaagtgctaataatgtataccttctcatatacaaaaaaaaaatggatggtttaaaattgcttagatcacaagagccaattacttgggcagaatggggaaggtgatatgaatgcataaatcttacatatatgccttaccatggagggatagcttatatgcatgtggttgaaatgaggaaaccctctctcacctataaattataatttaagcattctgtaaaaatttaaattcatacttaagattcaaattattttttccatacagagcagggtttctcaattgccacactactgatatttgggactgggtaattcttcactgtggggaatgacatactcatgataagatgcttagaagaatctctggcctccacctactagatgctagaagcagtcccctagtctggagttgggactatcaaaaatggagaccaggccaaatgtcccctggggccaaaagcactcctagttgagaagcaatggtctctagaaataccatgcagtacattccttcttccaataatagatgctaatcacaagcacacaagatagccacaattatatgatgtttactacttgccagacacatagtagctcattttaattttcacaaaagtcaaatgacctatataccataactacctgatacaatttggatgcttgtcccctccaaatctcatgttgaaatgtgatcccccatggtgaatgtggggcctggtgggaggggttttggtcatggggtggatccctcacgaatggctcaataacctccccatagtaatgagtgaattctcactctattacttactgtgacatctggttgtttaaaagagcctgacatttctcttgctccctctctcatcatatgacatgcctgctccccctttgctttaaataaaagcttccttaggcctcactagaagccaagcagatgctggtaccatgtctcccatacagcctgcagaactgtgacccaactaaacatttttattttttaaaataaattacccagccccagcaattcctttataacaatccaaaatgggctaatacactacttctatgttactaatgatgagactgagtcatagagaagtgacttgttcagacagtaaagggagcctggatttgaaaaagggcagtggggcatagaaggataaagtcctaaatgagattaactttgggacaattggattccagagagactggatacatgggtagtatatcctatagaaccctctgctcacatgttaaatctgggagctgagctagatttcagaagtcccttccactactaacaatctgtaagtctgtaaattgtagacaaatctatttggttagatttattccaataaaagcaagctgaccacatgtcagataaggtccagctacagcataatggcatgatggcagccttccatcttcactgatttaaattcgtgctgttttagtgcatataacccccttagatttgtctgctatgagaaaattctgcaaggaagagaaggctgcttacaaaacagtctttcaaatttctccatggatctcattggcaggtcttcaaggtcaggaccaatcacagacatggctggagaatgcccataaactcttcctcctctaatagccaatgggagaaagggattaactgctggtcagatgactgtgactattaacattggaagcaattctgtgcttgaaaacttgatcagtcaaagagggtaaactacattaataatgggcactggaaggagggagctctttttcaccgaagtccccatggtcacaacaaattagattagagtgcctgagaatatgctaaattcatagcctcatcgaaaatttctctttagtactttatctgtcgctagtctctcttctcttgcaatgggtcatttcagctgctgctaaaaccagctttctattacagtttctcctcatgtcatacaattccttaaaggctgatagcatcatcggtccctgattcttgtccatttaacctccctacccatagatacaatccaagactggtactcataaattccaaaggaaaaataaagctgcatattgctacctctatgacaggttacttttggggaatagaagattccaggacagctatttcctgtgtttattgattatgaatcttgaagaaagaaattttgtgtgagcataacatatacataaattttaaaatttcaaaaaaaccacagttctcaatcttttgaatctgccaaagccagcatgacacagtgccatgcctaatttcagagagtacctcctctctccccttccgtagtcagttgtattatcatcctttaaaacgctttagagggtcacttacggtcactcatggcatattcagatagtttgtaatccaattacattcttgaagatttaaagaaccagaaacaaacaaaaacatgcaaacatgagctacagtttttattgtatgtgtctatatataagagagaaaaatggagatagacgtagatatatgtgaataaattgctgcatataaaaacattagttaatataaaaaacagaaaataaatatctttttacttctttattttaaatgctaaaaacttccttataagggcatcattatatttggaaaacatataaacccatttagattattcaaaaggaatacagtgatacaaataataaaactgacaagatatctaattggaattcttttggttctttcagtttacagtgataaattttaccacactgaataactgtaatttctacctgtgccaaatctatagccagtctcatatcttcttgccactacaatactagaaactttccctgatgaattattaaatgatctttgaagttgctacagttcatagaaatgtgacagtccaatgtgtcttagtgctgtgaactgttaccaaaaagactaaacatccttgacagcctgataaaaaattaattattctccttccaatggaaagaatgcaactctgccaaaacctgttaaatgtggagcttttagagttctcaatttcttctctcttggagagggcacattataatttttcatgaggattaaatagcacatgtgaaatatctaaccttgcctagtatccactggatctttagaccttagttccttttcctaccttagaatttttgttcccctaaccgcactatactaaatgccaatgcatattagaatagaggtggcagtgcaaaatagaagaataaaagaaatattgtattattgcgagaaaggataccagtgaagagatgtttacttcagatacagtaaaatattcaaatactccaagcaagtttttccccagtgagcctctgtttctgcctatgtagacatcattcgacctgtccagttatatctaggttattgtgaagattgaaaaaacaagggagagctttttttaaaaaaaaaaaaaacaaaaaacaacaacaaaaaaaaacctttgtgttacaatatatagatcttattttcaacagcgattaggtaatggaattagtgcagtaaagttttattaatgaatgctgtaattagaaaatgttaattcaatatttgcttccccaggttacattcatttggaaaaaaatgcattaatcttaccatttagtgataactctttcagttcaacctacagacacaagatcttgaaatgaaactgttgattaatttatttactcagtaaagatgctactggatacaatagaaatacaagtcataaatgttttgcaaacaatgatagtaatgaaagatattagtctttttccttagaaattaacttagtggattgagacagtttaccagtcttgccttacaagaactattttaagcacctaaaaagtaatcatcccaagagaaaatatagagtgcaaagagcactttgctatttcctcctgttattacaaagcataataaatccctactctggactatttcttgcctgtatcctgattagatatacccataaagtttgaaaatgtctgcaactgagaatacttttatttataaagcgggatagaggttgaggaggatgtagagaacagattgttatctgtacttgtcacagcaaagcatatttttttaatacttagttttttaggcttctgttggcagattgacctttcttgagagtagcttatcttgctgtagagcaatattcccagacctcctggggttcacaaagttaagaagaaggagcatcaggaaataaagaagacaagaaagcaaaacagaaaagtaaaataaaatttctgctgagttaaagtagggtgtaaaagagccatggaaattccaaaggttgttttagaacctcctatttcacatcctactcagctgtccagaagagaaagcagcaaaaacactcagactcttggggaaacaagcattaggtggtggccagtgggggttgaggggggagtctctcttaaaagggtgaagaaagcacagatgaaaagggccaggcaatgcagactagttgtaaaagcctagaaaataacatctgaaagcttaaaggggggggtcataaaagagttggaataacaagttgtgagcacagatcagtgtagtctgagagttgtttattgcagaaagatcagaaacgttcaagtgaaccatagcaaacttcaaactgccattcacttctctcactaggtttgtgttaatctccgttccgtaaattgaaatcaatgacagcagcctggcagaggcgttgagagaattgaatgtgataatatgtataaaaataccggctgtaataattgcatatcttacactcccgatggaggtccacttcttttttctactactaatgccaatgctagaggcatagataaataagaagcatggagactgagatgggcctcacctgtctggaagccttttaagacgcacttttctggaagccttttaaaatgcacttgtcctacctgagattctccattctgcttggtgaggcaccctgatgaggcatttcacatgtgatcacaggagatgtcaccaggattattctgagttttaatttagtcggttgtaaatggggtcatgataattcatcatcttatgtggttgttagcatagttaaaggataaaatgaaacaaagttctttgtgtgtaaatattagctattgttattattacccccattgttagcataaatcaagagagtgtctgttctccacctttcccttctttaatggagacactggtcactagatttaggacttaccccaaaatgattttgtcctgaaatccttaccttaattatacctaaaaagttcatttttccaaatcaccttcacaggttttctcaggcttaagagagtgacatatctttcagtggggaaggggcacaattcaacccactatggggagttagaagttaagcatgtaaatggacatacattattatgtaatgccaagtagtgataaatgctctaaagtaaaaataaagccatataaggggataagggtgagtggaggatgctctttggagacagcagtcagtaaaggcctcctgaagaggtgacatctgagctaagatgtgactgagagagtgagacatgcaatatgggggacatgtgttagaggcagaaggagcagcaaatgcagagagctgagccaggaaagtcaagaaaaatcagagtggctggtggcacagcaagtgagcaggccagcagcagggaaagagagcagggggctgtgcttgtcacaagaggattttgcattttattctaggtttgatggggagccaagactgggctaagaacagcagagtcatattcaatttctaaggcagacattctattttaaaccaaactccagacgtggagctaaagatttaagtggtattataatatcctcgaataattgctctgataatgagaaaacaccaagagcaattctttgccaatattagaactaaattcagtttgtcctaccatgtcttttcattatcttgtgcttcactgaacatgtcacgagtttgcagaaacaattccttctgcctgcatgcccttccccagtgtgccccctcactctgctgtggcttgtccctggtttgtgtcacgtcccccagataaggtcactcacacttcctccatgctccaaggcgcttattgccctgggtgcctactttctcctatcattaccatctgtttacaagccttcctccttttctgactgtacagttctttatggtcacatgtaaatcttattaatcttcatattaccagaaactagcacactgcacactaggtactgaataaatgttaaatgaatgagtgaatcttggtcctattcaattttattttgcctgggtttatatattctccatcccactatttaaataaacatagacttttttcttctgttatttaatgaatagcctatagaaaggcattacattagcatcaggacacaatgaccatctaaacattttttaacagttcactagaactgtacacagttattagcctgttctttgcttgcaaatgcctcaagaagcgaaatagtggtacgtcctttcccctgtgttaaatttgagatcacagaggcagggcaagctgcattaacctgtctgaggtcaccctccaagtcactgcaatggagaagccaaatcatcaatgcagagagctgctttcttccgtaactgtgatgtactgagttcactgagccatgctgtatttgtcatgcacatgagttctgaaaatcaataaaatctgtgaaccatcccacaaaaataaaatgcagtgaaaagagtctgctttgctcccttcaattactccagcatgaatggacccaacagctgtggtcttcagtgggacttccagggcaataaagtttttagaaatattgattttcttgatttatcaaattttcttgtttgagctttgcctaataaaacatcaaagttgagcatgtgaagctgcattaaagcatgatcttcctggcaagaagaatatggaataaaattggttgcatctttggatatgaaatagaaaaaaaatacctgaatcattttcaacaaaacatatgctcaaatactggtggagataaaaaccagttcaggtagatttctttgtcatgcttgaaaaatacttttcttcaaatacatattaaatatattactatctagagcatctaaagtgagagtctcttgtcacacatctagacaaaattaggattcctgtgactcatgtccccagtcattctacattggttgtcagagttcatatctcaactccagattcaggtccagtttgctggtccatcagaggctggaagcatgctgtgccagctgtgtctgtagacacagctgtgcgctgtgaaaaatgcacactcggttaaccctggaatgattttagatcctaaatattgcaaaggaaagagtatcttttggttttttgtgcctcaatatcctattgacatgaatgaattttgcttgataaatttgtaaagccaacagcctttcgacaaaaggggtgagaaacatatgtgtgttttgtaattgagtaaaaatggattttgagaatactatggaatattcatagattattggctttcgagttggaagagcaatttagggataattataacaatcatgataattggtgaccatttttaaatatggttctgccattgtatgatgtgttttatcaacaaatatattaggtacatgattcagttaacactacatccaatttaaagaagaggacaatccattctagaggagttaaatgacttgccccattcccacagttgattacttttcagagatgaacaacaaagtcaatgcttctatcttcttggtttacaaaggaattgcaaaccaaatttatgagagtgattagccttctcaaggatgacatgggactttgtcttttaaccagatgattgcagaagtgattggccattattgcttcctcaaacttctagttaccttgaaataactctataggacaatttattgctaagaatcttctatggaatactacttcaaaaatacatcagaggccaggcattgtggctcatgcctgaaatcccagcactttgggaagctgaggcaggcagatcacctgaggtcaggagttccagacctgcctggccaacatggtgaaaccccatctttactaaaaattctaaaattagccaagcatagtggcaggtgcctgtaatcccagctactcaggaggctgaggcaggaaaatcacttgaacccgggagatagaggctgtagtgagctgagattacgccactgcactccagcctgatcaacaaagcaagactccatctcagaaaaaaaaaaaaaaaaaaaaaccagaaaacaaaaatgcatcagtagacgttacttaaagctatataaaaatgttgttaaagaaaatgctgagttaaactaaacatattactttactgtaggacttatcactaccatgtttaatataaatatatgcattgcatatcttccagtagtgggtaccatgtggagcacttactaaatgtgtttcgtcatgtgactgttttatctgttttctcttaaataaatattgagtgctttgcaacacaaagtttagtgctctacggagatgaactttcctagagttaatattcatcgctagtagactatactgtgacaaaaataatgtaattactttgactattttccaccgtggatattaccggaatcacattatttcacagtcattattaaaatggccagaaagattagaaaagtaaaatacaatattggaaaaaaatagaaaactgaaaattgccaccatatctacttagtctttgacatggctatgtaaaaaacattggtcctgtatatggatgaacctcatgacttctgtaatattttagtggtgattttatgaaaacattgtccttttctaaagtccctgaaaatcagttttgtatcttcaaattagaaagctggagagagcaatgcgtcatggggttatggaagagagagtaggaatctggtcccaagtgaattcaaatacaccacttgggtcccattcatctactctctggcccatggtaccaacctggtccttccatgaaggtgccttttggagacagcagaatatcctaggcatttgcttcaattttccaattttagacccaaagtcaaatgtttcccaaatgatttaaattgatacacataggccactggcactgggatttccatttccttcctgggctttgtaactatagaaaaacaacttacgaaggaagatgtggggattcttctaccacaggtagtcaggtagacctgtccccagagatgaagaaatgtacatgggatatacgaatgaagggtgatgggaagggaaattgaggttaatgctgaggtttctggctgagagtctgaatacagtctactgtgagcaaaagtggttatggtgctttttgatttttaaaagttagctgagaggtgtgccgtggccagcagtgttggtagccagaaacttcccgtaaaccagagagcacactgcatccaagggctgtgctacaaatcagctttggtatgaatttaggacatttgcaagtattatgcctgttaccttaaatgggatttaggacctggtgcagtggctcacgcctgtaatcccagcactttgggaggccaaggtaggtggatcacttgaggccaggagttcgagaccagcctggccaacatggtgaaaccctgtctctactaaaaatacaaaaatcagccaggtgtggtggcgtatgcctataatcccagctactcaggaggcttaggcaggataattgcttgaacctgggaggcagaggttacagtgagctgagctcacgccactacacttcagcctgggcggcagagtgagattctgtctcaaaaataaataaataaataaatatataaataaaacaaaataaatgagattcagtctgtgctttttcaggatttaaatttgccaaaagaaattgaaattatacattgctagtctcattagagagttctgtcatattaggtgacactaacaagaaaaaaaatccatgtccaaaggctaaggctatcaggagcatctagttacaatgatcaaagtgatgattaaagaaaaataactatttcttgcctgtttaaagccatgccattacaacagactaattgaaatgtgaagcaaagattatgtagattttgcttgctggatgttgtaatgttaagactttattgatcaaaaagaggcaagtagcttttgaactgtattagcagttcttctactggttggaaatttattttctgatagtgtaagttaccagagcttcatcatgctgtgaagtgtatttcaagtcaaaaaaattaaattgaacccataatgcataagggtctttgtgccttgtaacctagtgaataagaacataggctttggaatcagaaccaccttaatttacatataaacttagccattgttttgaaaaagacaatcaagttttctaagcctcagttttttcaactgtaaaagtgggatattaacagccacctgaataagtctatttatgaccaaatggaatgaataccaggccctagaccagtaagtaccacataatcatcagcaaataaattggggaaataattataataataattatcacctctctgtcgggctagagtggaacttgaggttcatttaatccaagtcttacaatttgaatgaggacactgagtcacaaagtggaaacagtttcaaagtgcttttattcattcgatgatatattgtagaccccccatttgtcaagctctgtggtaggtactggcaaatgaaagtataagcattcaccatatatgcattcaccatgtatgtattcatacccagacccattcaaggactaattgatggcatctgtcccttaaggagttcggagtatacagaaggacacacatggtgaattttgtgctataacagagggctcaacaggttgctgatggaagaacagaagacaccatgactctgccaggaaagccacttcagagaaaaggtggtaacttatggggtcttgaaggaagaaaatgattaatgtcaaccatacagaccttctagactatgcagagaaagtatcaaccatattttactaatgagaaaaccaagaatttgaaaaaatgtattattagtcgatggttccatgatattttaggggcagaaatggaactaaaactcagggcttatcatctgtatctcttactacttctattctttctcccattctctcacatgaataatatctaagtttgcagaaagaaattagttcagcagtttaattacactgtggataacttttaatttattcatttctcatggaattatttcctcttgcttgatttatgcccttacttgatctatttcattttactttgattttcccctttgtaatcagatgatgcatctttgataatatttcattctctttctgtatatagccatttgtttttctccccctggagaactaattcatatatattctaaaaataagcaaatagtgtaaatgcaaatgggcttcaaatgatactttacaagcgcctaaattgaactttgtttcacttgtatcctgatgcaaaatgttcctaactttaagatcatctcccatagggccattccaattgtaaaatgaactctgcatctgattttcagattattggatctacatatttaccataactctgattaaaggcctttgaagcaaatggaccatagctgtttttgcaattgagccttattaaaatttaaagtgtatccgtaaacatgtaagtgcctattatagatcaaagttcagaaaattaaatattcacaaatacagctcattttacaaaaactacagacttgaaattatctaagccaaataatcttagcacttaccacaaaatagccttagttatttcagcagcaagattttatttatgttaagcaactttttgtgacttgagcaaaggttttattttacctggaaaactcagcatatatagctcttactcatggaacactgttgtaatattaagatataaaaatgataaagtaccacctcacattatatcatttaatgcatcagcaatgaaaccatttggggtttatttattttgctgattgacttgattcccttcctttggagaggttaataaagttgggcatatttcatgattattcaaataagatagcaaactttaatttctgtaaccctctaggagggttcagccaacaagtacaatactgtgtgctgttttaggatgtttagattggtgcctccacaaatgaaaaatgaggccttgtatttgttgatagcaagtagattgtactgcagaattaaaaggaaagaaatcaatgctgccaaaataaaacaatacaattagaaccacattttgacttgtctcagaaacattttttggtattaaagttattgggctattaaattgcgtggggaaaaataatagagctcattacatggagtgttctgctttgccacagctggagtctggattgcacactttaatattacttacatgtactggagcaagctgaagaaatacagattattaagaaataaccttttccattaggggagcttcaaagtcctcaggaccttttgggggtattagtgggaatataaagaagaatgaagtatctttttgccacgcattttccaatgtgaacaataaaatctattaaaaagtttgtttctgtttcaatatatttccctgatagaaagaaaagaaagagggagtttaagggagaaccgattaaagactaaaaatagaagggatggaactacaatttccttagatagcattgagacagacaactctgtttgatcatttaaggccaaagattaaatggtaactcagaaatttttaattatttccctcaacaataatttcagaaacaactcataggacttgtctttttacttgtggccatttaaatgatggtgggcagcagcagttctattgtttttccttattttggggagtggaccggttttatgcatactgtcttccactaaaaaaatcagacaaaaaagttaaaaaaagctgttaaggcaattaaattacttaccatctttactaaggaaagaatgatagatgcatggtaattgaggatttacctagttgctagggatggcagtaagagtttcacatacattacatcctttaatcgttcataaatcacttattttttggataacagaacctatccttgctttttggaaaatcacattgccttccacattgttcatttatgagaaggaccctgtgccctggctcaaaaggtaaacgtatgacccagatctggttaatgaaaacactgtggcaataaggacagacaattaggatgtgattatagcttggtcagggtatagaattctgggacttttcctgaaactatccaattttgagaaaaatcctctggtcatctactgtggatctacaagtagcaaaatctttctcttcctttctgtctctccatttgccttcttctgccctttttagacattctagtaactagctcactcaccatgaaaacaactatgaaagagtcatttttgaatacaaaacaaataaaccaaaggtttaatttaaaaaaaaaattgctgaaccctgggatacataagactgccaaaatacttattaaaacatataagcaattctaaaggagtcagaatgaatgcttagagtttaagtgactatcatcaacatttaatttaccgaggtggatgtgccattgaccactgatattaaagagccattaccaagaatgcacatatgagcacattacatctaaatggtcccttcacctctttctggatagcttgtgggaatcacttttaactatgctaattgtttatgccgagtaaacattcatgcttaaatgcctccaacaaaataacatgtaacatttgggaatttcgtggtaacttgatgacttttattatcagaaccaaataaagaacacatgtttattgcatattaaatagaaatgaggaaaatttcttaaccaaaacaaaaactttttttaaaaactgtagtaaactgcatattttctagaaggccaacaacaaaagcaaacctctctttaataagtattttatgttataaaattggaaaatttgtccacacgcagggatttaaaattgagttatcaaattccagattttaaactaaatatgaaaaagtgttgtgacctaaaaattatttcaagcttaagataccaaagtgaacaaaaatactttcacatttatattccacctctcaacactcgcgtaaatacacagaacccaaaatatcttttgcaattatcttaattactgttacctttgatttatcttacaagggtaatgcatttaaaattgtaatttctcattaatgtcagttaggttttaaaggattttaaaaacattacttctctgttggttggtctgatgttttaaatatgtttgattcaaataatacagatgttataactaaaggatcagtttccatagggccataattttgcaatgctaataactactagattttttttaaagataggtatttcccacaagcacatttgtatatattggcagaaggaatggatatgttaaaaaatgattcaaacacaaatggtttccttcaacttaatgttttaaactttctgtgtgtttgaagcatttctccaaaaacatgatgatggaacatgcattggaagaagaatcagaaaagtcaaatttttacataaagtctgttaactcctttgctgtgtgaatattgacacattgcttaacattgcttaatctttctgtgtgttactatattcaaattgggaattgcattacttgcattacatatctttccacaatttatatgaaaatcaaatgggataacagatatgataggcaacgaaaattccaaaatgctaaattaatgaatgggtgctctgttcatcacttaccaatctaatatttaatgagctactactcaatatatagataatttagaaaaagtactcaaatatgacagtaggagagacacataaaatatgttaagtcctataagaaaggtttagttcaaatgctaagagaattcagagacagggaaagataattttgactgagagagaggactaggagggaaagtagaagtgacgctatttgaactgggtcttgggaaacactaggacctggatctcagatgagaaaacatgttttaagtaggggaggagataatggatttgaaggtttagggttatctattgcctgttttgagtgcatgatataatgcatttcacttcttcagttaactaaaagaatcacgtaaattgtttaaaaggagtagaagatcttgaataatcatatacctttttactaagcaattaatatatctaagacattgtttttatctactatctcagtgttgtgatatgagtattattgctattatatccattgatagattagaaaattgaaattacaacaaaaattacttgactccaaaaccacggatctcccctacatcctgctctattattctcttgtaaaatagattgtggttctttttatttctgtaacttaaaacatttttccattgatgtcattctttcaactacacgttgagtgcaaagatgaggtgcttgctctcaaatgggaagtaggaagttgaacagagttgtccttcttccatggatttaatgaggaattaagattcagaaatgagctctcatgtgcacctatccagccctccaacacccactcctcaatggactaaatatttaacctaggtggaaaagaactcacacattggaggaggactaacatgtgacttcctttgcacatgacccaggatcataagtgggggaccttctatttgctctttacattcagtcttctgctcattgtcacatatgcccatgatcttaaaagcaagccactagagtgtgtttctaagagcatagctataattcagataaatgtggagaaaatttgtaattccgtgtcttagtctgtttagtgttactatgaagagatacctgaggctgggtaatgtataaagaaaagttaatttggctcaccctcccacaggctgtaaaagaagcacagcaccagcatctgcttatggtgagggcttcaggatgcttccactcatggtggaagggaaaaaggagctagtgtgtgcagaggtgacgcagtgagagaggaagcaagagagagagtggagatgccaggttctgttttaacaaatagctcttaagggaactagcagagggagaactccctcattaccacaaggacaacaccaagcttttcaggagggatctaacccccttgagtcaaacatctcccccaattaggccacacttctaacagtgaggatcaaatttcaacatgaggtttgggttgggggctaatatgcaaaccatagctttcccttactagcagagtgacccaaggcaagttgcatacaatggagataaaaatcctgtgttaatcagcttgggctaccataacaaaataccatagacctgttggatcaaacagcagacattggtttctcacagtttcagaggctgagtagtctaagaccaaggggctggctaatgccattctgcgtcagggccctcttcctggcttgcagatggccgctttcttattatatcttcacatggtagagaaaaagtgatctctggtctcccttcttttactttcgaaagtgctaatctcatcatgggagccctaccttcatgatttcacccaaatctaattacctccaaggagccccacctgtaaaaatgatcacattgggtgttaaggcttcaacatacaaattttgagacacaattcagtccatggcaaatactgtagggtagtttcaaactttcataaacataaatatgtgaactatttagcctcaaacctggcatataggtacattgaaatggcaactatttgtgtcatacggctattcatgttttacatccacatagtaccatctcctacaacattcacctaaagcaactgattggcaatgacattcattacagatttatagctattcaataatcatttacagaatactctgtgtctggcactgtgttgggtgaggagaggagaaagtatataaaaagttgagtaatttaaagctcttatttttgaaaaactcatagaaaaatgaggagtgcagagagctctaaagagattgctgaaatataaaatgggattagaccatggggaaaactggtgactgattctgccagaccaaatcaaagaaagctttaaagagaagtgatgtttcaagcagctctggatatccaagtagaatttatctgccagatagcacaaaaaaagaaggatgctctaagtagaaacaatagtatctgataagcagggaagcatgagcaagcaaagaactgtagggaaactaatgggagacaggaattgttggagcaacagtcacatacaggaacaggtaaagaaacacagtcaatgtcactgagaactggattgtgagatccctctgattccacaatcaagagacagggcggagccgaaagtatttttaatttaatgttggcaatagtgtgaagaatgagttggtctgggatgagacaggtggcaagaggccagtcaggacaccagtgtcacagtctctagacaacaggtgaatagacctattgatatggtttggatttgtatccctacccaaatctcatgtcaaattgtaattcccagtgttggaagaggggcctattgggaagtgattagatcatgggagtgggcttcccccttgctattcttgtgcggtgagtgagttctcaggagatctggttgtttaaaagtttatagcacctcccccttcgctctcttcctcctgctccacccatgtaagacatgtctgcttccccattcgccatccaccatgattgtaagtttcctgagtcctccccagccaagcttcctgtacagtttatggaactgtcagccaattaaaccttctttctttataaattacccagtatcagatagttcttcatatcaatgtgagaacagactaatacacttatacaaggcagtagaggtagaaaggaagagacaatacttagagacatttgggagtaagaagacttagagcttccatttcaggtggattgagagatttactcctgatgagaggtcaaaggattcctattgaaccagacatcagttgctggggaacagtcatatgtgactgcaacatcaaggaacccacaaatgcagcctcgcacacatacaggacataaagccaaactgcaaaaggtaacacatcaaaatacctctatattgtgtaatgccagatttgtgtaaatcagaaaagaactgccaggctcaccaacaacctcatttatattacggtaactatcaataccgaaaactgttatttcctattatatttttaaaaagtcaaattaataaacttcaattatgaacaaccagcatttattaattatctcctataatcactatgacaaagatagttaattccctgcccggtatatatgcttgcttctactttaagaacaaatccacaattttattaagattagcaagtacccaatttaataaatatatatgtgtagatctatatattatatagatatgtgtacatttgtgtatatatacacatacctatattttttccttctctcatgaagctaggggtggccaatgagatatgaatggaagccactggctgatgtatctgaggacctctttataggggtctagacttatatggaagggggcccattgtcctccctgccaccccctctttcttgcttcttggatgaatttgtaaaggccagaactcatgaatagacacaagcaccaatcttagtagaataaaacaaaacaaaacaaaaaaccttagtatacataataaaaatttaacactaagttgtatcagctaacactatttggattttctgatgtgtacaatgcaacctaattaacatgtcatatagccagcatcatgcttagagccagggaaagcaaagataactaaaatacataaaccatctgaaataccacaggatagggaatataactttaaaaacaatacctttccattccccacccaaatagtctaatataaactgaaaactggatgaggatggaagttactttgtagtcacgacaatattgagtatcctgaggaatcagttctctatcaagtagcgtgagtgataactcatacctcatctcaaagcttaacatttttctaggtaccagtggggcagaaacacatgattcctagtcccaaacagttcacaacgcagaaggggagccagaacagtacttgataataagtagcatatatttatggccatagtcagcgctgctatgtagtttttaattcaacaaatattccccatgataacttgccctgagggagagagtcatgagtgtgcaacaatattgccctgttttcaaaactaggttttgagggggaggataaatagaattcaaatcgtattataatatggtagacttgtgtgaacttaataagtgacaatcctggtggaccccaaattcatgtgttgagtttctaatccctaccacctcagaatgtcaccttatttgaaaataagatcattgcaaaagcaatttctagttatgatgaggtcatagtggagtaaagtgggcccctaaaccaatatgactgatgtccttatgaaaaggagatatttggacatagacatatacacagggacaaggctgtgtgaacctgatggttgatattgagtgtcaacttgattgaattgaaggatgcacagtattgttcctgtgtgtatctgtaagggtgttgccagaggagattcacatttgagtcagtgggctgggagatgcagacccaccctcaatctgggtgggcaccatctaatcagctgccagcataaaagcaggcatggaaagagcagacttgctgagtcttccagccaccatctttctcctgtgctggatgcttcctaagttcaaacatcagactctaagttcttcagctgttggactcttggacttaccccagtgctttgccaggggctctctgtggcctttggccacagactgaagactgcactatgggcttcccaacttttgagttgttgggattcggactggcttcctggctcctcagcttgcagacagccttttgtggcacttcaccttgtgactgtgtgagtcaattctaataaaatcctcttcatatattcatctatcctgttagttgtgtccctttagagaacactgactaatacagtgaagatgaaggaaaaactctgggtaatgcttcttcttcatggcaaggaatgtcaaaaatggtcaataaaccaccagatactagggaagaggcatgggtaagatcactctcaccgcattcagagcgaatcaaccctgctgatgccttgatctcagattttgagcctccaaacctgtgagacaatatattcctattgtttaagccacccactcaattagcaatactttgttcaggctgctctaacaaactaagacaagctttaatggagtctacaagtttgttgagacatgtttaagtcccatgcactaggacactgatattctaaaaaaaaaaaaaaaaaaaaaaaaaaaaaaagcttgattgacaagtaaacccagattttgttgaatatttcaacataataacacttgaaagaaaataatagaaaaactttgcttcttgaggaggaaacagccctgttctaaaactgcttaccatgagtgctagtgaaagaattataaagaaagtacagaactttagtaatttgatagtagaatattatgaatttgaggattcatgacattcttgggatacattttagaaaaactgagaaagggcttcctcacatagcaaaggaggtaaaattcaaaaatgatataaaaataagcactatgagaggataaaagagaaaaagaatacattgtgggatcagaaaaggaggtggcatttgagaagaaacttgaaggatgttctattaatcagagtctggtgttttagacaaagtctatttaatactgaccattggttactcgggtgattaaagactgaagcttctggggatgttgatgtaacccagagctcaacagctttaggaagttgctaccattcttcaggccagcaggggagaaaaaaagaaagaatgaacgaatctgaaaggagaagctccctgcagttggtagttggacctcttagggaaaaaaagccattgtttcacacatactagaccactgagggggcctggctgtttttttacacatctcagaggggctctgctgtgtgttgggagaatgggggtgggctatgtggtactccccccactcaggtaaagtgacatcagggctagaagtgtcaaggaagttggaggctgaagccatcgttgtctgcctcaaatggagagggagacccaacctggaagtcagaaaagaatccttcttccaacttccacctcctgtccacatttcctactggcaaaatctacccagagatggctgaaaatgggagtctggaaaatgtaatttttggaaccttaatcctaacttctcagaaaagagtaggtggtggatagcggtaggacttggaactaatagccaacaggtaaaagaggcagagatgtagaggttttaatgtaaagaaacagggtgaaaaggaggtatttcccgtttcctgaaggccctgagcattggtaaagagtctggaatggaaaaggacagtttggtcaataatggtgattccctgatgtaggtcagaaatgggtctaggtgatagaaatgttaacgtgaacaaaatatacaatagctgtttgtagactatttaatttaaccttagcatcaagcatgtaatataggaagaagtagaaaataagtctaaaaagggaggacaggagcctagaactgcattctggataacttgtggcatccatatgggagaaggatatataactcaataaatcatgtttaatatcagtggcttttgaaaatgagtctgaagcatgtcaatggattaggaacattaattcagagggtttatagaatagattcacttttcctaatagtcaaagttattattttatcattttcatcattatcattgtcatcattatcataattacaatgtttatccagtactcaatatatagcagaaattgagcactttcctatatcacatcgaaccctccaaacaacactatacagcagctgttattttccctattttatatgggaagtaactgaagatcaaatagagtacatcttttggtcaaagtcatattggttcgacgtggttgaacctggattcaaactcaagtctgaccctagatttctttctcttaagcattacatgcttctccgtttgagaaaaggacatctagactcacatctcctttcaaaatattgtcatccatgaggtcacctcaagactcaagtgccacctggcagcttgagccatttctctaagttcttcgttcagttcatttataatcccctctgagtgttacttctccgccttctcacttctttaggtttgtcacagtcctctgagatgacaggctgagcaatggtgatgagaattatggtaatataaattccataaacagaagagtctaccaggagtggacacaaagaagttcacagagggcgcatctgggtgagaacagccccagctgttatagcatatgtgcaaaataatgatgtgcctgcacatccatgcagacctgatcctagctgtttataagaaaggatagttaaatgcagaaatgcaaatctgtaggctggagttgctctgtttcctaagtcttaagagtttggctccttatcttacacacaaaaatgcaatagacaaaacctccacataaataagcagcaggtgaactagcattttcttgccaaggtattatgcaagtgttaactgagctgatcagcagaagcacatatccatcagtttcactgcagaaagcaggaagaggaaggtgaagatgagcaggcaagttaaatgaaaactcatctggcttgcagaagagacacttattgctcagaggaggaaggtgcccaggggtcatgagatgtgacagtactaacagaaaatcctgagcttgcaaactctgataaatgtttaagatttaatggggagtgtccacacaaatgcaaaatgatttagaaaaaggtaaatgatcataacaatgttaataacatctatcaagcactttgctgagtattttgcttacattaataccccattatctaatcaaactcataggatatgtatggcacactatttcattgaagaaacagattcttagagatgtaaagtaactttccaaaagtataggtattttagatatatatattatagacctagcaaataagatgcaaaaatagaatttaaacttagaactgcctaacttagaaattactataaccaaatgctctacttcacatcctgattgctggggattccatttgaaatagccagatcatatataagtacatatctgtacacagaagtacatctatttctaaaagagactgctacttgtcaaatagtcaggcaagtatgtgttttggctctgtgatgtgataggaccagttttgaatctcctattttaacaaaatgtgttgcttatttttgttattttacatcatggaaacttagtttgttcagcctgaagagtttatgatggcctcctgtattcttcctgtaacgtgttcaaattctagggtaaaataaatttaaaacacaaacccaggatgtgtccttttaagctcttataaaggatatcatgtagataagccaataaaaaccacaaaactcccaatttggtcaaaagggaccttactgtattaatatatgcatcctaattcatgcagtcacttaatttctcatcatcttccttctaaacaccattccatgcacattttatatagcaacattgctgaaaaaaatgcatggatccacaaagatctctcatcttttttttttttttttgagacttgctttgccacccaggctggagtgctatggcatgacctcagctcactgcaacctctgcctcctgagttcaagtgattcttgtgcctcagctcccccaagtatctgggattacaggcatgtgccaccacacccagctaatttttgtatttttagtgaagatggggtttctccatgttggccagactgctctttaactcctgacctcaggtgatccactggcctctggctcccaaagtgctgggattataggcgtgagccattccacctggtctcatccttcttttcttgcctttgtggattctgttctctcatgatcttttccctatctcttagttgtactacaagattcagtttggtcttcatcttttcagcaaactttccttgacttaggtattagtgtccatctcagctattcagaatcatcccaggcatgttattattatcaccactgtttagtggtaaacagtgggaatggtcatagcattagcggtagtagcattagtagcagcaacaataatggaagaggtagtgatactcatacttgaccttagtgagtatctccaatatgtcaggcacagtaccaggaactttaaatgtatgaactctaatccactaaaactacatgaatcagcatgaatttattatccccactttatgactgagggaaactgagtttctcttttatcagtggctgtttctccctaattttctgttttcatgctccccatttttctctcttaagcaccttagatatttctttatttatcttgtatttgtgttctattgtttctcagatttctaaatcattgatttctagttttacccttattaattctgttctcgttccttgggatttattttttttcttttctaacagtttgaacctaattgcttaattcacttaaattttcccattttattaattcatctatgtaaggccagtaattttcctctgagcaataccttagctgtgttctctagtacctaaatttatattttatctattctgagacacaactttttaaggtcatttcaacttatgacatattttagaattaagagatatcttcatctaggggtgaatgatatgcatgttagtacactacgctccattttgatcaatttccaatgattatcagccaggttacagtcctgacatagctgataactaatgttggaaactggatagactgggacattgttcctgttggcttatgtgccttattgatgctgaaaagctaagtttagttactgtttcaaatacctttattttgttgatctaaaatattctatgaacactttccaagaagatctacctttaaaaatttcaaaatgggtgtcaacggcttggaagagaatttgggagataatagtggagcactctcccaactcaggctgcaatactaatgcacttagtgtcacagtaggagaaaaattctaacgactgtaacagagttgagtcatggtttatgggcagaaattttcttgttaatgaacacaagagaaccatgcatcttacaaatggtggtgtcttagattaataaaaaaattaatatttgttttctgtaagtttatcgtgtacctgaaatttacaatttcattttcattttcattttgacctatgggcctttgagcaagttttcaaaatctccaggtgaaactggcgtttttcttttcagtttgtttttaatttccagctttcttgtatagagatcaaagagagtgttctatatttatatatttaaataatttattgaggtttttgtggccttaatatatggcaggtttaatcaatgtttccaagctatttgaatagaaaaagattcccctcttttgaagaaacggagtccttatatacttacaggagatgttcggcagccttttatttaaatggggtgataaataaaataaaattctaaaatcattgcagaaggtgaaaaattaaagaaggatccagatttgaaggagactatagtctttagtagtcaatagtgaaccctcaaattgagagtgtaaggcagagtgtacacttgaagagctggataatatgaaccaagactaacagaagctaaaactagatttcagagtgaaatcagaaagaaagtatcttgacaacaaaataatgtcttatgcctagtctctctactactcttgttctcaagtttgccttatttcaacattcccagtatttctgtctttaatttttaccatttttgagaatctgagaactatctgtactattattatcctgacaactttctccaaatctattttataccaattcactctcacttgttatgtagctttgcatttagtaaaaatatccatgaactaatggaattatgtaatgtgtatgtcattatatatgactgtttttaaaagtttgtcaacatattttctagaagaatctcactgatcctttgtacaatactgcataacttgtaaacacttatgctgactccagcctctgtgggagaggaggtgatcttgccctcaaactgacttcagggaggtcagtcacaaaggtgacagctgggtagccatggagtttaaactaagagtcacttgaaataagtagaagtaagtacatcagaggctagacagaacacttgaatcaagagtccaagatgatttggaggttttgagataggaaagtttagggcacatcactttgattttgaattgagttcaatagttcctacattaggggttggattttcaggaacataagaaggaaaatgtttctgcctattatttcttatacctaaggaacaactgggctattgaatgagaataatgtccaataccttactgctgatacttcctatttttctccttctccttatcttttccttcccctccccttcttcctcttttctcttcctcctcttccttttctttctttagctaacttcttagtagttatttagatacacgttttctgttatctgcataatttgtcatcttcacaagattctacattcatctctgaatttattgtactatactgagactcattctcaaatatttaaatcacattttatattgcaatcttcgtgtgatagtttataacaaaccaaatttatttcaatagttaattatggaataggtagacagatgctgctttgatagtatgaaaagtatcacaaattatattatttcaaaagaaaattataattaaatgtcagcttccaacagtcacatacaaatctgcatatgatctgccaatgcagacaacccttagaatggtcttgaaaatcccatattaaagatgatagagtcatcagatggaaggagcttggtcccctaagtcatcacttggaagagagccattcatttgcgtatacttcttagggctcacaggtgagcaagaaaataaactatttggttaaacaactgaaaatttttttagtttgttgctcacaggagttggcctattgtgtgaggcttagcaaatatcggtagaatgacagactgagtcaataagtaaatgctgctactcaacatttgtttctgcccatagaagcctaaattttttagtggtttgtttcttgtctccaacttaaaaaccctgacattggagattctaagaaatcaactgatttaagactgcttcacataaagcatcttttatggggtgaaaaccaagaagcataaaagcccactgctctgctatatgacagttcccgtaggtataacataaaccaaggtcacgtcggcactaagccagagcacagtattttgcattttctgctaatgccgaaaaacacatttaaatatcctgttactgaaaaaaaatctaaattttctttgaaaattttggataccaaagtagaaacattagacctcgcttgcatactgactaaaaatcaatgccctaaaattgctgagtgcactcagaattatttgatatgctgtccaaacttgtttatgaaaatatattttggatgtgaggtataagtccccgattactcatttatccaaattgctaaatgtttagaagacttcaaagtaatttaaattattccttttattgatttattactttctttaatattcataataacttttgctcttaaccctgacctcataacatttgaagtgctatgataataattatcttatattaatatgctaatttcttcaaacagtacattcaactgaaacttcttaaggttttaaccactgtagacttaattaggttaattaaaatactattctattttatttttactttgtgattgctccattatcatataatgacactcataatagtaatagaatttattatttattgagcatatcttttcttcctaaaacattagttttatgattaacttcataaaaaaattaaataggtgcataccctgtgtggttttacctattcttttttagtttaataaataccaccccataaatgaataccaacttatcttccagtcatatatagtattaaacctaccaaatctatttagctaagagaaatttacttgggcttgaatatgctatcctggatgctacactgtgacttcagcctaaggagtttcccctgtctgaaaaacccttgactctaactggacagcaatagtaatctctgtgccaatttctaaagaggctgcagattgcaagacacctcatgatctggccttgcacaactcttctgccctctattacttttagaactgcaattccagctgcgcactgtggctcacccctgtaatcccagcacttttggaggctgaggtgggcagaccacctgaggtcaggtgttcgagaccagcctggccaatatagcaaaactctctctctactaaaagtacaaaaaattaggcaggcattgtggcaggcacctgtaatcccagctacttgggaggctgaggtaggagaatcgcttgaacccaggaggcggaggttacagtgagccgagatcgcgccattgcattccagccggaataacaagagcgaaactccatcttaaaaacaaacaaacaaacaaacaaacaaaaaactgcaattccataaatgcagtatattctttggtgcctctatgccgttgcacactctgcttcctctgctgcagctggcattctttgccttgaccacctagttagctccttcctctatttggaaattctgtccagaagatacctttcattcctggtgtcatcatttggtattttctcttttgcttgtctctgcttctgtcatcatgtgctacatcctgctctccatcatttactagtattcattttatgccagccactttactattcttacatatattctggagaattgttttagaaaactcacaagtttaacattgttatccacattttagaagcaagaaaaactaaactatttgttcactctggctaatgtgtagattattaagagttcaggccgggcgcggtggctcacgcctgtaatcccagcagtttgggagaacgaggtgggtggatcacgaagtcaggcattcaagaccagccttgccaacatggtgaaaccctgtctctactaaagatacaaaaattagccgggcgtggtagcgggcacctgtaatcccagctacttaggaggctgaggcagagaattgcctgaacccgggaggcggacgttgcagtgagccgagattgcgccactgcactccaacctgggtgacagagcgagactccgtctcaaaaaaaaaaaaaaaaaaaaaaaaaagagttcatgctagctaaatgtgaatttctcctgaattctacctaaggtctgtctgcttctaaagcccagtttttatatgctcaggtaaatatttgcttgtttccagacatatgacaaaacatgggcattaacaaaggagaaaaagaaaaacggagcaggagagagaaaataagagagactaagtaagaaattttaaataatttaaatatggcatccacccttctactcagtggatgaatgaccaagactgcattagaataaagcaaatctgctcatccgtgccatctcaacccctgggacctcatagaatgtgagtttcttccagttcgagtataatgctagtatttaatcacatgtgtttcttctacctcttggcaactgagggcaagcaaatgacttcgtcttgtactcagttaaagaaacagtgaccttttctgagcatgaaggtcatacatcccacactggactaactcaggggcagtccttctctgtgatattgcaccttcttaaagtacatttgtcttgcatacggattttagagaccaattgttttgcatgctgcaggtgcttaacaaatatcagtagaatgacagactcggtcaataaataaacgctactactcaacatttgtttctgctcatagaagcctaaatttttttcgtggtttgtttcttgtctccaacttaaagaacctgacattggagattctaagagatcaactgatttaagactgcttcatataaagcatcttttatgcggtgaaaaccaagaagcataaaaacccactgctctgctgtatgacagttcccgtaggtataacataaaccaaggtcacatcagcactaagccagagcacagtattttgcattttctgataatgcagaaaaacacacttaaagccacagtactgtttgaatagaacacaagtacaagatgagcctacgagttcatccaaaataaataaaactactgtggggaaaagttgatttattaaatttctttcatcccagaagaatatattaagaatattatttatatcctttgcatatcttccttctaattagattcccttgtgccatgttaaaaattgatttaatcttatttatttatatcttatttgtaaactgcttgctatgtaatctattaattgctgtttcaattaaattctatatatccattcatgcatttgtttatcctcccatggattgtttctcatcataactctacattcagaattctggaggcatttacccactgggagcaactaccctcaaacaccttgctttttattgctgaaaacccttgtactctactgagaataaactactgatactctccatgttctcagagtaaatggataattcagtacagttgaacacaatgtaattctaggttttattctccataaattgccttttagcatagagataaaaactttatttaactaaatgtttccctttatcctgactcatgtagcagaacaagaatatataacacagtaaaaattccttttgaagagtagttttttagctgatttggatgctttccaataaactcagtttttcacagaacgcttaggtaagtagggagattcattgaacattacaacgagaattatcaatggaccttaactacagctaaatatataatttccagttgtaatataggtgcccaaatatgtgttgaaataaaacatatttacttgtgtagttaaggggtaatgtctatataccactgaattttactagccatatctatgaattttatctagactacttaaacagtatcagggttctcagtgtatgcgttctcatgtttggaaagaataaggaatgaatctttactgagccatgaccttgagccagagactcttttaggccttatctatctcctttgatactaatactatcacgtttgagtattattgacctatgttccacataaagacacctcatctgggaacatttaaacacaaggttacaatgttaataggtgacagaaactacatttagctctggatatgtcttgttttaaagccagccttctttgtatacgaaagttttgctcaagatatttaaaagaaaattgtattttacaaaatgaagaatcccttgatgggattgcttaatatcagctagataaaatatttttaaaagtatactaccgaatattgttgcatcaaaactgtatttgcccaagggtggcatggagaaaacactctcctttatgtgattatccaaaaattttcatacaaagtaaacaaatgtttaaaatgatcattctcagcattctcccaaatatttttacatttgccatgcataccatgcacacatttaacgcacaccattacatcaaagatggtaaatgcccaatcttacttccctctcctctagaaaatcatctaggcatttagtcaacaagtaccttatacagtgtcaaggggagccattaaaaacatggtatacagaaattggatttcctttcctgagtattgcaacgaagaatggaagagaaaagccaggctgctagcatttctccttttgtaaggatatgtcagcctattcagagaacaaatgacccaagtcaatgagtgtgctgagagcttatccaggagagctgacactcaacttaagctaaacttataaactgtagtgcatgttcaatttattttatcttctgcatttcactctgtcactccacttgatgacattaagtatagccttgcaaaggaaatagtatctatttctgaaaggtttaggtgaaacatcattatatttccatttctgaaaggtttaggtgaaacatcattatatttccaaacaaaatgaaaacaagcaccttggtagaggaacggcataaaaacaaacaagcaggaggtctgttattttcaagggaattgacaacttaagaaattcacagttctacatttaaaatgtcttcctttttaggaaaattccatggcctcttctgaaacatctggaaaagactatagacatgttctttggatgcaagttatggatccatacaaaacgtattgatccttatataataaaacccacaatattcggggggaggtaaagaagataggaaggtaacggatgagagtttggctacagtcatgcaaatctgggttttaattctgactttgccagtctcaagtctctgtagaatcgggaaaagtattttcaaagcctctgctccttcatctgtaaaatgaagataataaatagtacctattgtatctgcacagttattaaagggcttaaatcatagaatatacccaaaatgaagttttgcataatgcattctcaaagacattgttcagtacattttgactagcattattatttatattatcacagcttggttcagtccctcatcacttctcacttgaagaactgcctccttcagtcagttcatactaaacatttggtcaaactcatgtgatcctgtcattgtcttaattattaacctcttacaaataccccctatttacacagaatgtttttcaaactccaggtcatgatccattaatgggtcatgaacccaatttaatgatgagtcgagaccaaacttaaaagaagaaagaataaaatggcatgactacatagggcatagaaagatagaatagactacatagggcatagaagaatagaatagaatagaatagaatggaatggaatggaatggaatggaatggaatggaatggaatggaatggaatggaatgggatgggatattgtcagagaatatgacacatagcaaaggtaaaacatatttttgaaatcatttattacaattagtatgtacatgtgtgtgtgctgtactataatgtaaaatatatgttcttacttactaggtaatattcaaagtcatctgacaagcattgggcaggatgatgtccaacattaatgctctgctactcatctagccactgaccctggtcactcaatattcaagacttaatgaatggaaagtggaagatgcattttgccttccttttgcttttgaggtgaggtaagtggtttagtatgatggaaagtggagtacaataggactttgattttatgagttggtaatttttttaacctaattttctgattcaataatagaaataaatatactttagactttaaatgctaataataccccatcattgcccttcctattctatcttcagaaaaagtgaatataatcattactgaaagtattatgcacaaaaaataggatcagaaatacaagtttaaaaatttctgtgacctgagatttttgtgtacatattagaatagtatttttccatttattgagttaaaatgtttctttatgcaaataccttttcaaacaaagacatttccaacacaaatccatgaatccaacttataaataaactatgaacactggacacaatgcatgcaaacaggacatctggaatgaaaatgcaccctcctgagataactaggaagtctccattttacatttagctagtcactcaagcatgaagtagtcttttgggaagaatgagaagaaagaggatcaaatatgttaaaactagtgtgtgcacccatcctagatcatagcatttttagtttcaaagattctcattgcctttctcacactagcaatgctcataaatcgggcctttaactaaaaatccacaactgccctaattctaagtggtaagagagaactcaaatgcaaaatcagactcatgtccatgcttataatgtttccatttcccctttgaagaaaaccgccctcagtaaaaccaaaagtgaattttagtgcatatccatcatcttaaaaaaatggattttacaaattaagcattatgaacaatttgtaagtgcattctaatactgtacacagagttgagagccaaggattttagcatctgataaatctaaagttaaatatctgagttcaaggccaactcaactattttctagctttgtggatttaggaagttatttaggcttgctgtgcttcaggatcctcatgggcaaaattaagattaaaatatctactttataaggtagaagtgatacttaaataaggcaatatatatatgaaacagttactccaggatctgacatacaataagtgctcaataaatggtagctattaaggttgagaatagtcataaagaagtcctaggaactagctaaatagtaaaataccaggattatatactctgcctttcacaaaataagtgctattagggaaaatgttttaacatcagcatttaaaactataatattttaatgcaattccaatataaatttatgtttaaagggtaaattttcatggttgaaataccgaacaaagcccattataaaaatgttttatttcacccatttcttctgagttccaagcagggaagataaagaaagaaaccaaatgagtagatgattttacatgataaactcgagaaaaatcaagatggtgcttcagtgacacacagaagtttcttacacatagtgatagtcaaaactagtttactgaattagaacatcatgtaaatatttcattataagattttttgtgtgtggtaaaatttctgttcttttcttgcatatgttatttatgaacataaaacatgcctcactcatcctcatgagtctccacaatgcctggcagatagcaggcactcaatgaacttaatttgaataataacataagatttatattacaagtaaacaaggatttactgctcagcaatctgcatagcccatggttagctacaaccaaacctttgaggtagcctgcctttacatgagcagttggaaaaatcattaccctcattttaattttccttctcccattaacgcttatacttcagtgagaataaagttaaatgagtgtctttttcttcctaggttgcttacatttttaaacataaatctcagacctaaaagttttgtttcccttttgaaaacaaaattaatttagaaaaatgtaatcaggttttaattttttaattcataaagggcaactaatttctcaacctaaattatagtacaaatttaccaaaattattttagtcataaagaatttgcataccataacagaatcattcttcgaaaacttaaagccaaatctaatacacacacattaagattttaggaaactgacaagccagaatataattaagtgaaaatttagagagtatagagagcaaattggccaaattaatttaaaataggaaattaattgagcacctacaattattactaatcctcaaaataaccaattagctggcattattccccctttagagagagcaaggctcagactcagagacatgtggctcaagaccatgcaaccagtgagggaaaattctaaattcaatcctatgtctgtcaaccttcaaagcttgatttctttccactacactttagtgctggaataaaaacttggaaggaacacactcacacaaagaaagattgatagtgatgagagggagaaaagtgcgaatttgaaggaagatgaagtaacttcttgaaaacgtttgagctttgtagaggagcaatatacgtaatcctctccaagcaagtgtaaccatttcttatgaatggctgagttttattttatttcatttttgtaggaaaaaactgaggtggagaaagcaagtggcccaaggcaaaaatagcagttgaacaaaaagcttaacatagtgaatacttacacttagcacaggatttgccaaatatagttgtttcataaacatttttggaacatataacagtaatcattaataagtatagaatgttcagtgaccccagtgctggggtaagcatttggcatgtaactgacatttctcatgacagtgctatgaggtgggtgttgttctcatctccatcctctgcatgaggatactgacattcagagagcttatgctgcatgcccacttcccaagtcggtagagacctggcctggtccaggaactctgcttcagatccccagatcctacttactatgcttcactgaatgaatagaataatcaggacattcttatctcaatccaattacttataaatcaaatttttgctgcaaagtttatcatcaagacttaaattacttttataaaataaaataaatactacttacacaactgaaattaagtgaaaacaaaggaaagaaattgccatatatttcactgtgtcatgagaatgagagtcattgatcttggcagatctgaagcatcctctctgctctttaaatgccaaactgatagattgtcaggacaagtgaaaaatatgcctgaaaactcatcaatacccatatattacaggaagcattgcccgcaaaaacaattatgcttgaatatgtgatagaagtcttagtgtataaaatccattatggcagaaattagaaatgagaggaaattccaagaagcttaatttattgattattattttcatgaagtgagggtgttggaaggaaaacaaaaccttgagataatggaacagagaagtataattaagaaatatgtatgatgtttatcagttttaaagactacaatggatcatgattataattaagttgaacaactaccaaagaatactcattgataaaattaatacttgcctaaaaagagagtctctatcctttggtgaagaagagaaactgatttttatgaacaataatgatactgtttaaggataatgcatatgtgtgacactatactaagcactcactcacactgtgtgatttaattttctcagcaattaattaagaaccagcaatgagttaagaactccattacataaatgttgggacaaaaaaggcaaaataaaaaacttgacctattctagtatcatcctgtagttttcatttatagcacatttccaattgttaattatacacttaattatatatttatttaagtgtgtattcatttttaaattatatgttccataagaagagggatcgtagatttaatttatctctacatatccagagtctggctcattgtaggtgctcagaatatatgtgttgaataaacttatgaataaaagagatgatgtcagagttccagcatctaaatgcaaagacattccatacacttgcctcccccagtgtctccctttgggtgaatgtggaggggatgggtgttaggcgtgtgggagcagcagtgagatcccagaacagttaaggggagatttttttaaaaatcaaaggaaggtgtgacaggaactgaattaaaaggttccaaaaagaaaagctccaagatttaagatcttccctttgatactaatcaatttattgaagactcttgacaaagaacaagagaaagagcaaacaaaactgataggacggagcctgatgcattagtcacttgtcaaaatttgttggtaactgaagagaaagtatgtttagcttccaagtccatttataaaaatatggttctcctgatactaaaataacccctggattcttccatagtaagggaaaggaaaaaatgtaatcatcacttatgtgtgtgctattctgaactcaggctattttttaattggaataaggtatcaagtctcagccttatcattttaaagtagtagttcccacaaggtatgattaggaccattatttataacaaaaagcaaaagctgtagtcttattctcgctagccaggagtgaaatggtgttcacttatcaacaaaactatctttgttctcaagaaggttgaagttattacccaccaaggactgctttgcatctactttgaggaattaagacatcaacaccaactagagatggcacaccattgttgtttgtgtatatgctatgtagatggttagattttacatcaagccctggatttattatctgagggcagatgtgtttaaaatcccgcactattgggtataagtaactttgtggatgccacacagccactctagctatccattttctcatgtcagagacagaatgataattcctgacctatctcctgaagctactggaaaaatcacaaatgaggtaagggatataaaaacaccacataaaccataaagtgcacttttcattttaacataacccatcactctttctttacatcactccatttaatttctgcattcaggtgtcaattttcaaaatagaaagacagtcttatcttcagttgtgttggcagatccagctgagtaaatgaagagttagagcttgggaaatgtgctcttccctgcaaacaacaacaacaacaacaacaaaaaccacaacagtaataatggctaacatgtattaagtgcttattctatcccagacgattttctaactcactgcagctgacctgcagtaggacaactccattctgatattgggtcaggtcatgggtgaactagcataggaatgaccaagagaaccattgtgtttgccatgttcatagtataagaaactggttcttcagccttcactagttggagaaagggtacagaaatattgtcagagtgggaggaaatcttagcaaacagttaatacacatcttgcccaaagagatgcatatgaatacatatagccctgttaaatgcttacataaccaatgtttatttgagcacctccatgtataaagaacttaatacttcatgaatcagttgcattccatttttgtatgtttaactaataaaatgttccctttctttggtattgtcttaaaatctagcttcctgttgcttccatctattgattttagttatcccctttgaagtcaaatagtaaaactaaaataattattccatgtgagagcccttaaatatttaaagacatatgtcatatcttggctaagagttatttcctcattaaaacaaaataactaccaacattatttttcttttaagatataaaataaaataaatctatgtagatagtggtcagattctgccaatgaaatcataatgatctacttttcatgtatttaactttgagaaaacctggctatgggtgctaggcaattaccaaatcaaaggttgttatggtgaggaaagtctgaataaatgtttaaatcccaataacttatccctgatcttccctcctcccctcaagatggcaaccttaaaccaaaggagaaaatgcaaagattttgatgctaattaggtatgtgaggtttacctcctccttctccgatggtttgtaaggccattccagatacatcaggattgtaaccctaagtgtcccacgccctacatcaggaaatgaattacctatatttcagatacatatgcaggatacttctactttctatatctttacttatagggagctgtgatcccaaaccctactaaaggcatcccagaccacagcagaggtactctaaaaaaattagctggtaatggaaggaacaataacaatacattataccctaactgtaattgaaatctactctgtctctagagaatattgtcagatacctagccaagaatgggattttattttctaattgtgtaaatgttcctattttttttgtatatcatagtatttgtaattagtaataagtcactacgacataaggattctgcaaccatcacttggattattcctcaatatttaaattcagagacacagcaggcctggtagaactaatcaccttttcatccattcagaagcagatgagtatctcctactctgagcctggtgccatggtgagcactgggaatagagataaaagaaagtcaaatcatatggaaatggaaataatgcaatagtgagagacgaaaagaagaaaccagattactataaaatagtctaagtaatcagttaggatatcctggactcagtgctgtaggggcacaaaaatggaggtgtgtatatatatatatatatatatatatatatatatatatatatatatgtgtacatatataagtacacatgtatctatacagatacatatatacatatatgtatctatacagatacatatatgtatagatacatatatatgtgtatagatacatatatacatgtacatatacacgtgtatatatatacatgtgtatgtatatatgtacatatatatatacatgttcagggtcggagaaaaggatagtaaggcaagggttctagagaaggtaatagctaagctgagccttaaagggcaaaaaaagcatatgaggcatagtctagaccacaatctaactggggaagcaagaaataaaatattaatgcaaaagggttgaattggataagcagactaaatactgtaagcaaggaaaataagaaacaagaagctacatttaagaagcagctgcttctctgtatttcgaactatgtatgaggtttaaatagtcaaaggacagaaggcaaattatgcttcctttaattctctcttatagtccccaattttattccttcatgacactcttcacaagtgagtaataacttattaaaaactgtccccccttctaagctgtaaattacagaggatagggaccaagtatgtttttttctccattgcattgctgccattaattgagtagttctcaccaccaagcacctgtttagttaatatttgttaaatagttgaagaattagattaatgaattgaatttcataagatgctagaaaagtaagatgttttataagatattcatggtttggtttagtgatgatgccatgtaaattaaaaataaaatttggaaggagcaactagaattaaggaagggcaaatcagagggtaggaaaagattactattagcatttccagcaaaatttagagcttgtattgtcttgatgttttagtataaaagtggtattatgaaaaaagtatattaaaggattaactgggttctgtgagccaaaaaaactagaggaggagtgaatagctaggtgaatagctaggcagctggtgtctcactcattctggttggaaagggatgaaacctattctaaagtgttttcagtaggtgtgggaagggaagaaaagaatagctatcaaggaatcaattgtttgtgaataggatggcatagaccttatttggcaagaaagaacagctacataatttgctgtgtctggggaaaaatagattgcagggccccttgtttaaagagtatgaataatctcaagactgtgacacaagaggctaaaataagggtggggtccttctaagtatgtggccctttgcaaccagacaggttgtatatccatgaagctggccggttgtcaggaatctcatataaagaaaggaggaaagaagaaagcaaagaaaggatgaatgaagggaggaagaaaaaataaaaggtttagggatgtttatttcagcatatactgaagttgtgtgacatagatatacatatattaaaaataacctttaattgtatggtgtatcatatctcctaagtttaatatgtgatcccaatgggtcattactatcttcaatgcacagtacatgttattagtttattgttttgtagagaagggaactagacaacatgtttggaccagtgtatcagtaaggctatgcttatagacaaaactgatcctctctctctcttaaaattaggtcttataattttaagctacataatagaaacaatgtccaagcaaggcaggtaagtatcccattaatctgctgaatatttctcagtgcagaaccactacgtctatgtattaatacttagaaatgggtaaaacacacaagaacactataccttgtcaagaggaggagactaattcaggtatttagatgtttgaaaaatgtcttatataaagaaaagctaaaaaaaattgacaatatttaacaaagaaaaaggaaggaaatatgggacaaatagtgcctgcatttattgaaggattactcagagaatctaaaatcatttgagctaccctaataggtgtcataaaaaacaaggaggaacgttataggaatgaacattttacttctgtattaggaaaaccttctgccagtatgaggtcaaaaaagaaaatggcctattcacaacaattttatttttacctgtgtaaagaaaaattgtgaaatattttgaaatagaccaaaagaaaacacaaaaacaaaacaaaacaaaacaaaagccactggctatcctgtgtgatgcagccttttgggtatctcaagcttttattgtctttgagatattttgtaactacgtaaattaaaaaaactgaaaataatgcaaatcacttttgtctattgcagtgcaaatttgtggtgtctaaattatgattgccctataactccttttggatgtacgtgtaaattctttttagcattctagatttgcctagaatgtgtggttctttgagagtcactttgaatcaattataatatcttactggtgacttcagtaattctggagttaaataaaatttttgagatgtgcatttgttctatatttgtatgagagtcttgattttacctttaaaaacctttatcttttaatacttgcaagtgtgcaattaaagcaagttattttaacatctatcagaaacattctgaaagagattcctgaatttgtagcagactgcactaaaatattctcaaaggcaccttttaactctgataatgtccaatatatgaagaaaaggaattaacagaaagaataaattgttctaattgaatgacttggcgaagggaggcaccattgaaagccacaaatacagttctacggtgctgcattggaagttgtctgtaagtgaattcagacttactgagaccaaagtgatagagggatagtcatgggaaaatatactggagtaacagaattcaggctgaattctggatgacaaaatcagggatctgacttagaagtcattgacagagagaagcattgaaattatcactatgacaattatgccaagaaaaaggaagggaaaaatcagcaaagagataacatctgtttttttgtgaaatcctcagaatgtggctattgttggagaagagaagagtatttattctttgacacaagtttccatcttggtaactatggatcatggatgtctcatttttttctctgtaacaatgcaagagaacaaacaacatatataagatatctcgtttggttattttaagtattccatcatagaaagtattgacttaccttttaatttctcattttattctcacaagttttcttagacaaaacagaaattatcattgattggttggagttttaaaagacctggataattttgttaaggttgatcatcactattatgcacaaataatttaaacaggtactttggcttcttgagaatggagctctcagtaattttgttcatagttgtttgtattccaagaactcctgaatccaaccccatgattgaattcaacatcattgtaaggcacgtgcttataagaaagctgcatatttaatcttctatttctttgaaagaggtgaaagtataattctagcaagacaaatatgcaggcctaattgataatttttatttctatatagagattcaacaagagctaaggtgtcatagaggaaagtcactgaaagagctgactagcacataaaatattttttttggtgtttgaagcgagaaaggaagaaacaacaatctatgattagagtgccccttagtttcatttcaaagagcatgaggctctcatggctgtatgaggcctccactaaaataagatgaatgggaaggaaaaacttatgagtttattgaaattgcaatattacaatttgccaagagttctgatctatgatgtccagtggttttccaactccttggactccttctaaaatgctgcattgcatatattcattctgcaatttaaataatgtgtgtgtgtgtgtttgtgtgtgtgtgtgtgtgtgtgtgtgtttcttaacagagtgaaaaaaaaaagtcctgctactccatagataccagggcaaggagcagagtgtttgtgtacacacattggactgtaaaaatcaagaataaaattcttaacttatgctgccacttctgggctgaatgcccattgctggttaaatttaccctaaaattgcaggaattaaaaatgtgatccgtttattatctctgaaagagcaaagacagagtgggaacctccgagtggttttgtggtcggagtgctctgctcttctgctgacagcctgtcagtgccctgttcctttctcatccttaattagaattctcggattctgaggttgccgtctgtaccacatttgccactgtggtccccggacctggcacaaacacggctcacctcgtcctcataaaatgactcattaccttctccagctgttatctattagcactgcagattttgcaccaatttccatgccaagtcatctctcccaccctccttattgccccacaacctactggagccagctggtgagaattcccacaccttgtttaagaggacattttcttgacacatcaagacagatgcatgcccttaagtgcacctataccaagacctgaaacaggataatttgtccagttctcagtcacagatattttgaaaaatctagttccatagcagcattaatgccatgtcaacatttgagacaaatagtgcaagaattgtctgttactgagtgagccattactcaggctgttctcatctgaagaatctttgcatttagtgtgttcaagctaaaacaggaatcatttgtgttcaaaattacttctgaacacctaccagccaacataatttgcttacttagtataccttggggcctgcatgtatgtaggaaatggagctaggaaatgagacttgtgaacaagctgaaagggaaaaaaaacaggttaccttgaaagatacaataccaaatttcttgtaatttaaaataactcctcaacagcaacaatgtaaagaaagacagttgctgtgttctgtgaaggaagctgtgctctcagatttatatgttccaactcatggcatcctgagttacaccatatgttaggatattattatagagtttagagatatagaaataaacaattcaatatttttgaaatgagctattggccaaaagtacaaaatcttttaatgaacaacaacaaaagcaaccaacgacaaataagggagaatagcataatagttatgaccaaaggttttgggctggaaaaatacatctgcttaatttcataacacttttgagcaattcttaacttttatgagaacaataataatatgcagggctggtgggtagatgatataagatgtaaaattctcagggcaatacttggctctatagtaagtctttggtaaatagaaaccagcattagaaattataatggggaggagggatgaaggtaggagggaagagagagtaaaacatagtcaataatcaatcaatcagaacagagcagaatggcttaatttgatctcaggaagaaaaatgctgctcagagataaagataatttaaaaattacatgcaacaaaaaattgatggaagcgtctacatgaaaatttaaaacttctgcacataagaacaaaccacatttcttaatccatgtgttaaatgtggcacaatggaagtatactgtctcagggtttccttcaatttggaatattaatatttagaatcaacatttggcacattccatttggaatattatgttggtgcaaaagtaactgtggttttggtcatgaaaagtaatggcaaaaaccacaattactttttttaaaaaaatttattatactttttatactttaagttctgggatacgtgtgcagaatgtgcaggtttgttacataggtatacatgtgccatggtgatttactgcacccatcaacctgtcatctaggttttaagtcccacatacattagctatttgtcctaatgctatccctacccttgcaccccaaccctctgacaggccccagtgtgtgatgttcccctccctgtgtccatgtgttctcactgttcaactcccactaatgagtgagaacatgagatgtttggttttctgttcctgtgatagtttgctgagaatgatggtttccagctccgtccatgtccctgcacaggacatgaactcattcttttttatggctaaatagtattccacggtatatatgtgccacattttctttatccagtctatcattgatgggcatttgggtgggttccaagtctttgctactatgaatagtgctacagtaaacatgagtatgcatgtgtctttatagtagaatgatttataatcctttgggtatacacccagtaatgggattgctgggtcaaatagtatttctggttccagatccttgaggaatgccacactgtcttccacaacgcttgaactaatttacactcctaccaacagtgtaagagcattcctatttctcctcttcttctccagcatccagtttcctgactttttaatgacagcccttctaattggcatgatacggtatctcactatagtttatgcaagcaataaacatatgaaaaaaaagctcatcatcactggtcattagagaattgcaattacttttgcacaaacctaaatagtaccatctagtccctgaaaaaatatttattgacaatctaccgtgtgctgacttctctgttcagcctcaatcctatcctaggtagtggaaaactgagaatccccaggagcatgtgagaaattaaacagagcagcttcaggggccacttgaaatctcctgctttccagagcaacttgtgttgaagcacagagaaagtgttgaggattgttacttcaataaatccccaaatttgcattagaagacacttagtttgtccttagcgcaaccaacgccttgtatcatggcccaactctcttaattgttcagctttcattctctgtttcttgtttaacacaatggtctgtatctcatagaattccaaacagacataggctacttttgtcttaaggcaaattggcttataattatactaattcaactaatatttatattttaccatctacaataaaaattttcaactgtttggatgaattctaatgggcaaatatttcagtacaccataattgggcttcaaaggcaatttttattaatgcttcttgtaacatacgaataaacacatttatatatatgttacaagaagtctattgactctgtaaatggtaaaatctgttaacactgcatttttatttctgctgttgcttttaggagttgatctccataacctggaataaagatattgtctttcttaacttggcatgttgctaaagtcatagtcaaatcaaattgtgtgtgcactgttttgaaacccccctccctatctccatctacctttcctggagaggaaaaaataaaaacaaaaaagaacaaaaacaaagcttgcctccacctggctttgagccagggaagaagaagaaagaagcttttgttattgatgctatttataaccctgaattactccgttagaataatggggcctgagcaggggaaggtcttttgtttgcttagtacaaatgcgtcttccccctcagtaaaaccttacttaggatcatactaaacagtcactgcaggtaccaggtgtggagctaaaagcgaggaaaggaccaagatatttgtaaagaagaaatggagaggaactgagttccaggcagaagatttggaagcggaaaccatcctccgaggagatggagagccagtggaggatgggttactttctatctgaagcctgtggagattgagaagaaaataagtgtttcaaggggttttgtcaagtgaaacatcatgggggtggtggtggtgaatgtgaagtcgtcccacctacaatacctttgataaaatattgttcattgatatggtttggctgtgtccccactcaaatctcatcttgaattgtagctcccataattctcacatgttgtgggagggacctggtgggagataattgcatcatgggggtcgtttcccccatactgtttttgtggtagtgaataagtctcagaagacctgatggttttataaggggaaaccactttcacttggttctcttttctctcttgtctgccgcgatgtaagacgtgcttttcaccttcggccatgatcatgaggcctccccagacacatgcaactataagtctattaaatctctttttctttataaattatccagtctcgggtatgtctttatcagcagtgtgaaaatggactaatacacccatgaatatcttcacacaatgttctagaaagaagtttcttcctgtttcaaaattagcataggatgaaagccaggcttgtctcagaaagctgaggggagggccacatcaccaaattctgccatcaaagccactttccttcagttcattggctttcccaaggtatgaaagaaaagtgttttctttgattggtccttttattatctacagctcccttggagcctaggtctactgtattcattcaaaaagagttggcagattggggatgacccaaaattacaggatttaggacattttcttaaaatatactaccatgctgtttttactgctttaacagcaaagcatccagacaatgcaggtttttaggatattgtgtttttccagagaaatcaaatgaattaggtccccagtggtaaatataaaaagaaaaagaggacttgttcgatttatagcaaaacatatatttagctataaaggagagaaagaaaaagacaacagaagagaaaagaaaaaatgcattttaagagagtaataaataattatgaactgttgattcagttgggagggtaaattatttcggtacgtctgaaaaattcagaaagctgtaaaatcactagtcagcatgccactgactattctggattaaagcagcaccggttaccattaaatgaaaggagagaacacggaagaatgtaatactgtgttttatgcataaacagtgttgcaagtacttactacatgcaacaattttgtaagattgattttatacccattttagcattggggataattgagtttcaaaaaggttaatcagctagaccagcttgtatagagaacatgcattttaagttaactgaagaatagttgaactcttagtctttgccaggctgtatacaagatcaaggtcagaaaactttgtaaagcatcagatagtacatattttaggctttgcaagtcatacagtctctgatgcaatactcaaccctgcagttgtagtacaaaactagctataggagatatgtaaaaaatgagagtggttgtgtgccaataaaactttatttacaaaaccaggcaggcagcagactggatttggcctggggtttatcaactcctatgattgatgatgagggtatgatggtgagaaagtcaactcattaatccctcacagagcctctctaattctaaagacactatttcaccgttttcttgcatctgctttatttagacagtgcttccccccaaaaagatctgagatttttaagctaaaaatgtttaactaagaaaagtaaatatttgcaagatctacacatgagcaccctggttcttttgcattcatgcaccagtggggtctcccaactcatccaatttacgaattttcagtttgtctccatgtctttccacagtttccaattccaagtgcaaatatcctcctagctgatttcccattaaacagagccacattatgactcctggaagacacatcaggttaggattattagacttatcttcagggaacagacatctcagaacatatcagaatttatgaagttgatgcatttgattaactgtatcatcgctgcagtcctacagctggattattgttttgctgtcaacattcgtcagatcttgatttgagcatccttgcaacactattcctcctctgttcagttagctcctgtgtggagacagggacccttcgggaaatgttctactgcctcctatgttctgctttgaatcctcctcccctgtttcacatgttaaaacaaataatacattttgaatattaatacacatttttgaaaattatttttcagtctgtacaaccttttgattctggttacttccctgtcttagaaagggaatcaataaccaagagtgtttttaaaataaagtttctattataataattatgatttactatttttatagtactataatttcagaatttccttaaagaaattaatttcgaagttcacaactttcccctcaaaatgcaaattgtaacaaaaataagaaagaaaaaaatgataactaccatgtattacgtacttaataggtgccacagactgtgttaagtaccataaatggattgacttttttacatgcaaacataaaattataaaattagaggtaagcttgagagcaaaataataccacagtaagtaattcaagtgacagtgctgtcctttgttgcttctactacaaagtgaattatagggtttggcttttactagttcagatctgtattttaggtgtgagttcaataattgttctgagcagagttgctctggccaagctgactgctgtattctgtgttaactttcctggtttacctaccaaaggtgaaatgctctggatgccagaagaattgagtttaagaagccaggatttggagataacctataaatattggaggcaggcccaaaggaagttgtagggagtactaaatataagacttgacgacaatagagacacagccctattctcagggattttgattcactagatctgggtaggattcagtaataaatatcattttcaacaaaaatcctcagcgattctgctgcaggtggtcctcagatcacatcttaagaagtattgatgtaaacagaactgtttcaaactgcttctttcttcattcccttactccctctgctaaccaagtcctcccactcagtccactgaaagggccaggcttggtgatgctaaggtatggcttcctccctaaaggagataaacaatacaaaaactttcatgctgagccaaaatgttcacttaatatcaacttgtaacagtctcttgtattttgtgtctagatccttgatccaaaactacctaaatttggaatgaagctgctcaaactttcataattactgacattattaagattttaaatctgtatagaactaaagttttacttttttaattgatgcataatagatgtacatattttgggggtacacgtgctagtttgacacattcatataatgtataaattggtgtaattgggctattcatcaccttatttactttttatttgagaaatattcaaattattctcttctagctattttgaaatgtacaatagattagcgtaaactatagtcatcctactgatcagttgaataccagttatcatttctcctatctaactgtgtatacttgtacccactaatcaacttctcttaaagttcttcttattttccagccatgcctagaatcttgacctagtactggtaaacactcatgctctgcatgtgtttacaacactttcgatttccccatggttgtgagctgttcctctgaattgacacttggatagatgtcctccaatacccatgttgtatttcatttccatcatgaatacttgtgtatgagctccttgctacatctataaaattggatttccagccttgccttatctatccttgctcaggtacctgctaatagacatctcctcttgcaaatcccacaaagacaccaaatccaatatcaccaacacaaacctgatccccttttgtcatttaaaaaaatcttactaaagaaggccatcactattccagtcactaacgttaaacaaacaaaacaaaaaactgggtgtcatcctagatccctttatgcttaccacacatcccttcatttaatcccccaaccgttttcacaggcaccagtgtcctagggttctatctgggcttcctagcaccaatctccctcctctcaattccttcttcacattgctgcagtccaaactatcatcaaaccaaatctgattatgccattgcttttcttttctccttaaaacactttaatgttttcacattgccaaaagaatcaatttcaacatccatgcaattaaaaagtgcatttataacccagagactgtcaatttaccccaactaatctccatctcattccatgtatataatcaaaattaatatatatccagctataataagtacttacagtgtcccaaatatgctgttctgcttctggcctcgaccactccaacttaaatcaccatcatgttttttctgcacctctgtaagagactctcctttcccctttctcttcccctaaacatgtcctccacccaaccccctaagtgaattttgataaaataataagatcatgtcagtcctctatttggctctccaatggcttcctgctgcactggatggatgttcatattccatccattggtctataaggtcctctatgatctgattcctgcctaccctctgccccttctctccttccatcctcccactctttcaaatcactccaacccaactgaccttcctgatcctcacatgagccaagctcatttctgctttaggaactttgctctcagaaccttcctgtagcttttcctccatgcttatgcatggctggttcttactccttattcaggtctcaactgtcacctcctcggagaagctctccttgaccacaccatcaaacgctaagtgtcctccccatatttctctgttactttactgtgctttattttcttcacgccatttctcacttagcaaaatcacctgaattagttagtttactaatatagtcatgcccctccccaacgcaattgtaaggacaccatttcaataagcatttgttgaatgtctcaatggctttgcttatgttgttccttctgcttcaaataggcttcttcaaccttgggcactgactacttgctaggctctagaatattcttcaacacttaattcaaacaactcttctgctgggaagtcctctttcaccccaaacagcattgatcacatctaggtttgccttgctccatgtctcattacagcatcaaactgtttcataactatttgcttgcatgtccttctcccaaattagacctccttggagtaaaggatgaatcttattcatctcaggatcctctgcatataacacggttctccaggggcagtagatactcaataaatgtatcctgaatgaacaaataaatctgctgctgcccataccagagtgtagataagatgtgagaacagtgatgatcagagtgatggagccttaagactaataaataagctgaactcaagtctctcattgtatgtgtgtgtgttgacttttcacatgtatagaaagatacacacacataaggtatgaataatcctcaagtacaatgattcaaagaaattacatataattaatccttattatattgctcagaatgtattttaaatatatttggtcatttatggctaatgcaacaattgtagctgcaactgtagctgtgggtactcatctttttgatttacgtatgcctgtaactgtacttacctaaattgataggttcagaataaagaaggaagagtatgaagcaattcaaatataatgcttagttcaagggaggtactttaaatctcttcttaattaaagaaataaagattcttggaaaccaatcattgaatttgaattttgccatttaaaattttatgaaacactaatgaataagatataatgtccatgtttatatacattcctataaatgttaagtatttgcttgcatctacatatctattcagctttgattattcctttttggcagttttatccaatatattgttttttggaaaaaacaacttttaacaatacttacaagactcatgattatttctctcttctgttgattttgccaaagagctttaaaacatcttttatcactccttcattacatggatgaataaacttatttgagcatttatttactaactttgcagttgctctagttttctaaattttgtgttttgaatcctcttctgtgtctgtaaaatgaccttggagtgaagttgtatctgcaagtcacataaagccataagagatcatagagatcactaaaatttattcagactttttgagtatttgcaagattgtgtgggaaagaaaaagaggaggaagaggagaaagaagaaagaaaggaaagaaaggatgaagggaaggaaatagagaaagaatgtaagacttcaaatgcaaagaagaaagtgcaaaatccagtcaaatgttttggctggttgagaaatgaaagcaggtaagatattacattttattaactaagaggccaactacttttgaatattttgaagcccacaatatctgcagctccaggtaccttgccggctaagctaaaatcacggggtccaacttctgttatttggaaaggcaattgcctgagtggccatgaatcttccaatcttaagacaattaaaagtaagtagcaatgataaaaaaaaaaatccagttaaatgaatgctaatgacctgtctgactagcgatgtgtctttcaatcccagatgaaaaatcacaaacaaaaagatttaacaaaatcaaaactataatatctgaaattatagaattggattctcatgtctaaggatttgcacatttaggcaatttatgtttctgagatgcttaaacaaatttaatctagtagactgatagtcttatagtttaaaatatattttaatcaaaatataatgaagtaactgatagacttgtgattttaagttgaaattttagtagacttctgttcggtaatgggaaatctaagatttttttcattcgtcgattataaattttaggttttacttttataaaaattatttagtgaataggaaagtttgattaagttagagagttacctcaaaatgaagtaaaatatattaatttttgaataatataccttctattactacatataatagtgctaatgaaatggtagtatctattgttgcaatgcagatgtggagtcatttgcttaaagcccattaaattgtttagaaacctaagagtaacagatgaatgcctactttttgctgtgtctaaatcatcctacgtgttagttgctcttgctatccatttatagataaagaaactctagaacaaggggtaaaggaatttaagtaatctgaccatgtttgctcagctagtaattttaggaaccagaatttttacctagggttgtgtgatttcagtataaaagacttattaaacattgtaatacagcaatatacagtaataccacctctatcttgtttaacacgatatattttgctcctcaaatggcaagcataaatgggaccttggcaaattgcaggattatttgctattggaaatttttgtctaagagtgaaaaataaccctcattaatcttttatttccatacagagtttcatagattgtctatatttaagataaagccaacttttacacggactacctctgaaaaatataaattggatgctatttgtctgaagaagttaggatgagatttgatatcctttttttggtacactaaatttagacaaattcaagcaattcttttgaaaatcactgtgggacaaagatattgaaagacaaactagaaaagtaaagtagctagtggaacatctttatcactttgatcaattatttcaaaagcctccaagaggtcagattacttcgctttaggtttccaaatgtattaggacattttcagtgtaaatggacagttagtctagtgaaagtgttgttcctctggcattttctgaactttaaaggacactggggtgtttctgggagtaaaacagcaagtcttctttggtgggattcttgcgggctggtcactaaaatgcaagtgtggtccacgttgaaatgagtaaaactattgacctatggctcagaagctaagagaccaaggatgacataaacatgaacactagctgttccaagggacaatgccatctggtttgctgtagacgctgtcagaaatagcagactcctgagattctcattttcactcttggcagattggaaaaggctaacaaacactatggcacaaaggtaaataaactttccttggaggctataggcttctcctcaaagtcaatgaggcaaggcaagtacatttttaaagtgagtccttattgaggatcattggatgcttcattcttgtgccttgctctgtcataaagcttctagggcgagaccaatatgcccaatctcaaacattctatttttaatattcctttttacaattttttttttgagacggagtctcactctgtcgcccaggctggagtgcagtggcgtgatctcggctcattgcaacctttgtctcccaggttcaagcgattctcctgcctcagcctccagagtagctggtactacaggtgcccgccaccacacccagctaatttttgtatttttagtagagatggggtttcaccatgttggccaggctggtctcgaattcctgacctcaggtgatcgcctacctcggcctcccaaagtgctgggattacaggcgtgatccactgtgcctggcgtacaatggttattttattgactaaaactaaattagttttcacatgtaaacaaagatagttaaccattccctgaccaccatcaaaaaaatggggtgggaggaggagttagtggctctgagtagacgcaagttgagggagtcttcttccagacagaaaaaaaccatcctctgttgtcttagaaatggtggccaataggtttccttccttctgttgttttctctttggacaggaaaaatatgtagaaagaatgagaaatgccctaagcattaaattcagtaccctgaacaatcttactggggagttgaacccatgcctggatagccagagaaagaattatattatttggaggggagcttggggtggtggccatccagatatgggaactcagagaaaggatatttctggcaatggcagcttcataatttctaaatagtgataatttgatcagagagtgaaggtggtggtggctggtaggataataacattgagactcgatatgtatggcaaacaggatcctttttaacatatcactgaggatggatggagaggaagagagttatctttctgagaatccctgatatgatctgggaacagtagtcagcagagtcattacttttctattgctgctgtaccgaattaccacaaacttagtggcttccaaaattgcgaatgtattaccttttagctctagaggtcagaagtctgatgtgggtctcagtggactgaaatcaaggtgtcagcagggctgtgttgctttcccagtgctctagggaggagttagtttctgtgctgttttgtttgtttgtttgtttgttgtttgttgtttgtttttgagacagagtcttgctctgttacccaggctggagtgcaatggcaccatttcggctcactgcaacctctgcctcccgggttcaatcgattctcctgcctcagcctcccgagtagctgggataacaggagcgcatcactacatccagctaatttttgtatttttagtagagatggggtttcacatgctggccaagctggtcacaaattcctgacgttagtttttactctgcctgcattctttggcttgtgcatgccttccatgttgaaagccatcaatggtgaattgagttctcaaatcgtattactccaatcttccctctgactcactcttccactccttaggacccttgtgatttcatgggttcctcacatataactcaggaaaatctgcctatcttaatgtcagctaattagcaacctttttttttttttataatgtagcaaaatatattagtagggtccatgaattaagatgtggccaccttggggtgctttcattctgtctgtcacaacagctgtgaaaaacatggtgtctggagccatattgtctagattcaatcccaatgccaccacatactaactatgcaactctggactaatgacacagtctctccacgcctcagtttcctcaactgtaaaccacagtgaataacgcctatctcagaaggttcttctaaggaataatgtgttaatatatgaaatgtgcttacaacagcacaagtactcaattaaaatgaacaattctgatgtccacctactttatcaagatagaagataaaattattaaacatatggcgaatgcctacaagcttcagacttaggagaatttgattgcagctatcaacaatagacacttacaagtgcttcctaacatgtctacactccaaattcccaaagtgaatgaatggctcaggagatcccagaatcaaatcaggtggacactattagaaagcacccgatttgatcccgggatctccccagccattcattcactctgggactccgggaatccttgcatggggagagcttctcacatataagcataatgtttatctgtagctctgccagttttcttagtcctgttcctttgaagtctagcattaagtaggcctaagatgtcatgcaagccactgtccatgatactgctggtctctccaacttgcatctgcctccctttctcacaggtcacagaaaaacctatgcttaccctgaatttttcagaacatagtcacatagcacagctggtggactctctagtaacaaagctatttccattgttccacaatcatctgcttcacaagagacaacaggctcctgagaactggggagctgagacgctgcaggtgacagttgtatacagacgtgcaaagttcttgggatctcttccaggttctaattcaggcccggatgctaaggcttgccctgctctgcaaggcttttactcatggtgcttttctcttaaaggctttattgttttgttttttcatgatggtccttattacagacatttccctctctactctacattccctttctattccctctgtattcttccacaactaattaccacaaccttagaagcttaaagaaacacaaatttattgtctgacattttctataggtcagaagtccagtggtcactgccacgtctttatttagaatctcacaagcctgatataaaggtgtctgcggggctgccttactttctgaaacctctagaggaatgtctctgttcttgctcattcaggctgctggctgagcttagttccttgtgctgtgcaactgagatccacatttccttgatgtcagctaaggaccattcttagattctagaaattacctgcattccttggcttgtgtctccttcctccattttcaaaggcatcaatggtggccgagtccttcttacatcaaacttctctgactcttctgtgttcctcttctgtttttgagaatccatgtgattacattggggcctccaggataatctccccatatcgaggtccatagcctttatcacatctgccaggtctttttttgccatgtaatataacataaaatagtcacagaatctagagattaaggtgtaagcatcattgtagaacattagtcagtcaagcactgcctcttgtactccagtcatcagggtcattagatctacatatgtctgaaatttttgcttctaattttctcccacagactccgagttctcaaagaaaatcaaggcatatggctgggcatctcttttagcatccttgaacagtctgtaatggcccaaatgtacttcaagaatgcagcaattgaaaacaagtcacccggagcacacagactagaggtaggtggtgcttcctcacagccaaaatgttgcctcatcactgaccagccaaaggtgatccatttcatccatattaagagatactgaaaatactaggagaactgatgagagataaactgactttcctgggagaatttagtaaaagtcctccaagagattatgttcaatttgaaatttgaagtatgcaggaagtttaataggaagaacaggaatggataggagaaatcatttcaagtaaatagaaaagcaagaatatgcttgtgaataatgagaaaaataaattttgaataaaattatgggtgtgtgtttgtgtatctattgtatgtatgtgtgtttgaataaggcatactgatattatgtattggtcaaccacaatataggaaaataaattgaagggcatctctttaaatcttacaggtagtccatgctttccacagtaccagcattatgttaaatgaattcattcatagtgatcaattcctcacttcgcatgagttacagttaatatggttctgtgcaaaacaaggacagcctgtatgtctatttttaatcaaagatctgaattgctgactacagggcatactcattaattcagacacctctgaagatagaaaaatttgctaggactagatttgaaggggatctttaaaaattagagcaacaagtaatcacaatgaagatgatatttcttaacaagatatcctcatggaaaatagagaaaagagaagaagattgcttccttaaattagggacacagactagtgaggtaaaagaaaagcagaaaaataatctgtgagttatacttgactacaaactgataggagagcaagaacatgtagcgagcaccctactatgtgctaagactgtgttaatctaagtacttttgtggttatcacatttaatactcacaaatgtttgtaagatatattttattaggtgaatgtcttgatgctgctgaagatcgaatactatctgaattgaaatattatctcattactactattcctcatgccacaccaggaatattcttgtcatacctactctgatattctggaaacaggcagaaactgttatatttaggagatacttctcctgctaccttagggatacttctcctgctgtctttagattataaaaccattttgactatgaactacttttcagtggcaggttataacaggtcatgcccttcgggcaatttataagcttgctatggctactgtaacaaaacactacagagtgaatggataaaccagcagaaatttattttcacacagttctggaggctagacatccaaaatcaagatgtcagtggggtaggttacttctgcagactatgaggaatgatctattctagacctttctccttggcttgaagatggctaatcttcaccctttgtcttcacattgtcttccttctttacatgtctgtatccaaatttcatctccttatgaggacagcagtgatattggcttagggtccacactaatgacctcattttaatttaactctgtaagtcccattaaacaaatatagtttcatttgaggtactggaacgtattataatctttctttttgtgagggaggatgacacaatttagcccataacacagaagaaaaacacaatcaaaattcacattagggattttagctctaagaaattaaatatgtatattagaatacataaaaacaccaataagaatacgaagtcatttgtgtaaatgagtttattcatacattttcatactgctacaaagaaaaacccgagactgggtaatttataaaagaaagaggtttaattgactcacttttctgcatgggtggggaggcctcaggaaacttacaaacatggtgaaaagggaagaggcacatctttttttttttaattatactttaagctctggagtacatgtgcagaacgtgcaggtttgctacataggtatatatgtgccacggtgatttgctgcacccatcaactcatcatctacattagatatttctcctaatgctatccctcccctagacccccaccccctgacaggccccagtgtgtgatgttctcctccctgtgtccatgtgttctcattgttcacctcccacttatgagtgagaacatgtggtgtttggttttctgttcttttgttagtttgctgagaatgatagtttccagcttcttccatgtccctacaaaggacatgaactcatccttttttatggctgcatagtattccatggtgtatatgtgtcacattttctttatccagtctaccattgatgggcatttgggttggttccaagactttgctattgtgaacagtgctgcaataaacattatgtgtgcatgtgtctttatattagatgacagcaggtgagagagagaagaagaggagtgaagggagaagagccccttataaaaccatcagatcttatgagaactcactcaccatctcaagaacagcatgggggaagccacctccatgatccaatcacctcccatcaagtctctccctagatacatggggattatggagattacaattcagtatgagatttgggtggggacacagccaaatcatatcagtgagcaattaaggaattaacagtgtcgaatcttggtttgttaacattgatgaagacaaatatatagccaccaatatccactctatctcttcacctggtttaaggtttttttgtttgtttgtttgtttgtttttgtttttgtttttttcctttcatcatggcaagaggtgctttaactcttcattctgtaatcccatgaacagctatacagatgtaccatacattttttggaggggtgggggataacattcttcaatgtcactaggtttttgtaggaccaactcaagccggcaggtatagttagagagacggaaaggtacaagaccaactatggaagaatccaatgcctccaagcattacatgttaggataaagatcaggatcactgtttgcattctcagtaagataaacttagagaaactgcatgttttcccttttctcaatgatttaactttttcttagttacgagacaaactttagaacagccaataatccattagagtgaagacataattgtctttttaataacaatgcctcaaagtgtgggatatacgcctgtcaactcagagttagaattgaatgtttgactttcattttatttatgttgtagaaaaaaagattgattttttttaaaaaaaggaggtttttctgttttatttcattttaggctgaaattggttgtcagaatacagcatcactgaaatattatgtgcattgaacaaatggagctgggttgcattccacagtatgccaccaaagtgaaaagaaacaaagtttttgtatagaaaactggcatgttaataacgtcacactcagtggcacatgcctgtagtccaatatactcaggaggctgaggcttggaaatcacttgagcccagaagtttgaaactagtctgggtaacatagcaagaatccatctcaaaagaaattgcactgactggggctgaaccctcaagtcattgaatcatggaattttaaaggagaagtctggctttttcagttgtctggagtggatacttaatttaattaaagagatggaatgcatttgatgaaaacaattaagccacattggcatactctacattggcatctaatatgatacggctatttaataaaaagctagtattctgtttgacagatcaattattcattaaatagatggggcagaaatggacacgcaaaatcaaagctgattaattcagcaaaatcttcaataatactgtcacctttaatccaagccaatggcttccagcacagcaggcagcttgatagagggtaaagtaatcacaatgcaatgtgttaagtgcaagttataagaagcactatgtaaagagtactatgcaaaaacagaggagttgcaccctgacttggggatatcagaaaaatcttccttttaatagaagtaatatcattcttagttttaatagatgtcaggcaaagaatgcataagtaggccgttcaaaggtatgtagagagaaaaaggccctgttcatattctgagaccctggtttcatcagtctaatcttgagtactgttggatcagcagccactccaccaagttggaacatgagggagtaattgatatttctcccataatccagtgtattcattatggtatactgttgcaatcatgctcccaacatgagccagcctcctacacccatgcccttggacagcctactaccacattcaatagggctgatatgtgttaaccaataggacattgtagaaatggcaccatgtgtcatcagaggctgggttatcaaagaaattttagcttctgccttgtttgttctcttggttcagtctctgtgggccaccatgcatgaggacattcaagcagccttatggagcagtttacatggagaaaaactaaggcctcctgccaacagccagcaccaactggccatataaatgaactaccttgatcatgaatgcagactctctaaagcctttacatggatgcaacctcatgagagacccctgtccagaagaacacaattaagctcctgaattcctgacccacagaagagctgtgagatactaaatgcctattgttgttttaagccactaaattttgaggtaatttattatgtggtaatagataactaagacatgagtatacactaaccctaaaataatctcaaaatcccttcatgttgtccaggtagtaccattaaatgtgacctgcatgttctcataagtgtatgtggtaagaaatgttccatgcatttatttacatgtgtctctagaaaaatattctacagggaaacaattcttctattcctcaatggatccaggtagggcccaccaacactttcatttattctggtggccaggcaagtgcaatggtccatgcctgtaagcccagcactttgggaggttgaactgggcagatcacctgaggtcaggggttcaagcagcctggccaaatggtgaaaatctgtctctactaaaaatacaaaaaaaaaaaaaattagccaggcgtggtagcatgcacctgtaatccagctatgcgggagactgaggcaaaagcttaaactcaagagatggaggttgcagtgagccgagatggtggggctgcactccagcctgggtgagaaagcgagactctatctcaaaaaaaaaaaaaaaattcttctggtcagagaaaatcaattcagcctttagctgagtagaatgagtacaaactgaaaagattattagagagtgaattttattcatgcagacaacacgctcttgacatgagggatgcaggtgtttaggcatatgctatacaaacttccagggcataaaaccaggccagaaagaattttctggtcaaacaagctcaacagcttaatagcagttccaaagctaggaaaaatgaatgcacccctaccttcactagactatttccctcctcccagctggaaagataaagggaaaataaacccttaaatattgagctatatatatataagtatttatatatataatatatatagcttaaattaagctataatatagcttctatttaatgcatattaaatcaaatatacattatatataaaataaaattacattacattaaaattatattaaattaaaattaaatatacattatagcttaaatatacacatttaagctatatatataatttaagcttatatagataaattcatatatttatggcttatatatgtataatctaaatctaaatatatatcatctaaatctcttacagacacgcattttaaaacccatcaaaaaagctgacaagtcaggaatccgttttaggacacctatgggcatattctgggaaaggagtcttaatcattgagaagcaaactctggagccatttcatggagggatcttaaaggcacacaaccattggttttactgcacatgtgtcaccgtctgaagccatcctgcaactctcacgagtcatctgctctgaagtagagcacacctatttctggaaaaagaggatcagactgtctttttctgagtgtggttggcatctatgggataggctttcctggttaaaaactagttagttaaaaactaggaagataagagtagcacaattgaaagaaagaatgaaagaaggagggagagaaaagagtgaaagtagaaaaatcaggaaaatctttcagtgatagaataaaaataaatcaaaggaaaaaagaaaaaaataatgattagagtaaaagaaactagaaataactttaaaaacatacatcatatagggccgggcgcggtggctcacgcctgtaatcctagcactttgggaggctgaggcgggcggatcacgaggtcagaagatcgagaccatcctggctaacacggtgaaaccccgtctctactaaaaatacaaaaaaaaaaaaattagctggaatggtggtgggcgcctgtaggcccagctactcaggaggctgaggcaggagaatggcgtttacctgggaggtagagcttgcagtgagccgagatcacgccactgcactccagcctgggctacagggcgagactccgcctcaaaaaaacaaaaaacaaaacaaaaaaaaacatataaaagtaacaaatattctagataccaaacaatgaaacagacaaaacctgaaaacaaagaattgaggagaaaaataaagtacatctctaaaatggaagctattcctgccccatccctaaatctgcttccatattttagatgactgcagttttattctttgagaaggcaaaagtctaggaatcattctttactcctcttgttctctcacaccccacatccaattttccaggaaatcttgttgattctatcttgaggctctttctataatgcaaccattctgcaatctctccaaggccaccactttgctctgagcaatccttgtctcttgcctgaattgtgaaaataccctatgaatttgtcctctggtttctatccatgccctttatggtctattctgaacacagaaacaaatgtgattcttttaaaggtaggtcagaccatgtcatgcctctgctttagcctccaatagctccctatttctttgagcaaaaaaacatacaaggccctacaagctctggctccccagtcactgcccttgtctcagctccttctgcccttcctcttgcatcttcatcatgctccagccttaaagctttgcacttagggtctcccattccctgaagtgttcttcctctaatgtttttccaagactgataccattatcttcttcaaattttgactcaaatcttacctttatctctccacctgtctcacaattgcacccttcaatccttcccctcccacccacctcttctgtgcatgactgatactctttattaccatctaacacatctccagactgctcttccctcttgagaatgtcagcaccaccggtgcagaagtctttgtctgaattgtttaccaatgtgttgcaattgtctacaacaggtcctgaacacatccctgtgtctctattagtgtcctggggctgtcgtaacaaattaccacaaacagagatttactttctcttcatgttagaggttatatgtctaaaatcaaggtgtcagcaggaccaaactttctctgaaatctgtggggagactccttccttgactctttctagtctctgtggtttgctggcaatccgagatttttctcggcttgtagttgtgtcattcacatctctgggcctccatagtcacatagtgttcctcttgtgtgtctctgcgtttcttcttctcttcttgtaaggacacgagtcatactgaattaacagcccatcctacttcagtatggcctcatcttaatacgtgttacatctaattaatgaattagctaattgatgaccttatttataaataagattacatcttgaagtgctgtcaggacttcaacatatctttttagagaacaaaattcaccccataacagttccccaaaatatttatttaaatgaatcaatgaaggtactaagtgatgtaagttcttaaaaacattctttggccaagggcgatgtgggaagtcccttactatagttagtacatctgagtgaatacacaaattagtaagacaaatgtagctgccttgataatgagtttataagtatttttaccaaaactgtcatttgataacaaattaaaaggttgtgtactgtgccttctttcaccatggttttacattacaaaatagagtaatttctaaaatgtaaatatcaataaatcataagaaagtaaaattcattattaaataaagttttacaaaacatactgtcatcctgtagtccctctgctatgagaatcacagagaagtgggtcattgtttcagaaaagaatatggcaataaaagtgaatttaaatattatgtcaaagaggaaaaacacctctttgtgtttttaatatgtcaatcattgctgcattttttattagaggacacgttttcctttaatttccctaatgtgttatagctttattcctaaaccacatgctaccatgattcctttgtgtaattttaagtaataaatcataaatgaatcataaacaaattatagaataattattctgctccagtgctcacaatgattttcctgctttttactttaatgtctcctattcctccttaatccaatatttatatttatgacaagcaccagttttcaatcaagagaaaagcttctgtgaagttgggattagagaatgttttattccaccctctattgtctaaataaacatgttcagaaattaatctcctcctttttatggatctgggctgtttcaaacacccccaggcaagaagaggagatctcgcttctacttctgatcatttgttttaaactctgtctttgaaattagcaaaatcctacagggactcaaaaaggttacttgttctttcaggcctctgtgagtttgaattacctgacaggtattgagaaaattatttataaaacaaaaacttttacagaagctaaaatataagtgacagaaaggactttagaagggacatgttgtccagaattatctaaattgtaataggttgtataccactgatggtacatatgatgctgaaggtagtaacatactattcaaaaacagactttaataggaatatatttgttttacattggcatcagttcagtttgctgtggtactctaaatactcagaggtaatttttgatgctcctagtctgggtaggtaatttaatcaaattcagtataatgctagcaaaaagaaagaaacagctcttcaagcctgtgatttcatagatactactgtccggaacaatactccctttaaaaaataagtcaattgagttaaagcccatttaaataaatcaagtatataaaattgataataaggtatgtcaaaaaatatgaaggtggtagccaaaataatgaaaatttaggaaccattgatgtagcagataagcaaaatagacaaagtaatcaagtgacttttcagattgagagctacctttctagttggagagtggatcattctttcctcttggtttttgcattctctctttctccttctctctttttctggtctctctctctctctctctcactctctgtttgtatttatatattttcttttctttttctttttctttttcttttttttttttttttttttgagagagagtctcgctcagtcgcccgggctggagtgcagtggcgtgatcttggctcactgcaagctccgcctcccgggtgcacgccattctcctgcctcagcctccctagtagcttggactacaggtgcccgccaccacgccctgctaatttttttgtatttttagtagagacgggatttcaccctcttagccaggatggtctcgatcacctgacctcgtgatccgcccaccacagcctcccaaagttctgggataagagacatgagccaccgtgcccggccatatttatatattttctatattatctcatatgttcacttgtttgtttcgtctaccaaatagtgagttacttgatgatcccaggacctcatttcatttatctatgtgtaaataccaacaataccaactatacactgctcacccgataagtgagactcaatacatgtttgtggagtgattggataattaacagcaaagatagaagttagtccattggcctccgacttccctccttaagtcctcgttcagaactattttcactgtaccatgcgttcaacatttaatgcttagatattcatttccaaagtcacaaattaaaatagaaaactaatgcgctccacattttaaaaatcttgagaaattgctaatgattatcaactgaaatatttgaatgtagaaatagctttttaaaaaattagtgcttgattaagcaaatattaaacatggtggtaccactgagttaaagcaagagtaagaaagatgaatatttattatttacataagttttgatcatatccttgttgttagctgtactgcatactttagaagacatgcaatcagacagtccaaattctaattgcagctttgctcattatttctgtctggatttgttcaaatccttagaacctttggagactggaggaaaagtaacaaccccaggtaacctgttcctgaaataagccaaataaggcatagatcccaaggtgaggctccctttgttgattgtattcaccaaatatataaatttactaataactttttcattcatcatctattcagtaactaagcacctgctatgaaccaggactttagctggtatgacggatactaaaatgggtaagtcctagccactgtcttcaagtgtttcatggtctaatggaagatgcagaaggcaaaaactcagatattaaaaatcataagtgctttagtagatcacaattgcagccagaagatgacacttcaaattagaaggggtgttaccttgggattatgatttcacttctgtaagattccatcttgtctcctgtaaaatgggtatagcaatagttacttcatgaaataaagtgatgtaaagaccattgtactcaatgttttgtggaagaagtaagggtaggtaatatacaccagaaattttaggcccaaggggcagcatgactgagcacattaataattaattctggaaatccatgaatggagtcagcagtaggaattggaaagtgattgttttaaaaaagtgttaaggagagtgaagatcaaaagagtagaaaccataagtaaagaaagaattgtggccaggcgtggtggctcatgcctgtaatcccaatactttgaaaggccaaggtgggcagatcacttgagtccagagtgtgagaccagcctgggcaatgtggcaaaaccctgtctctacaaaaaatacaaaaattagctgggcatgatggcacatgtctgtagtcccagctactcaggaggctgagatggaaggatctcttgagactgggaggcagaggttgcagtgagccaagatcactcctgtctgggtaatagagcaagatgcctgcctcaaaataaaaatacgataaaataaaataagtaaaaaaatacagtaggcatagaaaaatattattagagttttaccctcctatctaaaactgtccccaaatcctgttaactgaatagaaagaaaaatagaaaatgaaaaagaaaaaatagcattgatgaaaaatagttgcaaagatttccctgaacaatcagccctagctaagtttccaactaagcccaaactgtcttattacacattctacaactcaggaggggatataagagaatcccctacttttcttgctctagtttttacagctgttgcccatgtacttagccaaggtcatgtgctcaatcatccagtcccgagttttgcttctgatgccctgtctttcagtacagccttctgacctctatctccagtctgctccaaacctccatgatgcttccccagctctgggcctggttgctgattgttgttttcctgagattctgactccagtggtttaactaacaaccttcctactttttcttcttatagagatatctcaggctccgtacagaaactcttattaaaactcacagcattaaaccagaacacagacaaatgcctacaatggatgtgaagtgagccaagcaaaaagcaataaatagggagttttgaggattgttgcaaatagtagtaatgctccaaccaaaactactcaaatttaatttaaaaaggcaaaacatcactctagtcaaatagtatatgttcacaggtcaagaggattcagtctgccacacctaaataaacacttaatgctatctagatctctccagttgaaactgcagctgcctcagaccctgaagtgtgctgttcacaggaaaatgtgtcataattttgccatcttattacttattttttcctgagatagggtcttgctctatcacccaggctggagtgacgtggtgtgaacatgcctcactgcaacctcaacctcctaggctcaagcgatggatcgtcctgcctcagcctcctaagtagttgtgaccacaggtatgcataaccacatctgatgaaatttttgtagagacagggtatcaccatgttgcccaggctgttcttgaactcctgggctcaagtaatcctcccaccttagcctcccaaagtgctggaattagaggcacgagccaccatgttcggccacttcttttttttaatagacaaaaaggcaaaaggaggttttcacaatagacaatgaggcttaagcttgttttctgagaatccaacacatttgggcacgaaggtctgaagctggtctgctagaggtacattatataaaagaaattgatatttgattcacctattgttaatactcaggaacattctgaggttggagccagtgcctttatctattgaacaatcagaaagaaaagaatgacctaagccggcataagctccctataagaacagtgaaagacacatatctaagaagaacctaaagggatcctcaccctacttcagggctgccattggcaactggcacctcaaatactgggaggccaggcaactttgcctttcaactgtgagtgctggagagctccttgctgtcactgtcttcatgctgcgaagttattgtatcctttgctcatattaaagatgtatctttagcctggaatcattggtacctttctgtcaatcactgtcaccaggtagcaactaccaggtaattattcacagatgtacaaatgatgtataattaaaaactgcttgctaaagtcttttaatgactttacccccaagatgttccttatttgatctctgggacaagaaaaaacgggcccttctgagtatgttaattgaggtcataattggctgatatgtataatcagtttttccatgtgttttctcaaccttttgcctgcctatcctgcaattccacaccaattaaaaaagaaatttattaaatatatgtgttcttctttcattgcaaaatctcttattccccagagtatttcagaaagggcaagacaaccttgctttccagctgtttgcaagcattatgcctttgagtcattatgcagagctttttacaaaatcaagacatgtattcataatatctgttaatttaacatgtttatttatatcactggagcatgacttctgcatataaagaaagacatattttaatagttaaaatttaattaaaactataaaactacataattctccatatttataatttttaaataatcagcaaaatcctgaataagaggcatcaacttaaaaaaatagtttgaaaatgatttctctcaaggaaggaggaaggagtgacctgaattttacaaatagaaactttctaagtaacacctgaattgtcagggcaggttatacttcacaaaatcaaatcaatttctgtgacttgttttttatatttcttctgccatcactcagaacttaataactgggaagatttcaaatacaataggtgaaaatatccagtcatttatattttttgtataagtatttaacattcaatatgatggagcttatgacatcacttaaatgagattaaagatgtctgagcttagccaactacaatactagcagcaaatgtccttgtgttcagtgcagtactatgatttccaattagttttttccatcggcttaatttgaaatcataatatcataaacattctgaatttgacattgtgtgtcttcattttaatagcaggaaaacagatttgtaatttttgagcactttatagatggtgaattatatcacacactgagtcaaatcttattactaaacaattatgaatttaccagctagtgactggtatcatgctacttgctagaaaaattactaaacataagatatgctttatatgaaaggagattacacctatgaggacaggaaaatgccgtattcatcttggcattcatgtttttatcctacaaagctgagctcaatattttaccaacagtaagaactcaacaaatattgaatggaatggtttctctaataaaatttctctctctctgtctctcattcacagttttttagcttatgttggttcccaaactttagcttttagttttgcataagcattacctgggagttctgccacttactactttctgccatctactactctcaaagttcttttcaattagttatagagaagcttaggaagctacagttttcagaccaccagaaataccagcttagtagttaccaatagttctttcttgttggagcatctcagaaaagcattacctgggagttctggcacttactactttctgccacctactactctcaaagttcttttcaattagttacagagaagcttaggaagctacagttttcagaccaccagaaataccagcttagtagttaccagtagttctttcttgttggagcagctaagaacaagtcaaagtatttattgagaaagagtggaatttgaataataaccttcctttctgctccatcccagtgaaagcagggtgggtgatggtgatatatatactgtatacatgcacaagaatctgtgcagaaataacatgtatccagcatccctcactccaggcagcaattagccctttcttcccttccctccccaagaggcaatgtactacaatgaatagcgcacaggacttcagatcagacagaccgaagaaacttcaaattctgcctccattacttaccaacagtgaatttgggcaagtgacttgaactcccaagtcagctttataatatatatataagaagagtaataactagctcatagggcttttgtgggaatagagaagttcatagagaattttcatagcatatattccagaattgtaactattgttttttccatttacagactctaagttaaagaaagaaactacagtattaccagtcacatatatttatacactaagtgaaaatgtcaccacaactcaaaaaaataagtgggtgtggaatagatgaccttcgaccttgattcttaacctaggatgggataattatatgattcatattgatgtatttatccatatataatttgacataggattgtctaaatgttgtcagttcaaagtagatcatctggcctgactaaaaagttatcatatttcatattttagtagatataaaatttgactctaaaatgtcagtgccaaaatcttagaaataatattcatgtttttactggagtctcagataataataaatagctctgtcaaataaaaaaggtaaaatataaaatctgaaaatgggcaatatgtttcaacaagtgaagagaaacaataaagtcaaagactctttgacgccgtaaattgaatgccaactttctatttcacttagcttctcccccacttattatgctcttacaggttttgaaagactcttaacaggtaaatgccctcataaattcttgaatatactgagattagagttccccttctgctagctccaaagttacctaattttgtgacaaagtagctgacagaatgtggcaattaagctatgttcatattagacatggctgcatctattttttttaaccaaaatgatctgaggttccaaattatgaagcacagcaaaccaacagtgcttttcagggacaaactgaatatttaaataatttttaaataaatgatcatgactttgttggtcctcctttgctgagcactaaaatgatgatgatgatgatgataaaataataatatacattaaacaatccctgcagtactacttaactattttttacctctatttttgaatctataaaatacagataacaattgtatttacctccatagggtatgctgaatgttaaatatgttaataaatctgctgatctcagcacatggtaggttatatgagaatgtctataattactatttatattactatttataattatcccatttgtaaaattgagggcagtgggtatgttgttatcctaattggggagtagaggaagctgaagcttggtaaggtctgtaattctctcaagtccacatgggggacatcagtggaagtcgaatttaaatcccacttctctcattacaaatactctttccctaactcagagccttctcacagaaaactgcagaaagctggtgagctaccccatgtgcagaatgctctatcagtgactttgtcagagtagcagggcctgaacaaaagccaggtctgcccttcttttaagtcactctatataagagagaagtacttttgacatgcctttcagttaagtgtacttaaagcaaagctctcaagctttccaatgactaaatgctagaggaaataatgggaatagtcaatacctgtaactgaaaaattgctgactgtgtgacacagcaaatcattacactgttcaaataccaatttataaagctggagtgatcatagctgtctgggccaattcatcttagtctctcttggtttggaatgaatatttggttggtttagacagcaaaagcctttgacccacaaatgagaggctaggcttgccagatctagtaaacaaaactacaagcttcctagttgaattttaatttcagataaacagccaatacttctttagtatgttacaaatgttgcatgaggcatatttatactaaaatattgcttgctatttatctgatattcaatgaaacggagtgtcctgaattttacttggcaatcctagcaggggcttactttgaaaagttcctacctaagactgagcagttaagggaggaagttgttatagaatgaatgtttgtgttcctcctaaagtcatagtttgaagccctaatcctcaatgtgatggtacgtggagatgaagactttgggaggtaattagggttagatgaggccacgaatggtcaggttctcatgatgggattagtgcccttaaaaaacagataccagagagcttgttttttttgtttttttttcaccccctaagtgtgcacaaagaggtcatgtgagcacacagcaagatggcagccacctagaaggcaagagaagaagcttcagaatgaaacctaccttgctggcacattgatcttggacttcccagactctagaaccaaaaataaatttctgttgtttaagctactcaggccatggtgttttgttatggcagcccaagcagactaagatagtaatactaagcactttggggcagtggcaactaccccatctcactcaaacccttcatcaatggtggtaccaagctgtgtagacaacccttctttgcctaaatttcttgagtccccaagatgtccaatccctaaaggaactagtatgtaaataatgggagtcatatgggttcttttttcccattgaacgacagatcgtttctccacatgattggctgcacctttcctattttgctgtgcatttctaaaactgagttccattttttttttccccaggctacactctttcaggttccagtcactgttgtgcaactgtctggcttacaatctatgtttattttaaaatcccactaagaatggatttagatatataaagtcccggcctagtcacttttagtcctttttcctattgcctcttaaatgttgttttataactgaatgctgaagtcagattttcttttttacttcagaaaacttttgctattgaactgttgaaaatcttagcctaaataacaaattcttttgcaaaatttgtgtgtagattccaaaatctccaccttgttgaataaacttttccaattactttggcacacacatatgaatctagaccttttcagatttctacactgcattctacactaggcagtttagctcttggttataaaccatggtttagtttcattataaactatggtttggttgagctcttggttataaattatgttttaattttccttctattcctactccattttttcccgatctgtctttcccatgcacacacccatgcatgctcacacacccaaaaaactgttaatcctcatttatttttcattcatctttaaacataatcagtgcagtgctaaatacataactgctgcttaacacattagctgttgattattttctgatatttgcctgaattacactcaattatttttaacttttgaaattatttctgtattttaccttattattaacctaagaggaaaagaggaaaagattttatctggaaaaaaataagatgattctcaagaaattttccatgaagaacttgccaaaacataatataaaaagaattgtggtttctgaaatttacttaaggcctcctggatgttgatcttttcacactgaagctgatttaattttgcccctgagcttgtaagcaccagataatttgcttgcttggattgtcactgagtctaataagtgtcggtcattaataaaactttttcagaacatgagaatgatgtaggaatggtgcggttatattatgaaagttgagtgtaaatgattcttgggaggaaaagatttccaaattatgcaacgaatggaatttactcaacttttaaagatccaaagggaggtaatatgtatgcagtaatgcttgtttaacagacctgggctgagcttttctacccaaaatagatatattttacataataatgctatatattggtttattataagttacatgagcctggattcctctgtaagtattgcttactttacctcatttcaaattcattatagaattcatggttcttttgtgcttttttagaaaaagatatttccccaatggatattttacttcctttcaacctgcttctttacctcctccaaaattctaaattctgactattaaacatgatttaatgagctgagagtaggtatgttccttcactgtgattacccaataccccatgcatacctcaatcctgccgagttgcaatcttcattttgcctgactatatctcttgtgctaaactactggctcttcagaagcaaggccggctgttatcctcaaggtgtgtaagtcctagcacatgctggtacttgacatatgcttgatatacaaattaaaaatgagccgtgatgatcccaggcactcaatactagtggcagtacagtaaagtggctgagagcaagacggtctctgcagatccttggcttaaattcccattgaaaacatttcatttcatttagagaaatgtcactttgaaaagttctggcattttatgtcctttttaatgctaaccacagttatatttatcttttttactattattcaatgtgatcctatgttgtctgtacttttaacggcactagaaaaaaaacaagtatctccctaccaataataatgagtcacacaagtgaaacatatttaggtaaatagaaattttgctatatttaaccaatcactattgaacttaataccataataaattatacccatttacatttgattagcacttgcaagtttatacacctttcccataaattatcttatttaaaatggcacattagctttttaattatataagaatttcacaaatatgtggttttgtggaaaatctgaagtacaaaagtatatacatttaaaggtagagttctcattaacctgagataataaaattgcattttctccacacccctccaaggtgttgggtgggtcacaggtcagaaaacttagcaagccacgagaggtaggctgacagatggttgggacttagcaggagggtttgcaaagcagtgcaaagcaatgcaaaagaaaaggtttgcaaagcagtgcaaaagaaaagcttgggcctgaaatagaaaatctattttaaaagaagacatattgtgtcaatagttatcacaatgatacttgagagtttaagcaccccaaaagaataataaatcaatgatcagcttcatcagatgtaactgattgtattgcatcactgaagctaatgtacaagaaaattatctgggggaattagcttgcctagtttcatggctccttaaggaagcaataatactaactactctcaaagcaacaagaaggctgtcagctgtaggcgctttcatgtgaaatgcccctatttgatgccctgttagagtccaattcactgctagtgttcttagactaaataaagaacagtagctgaaggatttgctatcatatcataatgtgtgaaaaatgctacagtgtccctttatgagatattaaaactgtatgtaaatagaaataaaactgcatgatgtcaccatcacgaagctaagttttaaaaaatgttcttcaaattcagaaacaacctgatacctatagggaatttagattctttttgactagaaacatcaagagaacaacatacctgtttagttcggcacagtgtacgctctattcttgggcgatttctacatgaaaattagtaatgtcttgatgtcagaaaaccatatttccttttctttttctttctttttttttttttttttttgagacagggtcttgctctgtcatccaggctggagtgcagtggtgcaatcatggctcactgtaggcttaacctcctggtctcaaatgatcctcccacctaatcctctctactagctgagaccataggcatggaccaccacagctggctaatttttttttttttttttttgactttttgtagagacgaggtctagctatgtttcccaggctgttctcaaactcctgggctcaagtgatccttccaccttggcctcccaaaatactgggattacaggtgtgagccaccatacccggccaacatatttactttaaaaaagccttcagcgcggtggctcatgcctgtaatcccagcactttgggaggccaaggtgggtggatcacgaggtcaagagattgagaccatcctgcccaacatggtaaaaccccatctctactaaaaatacaaaaattagctgggcctggtggcacatgcctgtcatcctagctactgtggaggcagaagaatcgcttggacctggaaggtggaggttgcagtgagctgagatcctgccactgaactccagcctggcaacagagggagattccatcaaaaaaaaaaaaaagaaaaatccttcagaatcccattttcttctctatcatcaccatactcatgttcatattatctaagtcttcataaattatattgattacttactctgcttttttctctttccccggaccctgctggtttagtttccagcatcaagtgttaggcttattgccatcaattccttagtgcttttctcaaacctctcttcgctgcagatacgatgattgaaaacaaacacactaacagatatggccatgaaactttcctgtttaaaatccttcaatgatgccctcttcatccaatgaacagttgtttccttaatagcctctagacgcccgcaagaaagagcccaaactcctttgcatagcatgaaagatgtttctgttttttgcctaatgtattgagtaacatgttttgctactctcctcacacctacttttcagaaataacaaatcccatgttgtgtcttgaacaccatatggtacttcccattcccatttactttcacacgccccttgcaccttccgaaatgtcatcgctctctagttcacctggctactttctacatagtgttattctgtgacgcttcctcactatattcggtaaggaaaatgtactacctctgtatcttattattgcttctcttgttgctcacaagttatatatgaatttgttacatgtttatttctcctatcaacacatgagattcttgaaggcatgaactttgtcatatttatcttcctatctccaaaacctactataaaacatgcttcataataaacactcaatgagtatatgtggtttgaatgaatgtacttaagagaaaaaaagatagtaatataagccatgcttttattttaattaatgacattttctagttttccatttattcaaatagtaaaattttactaaaaatggtagttatgtaaacattagctaaagatgacctattggacaggcaatttgcaaataaattattttcttcttagatatgaggtaaatcaatagtaacttagcaatgaagatataaacttagacattatacctatattccagttggaaaggtggatggagttaatgctataaacacttcaaaaaatgtatttctatcctcctaatatggacatctctaatagtttctgcaactccacggtataaaaaccctctgctatgtcctctcaaaacacctcctcaatctgggtcaggcctgcctttcctcaattcaattctatctttatgtgcccatattctggaccaattgtgctcaatggcatctatgctttatttagaataagaccctccaaagtttctaactcttgagtctttagtctaccaatctgttcatcttaagtgaaaattgattttcctctgactccattttccttgagggttatgaaataaaatgagatttggtgttccatcatttatacattacccaccatctattcattcaacaaatatttgggtgccacattcaagccactattccatcacccttgctctaacttcccatccattaagaattatgccatcttttatcaggctttctacatctttgtgctatcacaaggaaactccctcagcttttaattatttgaggacatgtacaattttacctttttttccttttttatatccctggttgcttatgtcaactttcacagtgatgatcttctaacataatagattccatgctttttgatgttcagcattattgttacactttagttttctaccaccctacactttcgacttcaaaaatagtcttttgtcagagacagagtttcgctcttgttgcccaggctggagtgcaatggtgtgatctcagctcactgcaacctctgcctcccgggttcaagggatcctccttcctcagcctcctgagtacctgagattacaggtgcgagccaccatgcctggctaatttttgtatttttcacttgttttttttgttttgggggtttcaccatgttgcccaggctgttctcgaactcctgaccccaagtgatccacccggcttggcctcacaaattgctgggattacaggcatgggccattgtggctggccaacttccatctttataataacctcctctttgcctttcatgcaattgctcttattgaaagtaaatagaatcctttcaataaatatctgtcccagggtttataatgagtcacacttcagtgcaagacatacaaagtagaaccatgtaggaactctattccaatggaagtaataggagctacaaacttatgagggaagcagataagaaaattcaccattacattagactcatataggtgccacaagaagggtatctggagcaggagatggaggtccagcgtaaagtaatgtcagctaaatattttgggaacactcttcaagaatttccaactcaaatgcttccatgaaagcattaaaaactattccatccctctggatgccccaaaagagtttgcataattgtacataacacaaaaataatcttatactgaggttatatttatgacaagttttgtatctatttctaaacggtacgttcttccagcagactgatttaacactcttcgggtcacagacgttttaaaaaatctttttcataattatttggcaaatttatacctatctactctttagggacttttgtacaagctccctcacaaaaatcttctaaagttataagtttattgcacccatttacatagaaggaaactaaaaattaacagctatgtaaggcatctatgtttacctagctagtagacagcaaacctacattaaaagtgaggtatagtggagactgctaggtaatccccccaatttttttttgtttctttttggacatatagttgagctgtatttcccagtcttcaattccattggatttggccataaaacccagttctagttgatgggatgttagtgaatataatgaaagagatttctgggccaagctaataaaaatgccacacttttgctccttggtactcctttcctttttctagagtactgggaggttagtatcttctaaggcaaatgtgaaagtcatgcattgaagatagccaacctgaacatccacttagacaattaaatgagagagaaataaatctttgtgtggaaagttaacaacaaggcaggctctatttaatactacaggttatcctaccttattgaatgcagtagaccagcatttatcaaacattttagtcttaggacctattgacactttcaaaaattatcaaagatttctaagaacttttgttaatatgggttttatcttgatatttaccttattagaatttaaactgagaaattattaacatatttattcattttaagatataaagttagtacatgttaacataaatattgtttttgaaaaaaatgtaaattttccaaaataaaaaaaattgtgaagattggcattgctttacatttttgcaaatacctttaatatttcggttattagaaaatacttacattctcatatctgcttctggatttagtctgctatgatagtcatcgtagagcttctagaaaagtttactgtacatttattagcaaaagaagatgaaaagagaaatatcatctcagtgttactacaaaaatagattcatttcttgaaccagctaaaagaatctcagaggtccacacctcattaatgatcacattttaagaattactgcactagacctttgacaacagaagttactatgttatccactatgtagtatttaaaattcttaggaaagctacgggttctttcctcaaaaaaaaaaaaaaaaaaaaaaaacacatacatacatacttttatgcctaatttaagtggtttcctaaaacccctgaatctcattcaatggaagtcaaaaactttctctagagtagatggcatggctttttttaactttcatgtatcttctactatactgagaaatgtacactttatactttatataatgtcaataaacatacgctagaaacagaaaacattagaactgggaggatcttcagagatcatactgtgaaattttctccttttcacatttagactgtgcaaacctagggaaggaaagtgactacctcaaggccacagtgaacatgataaagaaaggatgcagaaataaaaacacaatttgcaaagttatgacacatcactcattcatatttaaaatctttaagtgatataaagttatacattcaaagagacaaaaatatttttaggattttggaatttaaggagacatataagccatctatttaaatcatctcatttgtaagaaaaacctacaggatctcagaaggattaaactgctttgctaaatttacaaaatggtaaagacctggtttgccaactctgaacagaatattataaccaatatatcacatttccctttaaagaactcacattttatagtcaattaataatctccattttgaagcaaatttataagaatagcaactgatgcactgtatttaaaaatataaacaaaatcttcagaatacaccttaataatccagattacaaaattgtattcactttattttgcttctccagatttaaaaatgaagagagcaaaggctgggaaagttagtcatctaaaattctatcttcttttgtcaaaacaatataacacaaatataaagttattttaaaataaattgttctggcaaattggtaccctgacccaacgaggaggttatgaaatccagtacccctccatacttcattgaaacttactcaaattactgcagtagattttccactcttggaaaatgagcaaataaatggcagcatcctttctaatgtcaattctcgacattctgattaaagttctgttttaagtgcccagatacattaaatcaacccattgttttccatccttacagatagcccagagttctagagaaggatggcgactacaaagaaatcaatcatcaggatgtgcttcttttaacacataatgctgttggttaattgggttttttgaaagaatctggaaagatccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccacctcacaccagttagaatggcaatcattaaaaagtcaggaaacaacaggtgctggagaggatgtggagaaataggaacacttttacactgttcgtgggactgtaaactagttcaaccattgtggaagtcagtgtggcgattcctcagggatctagaactggaaataccatttgatgcagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacacatacaccatggaatactatgcagccataaaaaatgatgagttcatgtcctttgtagggacatggatgaaattggaaatcatcattgtcagtaaactatcacaagaacaaaaaaccaaacaccacatattctcactcataggtgggaattgaacaatgagatcacatggacacaggaaggggaatatcacactctggggactgttgtggggtggggggaggggggagggatagcattaggtgatatacctaacgctagatgacgagttagtgggtgcagcgcaccagcatgggcacatgtatacatatgtaactaacctgcacaatgtgcacatgtaccctagaacttaaagtataataaaaaaaaaggaaaaaaaaaaaagaaagaatctgatataaatttggacttgcattcaaagtccctgacagaactactgccaagaaacggaaaagtaatgttttcctaaaactattacttgaaaatcttgaaagaaatgacttatgcataagtatttaatagttttcctatgtgaagagctgccaagacccaggcagcactaaaaaatggaacctttctattgtacattgtacttaaacacctggtgtggaggccacattttttcctgctgtgtggcagacaatgaagtgtaatactgacattctctctgaaactctccaagatctactaaataattccctgtgtagaggtagaaagttcacctaagaaactcccaaaaggcacataacctcagtcaagtattagatcttactttttctaacagaagctagagagcaaagagaaaacaactgatttcttcacaatggcaaataagaaataatataacagaaaccattctacatgagtccaaagcagaagctacaacaaattacttaacacaaagcaatagcaactgggcaattcgacagaattgtgaatccacgccatgaattcatggcatcattttactaaaaaacacaacagtggatggcagtctttaggatatatcttgatggacactaggaaacatttaataatagttgttgcctgttgttttgctattttttgttactcaagcagcagcgaagaggggagtaaacttgtgtttacagctggctctctgtattcacaggaaattggttccgggacctccttgggataccaaaatcctgggatgcttgagacctgtaggcgctgtggaacccttgaatatggagggtggactgtactgatcagctcctaaatgtcaaacacttggcactttatatccgttttaattctcaaaatagttctccaggtcgggtatcattattttaattttaaagacgaggaaccaagtttaagagagtaaatactttaggtaaatactttagtaaatacttcaggtaatgccaccagctagtaattgctagaactaggattcaagcagcataaatagctactcacatgggtttatgacatgacgagcactgtgctaagcaacttacctggattggctcattaaatcttcctcataactcttcaaaagaggtcctaatattttactcacttaaaagatgagaaaacaggccaggcgcggtggcttatgtaagcatgtaatcccagcactttgggagactgaggcgggtggatggcttgcggataggcattcaagaccagactggtgaacatggtaaaaccctgtctctactaataatacaaaaattagctgggcatggtggcgcacacctgtaatcccagctactctggaggctgaagcaggagaatcgcttgaaccccagagatggaggttgcagtgagccaagatcctgccattgcactccagcctgggtgacaagaacaaaagtccgtctcaaaaaaaaaaaaaaaaaaaaagatgagaaaacaaaattttggagttgttaaggagcttgcctaatcacacaaatcataagtggctgaacggcagttcaaactgagagtgtttgacaccagaactccaagctttttacttatcattccataatgtctcccaattttaatgtccatgctctttcctctacaggaatggggcaggggggagaaaaacagtaaaattcacacttttcattttcttccttcctctcatccaattcctaaaagagtaagacaatataacacatcagtacttttggaggttcaaaagatgctaatgataatttatctgaaggtttacttcaattgctgaaggaaatgttttctagaagaaaaagagagctcagcagagtacacaactatatccatattgatggatacctgtgcaataaattttccaatcaggggcaaatcaaggccaatcatgattcatcagcagcctaagagacagcatggagtcagacaatttaaaggtactccacatgtcttctgaattctggtctgtttcagatggcactcaatgcacagtctaggttcaaagattttttttctctggctgcacttggtgcaagctgtcaggtctatttttgggggtatcctttagaaacacaacataaaactgtataaccatgaaaaagaaaattcaggaaaaagctgccatttcaaatatttttatgttttttatcatagtggtgggagctctacctttacaaggcaaactgcagcatgatcctggcaacctcccgtgtaaatgcaagcaaattactagacaactgacatttcttgggcagcaaagatttcaatttctacaccctggtttttggaaattctgttctggctagttgtatttgaggttttgacagccaaataaatctgctgcaaagaatgttgcacatttcattaaaaatgctccatctagacacacatattctgtctgctatagacctgaatgcatgattgtgtgaacatgtgagacacagaatttcagtcttgaaagatggctcctcagtgaaactccttttttgtacaaagaaaattagttacttgtgataatgttgcaaaactagagctaataaggtatccaggtgtgttctgatagcaacaacaacaaaaccctacattcattatatgtactggttaactgtgagtaaagagttatctttaaaggaataattatatgagactttgtcaaggcataagtataaattatgctgctgattaattgggttttaaaagaatgtgaataaatttagatgtgaattttaagttcttgacagaactattgcccagaaatgagaatgtaagaagattttggatatttttttcaggacatgaaatgattgtttgaattctttcatcaactgtatttgcttctattttcttatgctgccaatcaaatgaaggcagcaggaaatgcaatctattagacttaatcacataaagtttaaatcatatttaactattcagttgaagaaaaataccagctaaactaattacagaactgaaaaatggcaatgataaaattaagacccaacaaaaagacacgaaatacctaagaaattgagaatcaacaaatctatacaattgtcagtgaagacagtcaatctttgtcattaaataattttaaagagaattatttaattatttctccatcaaatgtcttttatattgtatcacaattaaaattctggaggtctccttcattaactagacgaaattaaaatgatgaaaggtcaatctgacaagaatattgataaattgcacataatgtttcttcttgtttcaaaaagcaatataaacaacttctaggacatttaatttaaaaactgagaattgaaaacttttaaaaatattgtatattccattatagatagatagaaaaataactgtctcattcttttagcttatgggttctttgaggattaaaaagagtatcttattctaatttaggaattttgctagttgctgagtatgtctattctaattatatattctggaactgggtaaaaaactacaggatagatttggggacccactggacccattaatcatatgacttccatcagccctactctgactagtcaaccacagtgacatgcttgtatcttctggaattaatagcagtttagagtcaatgtctaatagtccccaaaggttctgattatttccttttccctaaaacacagtcacccagtaaaaggccatgatttggggttagaattttgttcacttgatctagaactctttgacttacacagatcaagtaagaattagtagcattcccatccatttaacttctaggaactctatcatcaactagccaatgccataggactgcccatattcaactattctgattgccgctttgactctgctttccatcatggtaacaacacccatcttatcttgggcgactgagggctgccacttggccagcccctgccaccccaggattcaattactcccattacatttaagtttccttattcagtggtagcagttcccactgtattttccggcagacaaaagcaatcacaaagctcttcaaggatgcaggggtgcccctcataaacttgttttttacacttaggatgaaaagtgtgccctctgggtcatcccagtgtaagtgagcagatcttaaatgacacattcaatctaacattccagtctccctaaaccttggaatctcttattctgcagtacaggaaagcagttctagcatttcaagttaaattactgtgggccagcttctgatccatgttccagccaaccaaccaaccaaccaaccaaccaaactgatacagccctttctcaatccctgagctacagcattaaattcagaatctctgcttaatgagtttctttggatttgggaggcaatacatttcttattctggtttgctaccccagcctagtaacagaatgacccaaaaagctgctaacaagagaaggctctgcaacaggtctaggctgccatataggtgccctgccactggggtcatatgatccagcagattcaatggtgtttaaattgttggtgacagatagggattctacttaaaatctttgacaggaccatacaggacaaccatagtgcatactcagaatttcagaccaaagccctgccactctctgcagataactactttccttttgagaaactgcttttggtctactactgagctaaaagcctaaccatggcacaccaagttcttctgcaaactgagctgctcctcatgaactggccgttacctgtcctaccaccaaggcataaagttggctgtacacaacagcattccttcatcaaaccaagaagtggtatatatgtgatcaggcccaagagggccctaaatgcacaagttacatgaagatgtgtcccaaatgcccatggtccccactatgctatattactacatctcttacaacctgcacctatggcctcatgtggagtactccactgtcagttgacaaacttgggtctggtttacagatggttgtgcataatatacaggcacatacaatagacagccacagcactacagtccttttctagcacatacctgaaggataatggtgaaggaaaatcctctcaggcagcagaaccccgagtagtgcatctagttgttcactttgtttggaaggagaaatgcaaatatataccaatttatgggctgtggccaatgatggtttctctggatggtcaaggacttggaagaaatctgattggaaaattggttcaaggaagtttggggatgaggtatgtggatagacatctctgaatgggtgaaaatcatgaagatatttgtgtgccatgtgaatgctaaccaaagagagatgtcaggagaggagggactttaataatcacatagataggatggcatgttctgtggataccagtcagcctcatttttgcagccactcttattgcccaatgtattcataagcaaagtggacattgtagcagggacgtaggttatgcattggctcagaaacacgaacttccctctccaaggctgacctacttatagccactgctgagtgcccaatgtgccagcagcaaagaccaacactgagttctcaatatggcaccattcctcagggtgatcagccagctacctggtggcaggttgattacattggactgcttccatcatggaaggggggtagtgctatgttcttactagaatagttacttactctggatattgatttgccttttctgcacacgatgtttctgccaacactacctactatctataaacttacagaatgccttatgccctgccatagcattccacacagcactccttctcatcaagaaaattacttcatagtaaacaaagtgtggcaatgagaccacaatcatggaattcataggccttatcatatccccaaccatcctgatgctgctggtttgacagaagagtggaatgaccttttgaagactcggttacagtgtcagctatgagacagtaccttgcagagctatagcatgatcatggaattcatgggccttatcatatccccaaccatcctgttgctgctggtttgacagaacagtggaatgaccttttgaagactcggttacagtgtcagctatgagacagtaccttgcagagctgtagcaaagttctccaggagtctacatatactttgaatcgatatccaaaatatggtactatttcttccatagctagaattcatgggtccacaattcaagtggtgaaaatggaaatggctctatttactattacaactgatgacccattagcacaattttgcttcctgctcccatgaccttacgctctgcttgttcagaagtcttagttccaaagagaggaatgcttctagcagaagacacaacacaaattccactgatgtggaagttaaaattcacctgatgactttgggctcttcatgcctctgaatcaacaagcagggaaggaagttacagtgctggctgggataattgatactgactaccaaagagaaattgacctggtactctacaatggaaataaggaagaatatgtctgaaatatagaagatccttaaggcatcccttattattgccatgtcctgtgattaaattcaatataaaactataacaactcaatttgggcaggactactaaaggcctagatccctcaaaaataaaggtaaggtgacccttaccagataaataactgtaacctattgaggtacttgctgatggcaaagagaatatgtaaatggtaatgaaataagagttacagcgatgtaaccagtacagaaatgggaactgtgtcatgtgtatttttctttgttattttgttatgaatatgttcaagtgtgtgcatgtgggtatctcaaatatctgttttcttccctctcttttccccttaccatataacatgagatgtattgactttatattatagtacttaagtaatgttaactttacatcatagtagttaagttagaggacattgagaagaataatcatcaaaaagactttcaaggattttgcatcctcttttaggggaagggttagtgcatttttagttgtacacaggatagtagtattaatcatgttaagcaaaagtattgccttgttattgtctttaattggagattaattttggtttaagatgtatatgagtgccaggtttacaaaaatggactcatgatggttaattttatatgttaacacggttaaatgatggtatccaaatatttggccaaatattattctagatatttccatgaagctattttttagatgagattaacatttaaatcaatggattttgaggaaagcatattaacctcaattgtgtggatgggcctgattcaacagttgaagaccttagtagaagaaaactgaccacccttcagcaagaagaaactctgcaaggagactgccttcaaacttgaactcttccctgggtctccaagctgccagactatcctgcagatttttgacttgttggcctccataattatgtgagccaattgtttgaaataaatctctagactgatagatgatagataggtgatgatgatgatgatagatagatagatagatagatagatagatagatagatagatagactggcagaaagatagatagatagatatcctactggttgtggccctaattaatgtatccccaatgctttactcattaaattttaaataaactttttctttttcattttacatatcagaaaagaaaagccttctaagttgtgtaaggaacggtgtcctggttttaaaaaaaaaatcaaacaaaaccttggaagagtaatttgacattgtaatcctttcatttcacagcaactccatgaactcaagattgcaatgtagttaccatctacagagatccagagtcagtttggattctacaattgtaaatacacaagcagaatgaacttccacctgagaaatcacaaatcaaatctaatattacttttggaggaaaagggttggagaaattccaataaggtaagcttacagaactcatgtccaacccaagctatagaagagccttatggaataaaccgaaagaactagattgatgggaggcacagccttgttctgtgggaagtgatgcatatcttgaggggcatagatccaaattgtagacaaattatataatcttggcaataagacttccatttccaatccttgattttcacatctgaaacctaatgaaagtgcagcaggtaaaagcagcagatgaggaaggggtaagtccatattcgaagctaccctgatccccttactgtttctgtggtattattattttagtcaacgcctgggtttactctgggcatctcagagtccgctggaattctgggtggatcccataaattctccaatagttgtctcagtacatttagtaatttatttataccttaggttttgttttggttttgtttcatttcattttggcccttaaaatgggatactgcttgtagtttgtagaaggctttgttaatttattttgatttttgatctctctatgatttatcatatgtcttcaaggcatattaagattctaggaaagaaaactggtgtagtgaattcatttttctaagaatcataatttgttattgtttgcaaataaatatctgagactgtggaatccaagagtatctgagcttaaaggtaccctagggtaccagagataactcttattgaacattactatttgccagatgttgtattaatattaccttctttattcacagaaataatcattagaatagcaataattaccaattattaagtacttgagtgtgtgcataagcactcatgatttttacttaaaataaaattcattccagtatagctggaatgtgttgcaaacatattaattcattcaatcctgaagacaaccatatgagttgtaccattatttctcctatgttatagatgcgtaaaatgatacagacaggttaaataaattgcccatatcatacatttagtaagcaatagaaccgaaattcaaagcagagactagctcccaggtctgtgtttttaactactgtattaagcggttaatggagtttccttaataaatatacattgttattattctcatttaagagataaacatctgaaagtcaaattagctaaataccttgcaaaagtcactgtccctaagcaatgagtatctgaaatactagtgcactttattctcgttacaaaaccttgaaatacttatatgcccatagaaaatctagtgaaaatccagacagatcccaattgtcacagattgggatcaataccactattctgtctaggctcttgtgtgggacagttcccagtctaagacctcatatctgcctatctctgtgctgtccttgatcgctgaaccaagccccaaacctatactccacaatttcacgtctgtctgggatgcgctgctcagatgggctgtatgagtggcaacacaaccacttcaaaaacagagactgtctcctcctgccatgggtagcaatgaccacaactctcaaatcattttgccactggatactaacataagagcaaaagactctataattaggtgatgaattcagatcattggagcacacattttacattaaaacacttctgtggcttcactctcaatgggcacactatttcaaatgcactttgttatctgttgcaatatcaccagacctgcagtaatatgctcaaatctcatttcctccatgaatccttttctgattcctacagtcctaccaagttgtctctcatctgaatcataaagagcgtatcactcactttatttctaccaccctaatccttcattgtcttgatttctccaacaagatattaatcttgtcccaagtaaagcctacattattatcctccacttggccttatgctgtcagactctgtatagtagattctataatattgctcccagtgaactgatcaaattggttgagttgccaatgtagttcccactgcccggaataacatcatatccaatcaaatgtctttcttgctatcctattaaatgtgcttacctacagaagttaagtctacctcctcagtggcttcatccacctcttcattaatgagtcaatattgttgtctttgttggtataaagagtaagaagaagcacatagtgtatttctgtccatactaatataaagataccgaattgctatattgaatcgctatagaatagcgctaaaccaaaaatttagatctccaatcagatgttctttttttttcctacaagattttaatgaaataaatactttaaaaatgtcctggtatttacattttcaatttaacagccatgccccatggttggcaaatgcaagcgcatgggacatggcaatactataggtgatttgctctccattgcccaagtgtggcaacccccactctcttggtttgttactctccctggcactatccatgaagttattaacacatgccactgattatatctatggcaaatcaatcacattctactacccattgcattaaacatgaacaactttaccctcttattttaatagcaaatcagggagtcattatttagaaggcacaatctcaaatgagaaggtaaaatttagatttacaattttattttcccccaatttcttctaatcattcttattttcctagaataaaaaaaatctagaaagttttgaggggaaaaaaaaccacaacagtttttcagtcttttgtaattgaaagtgaatagaatggtgatttgagggtgctccagaatcctaaagtattctaaaacaaagactacattttccttctaaaaatatatgtttaatattaaatatatcttttaatctaattatctttgagttgcagtttatcttatatcttaattatattttagttagccaccatactatatttattaaccttaccagaaaatatagtacatgcacatatacacattttttggaagaagaataatataaataaatgttgccagaattctacagggaaactgattactacaatttatcttcctaatagcgaacttgtcataacaattttaaacattctttttcattctatctctcttatcctgatctcatattaatatgagatcaataaaaaagactgattggaaggcaggggtgggcactggccatggacccttactccgtgcttatcatacacaataatcctcattttattccattttctgaaaaagacctactcctacagattattattaagaagttgacagataactgagaaactcatgaatagagaaaaaataaattcacatcacacatcacaaaaaagaacaattagccaattagtcaaattcctttttgagatctgggttcttgtctgttcattgtccctcatcttcctgctaactagtattctctctgtgtccatacacaagacatgaacttgaaaaatcattctattgttctcaacatttcagctctggccctcaacttacgtaccccactcaaccatatcacaactcacagaaaaatcaccacaggctcctcaggcctgccccttggaagacattctgctacaatgatgctttttttttttttttttttttttttttttagacagtgtctcactctggtgcccaggctggagtgcagtggcgtgatctcggctcattgcaagctccatctcccgggttcacgccattctcctgcctcagcctccctagtagctgggactacagacgctcgccaccacgcccagctaattttttgtatttttagtggagatggggtttcaccgtgttagtgaggatggtctcgatctcctgacctcgtgatccgcctgcctcggcctcccaaagtgctgggattacaggtgtgagccaccgcgcctggcctacaatgatacttttaaaaaacagatgaatacactgatgtccttcatccctgcaaaacgaggtaaaccatataaaaatatactccaaaaattcattttaaagcaatttctactttaagtccagtaagctgtaatgtcacatgttttgtatgtggcaagtgttttaatttattatttaaaatgagaataaatgtgcaaataagcagtaagagctcattgtatgaatatgttatagttcagggaagaagacactgagactgtgtgaggctctttataaactgtttagtaattcctggactctggtaaattatggggagatgcagtttacagacatggtaatatcttgcctgaaatggaaagaactaccagacacaccttccacagtctcaagctctaaatcataaatatgttgagccagtcgtttacatcaatttcaaacacgaagggcagagattagagacacattcaatagaaagtataaattggctgaataattatttgccaaaattttcattcacatatagatcatttcaagaggaaatcagggtaatcaagcattggcctaactctgaagtggcaaagtagggttgtttagaaaggaaaaattctgtcaaatttagcatatttattttctgtttacataatctagtagaggccccgcacatcatagaaagtcaaatatttgttcatctgattatgacatgattttaaattcccttgtgtttgctttatgatatatactcctgtccctcctgtttgaacattttatggaatgtcagtttggttataattaatatactctagctcgtgttcagtatcgagtctataatgacttaacattctcaatcaatttagtggaagataaagacaggatgttgaagttcccctcattccctgacattatagcttacattgaatgctgaagtacttttgtttctagatgaccagttacttatagttattttggattggtcattaggtatattggagaaatcactgttaaaactgtactggaatggcctagaggaaaagcatcagaagagaaagataattaaaaggtattattaccatcatctttatacagtgctaatttttaacaatcatttttacagtcatgtgaatgacaagtagatgctatccagaattcccatcattggagcctgtatttcattgaattaacactcaacaaaaacatgctaagtgtctcttaacattatactacatactgatgctataagaaagagataaaaatgagaaggatatgtaagacagtatggcaattgaaaataaatatgttcaaaataagtacctctcttgggtggtaaagggataataggaagaatgggatgtcttatggagtagttagttccctacatctagggtgttttcaagcatgtgatccatagtgaaacaggccttaaaaagtcccctgtagggtaataatttgtaattatttattggctatttatgtcttgttccttttatcctcttcacggctccttttgcaaatgcctgtatttctgtgtagttaagataaagatagcactttttaacttgaagccttgcaaagtgacattttctccaaatgcacttggtgaatttttttatacaactctaaactagagctgaatcaactgtagggaatgtgctgaatgtccatccataaagggaaacaagattaatgacctctaagtgtgaatgggcaaaagcaatttacaagagtgagtgagggtcatattttatcacaggcaggtggcttattccaactttgcaaacagttaccaaaaatgcacacaaccacaaatctttggcctttccatcctcacgtgaaaccattgtgtgtgccagacaaatgatcctactatgttttaaccccaaactcaatctgcatatgttaatgaagactaaaatagattgctagaaaactccttgaagcagaaactaacagaaaaagcattttccttcccaacccactccacaggatctgtacttcacccagcaagaaaaggagcatgaaattttgcttctcactatgtggaaaacccttaatgcatgttctgctaattttggaatttaaaaattttctttcaccttggactttgtccttgttccagtgaactgtgacttcaaatcagtatatcatatggtgtttgtttttatgtttttggtagtcatagtagggggtgttagaaggtatgtaatatgggaggacactggtaaaatctttctagtacaaatcataaaataacaaaaataaaaacacttgttccaatgatattggatctctattcttctccttgaggtttatgcctctagcataatttgggcacagcccactctagtactctctaaataacctgtgcaagttattatacttctgcatatctgaggtcaggaaagaggggtcagacatttggaacaaccaaaggatattagacctagtaataaaatagagagccaaaggatattagctgtctactgctgcataaaattttacctaaaacttagtatcttaaaacaacatgaatttattatcactcagtttctgcgcatcacaactccagacatgaaataactaggctctcttgattacgatttcacaaggtcaaagttatgatgtcagccaggcttcatttccatctggagtttgggggtcctctgaaaagctctcgtggttgtagcagaatttagttctttgcaattgtaagacaagatgcctattctttgctggttgtcagcatggggccactcagctccttgaggccacccacagttctttgccatatggtcttctccatctttaaaagtgagcaatagtgactctcctgctgaatccctttcagatttcaaatctctgttaccataaagagccttgcccttttaagggctagcttgtgtagatcaggcccactgaacatgatctcctttctttaagtaaactgtgccaaataacacaatctaattatgagagtggtattatggcattgcatcacaagcacaggtctttctcacagtcaaagggaggatattctacaagagcatggttcattggggcttattttataattctgtctaccacataattcttgaagggagtatcataaagccaaggcctgaggcaaggcaagtaagctgctatcttcaggagggctggacagagaaggcaaggagagggcataacaggaaatatggatgttcacatgagtgatgactgccatctaatgaagattagggataaagaggatattttgtccaagaaatggcattgttaatactccatctcacaactgtttagagaaatgggaataattttgttaactgcaatttaccacttcctaatggaaaatattctagcacagtgaccttgtgtgcaattgggtgaccaagctgatgtctaccaaccctgggtaaagccaattatgaaatatgatgaatgctgaatgactcaaaagggctttacataattagcaagagccaaagaaactaatgaattcttttacaagaacaaaacataacagcaacaaaacaaataaatgaaaacaggatgtccttagaatcctcaatataggttgcaagttgaagactttgatggcagactttcaggattcaaatcctaactttctaacttactaagtatttgaactcaggtaagttattgaacttcattttatgtatatagagctacagatatatacatctatgtatatatatagctatgtaatacagatatacatataaaatgtatatataatttggacaaataccagaaaagtagtttgtatataatacaaagtcattattactagttgtttatagtcctcttaatattactggaactaaagtttgtgtgtctcagccctaacaccgacattgcgaagttccaacaggtctacacctctaacacttctatatttatttatttgctcatccatctaatcttctggatggtaaatttcttaaggtaaaaaagttgtgcttctcattgatctaccttttagtggacaatttatgctggcttgactatcacaccagccttaacagtaaatcatccttgtagtataagttttcagttgtggcaggctttgtcagcaacttattcattttacatttatacttctagcagaacctggattctgttaggggcaacagagtgtcaggctctttggcccaccacctcttttggtaccattttgatgaaaaagtatagggagaaatacctcaggccttcctgtctaaaatggggatgtcaggtgggaggtggaacacccacttagtgacccaaaggaatattctagaagacagacacaagctaaagacattaggctgaaagatgtaaggagcctgagacattggggcctgaaaacctgctgaagccatgctggaaaggctactcctgtgcttgctgatatataaggaaaataaattttccttgagccacatgctacaagtgccaaattttccattgagccatatgctacaagtgccagatttctgttaaatgtagcctggtacatgttttaactgctgcaacagtgtattcagcatcggaggccaaaagatcaccaaagagatcaccaaagaatacagttaatccatattaatgtcatcttctgccacttgatgatatataattggatgtagagccaccgttcaagtaatgtgagtgggagcaagaggaagcaaacaaggagaataatgcagtaggatgtgcttaagcataacttcaagcaatgtggagcaatcatccattgctgggcaacagagaaaggtttccatttagtgtttcattttgcatgtgatatgtcatataattcaatccgcctgctggggaaagggaaccacaaacagaaaaatgtaaatgtggctacagacttcaagagcaccagacctctctggtgatattccacaaattcattatgcacctttaggcaaatactcacatacccagaaaagtgtgtgtgtgtgcatgcatatttgtgcattgcaatgtatctgtttgtacataatgattagcctgttcattgttgaaattcagactaccactgttgttagaaacacagacctggggcacactgcctgggttaaaattccatttctacagcttacttctacagcttagcagcataaactcatcttcaggcatcagctttcttatctgcaaaattggtgcaacagatcctgtttcacaggattattatcaggatgaaataattaatatgaggtacccaggacaggagttggaacagtcttgtacatgttagctaatatcagttttacaatgccgtagaagtaaatatgctctcaattgtgcatgtacataatcgtgggtatacaaacacatacatacatattcatatatccatccatctatttctatatagataaatgaaaaatccattgttgtgatatgtgtaatgctagtttacatgttgtagagccttatgaattttagagtccagcagcattaacaacagctactacttattaaatatttactaggtgtcaggggctgtgcatagcactttacttgcattgtcctgtttaatcctcacaacattcaaagatcgtaggaagtattattataagcacagtaaaggattagttacttgcctgtggtaacaaaacaagcaggcagaggaactggacttagaatccaaatccaaatctctcagtctccagagactgaatttttgtgcttgatgctgttatttttattttttgctccacttattaacttagatgacatgtcacacctgaataggttgaagaagtcctcatttaggaaactcaaataagtttctattaatactagaaagtactcgagttaatttcaacaaacaaatctcttatttgccattaacctatttatatcctaggatagtagtgcttggaaaaatgttacaacaaagaatagatagctttataatgaaaatcagaagtatttgctcaatcaaatgtggataaactaatactttctgctcattcacacaagaagcagtcaatttacagttaagtatacagaatgaaatgtaataaatttctctagcatacacacttccccaaaccacacagccctcagagtatcatataattagttccttgccacttgctgaccatttacttttgcaattgttacttaactgccttaatcgtgtacctggtgcaagggcatttagtcaagaggatgcaatctaaagtgtattccacacttccactcgcaatggcaggtgcctaggacatagatgcattcacctaggaaaaggagtgtcttttttctaatcagcactaaaggctgatctttgctaacaaataccttgattaaaatgttttttttttttatctaaagatacctaaagttgtttgatacctctagataaaagggctgtgccatcttgttcatcatcacccaagtacctggggaaacactgggctcatagcaagtgttaagtaaatgtttcattagaaaactgggccgggtatggtggctcatgcctgtaatcccagcactttgggacgccgaggcaggcagatcacgaggtcaggagatcgagaccatcctggctaacatggtgaaaccccgtctctactaaaaaatacaaaaaattagtcgggtgtggtggctgacgcctgtagtcccagctacttgggaggctgaggcaggagaatggcgtgaacctgggaggcggagcttgcagtgagcagagatcgcgccactgcactccagcctgggtgacagagcgagactctgtctcaaaaaaaaaaggaaagaaaaagaaaactgtatgactagtctgcaaagggtggaaagaaaaattgctcctcattctttttttctttcctatactctgcatacttaagggttgatgctacttcctaaatgtcctcacccagaatatctgtgcaatgccaataaaacgaaagacccaggggcctaatgtactattccatccagaaggcagcaagtatatgtgtacagcataacaaataacaagattagatcccatatgagctctcttttgcataatgaaattccacatgttaaaatgcagatttattttaagccctagaagtgctgaccatatgcctcggtggctgaggagatggctacttaatagataatctgcaatgcaagccaaagaactaatcatggccatctgatcatcatgccccatcaaaagccgaaatgaggagacagggaacagagccagaaactgccaacacattttacaagcagggagagaccacgagtctaaagggagggcaggagggataaaatgaacatcttcctaccctaagcaacataacaaaataataacaataagaacatggctgttttagagtatatttgtgataaaacacatgctccactaaatgtattataactatactcttatttaatctcctttcattggggaagttgatgagaatattgacatcacataaaggtagaatattttccaaaacatatatcctaaaaggtggggtccctgatcttaattctgttcacagaacccaagcttctgatcactatcctacagaagatggcacatcatgcatgctaaataaatgcttgttaattgaatgagcatataacacagagaaatcaagtgtttgtcattaagtgcatttaacagatcaccatgcataaatttttgccccaaatgtgttctgcaaaatattgattattatgaatgggatggctctaaaatatcttgggcatctctctgccaccttactagtgggtagaggacagtttatccttaactgatgactgagaatcaggagctaagctgcatgtctttgaactacttaatctctgtattagtttgctagtgctgctataacaaagtaaaacaaactgagaagcataaacaacagaaatatattgtctcacagttctagatgcaggaagtccaagatcaaagcatcagcagggttaatttcttctgagagtagtaaggaagaatctactccatgtccctcctccctagcttctggtggtttgctggcaatcttggttttctttagcttgccaaagcaacaccccatatctctaccttcaggtccacatggcatccctcctgtgtgagcctgtgttcaaaactctcctttttatcaggacaacagtcacattggattaagggcccatatttctgcagtatgacctcatcttaactaattatatcttcaatgatcctatattcaaataaagttgcattctgaaatattgggggttagaacttcaacatgtgaatttaggagtgcataattcaactgctaacagtctcttttatttatttatttatttgcagtttaataactttatttgacaccgagcagttagttctcattgaaatgaactgtagatttttgaaagtggtgacaggcaaaataggtatacagcctgtttggtgaatcttcatctcattgcttttcaggacagccacccaagagtacaagatagaacatttcttattcctttatgccacatagctttgttgagcctggtatcaatgcacacatctggagctctcatctctttcatggaaaatttccagatctctttcagtgcccataagacctactacttgaatcccactccatggatgcacctctaaatattgatggtgtatcctctggccaccttcttgtcgatggcaaaatggcccttcttcttgactttctttatgtgagctattctgccaggctcaggttggaaaggaaccataacagtctcttacatctgagcctttgcacacgatgttccccacacttaggatactccatccaccactgtccccatcctgacctccacattcctttcaactgactaattaactgctcacatcactgctaccatttcccttcattcaggaagccttccctgacccaggtcaataaatgtcagctagtgtgatgaataataataacagtaataatagctgagaaatattaaccaccctgagtagtcatgtggcaataagagaaagcactattgagacttttcaacgctgctctgtgatcacttgctttttaattcttttatcagtctttttttacttgctttttcgttattttatttattaaagaaattaagactgtcagtgagcattagtgtgttgcgtctgttggcttattattttccggtccatgtctttttgtgattacagatctatagatcatgtgtctgatagactccctttcttcattccatactttgtgactgaatccaggcaaggcaaatcacttttaattctcatttcctcatctccaatcaggataaaattcttaggctgtagagttgatgtgagaattagagatacagctaagatagtgctgaagtcataataggcactgaggtactcattatttgatatattatagtagttaggattattatttatgaaattagaattattaatgtttcttctactccacaatgtatcaaagtagaaaagcactgatctgttggacttatctgtaaaatgagaataacaggactctgaatgaggctctttctttgagtcaatgtgtaagggttcatgtacagacctctgaaatctactgagattctttggaaactctcttgacttgtctttgaccataatttgatgttcaatgagtctgcagcaaagtgttattagtgttttatcaaatggtttaaacataatttttttttttttttttgagacggagtctcgctttgtcgccaggctgcagtgcagtggaacgatctcggctcagtgcaacctctgcctcccaggttcaagcaattctcctgcctcagcttcctgagtagctgggattacaggcacgtgtcaccacacccagctaatttttgtattttgagtagagacgaggtttcaccatgttggccaggattgtctcaatctcctgaccttgtgatcctcccgccttggcctcccaaagtgctgcgattataggcgtgagccaccgctcccagcctaaatgtaattttatttaagatacacagcatacagataaatattgaaagcaataaaaattctacaacaccagataaactttctagaagcagacttttaaagacctcattaaacatactaaacatactgtaattttacttctgcaggaggtaaaatgattgtttatctaacttggagaagccttccatttcatcttaagtaatgcatctgtaaacataataaagttccagcctgtgaagagaacatcacatcacatcacatcacatcacatagggcacatcccttttttatttttttgagactgagtctcactgtattgcccaggctggagtgcaatggcacgatctcagctcactgcaacctccacctcctgggttcaagtgattctccttccttagcttcctgagtagctgagattaccaggcctggctaatttttatatttttagtagagacggggtttcaccatgttggccaggctggtcttggactcttgaccttgtcatctggccacctcagccccccaaagtgttgggattacaggcatgagccaccgcgccaggcccacatagtgcatatcctttaatacaacacactttggttttgatggggtgggggcagaatagtgaagcatacagcatgacatcattgaggatcacaggcctgaattccctcactgcattgccctgtgacctctgtctcccttgtgaagtgacaaggtcggtctaaatctttccttcagctttaggatttcaatgattctgtaagttttctccaataagaggttggttttgcaatagaattttaaagtcagtttgccaatgtattctatagataaaactgaattagtaagtggacctgttcaaagtctctctcaacaatatgtataatttaattagcagtttaaaaagtagaccattgattattagatcagccacctgtagaaaatatgcttttgtgcattttatggtgtgatattttctttcaaaagtgttactctgtgtacattatgtcattttggcataaatattttgtttatcagagcatctcattgcctaaacatatgagacaaaagataatatgattatcttatatattttgattagatctagtgaagttaaaactaatttttaaaaacctaaatcttgggttaatttgattcaaagcagttttaaccataaatttttaaaatcttactaagaatctctcatctctttattcatactcctggatgaagctaacagatgcatattcttcaagtgcagttctgattatgcatttttttgaatgaatacatttaatggttaccttactagtttttcaataaaataacaacctcttagcctggtagtcaagtccattttatttctatcttcatttctcctcagcattaattttcattatttttaatgcatcaaatacattttctaagccaccatttcttcatctagagatttggataataacttctacattttaggtaattttgaagattaagaaaaattaaatttctgtggcctagggtgagtacttaataaaccacaattattgattgttattattatttttgagaccccatgataaaaagaatatgcttactttaacagaagaaaacatggtttcaagtcctataccttacttgttattcctcatttcaggtaggttaattaatcttcctgtgctctcatttatttatttgtaaagtggttatagtagatgattaattaataagaggatggacttaaatacttgaggagaggactctagctaaaagcaccaacaagagtttgtttcccttttcgtttgttccatgtgtagcctatattttagctataggttaatcaccatttgtttaccatgtctttcctttcctaacactaaaagttttctcaggctagtccctcaatctacaatgtgctcctatatcctatctatcaatactttacctaaggcacagctgagatatttcccttatttaaagtcttaggatttttccaccaggaaatatcttccctatcctgtgtaccctcttttatctttccaaatatacttgtatatgtcctccttatttatatatacctcttgcttcccttacttagactataatacatgaaaggcagagatgggagcatcattcttcatatctcctaaatgacctttcccaatggcttgcagataagaaacattcaataaacttaggttaactacactatgatttttctgtatactttggtctctattttaaactccttgtctcccttctaaagtaatttctacatttagggacatttcacatcaagcagaatatataacatatttttactttccattgatctacccacatatcttttcaaatcttccctgaagttgtgctatcataggtagtcacagatgacagttggaaaagacaagagtaagtgcagctcaggggaatttcaatagtagactaacatgccctacttctggcatctgagaaaaaaacagcaagaaatgagaaagacagcactgttaacttggacctggaggttagagtgggctcatgagatgtggggttctctgtccactactctaaattgttaatgctatccttaaacaggtccaagaatctatgcttgaaaattagttcccttttctagtggtggttgtagtgatgacagtgatacttgttattttcatttatgtagcaatttcacttatatatatctcattttgacatggacaggaggcagggaaatactggttagaaaagggaggttccctagaaaaggccccaccctcaagcctggaaacttgcagccctaaatgagaataagcattcctgttttcgtgcccaaatgttgccttttccaagaccactctggcctgccatgcccctattctgtgcccatataaaccccaagctccataggcagagcagcagagcagtgtagcagagaaggaaagaagagaggaagtgtctgaacacatcaagagaagttcttctgggacgacaggcaaggacatcagccacgggacggctgaactcaggggaacatcatctgtccactccatctcctttccagctccccatcccatttagagccacctccttcactcaataaaatccccacattcaccattcttcaagtttgtgtgacctgattcttcctggacactggacaagaatttgggaggcagtgggtacgggaacccaaaaaggctgtcacactgactcttcactgagccgcttaacacttaagccattcttggatagctgggctaaaagagcactgtagcactcctggacactgccatgggtctggagcccaaaagtgctcactctggctcctgcacctgctcacttgtgtgctcccactcccataaggggtttgagcatgccacatccacgtcacaagtcccacaagggggtcagggaactctcccatttcaatttgaatagcaatccagttctcagaggtagttgttattacatctatcttacctatgagaacactgtggctcagagtgatgagccaaattggccagagtgactaagacactcatccgatagaagattctagacaaaatctcttctcctgcccccaccctccaccctccatctagttcactgccctcgataggttcttttatcccttcactttttaactggcatctctgaaatgctgaggggcaaaaaatgaaagaaaagataaaatactagtgccaaaggcaaagaagaaaataccaaacaattttagtgtaaaagtaactaaacgtccttatttctattaaaaaattagcttagatcggaactatataaggcagttttctcgctgtaagagaaaattttcagttgctgtaaagggtgacacaatgcgacccaagtgatctgtagacattttaaaaacagggctgagtccaaagtgccttttcagaaaggtgttagggcttcctcacaccacctggacaaaggggtatttgcttgtaagcaacctctacaagggtatttcatacaccctgtgtcctccacaatctgaagcttaaagaaatacaaagcagagtcagcggtgccctgggatgtttctgactttacaggtctgtcgagcttgggaagatactgacatttgttatatttttcttaaagccttttccagtaataaaaagtacatcttctcttcatttctaccagatgtatttttatttttgtccataaaaaatgtccaaagtcacacagtttacaatctgaatgcagtgatttctccgtaccaatacatatcacagaataaaataaaagttgctcactggcctgaaagatgggctaccataacatctgcctacaaagtgatttgctaaacagcattggaaatgcatatcccattaaaaatgtagcattagggaattcatccagaataatgacagaagcacaaaagcaggattaattagaaccctatttctttctacttaggcctcctatgtaacattatcttcatataattttgttttgtggtctaaaataattgtttctatataaaaatgattgtaatagctttgcagttgtatgtgttcactcttaaaaaccacagacttcatacacagaattactagaaaaactaaagtattaaccaagaaaaagattcaggctggtactggacacataaatattgttttatcaggaaaaaagaggagaatttggagagatgttacaccaacatcctccagcatttcatgttttccaatggaaactgaaacagtgtttctaataacttgattcaagggttattttacaaagaaaataaaatgcaaagatatattttacatcaataatttgaattatacaaaaaagaagaaactattgatcattttcttagaatgttactataatagctatttccctagaagaggtttcaatgcagtcaaattttgatcaggcaagtgggagaaggttaagaccttagaggcctatttcaggatatcagggaaaaggaaacttgtaaaataattgtaaatcagttttctaaactgataatgtagcccttatcgataatggtttctaacttactaatattcttgattcttttgagaaaagaagttatcgatgacattaaatggatgacattacttaaatgtcatcaaatggttaatggatgacattaaaatgtgtatcaaggtgattgtggccttcttttttaaataaaaatttttcctaaagtgtgtagattgttgaggattgtctgcttactgtgaaaagctgatgcctgtccacaagggtagcttggaggtgcccatcggaggaacatggggagcggagtgtaagcctttgggagcaccgtgctatgactgcagatgctccctggctgctcagagcctagctgtgactaagccaaggctactctactacctgctttcttcatgtcttcaatggcttaggactggcttcataactagcttctggttgttgctcactgacccacacaggccttgaacctgtgatcctgaccttgcttgttctaaggcctaataactatgagtggtgtctaatactcactgattcttgaaaggtcctgtagaacccaataagcttccctcaggcacttctgcacacactctgggacatcctttcagcaagtccattccagaggagtttgacatctacaaaacagaaatccccatgctagatccttatacagcttccaaaatctcattctcacaacagcactattttgttggtatgatatccaaggtaaagaatgatgttgcaacttcctcagagtcacagtgctaaataacttcagagctagaattcaaacttaggtttttttgtttgcttttgttttgtttctttttttttgagacagagtcttgctgtgttgcccaggctggagtgcagtggcacaaccttggctcactgcaacctctgcctccctggctcaagtgctttctcttgcctcagcctcctgagtagctgggactacaggtgtgcaccaccacaactggctaatttttttttgtacttgtagtagagacaggtttcaccatgttggccaggctggtcttgaactccttgcctcaagtgatccacccacctcagcctccaaaagtgctggcattacaggcgtgagccaccacacccgacaggtcttctgatacctctattgctaatgctcctaaactgcacagcagttctgtgaactagtcacatttaaaccacctgcaaatgctctgcagtagatagacctgtcaaacaaaaaacagaggcaaccaaaacaaacactctccctaacctacttcttaaacagagacaaaaaaaaaaaaataggaaccagagaaagcaattattcccatagcatatttaaaccagataaatatttctgcttgccatcttgcaatttgaaagttggaaatggcttatggtgagttaaagagtttggaatgtgggcctatctaggaagatagcaaagtcgttaaaagtgaagtttctgaggtcaggcacctcagtttatcttctagctttgttgtttatgatctaggtggctttaggcagtttgcttaatctcctgtctctcagttgcttcccagatatacactcgagagttgaaaaataacattcttaatataattcctgttccttcatctcaccatgccacctatagactattttttaaatgcctatggactattttttaaatgcctactgtgaagacttttgtgcattgcacaactttatggcattgtttttgcattaaatgttttccatatataattataaaattatcacaatagttgttgtgacatgatttggtacttctttaatttttaataaaagcctaaaaaatgaaaatggcttgaatttccaggtcttggaaagtcctgacttaaattcatggatgcttaatttatctgtcacatgatctattaatggctatcatatagtatttttggtgaagattaaataaaataggacgtgaggaccagcacaatgtctgacatatagtgggctctcaataaatcacttctgttatttttcagaaagaaataattttttaaagctttatcgttggtcctctgattagccagcatacccccaaagttcaggaaatatatggaaagtgaaaattttataacttctggaaacctcctccatgtccaggaccttcctctgggtaaaacagaggaagatttgttttcatgaacctttctttctctttaacatttagaggtcgtgggcagagaagccttagaagacagaaatttaattcaaagactaaatgcataggaatggaatattgtagtaggtgatatattgctaaaaaacctaactttaaaaagtaattgccaacttaaaaagaagtcaggaaaagctgaggaatggttactactgtcttttctatcacagggcaccccccccccctcattttatacatgtattttcttgtaaaagttaatcaacacaaatgtaaaaactaaaataagtcaaggctctaagaagcacagataggaacatttcaaacaaagtgtacctgactagtaggcacccagccagctggcctttcctacaaaggaattttttaggagtattgtgtagtgctgtctgcaatgaacaagatagcatatcataagggcgtatcaggcatttggcaaaacttgtgctggggcccaactatgctggatacagaattctctctgttatccaggtctttatttcccacttgcaggaccatctgcagccaactccctatatcccctgaagccttcatccttcctctgaccatacatggcgcccctttggccttttgtcattttcaattattgtgaacccaggaaggtggaaactaactttaatatctgctgtaagaaaacataacaagaaatataaatctattaatttcaaaaaatcagtgattaaagccaatttattttccttggctgacattttccttcaaggatttctctgttgctcctgcctatagaagaattttagtttcccttcaaacattctactggtgccaagttaagaagttacctgaaagagaatgcataaaaatcaagttgaaatgtctcagctttgttcctttttaaaagatgaagacatagtgcattacttaggtaacactgcttctctgattcagtgggacagcttgatgagaagatatatgatactttgtacataaccgttgttttctttttgtcatcaataagttgaatcttgacttcattagagcctatccaaatgcatcattgcaacggatcatctccccacattactgtatccattatgtgtagagcaagttcatccaatttccccaacagtttatgagagaaaagaacaaattaaaaaggcctactctcttacatatcaggatgatttatgccagtgtgtcagcacacgtatttatattttctctggcccttctatttgcttaatatatgaaggaggaaagttaatattcttctgaaaaactctgttctggtctctactgatttgaacataaagttcaaaaggagatgatatcttataaagactctaagcttactgcattaaattaacaatactaatctctgtgtttcacatggtacttatgcagagcagctttacagacattaaatgaaaaaaaaatgccaaagctgtcttttatatgaaaagcaagaatagaaccttctctacatgtcccttcaagtctttttaaaagatacgcttcagctagtggtggtgaataagggggaggaaagagagccacattgaatgggttcttctcctgcttacctttcttcaacttcagacctttctaaatcccactgacctggagggaataaacagagaagaaagaagcatagcaagaagtagaaggagaaatagacaaccattcaaaaatgttttaaaaaatcatcaattaccaatctcaggaactctgggaaggaaactagacaactataacattagaaaatccagttatactccccttccagacacaccccatggagaaacttgaagaggaaagagacgaagccaacttcagcctcaaacaattttgcccatgacatcagaagatggtaggacatgaaaggggaaaactgcaggaagatctcataattctatagaccttaggaaaattccggctcatctcacattagttttccaattctccttttcccatttgtctatggagataggatatttgagcagtcccaaccacctctattcttgatttcacatgtccgttaattcaaaaaccatgtactgaaaatctctcacatgctctgctaggattaataaagacatcacacacaaacaatgtcactgctaagcttattgggctcaaggtctcacaaggtatgtgagagaggatgttggagacagagccaggaatagaaagctataacagtgatatgatataagtatgcatcaggtgctgtgagattccactcaaacagtttgtccagacatgatatttttgtaataaaatttcaagtctatgatgattgcctagctgcacagataagtctttttccagaataaaagataagccaacaatgaccacttccttattccacaaattgttagtctccatagtaaggtatggaacaaagtctggaaggaaaatattatgaagaattgcgaataatgcttctacttacttatttttgggagaattaagctaaagcttaatgaattgtattgaatgccactgaatcacattggacattgatggaagaaaaggaagttctacggtgggacaggcggtgcagcaagctgcccatcattgtacagaggttcaccttcagtactctgcagcatcttctagtttgtgtgtaccttggttaacttgatagatagatcacactatttagcatagtatctcactccaatcaatgcctgtcaataatagactggataaagaaaatgtggtacatatatataccatggaatactatgcagccataaaaaggaatgagatcatgtcctttgcagggacacggatgaagctggaagccattatcctcagcaaacaaacacaggaacagaaaaccaaacaccgcatgttctcactcataagtgggagttgaacaatgagaacacatggacacagagaggggaacgtcacaccagggcctattgggcagttgggggtgaggagagggaacttagaggatgggtcaacaggttcagcaaaccaccatggcacaggtatacctatgtaacaaacctacacgttctgcacatatatcccggttttttttagaagaaaaaaaaactgctgtattaaggcatagataagagggaaactgcatgtcatcatttactaagcacaaggtatgatgtgcttcttacatttttatgaagatatttatgtgaaaactttttcaatcattaaaagcgggtataaaactgaaattagaactaagttctgaattgacatgtatcaagattttcaaaaataattaagtacatataatcaagctgccctcactaaaattattacaaatattctattattatatacaagaagataacaatatgcaatatatacaattctaacatgttaatgagagctaaaactttctttgataatccacaaaagtattcaaatatttaattttttatcaaccttaacattttatatttcagtttctctatgttttggacacaatattttagcagagtaatacaatttacttataatttataaataaataaacacagtgagaagtatatactctctatttatatctacatacagttgaaccttaaacaatttatatttgaactgcatgggcccacttgcggattgttttcaataaaagttataccaaatgcgcctgcctctcccgtctctccttctagttcctacagctctgccactttgcctaaaaatcagcaagaccacctgcctgcttctcctcctcctcagcctactcaatgtaaagacaatcaagaggaatacttttatgataatccactttcacttaatgcatagtagacattttctctttcttatgattttccctgcctccctccctccctcccttccttccttccttccaagacagggtcacctaggctggagtgcattgttgcaaacatagcttgctgcagcctcgacctcccgagctcaggtgatcctccttcccagcctcctgtgtagctgggaccacaggtgcgtgccaacgtagagacagagtctcactttgttgcccaggctgttttcaaattcctgggcccaaacaatcctctggccttggcctcccaaagtgctaggattacaggcatgagacaccatgcccagccataattttcttaataacattttcttttctttaactaatttactgtaagaatacaacatacaatacatgtaacatataaaatacatgttaatcaactgaatatattatcagtaagccttttggtcaacagcagacaaccagtagttaagtttgggggagtcaaaagttttatgtggatttttgactgtgctgagatgggcactcctaaacccacattgtttaggagtcaactgtcttttttaaatttatagagcagataatgcaaagtatgatgacccctatcattaaagaagaaactgaggcacaaagatgcccactctaataattacataccattttctttttactccattaccaattaccataatcttaccactatttgtttgctatgcacgagcttttcatgaacataaacaccaaggctgaaagcatttggggtgaaatatatgtcccctcctctgtttgatattactgaaaaagaatctatttgggagaagatggaaattttcaaagtaaaatgggtgaactgttagcaatgataaaaattatacctataccttgggagacggaaagattttcatgacaaccttattttaaataattcttaagtttacattttctaatcttccataagcatatttatctattcaggaatatttgttagttttttatataaaatactcataaatgatagaaaaattaattatcttcgcttaagatttgctaccaaattgaaaaaggcacatatctgaaacgggatgagaaagcaacacaacaaacatgtttcctaatgatgaaatacaacgttgctattaaacttagagaataaaaacaatcgcagccataaaaaatgatgagttcatggcctttgtagggacatggatgaaattggaaatcatcattctcagtaaactatcgcaagaacaaaaaaccaaacactgcatatcctcactcataggtgggaattgaacaatgagatcacatggacacaggaaggggaatatcacactctggggactgtggtggggtcgggggaggggggagggatagcattgggagatatacctaatgctagatgacgagttagtgagtgcagcgcaccagcatggcacatgtatacatatgtaactaacctgcacaatgtgcacatgtaccctaaaacttaaagtataataaaaaaaaaatcgatcatattgaagttcagttttgtactttaacaccatctggtaaaattacagacagaatctaaaaaatatatgagtaaaccttttcttttgagatggagtcttgctctgtcgcccaggctggagtgcagtggcgcgatcttggctcactgcaagctccgcctcccgggttcaggccattctcctgcctcagcctcccgagtagctgggactacaggtgcctgcaaccacgcccggcttatttttttgtatttttagtagagacggggtttcactgtgttagccaggacggtctcgatctcctgacctcgtgatccgcccgcctcggcctcccaaagtgctgggattacaggtgtgagccaccgcgccgggctgagtaaacttttttttttttttaaattaataacttgttatgttttccactggtttaatcattctctttcttttaataaaattgaagtaaaaatgacttagtgtcgttttgtttctgctgtgtttctacaggtcatattcagagttgactgagcaccataagtgttcagccgactttgattttatttttatcgcatgcctcataaaactgatttagaaacctaaaaatgtgtcactaaaatattaaattgtgaacagtcagagcttattgagtttccaaaatctaacaagaatggctggctatgaaggcaaacaaacattcttcaaatgtagccagccacattttaaaaactattggagggatcttgaagattcagaagtgtatgattgataccatgccaaattttcagaaccagtagtctgtttttggaagacttctcctgcatggatgcctagtaatattcccatcataaagtggtttagctccattttaaaattataggggaggcctagtacatttggagaaaatttccatccattggcatttttacatttaatttccacacaggcatctttcttacattatctctgcttcacagaatcttcatcacatttcaactgtcatcagaatccagtttttctcttggctatatacttcatcattttcctcttgctgttaatgggttgatatgattgattgatggagcccctattctgagaacatgttactcagactcaggggtattaggatgctttgagctgtatgtcacagtagcacccgaaacctatgctgaagtgcccacgttggaggaaaactaaatcctaacggcttgcaagaataaatgctcattttaaatgaccagtgattccaaggaaaaaagttagatacccaaaaaattgaattcctccccagcaatgccccttcacttaaaggtctgggttcaagcaaacgcatcccactagaacccagtcctgaactttgaagtaaatgaacaaatgctcctggatgtatgaaggccccagcagtaaagctgagcacttcatagactctctcttagagcctgattgatgcttacttaacttaccaagaagggattttatgctaagatagatcatatttaagatactggttctgacgtggacacaaggaggggaacatcacacaccggggcctgtcgggaggtggagagctaggcgaggaatagcattaaaagaaacaactaatgtagatgatgggttgatgggtgcagcaaaccaccatagcacgtgtatacttatgtaacaaacctgcacattctgcacatgcaccccagaacttaaaatataataatttaaaacaaaacaaaacaaaaagatactggttctgtaacacatctgctgtgagaccatgggaaaatttcctgacttctgtcacacatctgctgtgagaccatgggaaaatttcctgacttctgtcaattttgttttccttttctgtgatgggataaacacacctattcctagaattgttacaggctggatctgatataataaccttctgatagtaatttactgatcacttgaaacaaaggttcagtgtatattaaatatgtgtttttacatatttttcattggccaagcatatttactggtaagcatgtttgttttcttctgtctagttcagataccatgaaagtatgataagattccttcaggaaggctcaggtgacgattgggataaccacatgttccaggtgtcctttgtgtaacaaattaccctcaaagttggcatattaaaacagcaaacattgatctcacagttcttgtgggtcaggactttgcgagtggcttagctgggtgcttctggcccagcattgctcatgagtttgtagtcaaggtataggctagagccacagtcatctgaaggtctgtcaggcctgggagatctgctgccatcatggctcatgcacaagactgttggcgggaggcctcactttcctgccatgcaggtttctccagagggagacagtgacatggctcctggcttatccagagttaatgatccaatagaaaaagagagagagaaaaagcaaccagaataaatactgcagcacttttttaaccccaaccttagaaatggcatagcatcatgattgccatagcctggtgtgatatgggaggagagtataggaaagggtgaataccaggaggtggggatacttgtaagcaactagcatttatataacatctctcaagttataaagtgcttttcacaaataaaacaactctaatgaagcaagaaaccagacagtcgaaattacccgcctacggccacagttatcaacagtatatactcaaaatgactcaaaagtgttattttccattacattctttatatcttcttggttctcttagttgatcaggatatactgtcttctattttgacactaagtagcttcatcttgattaagttctaatagttaaggtattaattttcatttaaaataaaatacagtgcttaattatgatggcagaaagttaatttaaataaattataacaataagaataaaatattttattttagaatggcatatttaaaaaataaaccctccactaacataatattgggctttattccaaatcccactttctagaaatttaatttacacttttctgaaaataaatataaaaaccagtggaaatgaggtgttacctgattttctatctgtaaagatgcaattataactttgaatcaactatactaccgtactatacagacttgaactagctagtggtggtgggtaatgaactatgctcctgtgttattccaagtaaacagccaactttaagcaatttttttaaaaaacagctgatttcaggataagtattaaacaacagtaccttacttcatcacttccatatgactgacttgtagtcagcgttactgaagaactaaagcttaattgtcagttaattgacacattattgtacatgtttctatatgtgatttaaaaaatcctaactcattttagatgcaaagaaaccagcacatagtctcatgccttgcagggagtgtttgaaaacaaaaatgaagataaacaatgtcttatcagaaaactcaatcttctaaatgcgttagctttaaaaatgttaaaaacagatttagagaggagaatattaatgacttgtcagcagagttaaagtgatacttatagctctttgctatatgtattgaatttgtgtctagtctaatttttttcttagagtaataaccagaaactgagctctcatgaacactgaacatggaagatcacagatcaggcaagattgtggtgtgtgtatgtgtgcacacacacccatgtacatttctaccttatatacaggatcattggtgtgggctttctctacgtctaatccaaataagctttttgcagggttaaactgatctgaatacttctttgtgaaagtaactttaaagaggtaatagtgtatggcgattatttgggcaatttagcccataatggctacaagtgggttatgttccttaattgctttgaatattacatcttgaagacagcagtgttttcacttttacaagttatcttagaaagtctgagatgcagtatacttagctcttcccaactgtaacctctctcattgtgcctttgagaaatgaagctcagattgagtgtccttacccaacaaatcaagaagtagaacttgttcccttgttcttattttgggaattttaatcctatatcataccactttcatctccagatacaacagccttggcagtatctagaggagtgtttccatacctcaatcatctgtggatcccattcatggttgaacagtacctgtattttacctagtattcctgtgtgagttttgccacacctgagtaacctttgggtcagtattttaaaaataaattagttttagtgaaataaatttattttaaatcaaatatctaattcttataaaattactgtttttcataaatggaagatgcccataaaaatctcctgtaaacaaaatctgggtttttgtctgcactcctatgcttattgcagcactacttacaatagctaagatttggaagcaacctaattgtccatcaacagatgaatggatgaagaaaatgtggtacacatacacagtggagtactatctagccattgaaaagaatgagatccagtcatttgtaacatcaataatgaaacagagatcattatgttaagtgaaataaacaaggcagagaaagacaaatattgcatattctcatttatttgtgggatctacaaatcaaatcaattgaactcatggatatagagagtagaatgtcggttaccagaggctggaagggagaagttgtgggggaggtgaggatgattaatgggtgcaaaaaataattagaaagaatgaataagacctactatttgatagcacaatagagtgattatagtcaacaataacttaatcatatatttttaaataatttaaagaatgtagctggattgtttgtaactcaaaggataaatgcttgaggggatggacaccccattctccatgatgtgcttatttcacattgcatgcctgtatcaaaatatcttatgtatcttataaatgtatacacttactatgtactcaccaatttttttattaaaagaaaagaaacaccatcaaaaaataatctgggcattttctaaaaatttcaatttaccaccttgccttgctgaaggttgagtttcatatgttttctcttatgaaaagtagagagtcacatgttttagggtgttgatacggacatatgtgtagtaacttgaggatgtccattgaggccatcaaaagcctgaaagaaaacatgaaagggactgcttccatattacatgatccaactacttttcaatgccaagtttcagtgtcatgtaaaatcagcttacttctaccaatatatgtatcatatacctggaggacttgtgatctagtctctagcagaaagagaatgggattttagcccaagaacagggtcctagcttgagcacgaccactaagctgttcagtaaatctggtctgacaacaattatatactgagaaaaccatatggagcataaagaaacgcaataaacttggtctccttaggtctcaggtttctctgaaaaatgatgggactagggtggagcgtcactgtgtccctttctagagtatgactgccttcaccagctgtttttattatcaacatttttgaaacttttacattttacttcccacagtcagagaacttctaaagccccaaaggactgccacctcacgtttaacaaagataaattagaaaatatgaaatgaatgctatcatcttcctaacatgataacctcaatataaacttaagagtgacatttccaaagtcaaatcataatctggataagttgtcctcaagtcttgtcaaaagacgactcttcccttggaaatcctagtgaaggtacccaattgcctctccattcttgttaaagaatgattatttttagatgaacaggagatcctactttcctcccattgcagcagagatatttcacactttttcaactagtccaaattcaaaatggttattccttaaagattctgtcaccagaaatatactcattcaaggaactttgtactctgtcatatgtgaataaatcagcttcatgttccaggtctattttatgctatgtaacttttttgtagacaacattaatgagattttagtctatcctgttattcctatattggagtgttttgtgttttgacttacttatcatagcttgtatttacaaagatgggactcagtaaagttggaaaatatatgttatgaagcaaatttatataactggacataacccatgaaatactgagtatgtctttaaatatatcagataaaattacataattaatactgcaatcacattttatgaaataaaggttttttaaaggaaagagcaaaaatatctctaagagttataactgagattgtctttttcatccatcaatcttctaaagtatatgttccagaaaaaaaaaaaaaacatggtgcactaaatcttagcaaagataatggatttctacagaagtaccttaagatcagagatatagattatgaaagcagtccattaaaaaaacagaaatgccaagttagacattttggcttttacaaataaatgtgaattacataagttaaaatccagattctgagtccctcagaccacttagggattactgacagtcttcttttgagttcttattttcaatattacacatccaaaggcttaacttgtaaaaggcatctggcctgattcacttgaagaattctattttaattcaaagggtatataattagaatactagtattctagcacttcaagatatttttaaagttgtttgaaaactgctatattatcacagaaggttcctcactggcacagaaaatggaaaagttgctcaatgtgttcaggatgctcttgaagctacctctttattgctttcctctcttcatttccaggccatcagtacctcttgaatctaccatcactgccagttccctgcagccatctgctgccaatagggtttcctaaagcattgctgcaatggtggagcctctccactcaaaggcctgtagggcatcctgttccactggtatgcatgccaatgccatgacccctccctgatccatatttccaatcatttctttcactctgccatatcagcaatgctttctaactcccactgcagcctccactgctaccaccctagtcacagccaccactcttcccactgttggtattcttttgttttttgagatggagtctcactctgtcacccaggctggagtgcagcggcacgatgttggctcactgcaacctcctcctcctgagttcaagtgattcttgtgtctcagcttcccaagaagctgggactacagccatgagtcaccacacctggctaattattttgtatttttagtagagacggggtttcgccatgttgaccagcctggtcttgaactcctgacctcaggtgatctgcctgcctcggcgtcccaaagtgctgggactacaggcgtgagccactgcgcctggccccactgtttctattcttgaccctccatagtatgggccagagaacttactctgtgaagggtcagatggtaagtattgcaggctttgtgggccagacagtttctgttacaactactcaacactaccattataatgcaaaagaagccataggcaatatatacatgaatgagcatggccatgtttcatgcaaactttatcattagacattacatttcagttttatataatttccaagtgtcataaaatcttcttttgattttttttttttttttttggtttccatcatttaacaatgcagaggcaattcttagttaatggaccatgcaaaaaaacagccaatagactggatatagcccacagccagtagtttgctgacctctgctctacaacttaattgtaactgctgtgtttagaatgctgcagtggttccccattccactcacgacatgtgcttaggtcctcaccatggcctaaaaggcctcatataatctgtttccctttgcctttcttctgtcttctccatttactccctggttttcctctgtttcagcaaactgacatgctttctgcttcttgaacacatggaacacagcctgccttgtgacttctgcactggctggcctgtctgcctgaaatttgtgttcccagatatttctatgtttctcttgcttgcttcaagattttgaccaaatgccattctctgatagtctatcttgactactctatttaaatttcaaccacactgttatggacggaattgtgcctccccatcccaaacttgtttgttgaagtcctaactcccagtacctcggaacgtgactgtacttagagataagatctttaaaggagtgattcagttaaaatgaggcctctaggatgggccctaatccaatctgaccaatttccttataagaagagaaaatttaggcacacagggagataccaggagcacacaagcacacagcatagatggcatgaagacatagtgacaaggtggccatctgcaagccaaggagaaaggactcagaaaaaaatccaacctgctcataccctgactttggacttctagcctcaattgctgtgagaaaacaaatttctgttgtttaggctacgtagtctgtgatattttatagtgatggccccgttaaacaaatgcacactctaacctccacagtcttcccaaaccgacttatcctattgtatatttacccagagtatttatcatctactgacatgcattttaatttactggcttagtatgtgtattatctgactccccactacatgaggctaagatcttttgtttatggatgtatccaaagtttgcagaagaggacctagcaaaggataggtacttaatgaatacctgttggataattgaatcctagcaatgcattcatctcttatatcccctgcctttgtttcttggctcttcctgaggtccaatccccaactccacacccatggccagtgaaacccacctcaaatattaacaatgctaagaatgtatctcttgccaccaacactctgtgctctttctctttggagtctagtaatacactatctgtttttctcttgtggtgcttaatacattcaagcctgtattgaattttctatatatacgcatatctcagagatattgcaggttccattatagaacacagcaataaagtgaatatcacattaaagtgagtcatacaaatttcttggcttcccagtgcacgtaaaagttttgtttacactgtactgtagtctatgaagtgtgttattgcattatgtctaaaaaatggacataccttaaattaaaatactctattgctaaaaaatgctaactatcatctgagccttcagtgagaagtaattttttgctcatggagggtcttgcctctatgctgacaaatgctgactgatcaggacggtggctgctgaagtttgaggtgtctagtgtaattcttaaataagacaacaatgaagtttgtcatattgattgactctttcatcaaggacttaactgaagcatctgatgctgtttgataacattttacccacaagataacttttttcaaaattaaagtcaatcctctcaaacactactgctgtttattgactaagtttatgtaacagtctaaattctttgttgtcattccagcattgttcacagcatcttcatgaggagtagactcctttcaagaaaccactttctttactcacccataagaagcaactcttcatccatttaagtttgttctttagatggcagcaattcagtcacatctccatgatccatttctaatcctcgttttcttgctatttccatcacatctccagcaacttcctccactgaaggcttgaacctctcaaagtcacccatgaatgttagaatgaacttctcccaaatgttgatgttttgacttcctgtcatgaatcatgaatgttcttaatggcatctagaatggtgaaacctttccagaaggttttcaatttacttttcccagatcatcagaggaatcactatctatgacagttatagccttatgaaaagtgcttcttcagtaataagacttggaagtcaaaattactgtttgatccatgggctgcagaatggatgttgtgttagcaggcatgaaaataacattaatctctttgtctatctccatcagagctcttgaatgactaggcgcattgtcaatgagcagtaacattttgaaagtaatcattttttctaagcagtaggtgtcaacactgggcttaaaatatacagtaaaccatgatataaacagacatgatgtcatccaggtttggttgttccattattgagcagagacagagtagatttagcataattattaagggccctgggatttttacaatgataaagaagcatttgctgcaacttaaagtcataagctgcattagtccctaaaaagagagtcagtctcccctttgaagctttggagccaggcattgaattcttctctctacttataaatgtcctagatggcatcttcttccaatataaatctttttctttatttttattttttgatacagggtcttactttgtcacccaggtggggtgcagtggcatgatcatagctccctgcagccttgatctccctagctcatgcaaccctcccacctcagcctcctaaggagctgggactacgtacagtctcgagtagctgggacaacgtgcgtgcaccaccatgccaggctaattttaattttttttttttttttaaagacaaggcctcactatgttgatcaggctggtctcaaattcctgggctcaagtattcctcctgccttggcctcccaaagtgttgggattacaggcatgagccaccgtgcccagccaggggcttcttcatctacactgaaaatttggttttcagaggaacaacatttatcaatgatcttagctggatcttctgaataagctgctgcggcttctacatcggcacttgctctttaaccttgcacttttgtggtatggatatggcttcttcatgaaccaacctctgctagcttcaaactttcttctgcagcttccctatttctctcagcattcatagaattgaagagagttagagcctgtattagaccattcttgcattgctgtaaagaaatacctgagactggataaattacaaagaaaaaaggtttcattggctcaccgttctgcaggctgtacaggaagcacagcagcatctgcttctggggaggcctcagaaagcttccactcatggcagaaggcaaagggagcagacacatgacagagcaaaagcagaagtaagagagagtgagggaggggaatgccacacttttttttttatttttatttatttattttttttgagacagagcctcactctttcacccaggctgaagtgtagtggtacggccttggctcatcacaacctctgcctcttgggttcaagtgattcacctacctcagcttactgagtgtctgggattataggcatgcactatcatgcccagctaattttttttgtaattttagtagagacagggtttcaccatgttagccaggctggtctcgaactcctgacctcaagtgattatgtccatgtcagccttccaaagcgctgagattacctgcgtgagccaccacgcccagccaatgccatacactttcaaatgaccagctattgcaaaaacccacacactattgtgagaacagtaccaaggggatggtgctaacccattcctgagaaatccaccccataatccaattttctcccacctccaacactggggattgtaactcgacataagatttgggcagggacacatatccaaactgtatcagagacttcctctggattaggctttggcttaagggggagttgtggcaggtttgatcttttacccggaccactaaaacattctttatatcagcaataaagctgtttcactttcttactattcatgtcttcactagaatagcaatattaatttcctactagaacttttcctttgctgtgacaacttaactaacagtttgacatgagatttcagctattttggctttggacatgccctcctcattaagcttgattatttctagcttttgatttaaaagtgagagatgtgtgactcttcctttcccttgaacacttagaggccattaaaaagttattaattgaactaattgtaatactgttgtatctcaggaaatagggaggcccaaggagaagaaaagacatggggaatagctggtcagtgtagcagtcagaacacacacaacatttattgattacgttcactgtctcatataggtatggttggtggcactccaaaacacttacgatagtaacctcaaagatcatcataaaagatataatgataatgaaaaactatgaaatattgcaacgatcataatgtgactcagaaacatgaagtgaacatgtgtttttggaagaatggcgctgatagtattgcaaaaggcagggttgccatgaaacttcaatttgtaaaaaatgcagtatctgagaagtgcaataaagcaaagaacaatacgatgaggcatgcctgtatgttttatattctccactaaatgtcaagctcctttatggtgcagctattgcctcatgcatcttaaaatcccttaccataccttctgaatgtgccacacatattaaagacacaacagaccttagctgaaattaggaaaattattacaataaaaacacttgttactgaacaattacacattgtgtcaggctctattttaagtcttcatgtcacttgcctttactaacaaaaatctcatgaaggtcggactatcattatctcaaatttattgataaggtcactgaacctaacataagtaacttgcccgagatcatacgactaatgattggtgaagccagatttttttttttttttttttttttttttttttttttttttgagacagagtctcactctgtcacccagggctggagtgcagtggcatggtctcagctcactgcaagctccacctcccgggttcacgccattctcctgcctcagcctcccaaatagctgggactacaggcgcccgccaccacgcctggctaattttttgtatcttttagtagagatgaggtggtgaagccagattttaagcacagacctattgttctacagatatcagatatcaggatctatagtatactgtcttgccagttaaaaaacaatgcttactttaaagaagatcatgtcgtttgtgggaacacagatgaagctggaggtcattatccttagcaaactaacgcaggaacagaaaaccaaatacctgtggtgcatacacattgtcccagttactcgagactgtacgtgttctcacttctaagtgggagctaaatgataagaattcatgaacacgaagaggggaacaacagatactggggcctgcttgagggaggagggtgggaggagggagaggagcagaaaaaataactattgggtactaggtttactatctggctgctgaaattccataaaacaaaccctagtgacactagtttacttatataacacatgtacctccaaacctaaaataaaagttaaaaaaaataaatctgtaaagcacataaaaaatgcttactttaaaataaaaatactgctatcatgttaaatgaaataaaaggaagcagcatgtacctgaattcttatgcgttttagaagctggaatggactgatttcacatttcccatgactacttttcttattctaaattctgagagggtagtctttgtgcattggtcaaattgatatacctactgaaattttaaaattcatatttcataataaaattcttctctacatcttatttcactggtaatacttgaagatttaaaacataaaataataaaatgtattaaatatggttgtctttcctaaaactaggactttaacatctacgcaaatctgttatgcttttataatatttcataaataatttaaagaatgagtaggttgttaatattggcttgtgaagtaactaatttctacatgttattgtagtttaaaaatttttttactatactttatatcctaggaaaaagccaagattaatagttaatcttatttttggtgaaaaaaacaaactttttaaaattattattatactttaagttctagggtacatgtgcacaacgtgcaggtttgttacatatgtatacatgtgccatgttggtgtgctgcacccattaactcgtcatttacattaggtatatctgctaatgctatccctcccctctcccccgaccccatgacaggccccagtgtgtgatgttccccaccctgtgtccactatgttctcactcataggtgggaattgaacaataaaaacaaacttaattacaaattttttgaaaattaaggagtttagactcaaaaagtgttagcaagaatacatattgcacatatttgtataatatacaagtcatctgacatttttgggtaggaaatatcttttggtaggagagtaataaagcataattaagtaaaaccctttaagtatattaatgtataattttatcatttatgaaggaagtctttgagtcatatgttctacctaattttgaacattttaaaatcaatagaaagtgaacacattttaacattttctaaggaatttaaaataattgcataatgttttacataatacactacaccgatttataagtatctgaaacaggacttagtgctgtttgaatgagtactgattccagccactgtccttacaaatgctggcttgtaaaagtactcagcagaaccttgaattgggatcactttatttttccaatgaggaaactgatatcatggggggaatataaacttgtccaaggtcacctgctaagacgtgatggtgcaaagataaaagttcaagtcattttctttgccaggtctaagtgtttctaccccaccaagccaccacctgaggcacttgtcacaatgtaaggttgtgagagcaatgtgcttgtggaatgggagagtaataatcagtacgtggaccaattagctgttatgaccttagtaaaatcacttgaataactcaggtccagttgtctcttccgaaaataaagaaaggagaccaaatgatttttaagatccattgagatgtaacgtgtctatgatccaagaatatattctgacacaaaaaattcgtttatatgagtgacatgataaacacaatgttgtctatattgttgccattgtgttaaggacttgtaccactttgagtgcaaacaagtttctcaaccttctaagttcagggattgtgcttttacttgaagataggctaggagggcatcattggaaggaacatttgcatgtatttgggaacatacccagcacttggctgtatagtttcccttgggggaattcagtagacacagcataaaactgatctttaaagttctaaaagctttttatagaactggcttcctagttctttaaagccttttgacttttgtttggctcagggaattacaagatgattaggaaattctttttgtatctcccatcataaaacaggctctatgtatcttaacatgttatagaacaggaatgtgactgatttggtaggcattaagtctcttatcctaatctggtggtcttgaaaaataaaaatcttcccattgtagaggtaataatattgagctcggaagatttactactttctccaggagaagaaaactgcagctagagaacagatcaacttaaagcctggtaatactttactcaaagcatggtaatatgtttttttgtgtgtgtaaaatctctaaaatgatagtacagccaaggcggtatctgtttccagtaattttaccgtatttgaagatgggaagaacctataaatttctaatattaatttattagtttatcttatagagatataactatgtattttttattttaaaaacattaaaattcaactattatacatatactatgttccccgtagaaaaatgagaaaatacaaatacattgacatttatacataaatcaaccataagatgtatgactttttaaataaatgagcaaatatacaggacctaccccatttaaaaatgtgtacagttagagagaattcacacttccaaagctctcaatcatctataaccattttttatgattggaagaagtaccaggtagagatagaacagaaccataacacagattagaatgagcagctgaagtagccaagatcagaagtgattaggtcaaatggtatttctagtatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcgtttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgcgttagtgggtgcagcgcaccagcatggcacatgtatacatatgtaactaacctgcacaatgtgcacatataccctaaaacttaaagtataaaaaaaaaaaaaaaagaagtgattaggaagtcacaattctaccaacctgggaaaagatacgcaaagaaataggcaggagatggtgtagctttgtccccttaaaagcactggtgttgttcaattttgtagcacttccaatgactatgtaatgaacattgactgtgcaccagtatggtctaggcactggattacgataataaacaacaaaaaacccataattattttaaaaagtttatattccacttttacagacatttgtaaatattctatgttattttaggtagtggtaatttttatggagaaaactacaatgcctcccagcttgtgtgggacagtttggatttgtgcctgttttcctgctgtgatgattaagattgcctctttttactctcaaaaatgtcctagttttggtgaccctctctgtaaaagaaatttcaaaacaatgataatatgaaaatatgtatgggaggggttcttttggactggatgatcaggaaatgtctcactaggtgatatctgagctgagaattaaagtaatcacacagctcttaagggtgaatttgaatttgagaggggaaaactgtgtagtcaaacaaagacgtagtttagattctgacaaacctgattttatacctcagccccagcacaccctaggtttggtactttgggcttggctccctgtgagatactcaatagtataccttaagtctaataatgtgattcagaaatgaacacattaaattacatgggcaaagaaacttatatttatttatgatatcctctcacaataccataaagaaataatctatattttaaagcaactactgtgcagtacacactgtgtttgggtacagctggttaattaagtattaccggttgagtatccctaatccaaaaatatgaaatccaaactgctccaaaatctgagcctttctgaatgctcaatggacactcaaagaaaatgctcagtggagcactttggatttcagattttcaaattaggaatgctgaaccagtatatattctgcaaatattccacaatccagaagagtccaaaaaccaaaacactgctgatccaagcatttcaatgatgagatactgaaccaggttttctgtcttttagaagatactgatctacctgagataaaacttgaacacctgaatctgttcaatatacagggttgactagtaattaaatgctgaacaatatgggacagacaacttgtactatcagagctcaaaaagaaaataaatcaatatacattacagaatgaagcagggttccaaggaaagaaaataggatctgaacaggtgtttaattgataaaatgcaatatttcctacctgaccactcaaaaagccatggaaatttgctccaggcagacaacaggaccctctgttgggcttggccagtggtttctgcagcaatcgggttgtctggaccatttagctttttagcaaaacttcctgttcctacaaataatcccactaatcctctctctccccagctgcttccttgcctttcctgcttggctcccctctcataagcctctttctttctaattttttcagaggaacatattttacagtcccgttgcttcacctaccttgcccattgtccttgcctaaaattgtccttgactgaaatagtaagagatagttttcctctgctttttgaaatcttagcatatgttggttggttgagttaactgcttcatatttatttgctgtactggcaggttgacagggcaactgggaatcatgaagaaatagttcagcagaaccacgagactcagctcttaacaagcacttaataaatgttggttgaatgaataaatggctattgtagttattgaaaactaatacaattaaaggcaagtgagtttaaaaatcacagtcatttatataggtacctttctatttattcctaattaccaggaagcataataatgattaggtatttcaattatttttagtgaaaatttaatttgaataaaactaatagaacatcctatagataacagatcagtaatagcgacaaatttgttaaacgtgtgccagcaacagaaataattgtacaaagatccccattttacagatgcgatgacccagcttagaggggtcatctaattggtcttcccaattgtgaggttaggaattaaaagctggaattccaacacagctctatgctgtgctgttgcctctcagaaagatggctgggggttgagcagagagaatagctctcctggaacacattttcagaatataaactttttcagttatgatgtaatatatttatattattgtcattaagactatgatgaaaagacattagaggaagcaaaacaaagcctgatagttcagatatgagataagtaaagaagggtgtcaaatgacgaaatgctttttatgatgatatagaacgatgaaatgctcccttatgccaaaccttggcacagtacttctatgcccaccctggccactgattcagtcctactctcatatttgttcttcctgaagttggaaaataatgattcactggccatcctcagacattattacatgttgatctactgcagggttttattcaccctcctttaaaaacataaagtgaacattagccccaaataaagaacaccttgagacatcctgatgtcactgctatatctctattaggaaggagaaataaataacgttaagcatagagccatattttgtagggacttgctaaaaactgatttgttggtaaaactagtttatattgcaaatatacatatatatgtatatatatacatatattatatatatattttatattatatatatatatatacacacacacatacgtaaatatacacatcaacgatgatctctgtcatggtcagttggacttttcttccacagttaagggaagctcctcagatcttaccttcccaagcccacaaatgtatcccaatactggaaaaacagtgttggaaagaaaataaacttcatccaagaaaagatgttgatatggtttggatgttttgtcccctccaaatctcatgttgaaatgtgatcccagtgttggaggtggtggctagtgggagttgtttggatcatggggctagatccctcatgaatggcttggtgccctccccagtgtaatgagttactgacagatctgattgttaaaaagaatctgggacctcctctcctcttgcttcctgtcttgccatgtgacacatctgctcgcctttcactttccaccatgattgtaagcttcctgaggcctcaccagaagccaagaagatactggtgcaatacttgtacagcctgcagaaccgtatgtcaagtaaatattttttctttataaattacccagcctcaggtattcctttacagcaatgcaaaacagagtaacacagccatcaatgtgcctaacaaacacaaaccatagccgtatctcactgagttgtaataacatcttcccataataacaaacatcacattattttcaaatatcatttaatttagctgattataatgacattctctcagaatacagagtcagtttgtttgaatgtataggtttactttacttctggaatgtaaaaaaacatacagagaaatatttgagagaagttttactgtcaaagtaaaagataaacaatgatagcaaacgatgtggtagaatgataggaacctctgcatgacccacagatatgattagcttgctcatgccactttcaatatcttttgaggggaagcaacatgaccactgtgagtaattttaaataaaaaagcccagtcagtggtaataccagtggtgagtgaatataaaataatcaatactgctatgaacatatttctcctgcttagagtagctttcccgcaggttcctaggatggggtcagacaatggaagcagtagcagaaactctgaaagtaggaggaaaatgagaccagcatttttttcttccctgagctttcttcctaacaggcctctgtgggtaggctatattcctgtactcaaggccaccactctgtctggaagctttctagacacaggtttcctctccaggctctggaaatggttcctatctcttgcctcttcaatagtttactgttaccagctggagcatacacattaccccttattgctccaatatagagtcactttatcaaattcttttctggagtgtaagatctcattcctgccagaaacagaactgatacagatcacaatcgatgtataatatcctcggtagtctttgtcttgtattgtgaaacttaaacgtttctttaagtacttaaacgaggcactgatgtgtaagtgctgaagtttctggtaagaaagctctgattacctttagcaagaggggcaaacgcagctctttttttttttttttttttttttcttgagacagagtctcaccctgttgcccaggctggagtgcaatggcgccatcttggccactgcaacctccgcttccagaattcaagtgattctcctgcttcagcctcctgagtagctgggactacaggcacccgccaccatgcgcagctaacttcttgtatctttagtagagatggggtttcaccacattggtcaggctagcctcaaactcctgacctggtgatccacccacctcagcctcccaaagtgccgggattacaggcgtgatccaccgcaccaggccaaatgcaactctttctatgaacatgagctcctccctttagacctcgtgaaacatgttgattaatttagccaaccagtcaacaagtgagttttaagagtttaccacgtctaagactgtgagatcagaccacttactactttaaagttatgacaatgataaaaacagtcttctttgggaaagaggctttaaccctgcaagcttacctactatgctaattataggaaaaagaacataatttgcaatgtaataaaacattaacatgcaaatttctttctgaaattaaagaaggcaaccagtaatctgtatatataagtgttttgtttgtttaaatcagagatcatgtaatcagatttggcagaaatggcagattataagaagattaagcaagaccatgaattccccacaaacgtccctttaatcctgattataaagttaaacaggacaaaataattatcctgataaagttgaaaatgtaaactctgttgggaaaagtaacacagtgccataaattcattggcagtcaagtgtaaacatcatttttctttgctttcttttagcttcagaataggtttcaatggaagaaagagcaaaagaaaacagtgtaacatggtggtattttatatgcatttgaataataaaaattttacatgatgctttaagaaatataatcttgttttatcagcaaaatttgaaagaatagattaaaaagttgaaaaaaaataaatcagcaatagcataatttcagagcatgcgggccaagagaatataaactgtgtatttgactgccacatgtcagggccacttgaactgggaaatagaaaatcctgtcatttttttttttttttttttttttgccaagattcaacttgaattttgctagtgtttatttatgtgaggtctttaggggtacttcctttgtgtgagatgtgtctgccctatgtgtaaatgtggctgggctgggggatgagagagtacataggagagagaggttggaaatatgattctgtgttctatcatctccagggagaaagaagagaacagaaaatggaagggcacacagccagaaacaaactttgttcaagtctccgattttgcttaggatcacctcttccagacagagtggtggccttgagtacaggaatatagcctacccacagaggcctgttaggaagaaagctcagggaagaaaaaaatgctggtctcattttcctcctactttcagagtttctgcttctcttcagacttcaaaaatgtagtataaaaaatatttaaaatatttaaggctgggcacggtggctcatgcctataatcccagcactttgggaggctgaggtgggtggatcacttgaggtcaggagttcaagaccagcctggccaacatggcgaaacctcgtctctagtaaaaatacaaaaattagcagagcttggtggagagcgcctgtaatcccagctactcgggaggctgaggcagagagaattgattaaaacccaggaggtggaggttgcagtgagctgagatcgcaccactgcactccagcctgggtgatagagcaagactccgtctcaaaaataaataaataaataaataagtctttatatgactagcctgtggtggcttgacccacaataacttcagtgatgtcaattttaaggctggaaaccactcaaagaaaacttgtgaaacaaatggacaaatgtgcatcatctctccctctcatccgttaatctaaagctctctacttgatggaatgatgaattcttacctcctgcttttaataatataatttcacaaaatttgaaatactttaacacactagttaaacaattcagtgtttcacagaatttttgggtttaaattgcttttgcttcccttaggtggagaattgaacttggacatgcctataactttcagacctgaagcctgaaacagagctccaggcaatattcacctcacacgtatatttggggaattcttgataatggaaaaatgtgttcaggtcttgatttttcaagaaaacaatgtacagaatattgaaaaatgtcaaaacaaccttcaaataagtaccctaaaacatgacaatattaaatttcacacataaagaagaaacagttcaaaacatgatatctgcaataacattcatccttctcaatggggcagcattcatatgatagggtgttgtatgggttcctatcatacacaaatagaagtgtcgtattcttggagcaatcctaagacctatctccatttatttaggtgtacaagaatatattgggtagcatgagccccatctagaattgaatatgatatggtacatcaagaggcagatctcaagctgagaagaaaataggaaaattgatcctacagtgaactgaggccattaacttgtaatatttgcatatggatttctgtgatttgctatacataacaaataaacttttaaaaagcatatgtttttatgataaatacagacattatatatgtttgtaaaatacactctttgagaagtgatctgccatgataaaaaatatgtaggaagtttcagggaaaatagatgtatcttattttagctggacaaatctttacttttgaatctgtactctctaaaaaaattattttagaaatcaaattaaatttttaatttgtaagcaatcctagacactgccacaacttacatgaaaagctctcacaaaaggaaattgcttttctgtaacttgtgataacactaataagacaaattgaaggaaagtttgtatccacaaaaatttctttgcacttccaatattctatgtttgtataaatggcccattgtggtatcaaatgagaagcagctgccaaaaataaaattatatattttggaattaacttgttttcaaatgtaaaacaaaatcaccgtttcctcagataacacgattgaccaaaaaaaaaaaaaaaataaaaataaataaataaataaagggctttttggtaaaaagaaaaaaaatcacccaagacatgttcgtgttgttttaaatttttgataactacaaagatacatgctgattgctcaggatacaattagcagctgcctgcatatccaaccttaaaggaaattttttaagctagttcaactctgtttcctacttcttcattaattactagctaagggacttgaaagtgtcctaatgaattttacattagactctgtaatatgaatggtgtatattatcacagcatctagtaaatgcataaattggcttttccaagtcgcattttgagtagttgtaaagattctggctggatatcacaaaatttagtattagagactgagccgaaaagaatttttacaagaaacaggttgctgcaatcacatttctcaggtcataaatctatgttactactttatgataatctgtcggtccttgttctcaaagttcaaagatgctgtgcttcttctttttttttttcctcctgtggttcaaaaagaagaaagcaatcccacttacagtgatttccaaatacgcattgaataaagcttaaaatactactgctataccagctttccataatttccatattataaagtaccatccagtgataaagtaccaaccacagtgttttggatttaatacttatggtttacagtttcccaaccacttaccattttcgtaaaattctttgaaatcaaaagtttaagaaaactattcaacaaacagaatgagctagacaggcagaaaactgtacctaaatccagtcagaaacagacagaaccttaggattgccctatcagagaggaaaggacagacaaccatggaaacctcatggaaagctttcttttataaaatatttctctaatttcatagcaaggtaaaagatcacctcttgctcattttcaaatgtgacatgataccataaatggcacatcatccttacttgaatgtttaaagctaatatgcaggtaatgtcaaagtcatagtgatgggactaaacatttgtaatctaaaggtgaagactgcgtgagaaacaccacagagctccgagttggcaaaagtcagatacagactctcaatgattattccttaaagaatatccaaagtcaccacaattcacattacctaaagattaaaatgcggatattaacaggaaattaacattaggatgttaacaatcctcttaatatctattaatatttgatgatgctctctaaaatcatttgattgtcagttactctcttaaaatggttttcccttattacactaacataattgtatatgcagtttagttaattatcgccaagactttactttcttaggtaaaatgttgctcaaattcatctctcagctttatatcagcacaagatcacctcttgctcattgtcaaatgtgacacgatatcataaatggcacatcatccttacatcatccttacttacagtgtgtgagtttctttactctttttttctctttatttagattaaagaaaacaaatataggtcagtatttgaaaaataaagctcacaacagttctttatgaccagaatcaaagtgtgtgtcctgttaaccaagatttgtctctcagaagtttgatgatctgttaaaaaatatatatattatcagtgtcaagtattttagtcccacctgtcactaatttaatgacggcattgcctaggaatttcatgagcaacaaaactgttgatttagcctcataattttggaacatattaaaaatattttcttgctatcaacacttagatttaaatagaatttctatttcaatcatgaaaatttttaaacattgaaatccactgcaatgaaacaaatatgaaacctcacatggacattttactcttcagctgttttcatattttgctcacattttgcaaggaacccagagatccaaaagaaatatccttaactctttcccggccaagccctatgatcaaacacatgggaaataatctatggattacaataatcaaacagttctagagaatttctaaatatctgcaggaagaaaatctgtgtgcttttcaagtaaactgcagcaatcaggaaagaagagaaaaaccccttgcacaatcatgtatttaaaaaaaaaatctttctactctgcagatactgtttcctgaaatttaccaagaacactgccttgaagagataaaaaaaatacatccatagaagtcagttctacccccaaaagagctgcactgcacacatttttagaaacataaatctcagcaaatacagttgcattttattgacaacattaaaaataatcacaacaaagaaatagcctttcctattccatttcaacttcattaccatgctctactagcctctactaaaaaaaaaaaaaaaaaaaaaaaaagtcattacctgtatgaagagaacctgttaatagtctgagaaggtactgggcaaatttcagtatttcacgtttacaccgctttctacagccactcatcttaagcaacaaggtattcctctgaggagagccagaagtctttgccaataataataataataataataaaaagagagtctctgaggagaaacttctgtctcagtttatgcacaggctgccttacaactcctgtggaattagctgttagcgcctcaatcagaaattcctttaaaatgctagagaagccagatacagctacaacagtaacagggaggtgagaaaacacggcttctcagtgtggtgaccaagttcttctgtggcaacagacaggctgccggttcacacttgtagtaacccagctctggttcggctcggcatcccctctccagaagcagttgcaacctcacagaccattcagagggaggcggggcctgcgatgccagctcatcagtgaatcagcatgtaagcaggtgagaagacagatgacaggtcactgggtctgaaacccttccgataccaataaagggaacctgcgagtgcactccagcctgctggggaggaatctcagggcccgaggctgtacaaaatgaatgattcccaaaaaaaggaggtggggagagggaagcatgctgctcaaggtcagacatcagacaactcccttgacacagtgttaatcagattcaggaaggctacatgggggaaaggctcatttgagaagctgaccctgattctaaacagacttgacgatttaccaccaaatggggacaatgctattttgtcagggataaatgtattcttcttcatgggcttagagggagaaaacaagctgtttcttaaaactggctacattttctgcacagcgcgggctcaggtatttggaaattaggatacataattgtctcctttaaaacacagtagcctagaaaccagaaatcttaagccctttacattgcctccaggcaacagagctccaaaactaatttactgcgttgtcctaagagaaagaagtgcctcagtttcttcatatttcaaaaaggcaaacacaaccatctccctaccaatcaacttttttaaagttaatagccagaacaattgcaaggatttgcaattttcacaaagtactttccttttaagacattgggatagaggcagttgctgtgaaagccagaaaactacaggcttgccttctctgaaaaagtggttttcctgaattcttaagtgccttaggcagttttcgggatttgtctacactcttaatttatactcctagagtttgtttatttttgtttattctgaataaatataaatattatatctgtgagatttagcacagatggggccatattttaaatacctagacaggccttttggcttctttttctgacagttgcaataattctagttgaaactgataattcccaacagtactacataagaaattatgttcttctacactaaagaaagaactcctggactcatagactgaaacacattgaatggaaactcattctcttctagaactcttccccattcccaccagtctcagggttctaaccattctaaccatttaaatggaataacaaagcatgcattctaggaattttcagaactttaattgaaattatttaagatataaatagactcatacacaaaaatcagcaacgtgctttctgaagttctttctcctacacatttaccatgagtgatggcatccctaagtttgaaataggcagaagaaatacacaattgtagttcaacagttggtttaattagttgaacaccccatttccttatctacaaaagtgggaatagaatgcatattttatttacttgttggagagtaaaataagatagggaatggacaaccttaagcacagcacttttattcatagatgtagcaattctatactgaacacctattatgttccagacatggttctatgtgctgggaaaacagtggtaactgagaaaggcaaagcctctgttctcatgcagcttacacctaaacaaagaaaacatcaggttatcaaataataaataagaacatatcccatatgagtaagtgctgttgaaccaggagagaacattaaaaccagctggcagaatagaaagtgagtaggttgagaggtcaggaaagaggtctctaagaaaagaagttaagtaggagtttaaattacaagaaggaactgaccgtgagatgtttagggtaaagggcaccttgggtggaggaaacagcttatgcaaatacgccaagctgcgaatgagcttggcatccttaaggaacagagagaagggtgtggctgctgaaacatgctgagccaggagagacttctgggagacattttcatggataaagtccggggctacagtatgtgaagccttatagctggggtaagggatttagatttcagtctctttgccagaaagccactctagggaataggggacttgtgtgatctgcctgctatgaaaaggatgaactgccagggagcaagagtggaagaaggaacacatgtgagggggcatcacagtggcccaggtgagaaacaatggtggcatggcctggagtggaaatacaggtagtcagtttctggatataattgaaaacagaatcagtacaatttggtacactgaatagggacatgagggaaagaaaagaattaagaatgaattagtttgggacatgaataactgaatgggtaaatttaatgagttgatgacatagaaatactatgggattgctggatcgtatgataattgagttttttgagatactccatactgtattctaaaatagctgtactattataatttacattcccaacaacagtatatgcaggttcccttttctctgcacccttaggatacttgttatcttttgtcttttggctaatagccattctaacagatatgcagtgatagatcattgtgattttaatttgcatttacctgatgatcagggatgttgaatgttttttcaggaacttgcgggtcatttgtatgtcttcttttgataaacgcctgttcaggtcctttgcccactttttaaaatgcattatttgttttcttgctattgagctatttgagtttcttacatattttggatattaccccttatcagatgtatggtttgcaaatattttctcccaattgtgggttatcttttcactgtgtttttgttgtttttttttgtttgttttttgctgtgcagaagctttttagtttgctgcaatttcatttctctatttttgttttattgtctgtgcttttggggtcctatatgataaatcattgtccataccaatgtcctgaagcttttctcctatatttcagtagtatcacagttccaggttttacatttaagtatttaatctattttgagttaatatttttgtatatgatgtgagataaaggtccagtttcattcttctacatatggttatccagttttcccaacactttttattgaagacactgtcctctccccatggtgtgttctgggcacctttgtcaaaactacttctggggatatatataaaaaattaaattagtatgtcaaaaagatatctgcatttccatgttcatttcatcatgattcacaatagccaagatacagaagcaacctaagtgtccatcaacaaatgaatgaataaaaaaatgtggtatatatacacattggaataatattcagccttatacaaattaggaaattctatcatttgtgataatatggaagaaactcaaggatgttctatgctaagtcaaataagccaagcacagaacaacgaatatagtatgatctcacttatatgtggaatctagaaaagttgaactcataggaacaaagagtagaatggtatttaccagaggatgagagggaagggctgatggaaaaagtaaaaatgttggtcaaaggttacaaagtttcagctaaacgggaggaatacattttattgatcaattgtacaacgcgatgaccacagctgctaataacgtgtatttcaaaattgtgaaaagagtagattttaaccattctcaccacagaaagataagtaggtgaggtaatcaaattgttaatcatcttgatttaatctttctgcaataaccatatatatcaaaacatcatattgtaccccataaatatatgccaagtattatttgccaattaaaaacttaaaaatataaataaatacaaattaatactgtctgtagtcttctagggttaagagaatcaaaagatctgctttagatatattagaatgtagatatctataatgtactcaaaaattaagatggatgttttaattcatttaaaaatacatttttgttgttgttttgtttttttgagatggagtctcactctgacaccctggctgagtgtaggggcatgatcttggctcactgcaacctctacctcctgggttcaagtgattctcctgcctcagcctcccgagtagctggcattacaggtgcccgccaccacacccagataatttttatatttttagtagagacagggtttcaccatgttggccaggctggtctcaaactcctgacctcagatgatctgcttgcgttggcctcccaaagtgctgggattacaggagtgagtcaccatgcccggcctactaaaaatactttttaaaatgagagataaaactagaaaacctacaaatgtcaaaaggataatagatatgttgttcaatgcaggctgctacaacaaaataccatagtctgggtggctaaaacaacagacattaatttctcacaattctggagactgagaagtccaagatcgaggtgccagaatattcagattttggtgagggccctctttctaccttggagagtgctgtcttctctctgcatcctcacgtggaggagaaagagagagagaggtggtatcttcctcctcttataaggacactaattctatcctgagcacactatcctcatgaccttatcaaaacccaatgacctccaaatgtcacagctccaaatacaatcacattgagaggttacgactttacatataaatttgtgagcaggaaaaacaaatattcattccgtaagagaagaatactacaaacagccctacaacataattttcatgaattagatgaaatggaaaaattccttaaaaaatacaaactaaaataattcaccaaagattaaatagataatttgaatagctttatacctgttaagtaagtaaatttaatttacaatttataaaattttccattaaaaaaaacttcagaccacatggtttcactggagaattctatcaaacatgaaaagaagaattaacactaattcttcacaatctcttccagaaaatagacaagagttatacttcataattcattttatgagtacagtattggcatgacacaacaactagagaaagacaatatcacagaaaagtaaagtatagacaaatatctcttagaagtatggactccaaatcataaacaaaatattatcaaagagaagttagcaatatataaaaagaaatatatattatagtcaggtagagttcattccagggatgcaagcctgggtcaatatttaaaaaatcaaagtagtacatcatattatcaggccccccacaaaaaaaaatcacatgattatattcactgatgcaaaaaaaagcatatgacaaaattcaacactgattcatgattaaaaaaaaatccaagaaataggaatagacaaactgctttactttgataaagaacatctacaaaaacctactagtaacattatgattaatggtgaaaggctgaatgttttcacccaaagataaggatcaagacaaaaaagtgcttcaaccaatgttattcaacatagtgttggaagtgctagccagtacaatgaggtaagaaaagaaacttaaaggcatacagagtgtaaagaaataaataaaatctttccatttgctgataagatgattttctacatacaaaacccaaagaatctataaaaattaaaatttctctttttttattatactttaagttttagggtgcatgtgcacatggatgaagctggaaaccatcattctcagcaaactatcgcaaggacaaaaaaccaaacaccacatgttctcactcataggtggaaaaattaaaatttctagtataaattagtgtcttcaggaatgtcataggatactagctaagtattcaattatactacttgaaaaaacctgttgtactagcaatgaacatatgggcactaaaatttaaaatacaatatcatttacaatgactcaaaaaatgaaatactttggtgtgtgtcaaacaaaacatatacaagacttgtgtgctgaaaattacaaaaactctgataaaaaataaaaagatgatttaaataaaacatagtaaagatgtcagttctttactgcaactgcaagcaaaattacaagacttttcgatcatagacaagatttttcaaaaaaatgtatatagatgtacaaaggaactagaatagccagcacaattttgaaaagtaagtcttgaaatcaggtagaatgactttgagacttatatggctgcagttctcaagtttgtgaggtatggttagaacaacagatgagcacatggttcagtggtacagggtagaaaatgcagaaatagagccacacaattatgcacacctaattttgacaaagatgcaagagcagctattcagtagaggaaagacagcctttcaacagtgacgctggagcaaatggacatccataggcaagaacccaaccttggtgaagatctcacaccttgtataaatactagctcaaaatacatcacaggcttaaatgtaaaatgtaaaactgttaaagttttagaaaaaaaaagaagaaaatcttcagaatctagggctacgcagagtccttagcaatgttcattgctggtagaacagatgttttcaattagtatatattccaaaaacatgagccataaaaggaaaaattaataaattagatggcatcaaagtttaatactttcactcatcagagaccctgtcaagacaatgaaaagacaacatacagagtgaaagtgaaatatgcaaaccacttatctgacaaaggatttgtatctagagtatataaagactttgaatattcaacaatagtgaagcacacaattcaattagaacatgagcaaaaaacatggagagtcatttcaccacaaaggtaaaacagatggcaagtaagcacatgaaaagatatttaatagcattactaattattgaaatgcagactaaaactacaatgagttattactacacatctattagaatggctaacataaaatcaaaaatggtgtcaagaccaaatgttggcaaggacacagaaaaactggatcactcatacatggacagtgaaaatgtaaaatgttacattcactctggaaaacagtctggcggtgtcttaaaattccgaacatacatcacctacaaaacctagcaattgtactccagagcatttatcccagagaaataaaaatttattttcacacaaaaacctgtacacggatgcttatagcattttgacttgtcatagtcttaacctagaaacaacctagatgccttttaatgggtgaatggttaatgaaattgtatatgtccaaaccatgtgatactacacagcaataaaaaggaatgaactagtgatagacacaatttagatggctttcaagggaattacacagagtgaaaatgccagtctcaaaagattacataccacatgattccattcatataacattctcaaaatgacagaattataaaagtggagaacagattagtgggtgccaaggattaagcaaagggtgggggcagaaagaagggcattcgctatagaagtgcaacacggcagatccttgtggtgatggaagtcttctgtatccttattgtatcaatgttggtatctgagttgtgatattttattatagttttgtaagatgtcaccactgcagaaaaatgagtaaattgtacactgcatctctctgtattatttgcttataattccatgctaatctacaattatacccaaataaaaatttaatgaaaaatgtaataaataaaattttaaaaataccttttgagccccttctatgcactactgttttaggtgctgaatatacatgagtgaacccaatagacaaaattggtgtctcatggagcttataatggggaacggggaaagaaacaacagagcaggcaaagggacactgagcatgtcgaatggagggaagggatggcagggcatgtaaagcaaggtgataacaaaagtcctcaagagaaagtgatgatgtttgagtaaaatttgaaggtggtgtaaaagagacccatgtagatacctggaatgtgcacataggtgctttctctgtatatgtaactttctgtagaccctggacagtcagctaataatccacaaatcaatctgtttgaaaaaccttctcaaaatcagccctctgtagaaggttcatttttcacattgaagcctagagcaccagcatgatcaatattttctctagggaaagtaattactaatcaccaattgtgttggatgtgtgcaaggatcccactgcctatatttgtgtattgttggggagtatgcagggaaaataaagttgtttaatgctatccttgggaaaacacaaaacataattaggaagagaactatacaaatatcacagagtattagaaaacaaaaatgttcttttaatgatcagctaatttggattagatataactaccactagcagcaatatcaagaatcaagagttgcatgttcaataataacagatgtctttaatatttcagagatgtttgagcaaagccactgtcatttacaaagaaatataagtgaacagctcataagggcttaaaggttttcgagatgaaaccagttttggcacatggtaaggggactactaaaattcctaacagtaaagttacagaaaaatttagtttaaatgcaaaccagctcatcatgtgataagaacaaaaggttccttgatgagtgatgattccacaagcaactactggccatgtgaaataagttacagaaggacaaagaagtgtagactcatttcaagatatatttctcctaattgcattttggaggaaatgtttttcagagcagctcttttagagaaggccaaagtccaaatatatgaaatcttaaatgcacttagatgatcctcattgcttcttagaatggaaaaataaatgtgactgattgattaagggaagaaagttggcttctcttcaaggaatgacgagtgtagtgattcccaagaagactcttctcacagtggagttttctctcaaagactgctcctctcaaaacatcgtggtgtgttctgtgtatctcagtgggaacagacattgttatgcctttcaaattgtcacaagttgcaaaattaaacatgtgcagcataaaaatagcacaccatggggctgcaaagagaagcagagcagagccttgcggcaaagtcacaggttttgaaagtgggtcttgataaaatatcagacttgctactgtccattagagaggaactccccagtgccaggtccattattattccagaagctgttcccctacttcactgagtaaagagcctgccatgacactaccaatgtttgcatcaactttggttatagctctgtgaatacaaagcaagtcaaaatcaaccctactggcataggaagtcctcctttagtgtggctaggtctaaattgaccacaaaccatacgataaacattttaggtaatgtctaaatgatgccattgttgaggctttctgccatagtctaatgtcacacaatgaagactaaatcattgatagatatgaggattctgtatcaccttggtattgagtgtgacaatgtgaacaaatatttacatgtaaatagattcacagaagtatctactaaatacaaattatgagctttaaaaagtaaaacaaaacatcctggagggccgaagaagtgaaattttttctagaagatgagattgaactattctttgtttggttgtgtttttaaggagagccactgtttgttattcatgagtgttcagaggtaaggaaaagtgtttatgacatatgtgtagattttggacaaatagtccattggaaatgtgcaccaggtagaggtaaggctccattgatgagaccccacccaccaaaaactctgtctgaagtcctcattgttgttgttacaggagatgggagcagatgtgattagctgagggagagccctgagagtcagagacagatgtttacatcatactttaaaaaaaataaaaatacactggagagtcctgtccaatggagacatgactggcatcatgggcttggaatttggattctgtgtcagcatccaggacttcaaaaaaggaaaggttgaggggtcagtatggttaggggagctaagtttccagtcatagatttatacctagattataagaaaaaaggatgagacgtgtcctcaagcccaatattccataaaattaggctgacattatcctgaaacacacacatacacacacacacacacacacacacacacacacacacggataatgtcagctaatatacatatacaaaatcaacttatgagaaattctctttttcccactctttggtgggtcatttagaataaggaactggggttctaatttcacactggaacataatatcatattgtttacctttactcagatgcattttctcagctattaaacagtcatgcagtctcctgcctgacaaaacacatgtagttataggaagtattaaaatactaccctacaattatataaccattttaaagtgttaatatataaactttttttctttattgagatcactggagctcatccacttaattgtatttacactcttacccattttttctcaaagtacaatgtttggcctatttgcatcagaaccacctggaatgcctgtttaaaatgcagaattcttaggccccgcctccaatatatagacagaatttctaagtatggggtgaagagtcttacagatttgatatctcctgaattctcaaaaacacagacttttgataatcaaagcgacataagccaaataccatcttggaatgagaagtcaaagaacaatcaaagagcaagctgaagatgacaaaattatggctctataaactcccaataacccaccagatatttctgcctaaagccacctgcagaccactgagaggctgggatgtggtcttggtaatgcattcccagccttccatttcaaaacaaatcacaagtgagtcaaggaagcctcattttcagttatatcaaaggcaatcaataggcagctttaaaacaatgaggttgctcatttggcttgaacagaagtcatcaaccgcaagcaatcctgtggtgtccattggaacctaatggactcacacagatttggtaaactttttacaatattttacattgcctttttacaatattttatagattagccagttaactaatatttaaaaacaattaggccacatatgtgatttaaactttcgaattcagcatgctattttctccccttcctttattaatttttctgcagattagtattttttaaattttattacatatactattagactaatataaatatgagtaagctgaactctaacaaaaatatttgtgtatattttttaagggagaggcacagaactttctgtctcattctgttgtgaggtgagatccccaaaaaaaaacaattgtgagtctggggtaactaagtgaaggacaacagcataataaaaaaagaattaaaaagaacaataaatgtcctgaccttcccttggcccccagccaacatatacagatgatgagttgactcagtatatatttattgagtttctacttaccaggtagaggttgagagctgagtttcagatgacgttaagatacaaactgagtatttggaaatgatgatttaccattcagaagaaaggtcaatgttgaaggtcacatggtgatatcattcctgaagacatagcaattaaaactgaatatggatagaatacctgaaggagacagaggtgccctacaggctgttgtcacattgtctcagttataaatggcattgccctatttttcacttgaaattgaactgttttacactatttctttatcataaacagatactagtttttaagaaagagaagatgcaaataattttttttaaagttaagatcatcaacaaaaaaaacaggtctaaatattattaaaaaataacggtagtattaaaacagaagtattcttgatgtgctcagtaaaaaagattttgtgacttatgtaaacacctaggaatagtagaggcaatggtattacagaatcacagaaacatatatactcagtgatgtcttgtctacaccaggttacaattctctttagtgtgagtaatcccttttgtgctaaaatgtccagtgatgcttttataactaactacactaatgccataggccaaatgccaaaagagaagcacatatcctagtccaacagctaataattactgacatcatataatgataaccaccagagctgccagcacatgcaacttttagattaaattggataggagggcccacattggcatgccctgctggaaaaggcagcaatagaacagcaacaagacataactgctgtcattcttcccaaattatatattcttgttttgacttacataaggcagaatattagatgatgtggaagatgaatacctctttagcacttcatcctacaaatctaaattcaatttcaactaggtaaaggcaaagcttggctcagaaatcctctgtgccttttgaatgtccttgagtgtttcctaaggattcatttcccaacagcagtctgaggacgaccacactcacacactcccctggaacttgctgccatacacccttctcatcagagaagcgtgattaaatattcaggaccctgccatcgtggtgcatagcaaagtaatgcagggctctgacctcctccaggaaaatcagtcagggaacaaatgcatgacaacaggtggtactaactgcgtactgtaaccgaaaaccacctaatgcagttttcatgttacacactctccaatgctcactgcagaagatgttgtactaaaagcttttttaaatgcatgctgcaaattcatatgcagatccagccacagctgaccttcggccccatgtgaactctgtagccaacatgtgcctggaagaggaggcagtggaatgagccctggactgagtcaggcttgtgtctggctctctcaaggactaaagttgggcaagctgcttcaggtttcaatctcctgatatgtaaaatgaaggtattatattaaacaacatctgttttatgttccaattcaaaaaaaatctagagatagaattctaaatatcattaaaatagccaaagaatgccctgtaatgtggatctactttgatttattcacccttacccctattgataaactttcaggatgttttcagttgtactgctatttcaaacactactgcaataaccagccctgtacacatatcctcacaatataaagctttattttttctatagattaatttcattaatgtagaggcacgcctactacctatggttaagtaataaagcaagttaagaagatatgtacatgtgatatgtatgatcctacttttatgaaataaagctacattctctatggggtagatttcgtttgtataacattgcagcctattttcttgaagggagagaaaagatgctataagaaaaaggaaatgggccagacacagtggctcacgcctgtaatcccagcactttgggaggctcaggtaggcagatcatgaggtcaagagattgagaccatcctggccaacatggtgaaacttcatctctacaaaaaatacaaaaattagttgggtgtggtgacatgcacctatagtcccagctactcaggaggctgaggcaggagaatcgcttgaacctgggaggtggaggttgcagtgaactgcagtgaaccaagatcgcgccactgcactccagcctggtgacagagcgagactccgtctcaaaaaaacaaaaaaaaaggaaaaggaaacagcaacaaaatggaagttatcacaatatagtggtaatatttagaatataaaactaaaatgtgtaaaaatataaaacattttcatatactgctttgaaaaagaaatacagattaacgaaaaactgatttcattaagagataaaatatataggcaaattttaattggattccttctgttactgtttttcatattgtttttgcagaaaagtaacatgcagacaaaaagggaactaatgaacctgtgatgtgcatttccctgagcagttccaggactgtgaaatcccaatgatatctacttattctctatgggaaaggcaccaggatgagaaattctcctgaactgtatgaactaatcttcacaggaaactttttaagtaggttttattatccttcaaaaaggataggaaaactgaggctgggaagggttaagtaactggcctatactcattgcagcataagtatcacagcttaaatgtgttccattctttgcctgaccccaaacctgtgctctaaagcattgtggaacatcaaaagcctctctgccttccctacagtccaaaaattctcaattttctactatgggagctattaaaattacactagataaacctgtattttaaaagtattcaaaacaaaacacaacacacttacttagagcaataataataaatattacagaataatataatccttcccgttctaaaatatttttaaagaatatgataactttatattgggtcctagataccatactgtatttagggaatttaccaagatagagctggctttattgtaagtcaagcaaaatgaactggcgttcttgtaagctgggttcagtctactattatcggttctgtacagtgtctcctcgtgtgctagtgaaacaggatggggggcgaggaacctccttcccatcttttactagcctgagaagtatcttttcaatattttataattttgcctttggcaaagggctgcttatctcctgggaattcaggcacattttgaagatttccccatagccaatgagcacagaatgattattctcacaaaagttcttaagaaatgtcacctctcttgtgtctccttctttctagataagctctccccacacctttctcctgagacagtctagaatctcccttttatattgctgcagaaacacagactcatttccatacacgtttactccggcacctatagcatagatcaatgctatggacacgtgctgttgtgtgagatttaaaagtaaattttccattcagagatttttaaaaaaaaaaatctggtcatagcagccattagtcaacttagtcttcattgccctcctttttatttctaagcatgattcattcaggatataagattgcatgggcaatcattctagtattaaacaccttggaaagatgaggaccatcttcttcctccctgtgtctgcttctctttctgttccatcttctttccttccccatttctttcactctttccttccctgtccaggtcctgttgaatgctgactcaggccatctgtgctttccaggccagctctttcacttattgctcatgattttggccaagccatttaaaatgcctaggcctcaatttcctcatgggtaaaggaagctaataaggtctacctaatggacccacccaataaaattcttttgagaattaagtgggaaaatgtatattaaacacattggaaattcttgtctacaggggatatgtcatcaatgggagttgttactgctgctgtttctactagattccaaattgagaagaaaatctttctaaagcaagtatcaagtagagtcaggaggaagcatctaaagtttctgcaaggaccatggcacatcttcttgaacactgctgggatgattatttggataataggagttggcatcattttcattattttataggcaatatagaaatatatctgcactcttctttaaaaaaattactaatacataatagttgtatatttttatggggtacaagtgatattttgctacctgcatagaaagtgtaatgatcaagtcagaatgttaaggttgtccatcacctcgagtatttgtcatttctaagtgttgaaaatattttgagtcctctcttctagcaattttgaaatatacaacatattcttgttcactacagtcaccttactctgctattgaacattagaatgtattccttctacctcactgtatgttttacccattcaccagcctctcttcctacatgccctgcccacacataccctctccagccttttttcccatgttctctttctttcatcacataaacactggctttctagtcaatgggaaacaaattaccaaatggtcatatttcacagcacaagctcatgtacaaacccatgattagacttcaatcactcaaaaaaattataaaattcaacgaaaatgatatgaatatgtatgcattttctgacagaagagtccagcacttccactcaattctaaacaaattataataatcctgaagtgattctatactggatatattgtgtgtaaatacatcatcagatttatttttccctggaaacctaaggaataagtttaatatactccaaaaatatagtctagtgcagtgttttgtcacctttgagatggtagtcccctttgacagttttataaaaattataaactctctctcaagattaataaattgtcatcaataatggctgtattttcaaaggctcctagtggtaagttctccctcatagcagctaggaacattccatctctcccttccttgacatattgactactttacaatctcccctgatatttctcggctctctagtctcctttgttctttgagagaaggccacagcagtcagtctttctacagcatcggctacctaggacatggacagagaaggaaagggacaaggggaagggggcaaaaagaagatgggacagaaaggtaagagagtcagacacagggaggaaggagatagagacaggagagaaggaagaaagaggaaaggagaagaggaagaaagagagggaggaagggggggattaatgggggaaggagaagaagggaagagagaatatgacttggtagcttttagtaggtcaagaagtaggtttataagaaacacctctttcaaacctctcaacttccttccccattcaacacatttgctctaagataaaggtgaagtaattgagaacagcctggcctacagcttttaaagtgacctatgaatggatattataaagaatgtgttagtaatttccctttgattattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttattttatttatttttgagatggagtctggctgtgtcgcccaggctggagtgcagtggccccatctgggctcactgcaagctccgcctcccgggttcactccattctcctgccttatcttcccaagtacctgggactacaccaggttcacgccattctcctacctcaacctcccaagtacctgggactacaggcgcccgccatcatgcccggctaatttttctatttttagtagacacggggtttcaccgtgttggccaggatggtcttgctctcctgaccttgtgatccgcccaccttggcctcccaaagtgctaggattacaggtgtgagccaccgcgcccagcctgatgtattttattttacacaaccaagttactgagctatactttactgacaaactatttcttggagtatgaatgagggggacaactgcctccttagtgaactgaacaaaaaaatcccttctatgccagttttgctcttttgtcttgatacaacattagatgtctctgacatttttgctacaaaataaattattttcaacacagtttaacaaatatgaattggatttcttatagctttcttatactgagccaaagaaatagaaaaattatatctgctctaaaaattgagaggactgcaaatgtcaggggtgagttgcatccatcaaaaaaagtcctaactgaaaaaagttattttttctaaaaattaatttgctttcttcctgaaaatctctactgtttccatgatatggttttcaatcttttctttgtgcttctgatatcataattgcaaaatatttcacttgactctgcattatttattcacccatcagtcagtcatttattagggaaggaactgtaaaatcaggttactttgatacgacttctctgatttcttcaagatcaacattaaagtggaaacacctgggatctaaataactggagaaaatttgcatacaaaatgaattagcatcaccattaaaaagcctcttttatcctaatctgaagtttatggggagcagctaaaactaagaataaaacaaatcattcttggtcagctttgatggtcagacagttgtctacggaaccccaagtctatgagcaaagtgactcagtttacgtatggggccaacataatagtctttttttaattttaatttttatttttgagatagagtcttgttctgtctcccaggctggagtgcaatggcgtgatctcggctcactgcaccctctgcctcccgggttcaagcgattcttctgcctcagtctcctgagtggctgtgattacaggtgcatgccactgtatctggctcattttttgtattttgagtagagacagggtttcgcagtgttggccacgctggtctcaaactcctgacctcaggtaatcgcccaccttgacctcccaaagtgctggattacaggtgggagccactgccaccgtgctgggccggtagtctttagtttctgagaagaggcagaaacggctagttccttaaaaccctgtaatgaggagttactgggtaaagttagaaagcttaattataagatggtctgatggacatgtttacccccaacgagtgagtcaatttagatcacattttctgctttccagactgattattaacccatttgtttcctcacctccaaagctggtggtgactcatcccatgctaaaacggccttgttgaagggaacaaatggctgtgacctgatattaatgtcactttgttcctatagccattcctccttttggggtgactgactattaagaactcaagtgtaggtaaatttagaaatacagaagccacttctctccatacccaggtagacggaaagaatcaagttctcatgctgggccagtgtgcccactatccttccaaaggtgaaactaccacactggagtttcttaatttatttccccatctgatgggtttcagggatgcctgcaaatctcacctttctctcttacactcattattgtcatagtgtttctcaaactcagcactattttgggccaaatattttggtttgttttggaggggtatcctgtgtattgtaggatgattagcagcatccttggcctctatctactaaatatcagaagtattctcccactgtagcaataaaaatgttgctagacattctctaatgtcccctaggggtaatatcaccctggatagagaaccactctactaagtctacgaacttgactaatgagagtgccatggattcttgatttcagccctagtgactcagattttacacatgattttcacaatattatctatataatttgctatatattaactatataactccctagaatacactggcttataagcaataaatcaaatgcacttggatttagcattgagcattttataaccctcaaaaaaagctgagcctttgtttttgtaagaatttggctatggcagaaccaatgagaccatacctccccaaaataaaacccatcttgcaagttatgaccacctatattcaaatggtagcctaggactggagcaaagagcaaacagctatcagttcttaattttactcttgattgcttcttatttttctttactgggttgaactgatcagactttgcacatattagcctatgtgacctaattcttttcctcctatgttttctgtttcaaggctcttgatcactgtcattttcattggccccactcctgcgtaatagttccttctttaatatagttctcactccaacttctgttttatattccaaatctgtgatcgtcacttttctctttcatcttttaatgcatcaccagcttagacctatggtacccagttggcctcaattcactagtgtcatcctggcatctttttgacttctctgttctgaatctgttcatttcatgtcataacagatcacttagaacatgaaaaagtaagagaaagcaatttaacaaaggggcaaaaataaaaaaccatacattctcagaaataagcatgcaaactttataacttctgagaacaccacattatcacatgacagtgtaccaagtgtcatttgcagtaatgattttgagccttcaataaaggagtatgtgtgctctccttaagaagaaaaaaatactatatttagaaatagtttcaactcatctggttaatatagcagttgcaacacctgaagtgatgagctcaaattttctgcaaaacacagttatgtgaaacactatgttacctaaatatttattagccaatttgtatttatgcttattatgttgaattgtatatggttgctagttttacaaatattataaaatttggtaaacattttatgaatattaacaattatgtattcaaccaaaataatactgaaaggttttttttgttttttgtttttttttcaagttccaggatacatgtgcaggacgtggaattttgttacttaggtaaataaatgtatgccaggccataccaccctgaacatgccggatcttgtctgaaacttctctaaatgcaagacaatacaaactagcaatgccttcttcaaaagccaaacacacttaaagttttatgaaaataattttcattttgctaatgtttcatcaatgcttccttcttgcgtggatagcttcatgattccagaaactcaagaacattaactgaacaatcaactaaaacagtgcaagtaatgactccacaagacagcgcaagtaatgactctatagccaatggataaataagaaaatgaggtgattattttaattagcaaatctatttgcaaaggacccttcacggatcctcaagtttctgttttgccatgtttagtgcatttcaattgcaaatgtcaacaattgcattttttggattctaatctccagcagcataataaataatgtgcactgcatttgtcattttaagatgacagcactcagcggtaagaacctaacaaacaaaacaagctaaagaatcattaagtttcagtacgcaagtgccaccttaacaagtgatcattgaagtaatattttctgcaataaaacccctacagttgctaatcattgatgatagctgatgctagaaaccaaaaacagatacacatcttcagtacatgagatggaatataagacagaaagtaagtaaggagaaggaaaaggagacagaaagaaacctaattatatcagacacccaggaactctgaaatgaactcgtttcatctcagaggaacatgaagaaatatagaggagtcaatttaaatttattatctgcctgctgctgtttcagctgctgctaacagacgttgcatagagaacctatggggagaacagcatttttatatgttctcctggtaagaagctggggtgagggtgttgaggatgaatgtaaatgtgaatatatggtacttcatcaggaccaagttttatgttaccatctcaagggagctaagtaaaataaaagttcaatgaatatttgctgaataaataaatgatgcagtgattccaagactccctagaaatccattgtgtggttcagtagagtctagtactgaaccatcacctctcatcagcagtggcaagaagaaatctttgtgtcaggtaaaagaagaaacaataggggccaggcatggtggctcaagcctgtaatcccagcctttgggaggctgaagcagatgaatcacctgaggtcaagagttcaagatcaacctggccaatatggggaaaacccatctctacgaaaactacaaaaaattaggtgggcatgggaatgggcacctgtaatcccagctacttgggaggctgaggcagaagaatcacttgaacctgggaggcagaggttacagcgagctgagattgtgccattgtgctccagcatgggcaacaagagtgaagctccatctcaaaaaaaaaaaaaaaagaagaagaggaagaagaaaagaaaaagaagaagaagaaggagaaggagaaggagaaggagaaggagaagaggaaaaagaagaagaagaaaaaaaaaacagggctactgccagttatttaataccttttctatatctgctagcatccaccaactggtgataagagggacttcttaatcttaaaggctccattgaaacatgtctccacttctctcttaccctcaggaagtatgcactaggccagttgcgttcaataccacatacagagttttccatcataagtacagtacatatttctccaatttttttcatgtaaaatataaattgaaaaaaaaatcagtgcaacaaaagaaaatattcaaaatccaaagacaagtggagcctcagagcaaatagatgttaagaaaatccaagctagactctgccttcttgattttcatatctaagtgatagaaaacttttttcttattttgttttattttctttatttgttttacagtaaaagagaatgactcggagctgttgttttttttcccccattctgttttttttctttttttttttttcattgtactttaatttctagggtacatgtgcacaacgtgcaggtttgttacatatgtatacatgtgccatgttggtgtgctgcacccattaactcgtcatttacattaggtatatctcctaatgctatccctcccccctcccccaccccacaacaggccccagtgtgtgatggtccccttcctgtgtccaagtgttctcattgttcaattcccacctatgcggtgtttgtttttttgtccttgcgatactttgctgagaatgatggtttccagcttcatccatgtccctacaaaggacatgaactagtcctttattatggctgcatagtattccatggtgtatatgtgtcacattttctgaatccagtctatcatgatggacatttgggttggttccaagtctttgctattgtgaatagtgccacagtaaacatacatgtgcatgtgtctttatagcagcttgatttataatcctttgggtatatacccagtaatgggatggctgagtcaaatggtatttctagttctagattccttgttctttaacactagagccttagttcggagtttggttaaactgttcagtgagctaactccaacgtttacatagaaagtactttttccgtgaaaacagtgtgatgtaatgacctaaaagtagagattcagtgacagatcacctggatttccactctaatgctgcctttaatggctgtgtaataatggccaagttacttaacttgtcaccaaaagattatgtatgattatttctgcattcaggggatctacagtaatttatgttttctagtttatgttttatttttctgatttctataattcctatagtgaacaaattttaaaaaaataagaagaaagaaacttcaattggtgacaaggtatcaagtaaaaatgaacattaaatgaagcaccaccttaaatgctacactttacaaagttcgacttcagctataatcaacatagtttctaattttaatcagttaatggaaagcataaatcagccactcaatttttgcttataagtaatttctgggggcaagtatatatcagagttgaagttcttgatcaactaactaaaaaatcacataaaaattctcccaccttctcattatcaaacactatttggttttcataattgcagtgttgagctctgacctacagataatgttctgatacatccaataatacttttgctgctacatcaataaaacatggttgtaaactcagcacttgccattcacatggctaacacaattatgcccgtctccataataatacaccaacataaaatcatcctcatggctacattaaagttaatttcctccaaattatatgctgtgttcataagacatgactgtgcatttagacagtgcttacctgttaaggggctctgaacactgcctgtgtgtatgttctatttatgtgtatacatcactgatgcaaaaagagacagccttttatttcaaaggtatctatgttctgatttgcactaaaaacttagactccttaagatcataaatttcatattcaatcatagtaccattctattgagctcattattcagtctttcaccagtacaaacaagaactattttatggaaagccattcatttattcaatctactgctagtgctaaagaaagctgtaaaagtaaatctaagccagctctgcattttgggatgtcacagctcaactgggaagagaggtatgaaaacaattccagtgtatgcagggctgttatagccacactttaggcatgtgaggcgggggagatagggaagaaagaaaatgtgttcagggtaggcgttactaaaaagaatttgcaatgagtttcaggaaatgagtaggtttttggccactgggtaggagagaaaacaaggaaatcccacattctaaagagaaacagaatacctgaacagcagagacatgaatgagcaaggagagaaaatgacattgtaagaaaaatgctcccttttcctcagccaaaagttttcttactttcagttaggatatgcagatttaattcaacacgtcatttgggcaaccactagaattttcaattgagaagagagaaatcacaagtcaattcaaattataaaagcaaatttggcaagatcatatggttactgccgtgctagagggagcggatgggtatctggttctctttgatgtggcctgttacagctttgtgagtccttgctaaaatgtattattgctgccattttactgtgcatattacgttctgctctttccacatcctatggtaatatttttgtgccactctatggttaaacataattttaactattgcgactatatatgcattggcaattcagtatgtgtaaccttcaagggaatagttttaaaaagattctccgtgttaacaacatggtaaggaaagtgaggtcttcagacaaaaacaaacaaacaaaaaacagaagttccataaggattctcactgtctatctacctagacatttgttttacatatatttctacagaataaaatttaacaatatagaaagatctaatgggtctatgaaaagatttgctgccactgtccccaatcctattcattttctccaagatatgatttcacatagatgatataagttcttcgggcatgtggactcagatttcacttactaaaaacaaaacaacagtaaaataaaatctgtgatgctgctaaaattcatatatttcccaaatttgaagaccctcctttgagtggacagggtccccaggacccatattagaaaagaagagcttttagagaatattttgctaatattcactgctgcttctcctttttttgtgtgcagcaacctcacttctgatgagcttttaaacccatagccagctaaatcacatgttaggccttcacctagtatatttacccatcatctctttccagtaatgtacagcttgcctaaaatgatgtaaagaagaaatattgagttcagtatggctagtggagacgtggtttgtaggaaaacataggagacaaggttaaaaaagcacaaagaactcacaacaaatggctcagaaaaagaaagtttggtgtcacatgggagctcagtcatacatggttaaggaattaatacacgtaaattcctagccatacacatacacataatctatcctcaaaggtatgtgcaaggctcttcctagcctttagatcaactcaaaaaggagaaactttgatataataaatttctcagggattatctggttgtgatctatttaatacaaatgagtctggactatgaaaaacacagttttccttgagtttagatttttagggccttctctctgtagggcattaaggcctcacagggtcatgatcattttataatctttaggaaaagagccaagcacattcctcagccaattttatatgcaggccttatagcagagggggaggagcaattctacaacttgcagaagactcagggaagattgtcaggatgggagaatgccatatgagttggagagaaggctccaagcaggtcctgaatcagaatagaacctacatgaatgatggtacatggtcaaggatttgcagatttggatttgtacatctctatctcttttatcaaacacaactggtcaaactatcacagagcatagacaatgaggtgtctaagaaagatccctgagagccaatgaggtacagactaagagaatgggttttgaagtcatgtaaacaaaagtctgaactccagctttccaatttactagttattcacccacaaaatattttcttggcctctctgagtctcaaagccatctatataaccctaaaatattgtgggaaaaaagttacaaataatacaagtgagatatttggcatgtgtttgacattcaacatgtatgaactattattacatgaacatcatctaggaatgtaagtgagttacaacactaaagtgcaatatttctgcatgttgcttgcggagcaattcatcactttgtggagcaattcatcactttacataggctcagtgagggccttttttttttttaacctcttcagtatctttaaatctttaaagttctgaaaaaaataccgtatttccctctgttggtctaaaagttactattaaattcttggatttcacatataattttatgctcatttagtaaatacatgcactttacacataacttttcaaagtattatcattttgaagtgaagagatgatggagactgaaaggttccattaaatatcttctgctcagtgaagaaagagacagcttgcagggcatgcttaagagacccaaggagtgtgtgacagtctgcagcataacagacctaaccatacagtatccaaaggtctttggacttctagcctgacattctctttcctacattatcttttgagcttcctctactcagtccttactctttcctttctggagttgctttgtaaacactttagcttcacagaagttcctgtgagatgtcaaaatattccatctctctatttaatcagtctgactttgcgtctaaacctagtaaatttgggatattatttgtttgacacctctgccttcacaaacctatgattcctaatattcttggttaaggcatcacagatgccttttaaaccaatcattcttcatcaaaacacaaatccagaaaatcagacttcttagtaaatatttcaaaacttcctatacaaaaaaatccccagctccctttcttttcttagacttcctgtcacaacattcacaccatttgtgaataacagtctggagctggtgtgttagagtcaggctgaaaaattggatacctcagatgtacttcgaagtcatccataaaatactcaatggagaagaggcaaggaaacccattggttacaaaggcagcaaaacgaagtaaggccactgccagtggatcatgagaaaagacaagagacattcaaagacacaattgctatctatgatgcatctggctctggcagaatgatagacataagccttcagctctgagagatggagaggattactgctttggaataaggccctgtaatctttgcattagtatatctgaagcaaatgaccttattattttgatattctaccttaccttctctgtaactgaaaatagaggacaccaaaacaactttgtttggcaatatttttcttcttcattagtgtttatttccccttagaacagttcaacattaactgttaaattctgatgaagactgttttattcttggtgatttcaagttacaagaaaagcacctggcacatagcaggtatataataaatgttataaaattgatttaataattaattaattatcaggcctcttctgccctaaaagagagatggcactctaaaaagaagaaaataaattctgtttctggaagagtaaagtgaaaggaaatctatcactgatgtgtgctgctttggcaatatgtgttttcttaatctacagcaaacaaatgttatataggttagaggtatacatatggaaatagctcaattcctatcaagtttatttgcctagaatctatacagtaggaagtctaaggatagcaatattgtgtctcataacttcattaattttgatgcttagctccaaagcaactgggacatcagtgtactgttagcctggagatgtttacttctcctttcagcctcctcatggataaataacaaatcagtactactgaaatgagttgcttctggggcaagcaatgaagcagttgttccctcagtagccagctccaacagcctttacagtctctcaaagaggcatgtcttctgcttactaataaactgtattttaagctgccaaaaaagcagcatatgaaacactaaatgtgaaagtgcctaggcataaagataagtctcacgtagcagaggagggtgagtaatttttccctaactatgggatgacctagagcacaagttagaaaaatcgtaacaagacagaaattcgaaacctaggaatgtgttcaaatggtcctggagaacattgtcatttaggccagcaacaatttgagtcctgctttcaggaaatgtttgctaagaccttaagattagattccacgtccctgtgaatacccttatctcctcatgttttcagaaataaatcatttatcactctgcactgtaattgcttctttaattgtctgcttccctccccaaatgtttgctcactgagaaaatatcctgttcaccaccatttatacagtggctagcacagtgcccgacacaaagtagataagcaatatatatggcttcaatcgatggatcaatcctgatttgtgtcaatcatacataagaacatagctataaattctcaattatctttctgtagatttgggaaagtagattcttccattattatgaggggaaatctatttccccctagccataagctcaatctgtctagggaaggggaatctacatgtttggcactacacagtgcaaaaattatggtaatctgataacttatttctcaaatgttttgttggttagtactctagaatactgaaacacatagagtggtcacatgtgccatgtatactctaaatgtgttcctccaaaattcatgttaggatcaaacacccaatgtgatagtattaagacatgggacctttaagaaatgattaagtcatgaggactcttcctttctgaacaggaattgtgcccttatacaacgtttgaaggagtatgcctttctctcttctgtccttctaccatgtgaggacataatcttcattctttccaccatgtgaggacacagtcttcattcctcccaccatgtgaggacacagcaagaaagtactatcttagaaacagacagcagccctcaaaagacacaaaatcttctggtgccttggtcttggacttgccagcctccagaaccataaggagtaaattatatataatttatccaatctgtgttgttttgttacagcagcacaaacagaccaagacaataccctacatttaaaatggttatttgtggccgggtgtggtggctcatgtctgtaatcctagcactgtgggaggccgaggtgggtagatcactggaggtcagaagttcaagatcagcctggccaacataacaagaactcatctttactaaaaatacaaaaattatccgggtatagtggtgctcacctgtaatcccagctactcaggaggctgagacacaagaatcacttgaacccaggaggcagaggttgcagtgagctgagaccacaccactgcattccagcctgggcaacagagcaagattccatctcaaaaaattaaaataagaataataagaataaataaaatggttatttgcctttgttcagaatatttttcagaacagcagcctacacacaagccacgacctaaaatgcaactaataaacaggccaggcatttcttgcacactttttcacatagtatctaatactacactgtactagttttgctcctacccaaatgacttacactttctgtcttctggactcctgtctttcaaatctcagcctcttttcttctccatctacacctgctttccaggtaattccatctcagtaaacaatgacaatttccaaatttaaatctccagcctgagtctcttccctgaactctagactcatgtatcaacacagccaattggatgtataaggagcatctcaaaactaaccaaactccaaatctcctttcctcaactctgttccataaagtctttcttatctctgtaaatggcaatacccttctcccaggtgctcaggttaagtcaaataaggcgttttcctcccactccacatcgagtccatcagcaaatggtgttggctcaatgttcataattgaagtacttcccaccactgccaccccagaactgcaggccaagctgctgtgatttatggcctatttattgcagtagcctcttcactaggtgtctgcttctgcccttgctgccttacagtctagtcttaatgcaataaccagagtgatccttttaaaacataattcaaatcatgccacacctctgctcaagtctctccaatgactacccattccatttgaggaaaaagcacttaaaccacccacatcatttttttctctgtttcctctctgacctcatctgaactactggcctcttcttcactctggatcacacagatatgatgctcttttaaaagactcaacatgccttcctcaggagtttgcctttgaggatcctcccctggggaagcccttcttaaggagatctctatgtctcattgtcttaccacccctcaaatcttagctcaagattcaacttttcaatgagactttccaagaccaccctattaaaaataaatttcctcacactggattcttctctttcccttctttggtttattttactccacagtttcttccaatatgatgccacatatatacacactcatgcattcgtgtgagcatgcacacatgcacgcttgttccttgcatttatttcttggcaaataatgtctctttgcaaataatgatatctctcctccagaacctaaactccatgatgcacagacttttatctttgtgctaagtgcttaaatctgagcaccttctacagggttttccctacccatactgaatacaattttaatgaaaaaaatacagatgtatatttgaataggaatcatttggggtctaggttgccttttgcttagtcactttccaccaacaatatcctactagacacagaatcttcttatttcattattagaaacacttttgcattcagtttaccaggcttaacataaattaaaaaggaacaaggaatacaccagtgactacttagaatagatgccactataaattttctggccctagtactaatctaggtaatataatttgttggaagcatattattattcgagaagcaattatttcagctaagatgcaagacttctgtgacgagaatttcaccatgtcctttcacataaatgcacagtaaaagatttttgctgtgttctatggagcctcaagtgttttttaaatgaaaaagatgcatgaaataaattagtaatacttctgtgaatgaaaagaattaatacaagaattctaaaagcaaaggtatgcctctgcttcattcccatgaatgtttcctataagtttacatgtgaaacagaactctgcaaattttaattttaatcaagaaactaagttgacagtttttatttaaaaatgaaatatatatttcacacactaagttttctaatttcatttgaatcttttacaaaacataaaagtattttataatatatggcacattacaaaacttgtcttgtttggaaagtatttaatgcataaagtttaataaatcataaatcagatatgatgtgtgactcattaataacaattggtttggaaaactctccctgaagcacaaattgttggcttgcttcccaatatcactgttcaatcaacagtgattgaagaatcactgttcttcaatgcctgaagctcaatgtctaaaaacagttattttatggttttgcttgttcatcatttgtttcaggtgggaggtaaatctggttccttgctggaagaagatgtcaaaaatattcagtattgcaacacggatatattattatttagaaatgaataaaataaaataagtgcctggctcagtatcacccagtgattaaattgggaaagggagagatcaacagccacatcccagatcttaaacacagtaatactctgcttcttcttaaaccctcattaacatttgcaacttaatattataatttttcaaattaaaacctcctttttctagactctgacctccttggaggaaatagttccgtgttgtgtttcactctaagtccatgtatagcccagtgttggtgcacactcaggacatgctcaggaatgaatgacagcaggtaagcgagctgcttactgggctggttctggcaaagcacaaaatcatgccagtgacggccagacaggatatatattgggggtgaggtctttgcaaggaaggctacgaggcttggagatattaatataccataatgaaaaataagtttcatgagggaaaaaaattaataaaacattgtaatgggtaaaggggatgtaggagtcacggatgtgccagccaactttatttagatatctgctaagtggaaatgttattttgattcagatttactctgaaatgggcatctgttcaggatcacaaacttatacgctggaagaaattactacataggtcacttgatcctggttattgtgcaaattaagagtcgattctaggctgggcgcagtggctcacgcctgtaattccagcacttcgggaggccaaggcgggcaaatagctggagtcgaggattttgagacaagcctggacaacctggcaaaacaccatctctataaaaaatacaaaaaattagccagacgtggtggtacactcctgtagtcccagtttcttgggaggctaaggttggagtatcacctgagcctaggaagtcaagactgcagtaagccttaattgtgccactgcactccagcctgggcaactgaagtaagaacctgtctcaaaaaaaaaaaaaaaatccattgtgacaatagacattagccttatgattaagtcctccaaataacagaggtccattatgggtgagagaggctgtcccactgttagacaattttaactggtagaaatcttctttctcatattatctagcttctttacacatcaagagaaggtacatacacacaaagagagagagtgagagagctatacacaaacgatatagcagatttctctcacaatgtttagacatacagaaatacgctttcgacgtgatagaggacggaaggagaggtggaggaggagggggtgaaaagatctaaaagtaaaatatttatatgaagagtagtttgcttctaatcacgctgtattttagttggactagaaagttctaggaatatatggcaaacaatatgccagaaatctcatgctcatttacatccccaagttattattaaattaagatattttttatcaccaccccagcacttcacccctgacatcctaaaggcttaaaatctgaaaattttactgatcttcaaaacccaatcaaagtttgcaccattagggctttatgggaacaagtctgtaactagtgatgttttgcatagtcctctgatatacaggacataactcatggttaatgtcatcatgtggttatctatataatattgtcaccatatgccatcaagagatgagattgccattttctttccatgtactaaaagaataccagacaacttggctaaatacatatggacctccaccaaaaaatcagaacagctaagacaacttgagagaaagggcagggctcaatgagaaacctcagaattaccagttgactagtattccttatttattatatatgctccagctattccaataattccaaacacacataaattacatatatataaaaatatatatatatttaattgaataaacttgattgtataattttggcttagtttttagatacatcatgagttggtacacttacttcttcagtttataaatttttaaaatatgtaaaataggtgtaatgtgcccagtaatgagatagcttggaaaatctactagtaaaaataattattcttcattaactccctttataaattatattagattatgcttgaagaccttttcagtgctacgtgctaggatgaaatgatatataattgagaaaataataaaagacatcaaaacaatagctccaggtcttaaaatatgagatatttcaaagcatactaagtgattgcccatctctccttaattactaagttcaattcccgagaagtgagaaagcagaggcgtaatattgatgatcacctattgtgttctttctggctagtctgaagctctgcatttttattaaatttccacaataactaaaatagttaatcttgcccaaagccaatccagctgtttcaaagcaggaaggagcctaatgcagagttgcacagccacaacttgggggcatcctacccttcactgatgcctcccagagcctgctcctaatgaagagcccctgcctccactctcctcatcccattccagcactgatctggggtattcggtcttgcctcagctatgactgcctcaatacattcgcctctcaaggtggcatcaggggaaggagaataccagtgctgaaaagtgatactctgtctactgatgtctgctcagactctgaggagtaatcagggtccaaatcatataaaggtaaatgagagaaatacaatttcaaaattaaaagattcatacctactccaatcacaaaatattgctcttctatttctgttctatttctatataatttcacctaaccaaaattacttaaaaagtatattgatattaaagataacatgttttaagagaaaattaaacttcctatttaacttttaatagaaaatagaaaactttcacaaactgtactctccccaagtagaaaagtacgaatctcaacgctgagcaagagtataagactttccttgggcactcatggatgattttatctgctacgtctttgtgttttatacttctcttcattttttatgcgccaatcccaatttttactccagtaccctgttgtaattaataatcctttatattcaacttcccagttcaaattactgtgtggtttctatctcctgattgggacatgactgatacacacagtgaactgaatttgataaacagtgaatcgtatatagatacagatatactactgggagatttctcagatggtctcaagtatgttaatacatgtcacaaatttaatagaagaatatgttgtctacagagtttcgcaaacttgtatacagatacacacacacatatacgcaccatggcacaagattagtgctctgtggagcatatattgggacacagatgttcgaaactatagtatagcaaaattccacctggtagaatttttaagacaatgcatgtccatgggaaatagcagtataatttttgcaagtcaataattttctcttttgataagagaagctgtggaatgatgtttttgaatatgttcatgtccttaagtacccgagcgagaaaacacttgctcatgaatatccgtatgttgctactgcaggaagagtggagattcttgtggggagtggggaggataacttccccaagggatatagcagtatcttaaaatggggacataaaaaaattctcccattttagagattctatttcatattccctacttaataattccttattcagaaagtttagccattcccatcaatgcatatgacatccatggaaagttggaaacataatcagatttttgactctttgcagcttgagacagtatcattcaggaaaagaccttgcagaggtctctgctttcagaaatatatgacttaagtaataagtgtcagacactatcagagactggggctgtgacatgctgcaggacagggcgctggtaggagctattattaccttttatgtacattctccaaaatgttgttaagaaaatgtaattaccatggggaggctcatttatctaaattattctgggctaccaaagaaacttgacatgtaaacaatttagataaggagtttaataatctagcaataccaagtgtctgcaatctgtcacttggtgcactcttattcttcggtggaacagtctgttgtccttgaagtgctatttcagtggaatgtacattaggaagacaaacgtgactcagtatcaagatagtgagttttaataaagctaaaaaatgtacaaaacagattttcagctactaatatcaaagtagaactcagtggaattcagataattggcattcttcaatccagggaactcactgaaatggaaaatatataagatctacaggaaacttcagaaaataattttgaattatattggtatttgagttagaagtaaaaagtaaaacaatcaatgcaaactctttaataatttgagtcactatgttttgaccaatactgtgctgtgtgaaagaaatacaaataaagcacaagatacaattgctatctttaaacacttgactcaattggtagacaaaaattttttaaagtggttataaatataaatagattatttacataaggaaatgtatgataaaatttcaaaaatacaacagaattttcaaaagctacaatccaggtcttgaatgtacatttaactcgagatattttctatagaaattggcattcacccagaggagcaaagccaggctctaagatttttttttaacagctgagtatttgcagtaggtgagattcacataagaccaattgcctggagtggctctttctttatgaaatagaatgacttcgctcctataaataaagattagtgtaaagagagaccaataagtttcttatttcatgaaaaaatgttttcactcattcattgcctcaactgatatttgctgaatttcttctgtgttccaagtaccatgttaagtcctgagaaattcaacagtgagataacatccttttccttgaggagctcattgtccagcaggcaagcagatgactatagaataattgaaataaaatttgataagagccataatggggcaagtaccaagtgtgggagtgcagagaaaaagaagacactcatggtatgctagagccggcttctaattggcttgtgagagccaattgctaaattttcagaaattttgttaagctactcactgaacatagcaattattaaaaattaaattggatgaagttataattcaataaattaaatttaaaacaaagattacaaatacttaaaacttcattgcatcctaattattttactatggcataatagtatctgtacattttaccttattcagttctattgcatctatatgatggaaatgccaaataatggagtgctgctgtgcacctgttaccaactccgtgttcaatgacaccacattggcagcctaaaatttgccttagtgggaggatttgcactcaggagttcagcgaagcctccaaaataaagatttgtttttgtttttgtttttgttttctacgagagtctgttgttaaacacatagcatgccactgagaacatggaacctaggtccctatctactcttggtcagagaagacttcctggaagaagaggaagcaaagataagcaaaatctgtcacgcgaagaatggggactagcctgcataaacaaaaatccaaactagaaacacctttgaagttatcctaacctctactcttacgtcttccaaatgtgaccatttgctatcatatcatatctctaatgagagctcttcacctattttctagttttcactttcagagcctttatgggactgcatttttcagtcccctggaagccatgcatggccatgtgacttggttttgcaaagagaatgcaagaagaaaggaaatcagtcatttcaaggttaaagctgttagagacggcgtgtgacttagtgtgctcatttaaccttaatgtggtgactgtggaagctgtcagcctgagtccctgaatgcctttaatgagcagtctctcaactcctatttggattggttattatattgagtaagaaataaacttagattggtcatgtatactgagtgaaaggaaaccactgagattttgggggttactcatcactccagcatggcccagcccatctcaattcacctccctattaatttctcactagaaccactatactagccacctcccttcctatggctagtctcagcatccttccatctgtcctctgtactgtagagagataggtccctgtaatactcttctacttaaacatctttaaaatatcctcgtgacacacagaataaatctatacaatttagaacagtatattcaacaagtatttcatgatcttttcctcagatatttgtgtcccaaccacactgaactagtcactttctcaaacagttttcctggcaacagaatgcccacattttgaggctttatgctatcatcccattcctcgttttgacaaactcaaattcagacatcaaataccaattattatgtcacttcataagtgaagactcaagtcacatcagttacctcttccattatctgtatttttacgagcactttgctcacacttccatgacagcaagaatcctatgacattataaataattttatatatttcttatttagatttaactttctggaatctatttttgtatcccagggatttgacacacagtgttcattaaaagcttgcgctcaatgtatatgagtgactaatctttgatttactaaatatggtcagctagaacagaattttccttttggttttcttgactttgattttaattaagattgtatcttagactcctgctagagctctagaagaaagttctgagaatgatgttgtgcacatgtaccctagaacttaaagtataataataataaaaaaaagaaagtaagttctaatcatttcctccaatcctttcacttgagggacagaaaccaagacttacagatgttgggtgacctggtgcctatttagtgaccaagtcagaaataacgcctaaggtcttctcaccctcgggtgtagtcatttacctaccttcagtgtgatgtactaaaatgttatccttatgtgcaccaatcaaaatttaatgttctcatcattcacatcaaaccgtgcctgagaaatatagtcactgtttttctagtatttctcaatttatttccataggctatgttcacacatatattgctcttacctctcaaatactctttctgggtttttttttaatggcccaaaatatgtcatgaagtggacattcaatgaaaaggcaaaaatattaaggtaaatttcagaatttctgaaatggaggagactagaaaaatcatccagtgcaaactttctctttgacaaatttttaaaaatgagatactaaaatataacatcatttattaacggctacacagctgtcatgtggtcaaaacaagaatgcattcatatttctcaactcccaggccaggagccctcttccagcagaatgcaggattctcttttgccagtaaccatggccactattgccttacagcttaggtccctggttctgtggctgaaattaaataatacaagtgaaatcctttttatttaaatacaaatgtttaaaaataaaggaaaatactctgcggaacctaaaacctaagttaataaaaggcttaaaagtcagccgggcatggtggctcatgcctataatcctagcactttgggaggccaagatgagcagatcataaggtcaggagatcgagaccatcctggctaatatggtgaaaccctgtctctactaaaaacacacacacacaaaaaaaattagtggggcatggtggcacgcctgtagtcccagctactctgcaggctgaagcaggagaatcactggaacctgggaggtggagcttgcagtgagccaagatcttgccactgcactccagcctgggcgacagagcgagactccatctcaaaataaataaataaataaataaataaataaataaataaataaataataaataaaaggcttaaaagtcaaatctaatgaatttattaatattttaaaaggcatatacttgaaatctatttgtttttattcctctttatataatctacttgtaggatttcaaaagaaaatcccacagtaaaatgttcattcaaataaaacatgtgagacaaggaaatgcaagctgtttaaattaaatgaaatgacctgatcatccattcaaggcaactggaagagggattagagtaaagttctatatttagttacatgttcgaagtaaatgggaaattgctgacttaataacttaagcctaaacaaaaatgaatctcagtcttctaaaaagagtccctgaaacaaaacctttaattcctagaaagcatcacagtatgaatttcagaacattgctcagggcttgtgttacataaatgtttgataaattaagaatgtattttatgcttacatgtgtcctgcttttcacagtgtctctggtcaaattaatgtaagcttttaaaatgctgcctttaattctcatgtatctaattccatccattctttatggccagttaaatgcagtatacttgtcataacacctccaaatatcaaggtctatgcatttgtctggccatttcccctgtcttccccactttcttctcaatttccagcagcatgtatcacctaggtttcttatttgagttattattctgtagacaacggcataagatatatagacatacatgatgatctatcattaaacaaaaagggaagaagagtttggagaatagaaattgtggttattgaatgacattattataagacacaaatatcttgattcggctttcattaaaatcatagtgaaatcacaggcatgtatttcagttggaagcaattaaggagtgaaagaccgttgacccaattatcttagacaatacagagtgctggattggccactacattttgctgagaaaaggaaggaaaggtaaaaatgcatacatagacttattgtaaaattaggttaaacctgctcatcataaaagattgaatctccgaatttgttttctaaactgaggaaagagctttcctgtaatattttaatagttatcttccaaaaactgttgatgtattaccctaagaccatacaactgtgttataggaatatgcactaacatttgctctaaatgtagttaaatatatgttttaataagaataaagtatataattgcatttttaaataaaatataaaccctaaaagctatcttcaggatttgaaaattgaatctatgtttcaaaaaggatactttttaaagcttacagctctcagatggttctatctctttttttcttaaaacaatttaggcatgatattgacaaaaatcttgagaaaatgacgtttttcaaagaagtatcatgaaaacttatattgaaaattttcttactaaagatacatgacagtttctaattctttcaaatgaatttctatatcataaaataaccatttactttcaagaaataaatgaattacatatgctcagaaaactcccaatgctacccacaccactatgatataaggagaaagttatgcttgttaaaataagttatgtccaaaaatatttgtcaggttgtcttgaatagctcctttgaagtacatcctttatgtcaccgccaattttctgtttctctcattaaaatataactactattatgcaaaagaagaaaacaatgaataaataaaaatgctcaaacaaaagtatccaatggttggttcacaggaaaagcaaaatatggtatctacaaggaagcagaaatttctgatttaatttgccttcacattcagtcaaccattaaagcaattggttttaatctctgtatatgggcttagtccaaaagggtttcaaaatgtggatgatgctgcatatacttgagtaactacagccaagcaacttttcaaatactcaagaatatatgtatacacatgaatatatgtatacaaaagaatatatgtatacacatgaatacctacataagaaaatatatgtatatatgtattgacacatgcatatatacatagacatgcacaaacatacacatatacagttatggttttcaatacttaaatatttatatatgcacagtaaacaagtataaaaatgattgtattctatagaagaaacacttgaagtcctgaaactaaagtattttcaaagacctaccctttctcccttcattcattctttcttttctcccttccttccctcttttcattcctttcttccctgtcatcctccctccatttttctatcaatttattccttctttccataaataattattaatcatatcacatgtgccaggaactgatatatatagaatattcagtggtaagcaatcagagaaggagccccccttcatagagctttaattgtgctgggtgtaaatccattgaaaaaaatgaaaatcatagcatttcaaatctgacagacttacattcaaatcataataacatcacttatttcacttatttgggaaataactttgctaagtttccatttgttcaaaaggaaagtggcaataattttaattccaccatttatcttgagaattaaataaaatcatgaatgaaaaaatctgatggagaatctgggacttagcaggtgttcaataaatgctacatagctactctacccatatacatttaacattaaattgcagttaaatcttagtttcaatgtcacaggttcacagatggtcaagaaaagaaaatatgctcagggtattacattgccctaaagcaaacattttactcagaaaatgtgctgaataaacactggttgaaaatatgttggtgttaccaaaaagagggagagaaaaaaaaattcagaggcaatgacacagggacttggagagacagtgtggaaaaataagcccatggtgggcttattttaataaatacagcagattaaaaggtgactggttcctcctttcttgttcatataagaggcaccattttgtaatgctggcttatagcatttccaaacccaattttattttttccatttttatgaaggaggtgttttcatttactgggaaaagagctagggcaagtaggcctccagccatggcaggtaatattctaggtttctatgaaataagttggtgcatgaaaagatagataaactcgagaaggaagtaggtctgcagggaactcaaatagcaccgtggaaacaactaacagaatggacgttctcaccaggaaatgatctgacctctatgaggacactgcatattccagaaatccaaggcatgtcctgctccatcttttatctgcttctattccccaaggaagcttttatctctgggatgggctggatgattctaaatgagatttgaaaacaatgaactccagtggaacccagcatcatctatactttaagcctcaccactacttgctataaaattccagaaactggctgaatccagtagtcttagttttaaaaaggcaattttatgaaaacaataaagcaaagacagaagcgtatttatagtgagagggagagcacttttgaaacactgggatttaaagtgtaaaatcaactcctaactgttgatatcaatgtaactgaaaaatacactaggccgggcgtggtggctcatgcctgtaatcccagcacttcgggaagccaaggcaggcagatcacaaggtcaggagttcgagaccagcctggccaacatagtgaaaccccatttctactaaaaatacaaaaattagctgggcatggtgacgcacgcctgcagtcccagctactcgggaggataaggcaggagaattgcttgaaccctggagtcagaggttgtggtgagctgaaattgcaccactgcactccagcctaggcaacagagcgagactccatctcaaaataaacaaacaaacaaacaaaaacaaacaaaaaatactagaaaaaatgtttcttctccataaataaaaaactcaagtaccaaattgaaacagcgttattgtacctaatgaaaagggtactgaataaaagtcagatttctgtacagagctatgcgaaaatgacacttccaatgtttttgttgtccaaccatgcattacatagagagagggtccccaaaactaataggatcccttactgagaaagtctcctttgcagatggatgtgttaaatagtctgggcttattgtccctaagtattaaaataagcaattatttccaatcagacaggttctatattttccaagcaaccttcctgattgcgatttagctccctacatggattttccattgtgattaaaggagacctctgattcactttacaatcatatttctcattgcaaagtagaaagctggcattttacttcacgttcctcagtcttttatgagttttctaagtatgaatcagcatttcaagttccaattacttgtgacaatgaaaagatggagttactaaaacatgtgagatttagggccaaccagatgtactggtaaatttggtcaagttaatggtatgtatatgcaaatcattcctcaaagcatggcagacatagagaaatacaacaagacttagtctcacttctcaaggagtttccaaaccagatgaggaggtaagttatatgtacatgggaaaatagaaaaagacatgaaggcagtttgaggcccagcagaatagggagatttataagatacataaatatattaagagcatacacatacacctacaatgaaaagattagaaggatatctcggggtagtgggatagatatgcctttattgcatttatattttctataatacacacgcatttgcttttataataaaaacacttaaaatgttatctgtagagtgtaataggctaccataggctggagcagaaatatctacattcggatttaccgtggatctgtagagatataatcagtggtcaccaagattaagttaccatcaaaaatacttctattagtttcctattgctactgtaatgaattatcacaaacttggtgggttggtttaaaacagcctaaacttattttctcacaggtctggagttcagaagtacaaaatcggtctaattgggataaaatcaaggtgttggcagggttgcattccttctggagggttcggagaaaatctgacttcttgcttttcccagcctctagaggccacccacattccttggctcatggcccctgttcatcctcaaaaccagcaatgtctggtatagtcttcatcacactatgtcactgggacattgacacttttgtctcttttttttttttttaacttatagagaatcttgtgattacatcaggctcacccaggaagtatggagaaatgatcaaggatccataacttaattacatcttcaaaatcttttaccatgtacagtaatatattcataggatccaggaattaggacatgggcatttttgtaagtagattattttaaataccaaaataatatttaagaaataaacacattccttgacacaattccttttttttgtagggggaggggggagatgcatactttctctttttctccatatatcacttttaaaaatattataattcaacttgagtggtctaagaaaatcagcaatatcaaatttgtaactcaccaccaagataacaagagagaagatgcaaaggttattttctgcaaattacacagctttcttcttagctataggagcatcctagatgagaaattatgctcttcatccatagttaatggaattttgaaaatgggaggaggcattgccatgggacttgatgttataaagtaatgctttgcctgattactccagaggctagatctgctaaagctacagcagaagtaaatccacggaacagaaaatctagattataaccttcctgacaatcaaatattggagaagaattctaccaagctcaactgctatttaatgagctactactgcaatgtcaaatgatgtaaggttaaggactggcttttctaataaacattttgcagacctattaatattgaagttgttgttatctcctcataaatctaaccatgaccacaatctatacagtgaggacttggtctttgctcatgattcaccctctgcctacaaccccttggtgaatatttgcacaacttccaaaacttagcaaagtcaccctcttgcccttccagtgaagtcctttgtctctgtattactcactctcatctcaaataacattgacccctgcctccctggaattccactggacatacttacaacttttgtgacctttgtctttgcatggtctacatccccacattaatatccagaggtgagaattggtttgacttatttcaaccattttaaagataaccataaggccaggaaaaagtttacagtctgatagagctatcccacttgctcaaatatttaaatgcttcaatgaacacctgcttccctgagctttctcctgggactctcaacccagcaactaaagtggtgatgcctgggccatccaggagcctctgggaccctgctatagaaccacagccaaggtcacttctaattggtcagtgtccaggctccacaaacttgactgcattcccaaactgcaggacagtaactggcttataatgggcactcagtaaatatctgttgaatgaatgcatcttatcaacataccttgtaagtcaatatattttgctacaaaaaaactaaaaacaaaacacgttcctcacaatttcacagaaggtcattcaaatctttatttaaagtagtttgcaaactatattttctactattttgcaccgacctaccgtggttcaacttgggagacattccagaatggctagataattttatctcacaagtgaaaacagttttatgttttaaaaagaacactaccagcaaagaaacaaaaaacagtgccttgcagagatggcatttttgattgacccaacagcaaaactaaattaaataagcatagagctatggaaaagacagacatgtctaaataggttctagaaagatctcccaagaaataaagtagaaatctttgataaaaagttccacaaaggaagactttaagcattttaagcagaagaatcacaagtgaaaacaagaaaaaacagaggaaaatgttgctttcatcttgcaagacaagtgtccttcacttgaaataagattaccgtagaatttcaaagacgtttagcagatttcagaaagtagtagctactctttatctttaggttctttgccttaataactgtgatatttatgaaatagaagatttgttttaagtgaggttattgttccatttagacaatgaacattttcaaaagaatgtaatagccatagaaaatatcttacatgagacagttcagggcataaaaatcttaaattaaagaaagctttactctgtaaatttaaaattcacctacttttgtgagtctgtactctcaaacttggaaaatagttatattatacaggtccacatcaaaccacagaaacacaaaaattaaactgacaatgtatcaaaactcttgaggaaaaaggactttctaagctttgaagtactatgaaaacaaaagcacacaggaaaagatgaataattgtggaacgatagtaaacatatacatgctttatgctaaaaaaataagaaaatattcaaaagacaaataaccactttgcaacaaatgtaagaagcaaacaataagtatgtttaatataacaagagcatgtatagattactaagaaaagccataagaccctaataaataaataggtaaaaaacagtgtttttgtttgctatgatgccataacaaaatacaacagactgaggggcttacacaatagaaatatattttctcgcagatctggaggctagatgtcctagattaagatattagcgggtttggtttcttcagaggcctctctccttggtttgcaaatggccacattcttgctctgtccccacatagctgtcctcagtctttgtgttgtctgtgtcctaatttcctcctcttataggacaccagtcatattggattagggcccatccatagaacctcattttatcttaattacttacttaaagccctatcttcaaatatagtatcatgctgaggtttaggtgttcaacatatgtattgaggtgggaagcacaatttatcccataacaaaccataaacaattcaaaacagaaatgtctgaaacaggcacataaaaatattacatttgctaataagtaaaggaatgctaattgaaggtaaaatatcattatatttttcattttcaaactagtaagacttgaaagtcttttaaaagcattttaatcctggcaaggtttcagttcaatgagaactttgaatgctattggcaggagtgtaatctgacaaaccattttgggaaggaaactttcaatattaatcaagattataaaaaatattatactcagtataggtcaatataatcaagaaaaaataaaaaaaaaagcacatttagatatgagcatattaacttctaggaagatatctttactaaaatattatctgagtcttattcataataccaaaaaaaaaattgaaccaatctaagggctcacaatggagaaactctaatgtaaactcaacacttcataagctgttatgcagacattaaaacggtgtgagtaataactatcaaaaacataaaatagttacaattttgttttataaaatgcagtatgcaaagctatatattaaaaagattcacagaataaaaggagcaggaaatatacccacagtcatttctttaagataacacaattgtttgttgttatttgtttctatttactggtattgcagttttaaaatttccaaaaagcaatatgcattcgtgtttataataaaaacataatcatttcaacttgagttaaattggattgaatatgccaaaatttagtttcaattctattaagcgtagctcaacaggtcagcttcttactttaatgctttgctttcactctgccacatggtttttaaccaacttttatgttgacataagtgataccttcactcaacacccatttcaaacccaacccatttatgccccagaaataaaaacagatcactctatgggaaaagatggagatccctatcataagaacttgagaatccttagcaggtcaagttcccctttcaggaaaccctggtaagatcattctctgttcagcttttctacctgagatcatccactttatctgctgaaaggtcagaggcatgcgttctgtagacgcctcaataacatgagacactacctttctgctgcctttctctgtgactgtgagagaaatatacagcaaggtgtggcaagttctaacacaagcatctcaactcttagttcagtgcaggttatagagtactgtgccagaagaacctgtgaaatattgtattttactttttggtaaaataccaagattcaaagtacactcaatcttggagtttgtgaggagctccaaattgtaaactttgagcaactgattgccaatcaaaactacaggactcaaactatgttcattaatttgatggatcttaattgggactcttattttcctactagactagaaaggagaaacataattgtaaagagttgcatagtgtctcaccaaaactcacacccacctggaatctcagaatgtaaccgtatttggaaatgtggtctttccaaatataactaaggtaaagatcaaggtgaactcatactggattagggtaggctctaaatgcaatgaaagtgtttttacaagacgcaaaaaaggacacacagagaagaagccatgtggagtcagaggctaaggtgagagcaaggctgccacaagccaaggaacatcaggagccaccagaagctggaagaggaaggaaagattctttagagtcttcagagagaccctgaccctgctgactcttgactttggatgtctaatctggagaactgtgagagcataaatttctgttgttttaagtaacctagtttgtgatgatttgttatgacagccctgggaaattaatacaatgctatatgaagacaatgatgccacatttcacaaaactgtccctttatattgaggcagaagggtgtggtggaaacagcaccaaaagagcagagtcaaagggttgggtattggctccatgctacaactttccactaggcaaaacagagcctctccaaatagctgcttgtgatagacatgattatctcaattgcataggattgttaacaagacaaaggaaatggtatacctaataagcatttgataaggtgtagacagaaatcctgattttgttgttattgtcagtggtttagagtaaatgccaattttgcactaaatatctatttaggaaatatgaaaacagaccaaaaaatatttacacaacaagtacatatgtggtttacctttcagttctttattataggagctttcttgcctaaagggtgggtttatatcatgaagaccgaatttataccctgttgtgaatcatttatcacacaggtgaattattagggatgttttggaaggggtgtaatctgaggctgttatttttaggattgttgtactgtcattaataatcatctcttgtacttgtagtcatctgaactggcaaagaaaagaaatagatagcccggatcatggtaaggcagctttttagtgtttctgattgaaaaaaataaaaagttagggacaaagaatcctgtcactaatgtccagttcctgggttttgatggcattcaccatccaatttgagaaaaatggtagatgggtggcatcaaaggcaagaaaactgactgctgttatgtaagtaataaccacagtacaatactgcttttataacattccaggctgtaataactactagaataaattactcaattcttaaagtaacagcttaggtgtaccattcagaatattaaatgtataactcttgattgtgaatccccttattcaataaaaatataatgtggcaaattgtttcaagcattatttctaagaattgatgttatccaaacatgtcttcaaaattaaatagaagaagggttgaaggcttctggtgttcatgctttcctccctattagagcagaaggcaagtctccaagctcattctcaatggaaaattgatgccaaacctaaggtgttgttgtgaacaaaactcactgcagcaaacaatttctccaaagctcaactccctaggagcattttgtcaatgttgggtaattagtttccacgatgatcgctgtctttcagtgggtctacctagacggttacattgttctccagtcttcttttgtgttccaatgaaggaccaatgtggcaagtgccaattcctcactgctttgccctctccccacttgacaccattcccagacatgcagatagtggtgatggtggaaaaatattcaccgccctaggaatttctctctaaccccattcataagttcatatccccacccaatcctggatgagtcattgcaatattcagctaatgagacccgtcattcttggacctgtgcttaccctacatccacatctcccatcactgccctccacatgtgctatactgccgtcacactgagggtcagggccctttcactcttccacatctttgggtagaaagaacagcagggcatgcctgtttggagcacacatgccggagatccttgcctaaacaccctcatgctgagttccttgctcttctctttgcttctttttactatgtctcatcactatatattccatacttagagtctaagttacttaattccaggctgaggctggagctatacagtagttaccacttatctgcaattttgctttccgtggttccagttaccagctgtcaatggtggtctgaaaatattaaatagaaaattccagaaataaaccatttgtaagttttatatcacacgcccttcagagtggaatgatgaaatcttgtgcccatcctcctccctctctccagggatatgaatcctccttttgtcctgggtttccacattgtagacgctgcctgcccatgaatcactttgtagccactggtgatcagatctactgtctcagtattacagggcttatgttcaagaaaccctttattttatttagcagtggcccaaagcacaagagtagtgatgctggcatttcaaacatgccaaaaagaagctgtaaaatgcttccttaaagtgaaaaggtaaaagttctaaacttaataaagaacacaaaaacttatgctgaggtagctaaagtctacggtaagaacacatcttctatccacgaaactggagtgacaccagcatttccagttccctcaaatatgcctccgcagctctaggtctgatgctaggttgggaatgagggtgtagtgattgagcttgatgatggtttgactaacaagtaaatgaaacatgaacatcctttgaggaaagtggctaattataaacatattttgaaaacaagtgctaccatttattcagcatttactaggaccaagaattaagtagtttttatatatatcatcctaatctaattctaggcacctgtaagttcaaaccatgtgattgccctgagaagactaataatctattgcccttacaaactgtattttccaggtgctcaacagttatttcgcggagaagctgtgggctggagaatgggaaggtggagaaggtaggctactaatgtgagcattccatttctcctacatggcttcaaacaattcagccctggccccaaacacacaactccattaggcaacataaaagccctacagttaagtgggtttgccgcacctcctagctagataagactgcaatcatctatatttacttaagactgtccatttgtaggaagtagggggtcctactgtaggacgtagggggtgtcttgattatttaggccttgcaaaaaatgaattgagcctgatctcatggaaattctacagaggtaggtagggaagaggagactgggtgaagacatctggaggaagctctcagccaaatccaaagaccaaacatcccctttctcaaacaaatcaatgacttgaataaaaaggaggcagagctagtgttacacatttaaagagacttggaaaacataacagcaaataccatataaagactttgtttggattgtatgcaaacaaacacacaattaaaaaacttcttgagacaattgaggcaatgcaaatatggatatatgaactgaatcttaaattgcattaaaggattattattaattgtgttaggtgttatgacatggtgtttatgtatatacacattcttatcatttggacatgtatattcaagaatctgcaggagaaaagcattatgtctaatattcattttaaaatatgacctcctcaaataaattaatggatggaacaagatttgaaaattgctgacaattgttgaagctaggtaaagggtgcataagctctattgtactattcagtttcttttgtttgcgtttgaaattttcataataacaagctttacaaaaagcaaatgcattgattctttttatctcaaaaagagacatttgtgcctgccaggtaatgtgtccaagttttagaaatgtaactggaatgctcagatcaatttacatttatatgaaatcacaactgggttgaacacaggtagagaaaaggcaagcagagccaagaagaaaaggcttagggaggatgagtattaaaacaacatctgatggaacaatcaataattatgtgcatagccacaatatgaaagaagtgaatgaactccaaggaaaagaagttcaaataaaaaggtagcaaaactaatagaaactgtctttctactgttctgcaggtggtataaacaccctcctccttcaagacgcatcaaaagttatagatcagcgctgccttttccagctccccaaggctgttagctgctctctcatatgagattccacaaagctttgttcatacttttctgtttttctccactttataagggaagagatgttgactagcacctgccttggaaggtgatatatgtatacgcttaagaaatagtggaaggaatggatgcatggtctatttgtccattttcacactgctataaagaaatatcagagactgggtaatttataaaagaaaaaggtttaattgactcacatttctgcatggctgaggggggcgcctcaggaaacttacaatcatggtgaaaggcaaagggcaagcaagcttgtaccttctcacatgtcagtaggaaagagagagtgagcaagcaaagggggaagagccccttgtaaaaccatcagatctcatgagagctcacttcactaccaggagaacagcatggggcacactacccccgtaatccaaccacctcccaccaggtctctccctcaacacctggggattccaattccagatgagattttggtgggaacacaaagcctaaccatatcacatgggtactagaggaagaaaaaaaagggagggatggaagacaaagaaaaattctattctttcctgggaagaaaaattctgaggtcagagggttgggactgatatttaagaaagacttcctgtaaataatcccaaaccaagtagaatcagatgctgcctttctttaggagcctgctactaggattttgttttgttttgttatagctaggctaaatcccacccattctcttttgtgcaagcaattcaccaaatatgccaggctggagacagttgagattttttatctcttgctgagaaaagaaatttttcattgagctatcacatgcacagttatttttatttgactctcagttgagatacccctgctgcatagcatattgaatactttattgaccataaaatgtgctgctgcaattagagggtttttttttatctttttttccaagcattgtgcctttctgggggcacttggaagctcatttctgtttatcagtttttcaaggatgtttgcaatttagcaacagtgaattggaagttcagttaaatatctggcatgtttgagtgagtgtttccaagatctgcaattaagcagggcagggtaaagtgtagtgaggctcctcatgcataatctgcaaaggtttttcacactatctgaggtcttagagaaaaaaaatgttcactaagtaaatcaggagcaaattcacttaagagactgctttgtaaatcattcagctttgtcaggcaatctctgggtgcactaagtgctggctatctttgggctattttagaggccatcacctctattgggtatcaccaagtaaaacagcacagacctcatggaagataccatgtttaaatagcatgagttttcagatctcatgcctcaggcagagtttggaaccaggagctgaggacactattagttgaatgaatgaataaaagaaaagagaattcttcctggtctctaaaaaaatatgccctaggttacttccagtaagccaacagcaaatcagaatggaatgtgtgagttgcagcaggactggcagctcatgcaggttaaatgtcctgttgtgcatttccctccatgtaccctcactgggttagtagggaagcccggactcgtcttcgaatctcaagccatgacctgtgctatttctgtagatttcatagctgctgtcaagaaaactttttattgaagcatcatgccttttgtgaaactatagtcaagcccatgcccaaaagccatctaggtctagacctctgatgacattctgatgaggtggagcaggtgactgctaccgtggagattcctgttccactctcagcttcttctctccatctactgaccccctcctcctactatccccaccaggaaatagacagactccaagagctacagcttagttgtactgagaacctaacaggcattgtgcatgcttgtgatgcaccaacgaatgagacagaagtgtgccctccttagggagctcgaattctagtgatttaaaataagcctgcagtaagggctcgcatctctccacagcagccatcttacaaagcattgtaccttcaatttggttttctgtgtcgtttttttcttaattcgctcaataaaatttatttcaggtttctgctcaactgtcactttacaatggaaagttctccttctaaaaaatatccatctccaactaccaccactccacacccacctctctctaccttgctttatttgtctatacagcccttaccactaccggaccaagcttatttatttattagtttttctgtgtgtttttccttgctagaatataaagtgtttcagggcagccaacttggttaattcattgctgagtatctggcttattataggagatgaatacatatttgttgaattaattaatgcataaataaccataagcaataggtatgaccattattcctgtttttcaaatgggaaattcacacttaaggaggataagaaatttgcctaaagtcacccaatacataagcagtgaaactagggctcagaccaggtcttctggagcagaaagcctggcctcttgatcattactctaaattgtcccacttcaaataatcatttctttaacatgtctaatagtagaagcttccctaaactgtcaactctaggatgggatgaagacactgaatagaagaaatgccactaaacaacatataaagataaaaatacaaaactacaaacgtaattctgaaaaacttcagaataaaatttaggacagttttatcttgtgcagagttaacataaaaatatgtgcttttgggccgggcacagtggctcatatctgtaatccagcatttttggaggccgaggtgggcggatcacctgaggtcaggagttcaagaccaccctggccaacatggagaaaccctgtctctactaaaaatacaaaaattagccaggcatggtcatgtgtgcctgtaatcccagctactcgggaggctgaggcaggagaattgcttgcttgaatcccagaggcagaggtagcagatggcgccacttcactccagtggagacagagcaagacaccgtctcaaaaagaaatagaaagaaagaacatggaaagaataaaagctttagagtcgagcatggataggctgtctctgccagtagttattcattcaccttctcaacctcaactttcatatctataaggtagggctgaggcctacccaccaaggtggttggcagaaggaaattagataataaatgtaacgtttctggcaaaactttaagttaaatgaatgactcatttagttacttactctaataagtcctaagcaaatggacaaataaaattaggtttcagttatgcatctattaatgcctaaaaacagcagcgctgcacatcacaaaggaacaggcagacttacccccggggcaactgaaactgaaggacaaggggctagtgacagtcaggaacaatggtccctaatcccagggaagatgtattaaatgtgtttacttgctgttgctcataccaatcaattgatcaggctgtggaaggaggtatagtggcacccatacatttatttagacataactaatggacttcccaagcatggatagagaagccacttaactggtcaaatatctggaagaaaaaaaacctgtagttaatcaaatatctttaataaaagtattggtaacattctgcccatattcatcaaacacttggtattaatattgttttcaaaaaaaagtgactgatgttctagctcagatgtggtcttacatatttagtttgtcacaatttctatagttgctgatagggcagtaatgatcttttcttgtgttatggttgtattgatataataaattgcattttcccttagattttattagaaactataaatggctctatcacctctgaaacaacataagtcacgcaacacatttttaattttatcagcccaactccttttttagaatcagaatatttgcttgaaaactgaaaagttttagtctccctaaagaaatatcaactgatactttatagctaaaaacatggatttttatttctctttttctttcccaattcctaaagaaatgcagatacatttctccttgttctatttggccagtttagatctttagatggttttagtcttcgtatgtttgtttacgtgctggttttaaaatagttgaagtattataagaaatatctgttggccgggcacagtggcttacgcctgtaatcccaccactttgggaggctgaggcgggcaggtcacgaggtcatgagacagagtccagcctggccaacatgatgaaaccccatgtctactaaaaatacaaaaattatccgggtatggtggtgtgtgcctgtaatctcagctactctggaggctgaggtacgagaattgcttgaacccaggaggcggaggttgcagtgagccaagattgcaccactgcactccagcctggcgacagagcaagactctgtctcaaaaaaaaaaaaaaaaagagagagagagagaaatatctatcaactgcagcctctctctttctcagatggaagaagtccaaatgtatattagcttagtaactatgtaaccactttaaaaggggcacaaatctaccttgatatctctgaattacttctgaaattatttatcctgaaagaaaaatcaatgaacactcctgaaatttgccacttgtcatttcatgatattgaaaagcaaatgtaaaactcgcttttagagaaaataggccaggcgcagtggctcacgcctgtaatcccagcactttgggaagctgaggtaggcagatctcttgaggacagaagttcaagaccagcctggccatgatgtgaaatccctatctccactaaaaatacaaaaattagccaggtgtggtagcaggcacctgtaatcacagctacttgggaggctgaggcagcagaatcgcttgaacctgggaggtggaggttgcagtgagctgagatccagccagccactgcactccagcctgagcaacagagtcctgtctcaaaaaaagaaagaaagaaagaaagaaagaaagaaagaaagaaagaaagaaagaaagaaagaaagaaagaaagaaggaaggaaggaaggaaggaaggaaggaaggaaagaaagaaagaaagaaagaaagaaagaaagaaagaaagaaagaaagaaaagaaaagaaaagaaaagaaaagaaaagaaaagaaaagagaaaagaaaagaaaagagaaaagaaagaaagaaactatcataaaatcattcaggatacctctttgtgtgggttagatctctgacaacagagaacgtaagctcacatgtgggtttggactaaataatgatcaagtatctatgttcagatattatctgtcccaagagagcacttagcaaaagaatcacaatatttatcatgatgtaatgcctcctctctatatgcaatttgaaaatgctggttaggaaatacatggctgagaatgctatttttcttttttagagacgtcttcaccatttattacagattgagccagagacttggaatcaacagtcctgagtttatattctggctttaccaatttctagcaacaaaaatatcatttatttgaacttccttttttgcccttgtaaagtagaactggtgatgcctgccacccaatctatgaccccattcaataagtgttcattgaatttaaatcttgtctacaaagttagcgatgaagccacataaatgacgtcttgggaaaatcaaccaatgaaaagatagaactgttcagaactttttgtagccacaggtgagctgagtattgggtgtaagagtatagtccatgcagatgaaaagacatgcgttggtgtgtgactcctaactactaggtttgtgtccttatgcaagtaatttgaccttagtatgccttatttttcacatctgcaaaatgggtatgacaataagaccaactccctaattttactgtaagaaataaatttagaaaatgcatacttactgcaaagaaaggaacacaggaaaccagtcaataaaaattgttgctattgatatttataataaaaacaataagcgaaatcattcattcaattaaagttttggggtgcaatttgtgtcctatatactgttctaggtactggggatacagaggtgaataaaaccaacaacctctctgttctcatgaaactatgtctggtaaagaatagacaaggcaatgtcaatgctctgaagacaataaaacaaaataatgtgaatagagtaactgaagatgtgtgtatggttttgtgggagagtgcatgtttggaaagtgccttaaaaacagggtgacccccacatgtctctttgaggaagtaaggtttgagcttcgacctgcaccctgtgcagactttctgcaggactttggcacatgcttactcaagatgcattttcacttcctgcaatccatcatttctctaaacccatgtaataaatgggattcagattttaataggcatactttgttctttgtaacaaaagggacatccacagttgcataagtggtgaatccatcttggtctttggaattagagattcccagccataagacttattgggtgggtgatagtggactcattatctaggcaccctaagccttacttatcccatctgtaaaacagccatgaaacaaagccatatatgggctgcttctgccagagtctgtgatgcagaagagaacctccaaatggtaattattgtcactatcagcagtagagaaatatcctggttaaaacctccactgcccacttgcaatgtgaccttgggtaagatgtgtgacttctctgagcctcagtgtactaatgtgtaagataaggataataataacaataataataataataatacctacttatcaagtttgtgtgagaaattaactgagttgtagaaaccactttgaatgggttctggcaaagagcaaactcaataagtgctccttgttagtattactcatgacattgacatcatgaattactactcacaggctcatagaccactgtgagagaaaagatcattgacttagaaatatgttgaactaagctgttcccatgaaaatcttccctaatagaacaattatgtgaaccattttttatcttctggagattttaatatattgattaaatgtgtcaacacagtgatatgatcagtgaataggaacacttgctttgtataattttgcccattttgattgctcttttaatttatgcatttcttaaaattgagttcaattatcaccacatgcctcttcaatcaacattggctgcatttcatgtgtccttaacaaatcacaaaagtaatttgaacttattgccaagtgaaaaagaaatgaacatcttcaactgaatattcttggttttaccatatagcaggacatagaaatctttgtagtcaaagaatcctagaacctaagaacagtaatcatgctacttttcatagacatcagaaattgatcaggacattttttattctttaactgaccctgaatatgtctttgaccctgagatctgggaagtcatttctatactgaggtgtggaagaggagacctattaacctggtatcagcttctcaattccgacctgacttcagggcagtctgaagtcttcataaatttattttgctgaggtcacacagcagtagacctggaatgacaacctacgttccaaaattctcatggccattatcttgccacctgtccttgtaaactgctattaaattcctgtctaaacatggctgtggatacaggaggaacggaattataacacaagtcaaagtcctcatttttcacctctgcttgaatttaatatactgctcctttagatttctgctctcaatgtctttgctcttctttctattttcattgacataaatattctgttatagctaactgataaagaaagaactacaggtctccaactactctattcagctgctctcatattcaagaacagcatcctacaaatagaaatattgaatataaatatgaacaatgatgttctcacccataatgttgccgtgcagctcaattactcatggttttctttgctgaaaacttatctcccttgctactccttcccctcaaagcttcctttcttaacatttaacttccagagcctaaacttaactaagctcaggtactagaatctagtggttccatgaatgactgcaaatcttgagtgctctgctgatgctaataataaagcatgtcagcacaagaaaaaccctggtaataaccatgccaagaaaatgagggaaaacgcccaatcccacgcctacaaattcatgctgctaattattaacaatgaaaaacttggcttaaattcaaccttcaattagatacatgttcatgtttttattaaagtaaaattctaaatttgttcaataaaacaggcaaattatgggttttagagactgactttattaaaatatttgtgttctattggcagcatggcaatgtgaaatgcagaattcggaaccccagggcctgacttctaggccttttctgaatcaatctgaatacacaagtagctccatggctgttttctcctctgtaaatcaagtacataatcaattacagaggattagaaatcctctctaaatttctgtcaagtattaaaaagctaaaattttaaatatttctattatttatagctttgcaaagcaaacaaattgcttaagggtagccacagaatggtcatggatgccatttccactattttccatccacactcccaatgcattctatagcaagaccagcatggaatgaccaaaacatatcttaataagctaagtgtattcatttaacagatattcattcaccaactactacatggcaggcactgttctaggtgcttatgagtctgatattttgctcatatgagaaagaacttataaatctcataaaattaaataacgttttgcacttgtaaaaactgactataagaataggttgaaaggagagtgtgtacctctcctttaattatgtactttattaagaacatcctctaataattttttgagagatgagtctcactctgttgcccaggctggagtgctgtagcatgatcataactcactatagcctcaaactcctgagttcaagtgatccacctgccacagcttctcaagtagctggtactacaagacctatctataaccttttcaacaatataacttctaaattgaaccctggtggttactaaggtgtgatagacagtccttctttgtgtacttttttgtaaatgcccatctgaggcctgtttgatgaagaaattcaaataatctaaaatttggagaaaaaataatgaattatttgtaattattcaaaatttgattaaatctataaggccagtagcagagaaaaataacatattcactcagttgaacactatacagacattacaatgacctctctctcttttttttacaaccatcttataactaaatttaaaacatacaattcttatgttcacataaaaataattaaaatgcaatatataatattaacataaatttgtaaaacaagtacaaaaaagcaaaaaaaaactctcaaaataaatataccacaatattaaaagtgtttcttataacaaaattaatttttaattatttcttccatatttattttttccaaatttactcctatagaggaagagaggggaaaattgtattgtttaacaacattaaaaaaaaattccttactttgcaaattgcaaatgacctaaatgtctaaatggctaaatgatgcggaacaggaagtcctagttatacacacaactcaacacttccatgatgggataattatgataacatccaaggtggctatacaaatatcatgatttgagaaaaatatttaatgaaataattttaaatgtgaaaaatcatattataaatcactatacactatattatcatataatccccaatatgactagtggaaatattacaatgacactttctaacaaaaatataatatgtgccacatatgtaattttatttttctagtagccacattttaaaaagtaatatgtgccacatatataattttatttttcaattagccacattttataaagtaaaaagaaacaggtgaaattaaatttaataatatattcaactcaatatattcaaaatattatttcaacatgcaatcaacataaaaaattattcatgatctacttcacattattattttaccacacatcccaatttggaccagttacatttcaggtgctcgttagccatatgtggcttgtgactaccctaaaggacagcattgcattgaaatgaaacaaagaagattagaaattgttgtcttttctcattatgtttttcccatttcttatgtgcaagtttccttattttatattttccccattgcctagtacactgctaggctcaataaatctgggctgcctttaacttataaaatactaacaaaattaattttgagcagaactggttgctgttagttagacgaatctcaggaaaaaagccaagggtactgttcctcatctgcaaacataaaacaaaccagcaaggacaccactcttattttattctttagtgttaaagccaaccatcataaccaaagatggcatctacaagacaacatttaaacactttaccagcgtcattagtgggctgggtcaacgagactcttccacgagtcatcaaaaccatcttccagtcatgactcttctttatctgaataaatgttcacatgaagaatgtgtatatataagtgtgagaaaggaaaggagaatcccagaagattgggaggggggtgtaggtggatggaattggagggaaggactcacatgatgatctgacaggtgctcccacttccgaagtctccctctgggaccactgggtgtaagtcttcttgtcaaggacagcacttggtacacagcgaatgctcaataaccgcttctagattgaatggacatatgcacagtttgcctaatttcctcgtcaggacactcaggaatgcattcctaacaacgagcacaggttcaccagacaataattccttcactgtggttgaattcacacaaacaaaatgtgaagaacattgcccagattatcattttaaatatagctgcagtctgcgtgtcataagaaacaaagcccacggctgtgcattcctctaacacaataggcacatgccatccggtgcttattacacacaaggtgctggtgattatggttatatacatagagacaaaacgggcaactagcttagcctagttataactaacaaatacacttggctttatctctttccataatgaaggtttaatcattcctttctttttcttttactgaataaaaagaactggatagaattttgaacatgattctactggctaataaaaacaacaatgtcttcagaagtgtggagaaaagccttagctagtattaaagggtaaatgtgccattctagagtgtcttctgagagccagggcattagctggcaatggtaggtatataatagcttgggtctgtcccctgagctggttaaccttgagcaagttatttctcttttctgaatctcaactttctcagcaaaaggaaataaagaaaacccagcacagttattctgaggattaaataacataagtagaatgcttcttccactgtatatgctaaatttttcatttcagtcttgttatatacatcttcctttttgttgaaaaatgaatgtgacaaaagcaagaaaaacaatcactgatttatctgaaattgtaaaaattctcaggtttgcttgttatgctttgaaaaaggaaccctcagccaacacacagaatttggaagcagcctgggagttttaataggtttgctaggaaatgggtttcagtgccaggaactccagatcacaagaaaatttatgcaattagatcatttggtctaaatgtgattatgtattttagtaatgaacagtatggtaaagccagaacaatagaaggaaagcagtaagaagaaattcaatttagtatagaagcttcagagacctgcagaaagggaaatcatatatgcatgataagcaggcattttccataatggctggagataacaagtaaatgatttcagacaattgcgtggaggatacagagggtacagactggcaattctcagaatgtggccataacaccagccagggagacaaactttgaagttcagaacagaaaaggtaaagatgttagaggtggtagtactgagtcagtgccaattaatgtgcaaagtttgcaactcagaagagaaataagaaaagtccaaccagaaagttcataaatgagctagttcaacttggagagaaagtggaagaagagtgagccttgggctatatcatgacactggggcatttgttttcaatgaaatatttatataaaaatgaaacaaggtgtgtcatattggtacccatagttggtgatgattaattatgtctggtcaggatcagaaaccggactatataaaccactgccagctaatgcatgtctcccagaagacatgagagggtggtgatggctttgctctttaatactggacttttgctccacatccctggaaggaatgggccatagggaggcttagaaatcttttctgccctttccaccaagggctcagatgagagcaagactaagggacctacttccctgtccttttttgcttgtctgctatcctttgtgctccttaggactgggaagtcctcaggcctcctccaacccccagactagctggaggggagatgtggagtgtacaggcattgaagagaggtgtttgaagagtcaggagaagaagattttccatggaagttcaattcataagccctttgctcttctcattaaaagctgtgtattggaggagaggctctatgagacccatatcacagccatgtcaacttgggatggagcctagtgtttcctccccaaattaaattgagctactctcagggagtatacactgtggctacaacagtcaaataataataatattagtacgaatttaaaatgggaagtgcaatggctttttgtcattgttttattatgaagagaacctttttttttttttccgagacagagtcttgctctgtcacccaggctggaatggagtgatgcgatctcagcttactgcaacctcgacctccggggctcaagtgatcctcccatctcagcatcccaagtatctagggcagaatctaatcctttttgttttattgggccactggagtggtcttattaactatgttaatggtacccactgctccaggagaaggcaatggtaaatgactgtgtgtgtgagcgtgtgtaactgtgtgcgcatgtgtccatgttgcttaacaaaaactgttttatcccttttttatgcagacttgctccctgggggaaaagtggtcaatttctgagttaggggctgtttgaaagagaggaattgttcccctggagggacatggaatcaggatggtgacttgagcttaaagatggactctggggtcagaaacagggctccgtcttctttttcttttcttttttttcttgtgttaatacatataaatgggtcttgttttattgctcagactggtcttgacctcctgacctcatgtgatcctcccatctcagcctccctagtagctgggattacagatgcaagccacctgcctggctgagggttccttccacagaatccctcaggacccagagatcttagcaccaggccgtgaaaaaaaaaaaaaaaaaaaacaaactgaagatgtgtatgtgaggacagaaagagagagacagatcaaggaatcccagagcccaagagcaaagatacttaggaaaaggcatacagtaaactaagcggccattagattagaaaggagccatctgcaatagcggcaccatgtggtaataatgtgtcatagcagcagtggaccaggattgtagatttctcttcccttggcttttaaaacacctgattaacgctctctgagtcagggctcttgaattacacaggaatgcagaagaaggtggaagaataggaaaactcagatgtcttcctgctaacggagcaggtggtggcctgaacaatacattatttaacaaatgtgagaaagtaattattggggttctacaaggtttattctaggccatcctattttccataagaaggtagcactgcacttggcgtataccgatctcatttactatctcaataataacccttgagacagtttcccttacccactttatgcaagaataactaagggtcagagagttcaaataatttgcacaaggattactcgattgtaagagtttgagctgggactcacatgcaagttcatttgtcttcaaaatcctgggcttccaatctctgttccccttgcctccccacagtcttaaaataaatgtttcccaggcttccctctgctgctatcactgttggcataaagcgaatttcctcgactggtgaacctaaaattttctaacaacaatgatctgcataatttctcatagtttaaaaagttcttatgaaaacaatttccttttcagtcttcccacaatttcataaggtaggtaaaataaagattattattatcatctcattttatatacgaggcagggagggccctaattaatgtacttatttcaaagtctggcatctcttaacaataaacttatttcactctttgttaaactgaccagcatagtcatggactgagagtcagaaagtgtgtgttttatttattcattcattcacttgtgtaattacaaatccattgagtgtctatcacctatcaggcattattttaggtactgaaatatagcagtgatcacaacaaagaccctgtcctcttggggaatgcattctagtgaaagaaacagaaaatgcacaaggaaacaatgatttgagatcaagtgtcaggtagtgatcatggcaatgaagaaaaacaaagagaacacaagaaagggagtcagggaatctctctttgcagagcaacatctgagaagaggtgaggaagagaactagggagaagacttaatgcattaaagctttagaaaggaatttgctttatgaaagaatgagaaggccattataactggagcccaacgagcaaggactagtgataccagaagacactggaggaggagacagtcagatcacacagagcttgaaatgccttgttgagagtgagggagacttattgcaagaatgatgggaatctatgtgggggttcagagcagggtggggcagagctgatacatgtttaaaggatacttccatggctctgtggaaacttgactcagggatgtggggtggggaggcagtgcagagagaaatcaaggagatggggttaggaagcagatggagtgacaggtgagagaggtcgatggctaagaatagaatggtaacggcagctggctttattgccaattatgcaatacttttaggttctatgaccttgagtttaattaacctctttggggttaattagctttttttagcttatttttatttcaaaatacagttattaaaatccttacaagtctgtaatgaaagaaaacttacaaaaaattacatatcctgaaatatataaaacgttaaataactgtttttctcttgccatagagaaaaatatacacagcggggacctaataagcacagaatttgattcagaaatggatttaaaacatacacactactacctgaaagcaagcatcaaatagttgtaagtgccaaagcaaccaaacttaccaccgacatatctatttcagtattgacagagctcttggttctggttaaataaattaaagatgggaaaagtgataaaatgtcaattaagaaagccaacaaaatcccctaaaggaagaagagaagccattcttctaacttcaaaactgatccttgctgaagacaaaacttccaagaatttgctcttattatacacatcattccttaaagggaaattgacagacatggatatcaatctcagttacaccaccaactagtgccgataaaccgccaagcaagagcttctaaatttatgatttgtgattaaaacaaatatttagtaaaataattagatggactaaacagcattttagagagctttttaagacctaggattttggatacagtatgcatcttaacacaaaaatcatcaattctatattgataactaataataataaaataagtatgtaagcatgtgaagtatagattctgctctctctctaaacagtaccagaaactcctgcaggagtgctttgcttgactttttgacctctgagtacgttaatattttaaggtaaattccgatttaagtacccaaatgattataaagcagggcttcaccttggtgttgtggttacaattctgcatatcaaggaaaaagagaaatgcttcactcccaagtctcgctcctcattttcagtcttgaggtacctttgtttacaaaggatttctcactgcttgttttgtactgccacctgctggtaagcaccaaactttatttttataaatgagaaatctatacacatccactcttagttggtgttacactctcagatttttataagttttaagaaagtttccttcacatttgcaattattaattatttctcatggtacaaaattttatataaccattaaaatatagaaaacacaaataaggaattaatagatgctgcatttccatctcccagagataatctctggtatacagccttcaagaacacacaattgggttatatgatgtttatcatctaaaatcaaatgtgatgtcatttaataattatttgttggatacattacatgtaatcatatgtcaatttattttcaaacatttggaatttttttcaattttttttgttatttgtttgatgtagcaatatcctcgttttaaaaccttatactcagctctaagctatatgaaatattactagaaatatagctagtacatcaaaggacttcaaaatgggaaggcctttgacatgtacagacaagttcacctccagaagtctatacgaattcacactcctataaaagtgctactctctccacactgtcatcaactcctccttttaagtattttaaaaaaaactactccaatcatatcctgaaggaaaactggatacttttatcatttatatttattttattgggagtgaacatttatattcatatctattaaccgtttctatttttgcatttctaaaatgccttatgtccctctgccaggttttctattttagtgtttgtataaaagaggaagtaatcacttttcatgtatgttccaaatacttttgctggtcatatattatttgatttcatttgtggtatttttaacaatagacattttcagtattgatttagtcaattacatcagttatttccttcatgtggtttgcctgtggttttatgtttagaaataacttccttgttcttagaattattcattattttatcttgaaggaaactgttcgaattccctctgtcatgcaagaagattttatctagatatttttcctgtggcagttcactaagttgcctggcatgagactgaaggttgatctatgagtcattatcacattacaccatttgttttttctgtacttataggaatttatgacactgacgtgcaaaatattttgaggactttataaggaatcccttattatgtctattaatgggctagccatctctcctccatagcattccacacttataaattctgttcgtcaataaaaagcaaaaatcatattttacatcaaataaaactcaccataaaattcaaccacaaacagaagcagacttctattattgtgaggttactaaaatgagaatgggacctaggaggagggcagcttggccagctgccaatcaattcataccagaaggttgtctttttcttatttatttcttctaaaaaaaaagaaagatacatgtgcggaacatgcaggtttgttacacaggtattcatgtgccatggtggtttgctgcacctattgacttttcctttaagttccctcccctcaccccctaacccccaacagaccctggtgtgtgttgttcccttctctgtgtccatgtattctcaatgttcgacatccacttatgagtgagaacgtggtgtttggttttccattcctgtgttagtctgttgaggatgatggcttccagcttcatctatgtccctgcaaaagatatggcctcattcctttttatggctgcatagtattccatggtgtatatgtaccacattttctttatccagtctatcattgatgggtatttgggttggttccatgtctttgctattgtaaatacataccgtgtgcatgtgtctttatagcagaatgatttatattcctttgagtatatacccagtaatgtgattgctgggtcaaatggtatttctggttctagatccttgaggaatcaccatactgtcttccacaatggctgaactaatttacattcccaccaacagtgtaaaagtgttcctgtttcaccatagactcgtcagcatcgtttcctgactttttaattaccgccattctcactggcatgagatggtatcgcattgtgattttgatttgtatttctctgatgatcagtgatgctgagcttccatgtttgttgaccacgtaaatgtcttcttttgagaagtgtctgttcatatcctttgcccactttttgatggggttgtttttttccttgtaaatatgtttaagttactcataaattctggatattagccctttgtcagataggtagattgcaaaaattttctcccattctgtaggctgcctgttccctctgatgatagtttctttgctgtgcagaagctctttagtttaattagatcccagttatcaattttggcttttgttgcaattgcttttggcatttttgcatgaagtctttgcccatgcctgtgtcccaaatgatattgcctaggttttcttctagggatcttatggtttttggttttagatttaagtctttaatccatcttgagttgatttttgtacaagtgtaaagaaggggtccagtttcagttttctgcatatggctagccagctttcccagcaccgtttactgaataggagatcattttcccattgcttgtttttgtcacgtttgttgaagatcaaatggttgtagatgtgtggtgttatttctgagatctctgttctgcttcattgttctacatgtctgttttggtacaagtaccatgctattttggttactgtagccttgtagtatagtttgaagtcaagtagtgtgataactccagctttgttctttttgcttaggattgtcttagctatatggggtattctttgattccacatgaaattgaaaatattttttttcctaattctgtgaagaatgtcaatggtagtttaatgggaatagcattgaatctataaattactttgggcattatggccattttcatgatattgattcttcctatccatgaggatggaatgttttcccatttgtttgtgtcctcccttagttccttgagcagtgatctgtagttctcacatccctcgttagctgtactcctaggtattttattctctttgtagtgattgtgaatgggagttcattcatgatttagctctcggcttgcctattgttggtgtaaaggaatgcttgtgatttttgcacaatgattttgtatcctgaaactttgctgaagttgcttatcagctcaagaagtttttgggctgagatgatggggttttctaaatataaaatcatgtctgcaaacagaaatattgacctcttctcttcctatttgaataccctttaattctttttcttgcctaattgccatggccagaacttccaatactatgttgaataggggtggtgacagagggcatccttgtcttgtgcccactttcaaagggaatgcctccagcttttgcccattcaatatgatattggctgtgggtttgtcataaatagctcttattattttgagatatgttccattgatacctaatttattgagagtttttaacacgaagggatgttgaattttatcaaaggccttttctgcatctattgagataatcatgtggtttttgtctttgattctgtttacgtgatggatgacgtttattgatttgcttatgttgaaccagccttgcatcccagggatgaagctgacttgattgtggtggataagttttttgacgtgctgctggatttagtttgccagtattttaattgagaattttcacatcaatgttcatcagggatatttgcctgatgttttctttttttgttttgtctcttcccagttttggtatcaggatgatgctggcttcatataatgagtcagggaggagtctctcctgttcaattgtttggaatagtttcagaaggaatagtactagctcctctttgtgtttctggtagaattcagctgtgaatccatctggtcctgggcttttatttggttggtaggctattaattaccgcctcaattttagagctttttgtctcttcagggattcaactgcttcctggtttagtcttggtagggtgtatttgtccagaaatttacccatttcttctagattttctagtttatttgtgtagaggtgtttacattattctctgatggtgctttgtatttctgtgcagtcagtgacgataccccctttatcattttttattgcatctattttattcttctccctctgctttattagtctagctagcagtctatctattttgttaattttttcaaaaaactagctcctggatttgtttatttcttggagggtttttcatgtctctatctcattcagttatgctctgatcttggttatttcttgtcttctgtagcttttggattagtttgctcttgcctctctagctcttttaattgggatgttagcgtgtcaatttgagatctttccagctttctgatgtgggtgtttagtgctgtaaatttccctcttaacactgctttagctgtgtcccagagattttggtacattgcctctgttctcattggtttgaaagaacttattgatttatgccttaatttcattatttacccaggagtcattcaagagcaggctgtccaatttccatgaaattttgtggttttgagtgagattcttaatgctgggttctaatttaattgcactgtggtctgagagactgtttgctatgatttcagttcttttgcgtttgctgtggagtgttttactcccaagtatgtggtcaattttagaataagtgccatgtggcactgagaagaatgtatattctgttgattttgggtagataattctgtagctgtatactaggtccacttgatccagagatgagttcaagtcctgaatatctttgttaattttgtttctctttgatctgtctaatgctgacagtggggtattaaagtctcccactattattgtgtggcagtctaagtctctttatagtctctaagaacttgttttatgaatctgggtgttcctgtattgggtgtatatatatttagaatagttaggtcttcttgttaaattgttccctttattgttatctaatgcccttttttgtctttcttggtttaaagtctgttttgtaggagactagcattgcaacccctgtttttttttgttgtttttttttttttgtttgtttgtttttgttttgtttaccatttgcttcataaattttcctccattcatttattttgagcctgtgtgtttctgcatgtaagatgggtctcctgaatacagtgcactgatgggtcttgactctatccaatttgccagtctgtgtgttctaattggggcatttagcccatttacatttatggttaatattgttatgtgtgaattggatcctgacatcatgatgctatttggttattttgcacactagctgatgcagtttcttcatagtgtcattggtctttatatgttgctgtttttgcggtgactggtactggtttttccttttcatatttagtgcttctttcaaaagctcaagcagagcaggcctggtgataataaaatccctcagcatttgcttgtctggaaaggattttatttatccttcacttataaaacttagtttggctggatatgaaacgccgggttgaaaattcttttctttaagaatgttaagtattggtccccaatctcttctggcttgtagattttctgctgagaggtcctctgttagtctgatgggcttccctttggaggtgacttggcctttctctctggctgcccttaaaagtttttccttcatttcaacctagaagaatctgatgattatgtgtcttcgggttgatcttctcatgttgtatcttaatggtgttctctgtatttcctgaattttcatgttggtctgtcttgctaggttggggaagttctcctgggtaatatcctgaaatgcgttttccagcttgtttccgttctccctgtctccttctggtactccactcaatcgtaggttttgtctttttacaaagtcccaaaattcttggaggctttgttccttccttttcattcttttttcctctattcttagacaagaatgcatatcttatttcagtaaggtagtcttcaatctctgatatcctttcctccacttgatcaattcatctgttcacacttgtgtatgcttcatgaagttttcatgctgtgtttttcagctccatcagatcatttatgttcctctctaaacctgttattctaattagcaattcatctaaccttctatcaaggttcttagtttctttgaattgggttagaacatgctcctttagttcagtgtacttttttattacccatcttctgaagcctacttctgtcatttcatccatctgatcctctgtctagttctgtgtccttgatggagagatgttgtgatcatctggaggagaggagccattttgtccttttgggttttcagcatttttttcattgattatttctcatctttgtgagtttgtctagttttggtctttgaggctgctgacccttggacagggttttcgtggaggcctttttttggttggtggtgttgatgctgctgttgccactttctgcttttttgttcttctttcaacagtcaggtccctcttccgtagggctgctgcagtttgctcggggctcacttcaggccctattcatctgattcactcctgtgcctggagaggtcactcaaggaggctggaaaagagcaaagatgggctcctgctccttcttctgggacctctgacctcgagggccaccaacctgatgccagcaggattgttcctgtatagggtatctgacaacccctgttggaagtcctcacccagctgagtggcacaaggagcaggacccacttaaaaaagcactttgtcccttagtggagagggtatgcttttcttcgggggaaacccatttgtctgggctgcccagattccttagaactaccaggaggagaggctaagtctgctggtccacagagaatgcagtcacccttccccctaggtgctgaggcccagggagattcgaattctgtccctgagcctctggctggagttattggagatcctgcagagaagcctcacccaatgaggaaggatggataaggtttatgcctgaagaggcactctggccacaacttgtgtgttgggctgtggggacaagccttgggaccaagccattcagcctccctggctccagcaggggaaaagcacagcctggagctatggaaatgggtgccgcccttcccctgaccagggagcttagcattttaggtagttgtgagtcccagcgctggctgatgcccctcccctaaggagctcaaatgggttagacagcaggcagccacagctggtgcgggtcacccctcactccaggagttcagtaggcttaagcagattccagctgagaggctgcaagaatctaaccattctagggttgggacactaagccctggtggcatgagtttgcaagtgggatcttccaatccatgggttgcacagttccgtggaaaaagcacagtttccccagctgggtagcatgctcactcaccacctcccttggctggggagagggggttccccttccccgtgtggctctgaggtaagctgctgcacctcactgttcttccttctctccaagagtcacaccagcctttttgtcaattttgatgagaaaacctggataccttggttgctggtgaagaattcacatacttactatggttttttttttcgatgggagcctccgaacgttgctgtttctagttggccatcttggccccgccccagaagtttcttcaacatgagtcatgtattatggagttttcctaaatttataatatggtgaagtagaaagtgtggtgaacaggcctgggtatcacaaagttagctctggcaacactgcaacccacagaaaatcatctaatttatcctttcctaagtttcctttacttctgatgtaaaataagggaacttgagttaatgatctcaaagatgttgatatggttaggctttgtgtccccacccaaatctcatcttgaattgtaatcccataatccctaggtgttgaggaagaaaccaggtagaggtgattggatcatggggacagcttccttcatgctgtttttgtgatagtgaatgagttttcatgagatctaatggttttattttattttttgagacagagactccctctgtcacccaagctggagtatacaatctcggctcctttcaacccccgcctctcaggttcaagcaactctcctgcctcagcctcccaagtagctgggattacaggcatccaccactacacctggctaatttttatatttctagtagagacaaggttagacagggtttcaccatattggccaggctggtcttgaactcctgacttcaagtgatctgcccacctcaacttcccaaagtgctggtattacaggcatgagctaccgcacccggccaagatctaatggttttataatgggttctcctgccttcactctaccactcttctctctcctgctgccttgtgaagaaggatgtgtttacttccccatcttccatgattgtaagtttcctgaggcttctccagccatgcagaattgtgagtcaattaaacctctctcctttataaattacccagtctcaggcagttctttataacagtgtgaaaataaactaatacagatgtcttcactctctaacttaccacaaatttatatttctcagacacacttggataatatctcaatcaggtcaatacagtaatcaacagtgttcactgtaatatacaataatcactaaagcaccttcatatggtgccacaaagcataccattttgaggaaatagaattaaaaatgggacatttttataccagatgtaatatgacttggcaaagaaactgcacaatttttacagtaggacacaatggtgaataacttacattaccaaacacaccattaaatgggtagaatagctgtcacttctgctcagaattacatataaagagagagggtcactcacaatcttacactcatcaaaactcctattgtgaactctaccactagcacatgactgatataatttataggcaaataaatatatactcagcaactcaactatcttaatcagctcattaaaaacatacagctttatttgtttatatttttaaacacatcagttctttacttcttgaataatgttataaaaatttcatacactttttatgattttcctcttatatacagccattaataagagttgaagttttactttaaatgcccaaaccaagggaacatttgcttataaaaatctgtaagttttgactataatcatataatctatttttgactataaactcatttagggaaaataaataataatttgatcattataaataactaagtaaggacataattcttcaagaaccaatataggacaacttatctgtctttaccaggtgaaactagtcagttctccctctgtggctgagtttcagagcaggaaaaaataaattggtgcataattttcataactcttatgatcaaaaggaagccaaatagcaaatgtgtttgtatgttttatttttatttgtttctttttccttttttcctttttttttttcttttttttttttttttgagacagggtttcactctttcgcccaggctggagtgcagtggcccaaacatggctcactgcagcttcaacctcctgggctcaagtgatcctcccacttcagcctcctgagtagctgggaccacaggtgcacgccaccacactgagcaatgaaaaaaaaaactggtagaaatgggatcgcatcatgttacccaggctggtcttgaactcttgggttgaactcccacctcggcctcccaaagtgctgagattacaggtgtgagccactgtgctgggtgtatatattttttgtttgtttttgtttgaacctaaagtcaaaaagaaaatttctcttgtatttctctgcaggagagacactgcatattgtaacataaaatattacaaatatcatttttagagcaaaggtagaagcacattttatataaatctagaagtatcctttgatacaaattaaggcataatgtaaaaatcggattcttggaggaactaggtgatatgatacaagtatactccagtgaagtaataataataacatcaactaaatttactgagctcttactctgtgccagctactctgtctccaggctacctatgtgcaaattccaactcagtcacttattaactgtgtaaccttgggcaattctgtagctctctttgtaaaatgaggaaggtactaattgcattagtacccacttcctagagttactgtgagcttttaaagtatgggtctggtgtgcatgagtgtgcacgtgtgtgggcatgagagagagagagagagagagagaagattatattcttatataaatgaatcttgcctcttcctgttttctattccattcatttatctaccataagggattccactgtgatgaaaaaaaaagtatcttgtttcctcagaaagacatttagaaatatgtaaacattttgctttcatctttatatttatggtaattctaaggatattataaacttgcagtggtaattctgaagtataatatatattcagggtcacaaaacagggcggcaaggatgataactctattagcatttaaaaagcataaaaatactaataagcacaaattttcctactatagtaactgtagcctgaagttaagaataatagcatagtgattgtaattaataataatatatatttgaaaattgatgagagattaaaactcaaatgttcttatcaaaaaatgataagtatgtaacgtattggatgtgttaattagctttaattatttcacaatgtatacacatatcaaaatgtcacattgtacaccataaatatatacactttttatttgtcaattataccctgataaagcttgaggaccaggagaggaaaaataagaatatacaaaaatggaaccagcacgatagttcacgtctgtaatcccagtgctttgtgagaccgaggcagaagaatcatttagcccaggagttccagaccagcctgggtgacacagcaagatcccatacctactacacgttaaaaagttagccaggcatggcattaaaaaattagccaggcatggtggcacacttcctcctgtagtcccagcctgtcgggaggctgaagcaggaggatcacttgagcccaagagttcaaggctgcagtgagctataattgtgctgctgcactctagcctaagcaatagagtaagatcctgtctcaaaaaaaaaaaaaaaggaagaatattattgaaaaatgaggtctgcaagaaatggcatatcacaatggctagaagacacagtgatttaagaaggaactcggatgcttagtaaatattatgaagacaattctgagcctccagatgaagatagtggatgaaattccactatcttctaaaacacccactaaaatgagagcataaaagttttataacagtatgaacagagaataacacagaacaggagaaggggataagattctggaagcaggaaattgtgaggatgtgtggaatctgatgttgtcacctgagctttgcaggcagtacaacaccaggaagcaatatgatttgcttgcccaactcccaaagggtcaaaaattccccatgccacctggaagtggtagggaaagggactaaaaataaacagtttgcttgaaagtcccatgaataatcagcaaggcccattccatatgctcctactcatgacagctgggtgacccaccacctccaccactctcaactgccaaagacttgtgagctatttttttggagagggtgaaactgatggtttcaggactagaggaaaccacatgcatttgagggaagggtaccatgctaaacataagggggactcagaggaagttatttcctgaacactgagactgcccaggctgctccaacctcccattcacatgagtctcagtttacagcagtggcaacctgacaggtaacttacaggcttaagactgaaagatgctttgctcagaaatgtatcaatcaacctgtgttcattttctagagctgctgaaacaaattatccacacacctgtggattaaaactgtgtaaatttattctctcacatttctgaagacttaaattctaacattaaggtgctgtctggaccatgttccctctgaagctgctaggggagaatccttcctttcctcttccagcttcaggtaaccccagtccatcctttggcttgtggcatcatcactccaatttttgcttctgtcttcacagggatctcttcctctgtgtttgagagtgtgtctcttctaagaacaccagttacttgaggttaagggcccacaccactctggtctgaccccattttaattgacctaaattcatctgatatggtttgtctctgtgtctccacttgaatctcatctcgaattataatccccacatgttgagggagggaagtgattggatcgtgggggtggtttcccccatgctgttctcatgatagtgagcaagttttcacaaaatctgatagttttataagcgtctggcatttcccctgcttgtacttctctctcctaaagccctgtgaagaaggtccttgtttccctttcaccttctgccataatttaagtttcctgaggcctccttagctatctggaactgtgagtcaattaactccttccctttataaattacccggtctcaggtagtatctttagagcagtatgagatcagactaatataacatctgcaatgaccatatttccattttgaggtactggggattaggttttcaacgtgtatatttgagagtcactattcacccataacaaagacattctcagataaaggaaaactaagaaaatttgtcaccagcagacctagaccaaaagaatgccagaggaagttatttatctgttatttatcgaatagaaaggaaatactaaacaaaggactctttggacatcacgaagaataaaaagaaaaaaattataaataaaatagactttttcctcctcttgaatttttaatttttgttttgtatctaagcaaagattataacaatgtctgatattattcttagtatatatacatgagatattaaaaataattatatggggtatataaatggtggggagtaaatgggcttaaagagaggtaaagtttctatatttcacttcaactggtaaagtgttgacaccagtaaactttattaactaatgcatatatagtttaatagctagagcaaccactagaaaaccaacaggaaaggagatacaagagatactattgataaatcaaaatgaaattcaaaaatgttcaagtaacccaaagaaaggcagagaaaaaataaagaaatgaaaaggagagagagaaaaataaaaaagcaaaattataataaaagacttaagcactaacaagcataacaacaattacattaaatacaaatactctaaatacaccaagtaaaagagactgatggagtggagtgaaaaaacacgacctaactacaagctgtctacaaggaactcacttcaaatataatgatatatatacgtggaaagtaaaaagatagaaatatacatgccatacaaacaatgatcaaaagaaaataggagtggctattttaacataagatacaaaacaaattcttaccatatgacccagcaatcatacatctaggcacttatgccaaataaatgaaaattcatctttacatcaaaacctgtacacagctggatgtggtgattcatgcctgtaattccagcactttgggaggctgagacaggaggatcacttgagcccaggagtttgaaaccagcctgagctacatggtgagactccgtttctacaaaattttttttaaaaaattagccaggcatgatggcatgcacctttggttccagctactcagaaggctaaggcaaaaggatcatttgagcccaggaggttgaggccgcagtgagctgtgttagtgccactgcactccagcctgagagacagaaggagatcctgtctcacacaaacaaacttgtacacaattgcttatagtaactttatttgtaatagccaaaagacttggaaacggccaaaatgtcctataggtgaacagttaaacaaattgcagtagatccctgccatgaaataaaattcaggaataaaaaagaacaaaatactgctataaacagcaacctagatggatctcaaagtcattatgcctactgaaaaaaagccaatctcaaacattatatgatccatgtaggtaaaattcttgaaatgacaaaattgtagatagggacaacaaattagtagctgccaaggatgagggatgctgaaaaggaggtggaggtaatgataaatgggtagaataaaaggatttttgttgaaagggaacagttaggtattttgatcatggtggtaaaagaaatctgcacatgtgataaaatgacatagaactacatacatacattacagaatttcagtttcctggttttgatttttgtgctttagttacataagaggtaacaactggaggaaactaagtgaaggctaaacaagttttctcagtgctatctttgaaactttctattcatttataatgtattcaaattaaatggttaaacaaagccaaaactaaaactaactttaaaaagaggcagacaaggatcccagaaatgagaaacaaagcaccagagaggaataaagataaactcaaaaaaaaagttttcaacaggcctaaatataaataatgtggattggggcaggcaggaaactacagaagaaatgtttccaagatgaaactgaataattatcccaagtgcttgatcacattgaaaaattattataaaactgagagcaagttacagataaattagtaataagtacatttaatcaaaagcaaacccaaagcagatgtcatttccagaaaaaaataaaggtaggacatcaaaaaaggacatttaagcataacaacatgaatcttctgaagtcagtgtttatagtcataacaatataaacattaaagacttatttacctaaaacaatcacataatagaaagatgagaatattataaatgtacatatcggaggagtgggtaaacagagcttaatccctatcttccattattatttctattaatttacaacctcaacagatcacatcagttttgcacatatcaacggataaggtacaaaactgaaatatcaaaagtagcagcataattacattatttgaccaaaaatatttttcataagctttgtagaaatatatatttaatcagatacatatatgtattactctgttttcacactgctataaagatactacctgaggctgggtaatttatcaaggaaagacgtttaattgactcacagttctgcatggctggggaggcctcaggaaacttacaatcatggcagaaggcaaaggagaagcaggcaccttcttcacaaggcggtggggggtggggtcgaagtgccagatacttatcaaacagctagatctcgtgagaacccactcactatcacgagaatggcatgggggaaccacccccattattacaatttgagatgagagttggatggggacagagccaaaccatatcaatatacatatataaaacaaaaacttactcgactccaacaaatcctgtgctctgtcactatatacagaacagcaacttaaaaacctctcaaatgacaaaacaaaaactttcttgcccaaagaaaatattcttaacactagaaaaaaaaacattttttgattaaaaaatcacattttaaagaaaaacaaggagttataaaatatttttatggaagtctttgaactcatattctaatatgtcaacctgccaaagacagaaacatttgcacaagaatgttttctggaaactagataaaaataatgccatatttttatctgaaaaaataaatataagtcgatgtcaaaaaccccaaaggtgttatcatgaagccaaacattttatcctcaaagatatatctttatttggaacattctgacgaaaatccaactaggtcaaataaaaatgcagaatttaccatcaaagagtacacctcctggctccttcacacagcatttttatttatcttatcatgatcatgtcctaaatttagtttctttctactctttaccagagtaaatttgatcacactatatttgattcaatgttgagttgacattacttaaatattttcaaaaccttcatgaccaagtgtcatttcttgcatgcaaacagtcttttaagctaaaatagctgatgtacagcagaaattaaattgtccttaaactatgaagttatattactggctgtccccactctcacccatcccttgcagtcaatagctggtttaaactacacgtacagcagtaaagattggttactttggtccattaagaatagcggtttttcacacacactatttatcagaatcactcagacctcatcccccgaaattatttttgtagtagctttatggacatataactcacataccacagaattcacccatttaaagtatccaattcaatccatgttagtatatttaaaggtttgtgcagctatcacaattaattttagaacatttatatcacttcgaaaaaaaaaaaacttggctggccacagtggttcacacctgtaatcccagcactttgtgaggccaagggaggctgatcacttgaggtcaggagtttgagaccagcctggtcaacatggtgaaaccctgcctctactaaaaatacaaaaaattagccaggtgtggtggcgcatgtctgtaatcccagttacttggaaggctgaggcaggagaatcacttgaacccaggaggcagaggttgcagtgagccgagattgcacccctgcactccagcctgggtcaaagagtgagattccatctcaataaataaataaataaataaataaaataaaaaaataaccatgagctattatccccaatcctccctttacccagccctaagtattcgctaacctattcagtttctatgaatttgcctctctatattgaatcatacaaaatgtcaccttttgtgtctagtttctttcacttagcacacatttcataacagcacttcattctatttgttgcaaacaatatttcattgtacggatatgtcacattttatttatccattcgtcagttgatggacatttgaattgttcccactttttgactattacaaataatgccaccatgaccattcatgtacaggttttggtgtgggcatatattttcacctctctttttatttgaggggcagtctcactctgtcgccaggctggaatgagtgcagtggcactatcttggctcactgcaacctccgcctctcgatttcaagcgattcccctgcctcagccacccgtgtagctgggactacaggcgtgcgccaccacacccagctaatttttgtattttcagtagagatggggtttcaccatattggccaggatggtctcgatctgttgaccttgtgatctgcctgccttggcctcccaaagtgctgggattacaggcctgagccaccatgcccggcctcgcttctcttaaatatatacctagaattgaaatctctgggtcatatggtaactacatgtttaaccttttgagatacttgtccaagtgctctccaaagtggctgcattttacattcccaccagcagtgtaggaagattcttatctctctccatttttgccaacacctgttataatctgatcagtcattttattattgccatactggcaagtactcccagagagtttggttcaattggtgtagctgttgtacccaggctgtatgtttatttatttatatgttatttgtctacattgagtgattttaaaccagcatagagagtcactctttttttttttttgagatggagtcttgctctgtcttccaggctggagtgcagtggcctgatctcctctcattgcaagctccgcctcccgggttcatgccattctcctgcctcagcctcccgagtagctgggactacaggcacccgccaccatgcccggctaatttttgtatttttagtagagacggggtttcatcgtgttagccaggatggtctccatctcctgacctcatgatccgcccgcctcggcctcccaaagtgtgggattacatgcctgagccaccgtgccccgccgagagtaactcttttagcctctatcagaaagtacctcatatgatcgagaataaaggttatgtctctagcctaagaacttggaaaccatttctgccaggtgaaggtaaaccaaataagccagtgataaaacgagataaatatgtgtatagacagtttgagcatccctaatctgaaaatctaaaatccaaaatgctccaagatttaaacctttttgaacacccgacataacaccatgagtggaaaattccacacataagtacctaatacaaactttgtttcatgcacaaaattatttgaaaatgtttaaatttaccttcaggctatgtgtacatggtgcatataaaacacgaataaatttcgtgtttaggcttcgattccattcccaagattctcatgatgcatatgcaattattctcaagtttaaaaatctgaaatctgaaacacttttggtcccaagcatttcagttagttcttcttactggactataatctactgcattcattccagtttgtcaaactccagctgaaacacctcctcctcaatgaagcctggtctctccaactagggttagatgctctctcatttatgcccacacagcaaaactcagtacactccagatattatactaaatgctctttgtcatttatttctcacaacaaccccatgaagaagttattattatcctaattttacatataagaagctgaagttctaaacaattaatttacacatagtccttgcacatggcagagccaagatttgttcctagggctatttgactccaaagtcactgatcttctcactgatttgcttgccttcccattataacgtttcacacacagctgaaaccatattgggcagatcttgtattttaaaaactaaatttttttaaaaatctgcatttttgcctccatcattaattgttccttttttctctatgtgcttattcattcaacattagacattgattctctgctacacactggcatataattgtatatcggttcttccagagctgacattctagtgggggaagcatataccaatcaaatgtgccatgggaaaattccttcagattatttgtctcttgctccaggtaggagcaaatgaataaaaagaaaaaaaaaaagagagatggctttgaaggcaggccgcttgatacatttcccaaaagaaaattaaactcaagtcccagaagccaacagcaggccttgtcaattaaatttcaaccagaagacattcactcttttgcaagtaaaccacactggacatttcaaaatttgggaggtaaagaagaagaagtagccatattattttccacagagcaatttcatataaactcaagagcaatgctattagagattattaagcaatggacaatataaacaaggagttgagatttttatgggaaatgaaaaatgaaaaaaaaaattctgggattaaagacttccttacttgaaggatatattaacacatagctaaatgacaaagtaaatggtgcacaagtttcagcatattcatcaaagattcataaacaaatgttctaatcaattactttaacttctatgctatgaattatgaggaatgcaaagaaatctcacccccagcctctaacctcatctacagcctggcttgcaagatggaacaagatgcatgcattctacaaacatttactctgcctcaggcaggtcaccaggcatctcagatccaaagggtagcgggctaaggcagcttccaccctcaagaaatttacagttgatgtggagaaaaatccctacaaatactgatgttttagttctttaatgcagaataactataaaaatagttaccattccttgagcccgacctacatgagcccctgacatattcacaacaacccattaagtagatatgcttatgtcattgtcattgtaaaaatagtctagctggccggttgtggtggctcataactgtaatcccaccactttgggaggctgaggtgggcggatcacgaggtcaggagatcaagaccatcctggacaacaaggtgaaacctcgtctctactaaaaatacaacaattagccaggcgtggcggcgcgcgtctgtagtctcaactacttgggaggctgaggcagaaggattgcttgaacccgggaggcagaggctgcaatgagctgagattgtgccactgcactccagcctgggcaacagagcgagattctgtcaaaaaaaaaaaaaaaaaaaaagtctagctgaggttcaagggaggatatgtgttttgcctcaagccacacagctggtgcaggtattacaactcacactcaacaaattccaaagttcaaggtttcttctacccgccctgggtttcatgccacctcccacagaggattttaagaaatcttagttgtataaattttcatttactttgggaatgattgtgtctttcaaagtttaatttaaaatgtaagtaaatttcaggtgcagcatttcatctcagctgacaatttatctctaatagaagagagctacttcaaattagacaatggaaacctcttttgctttagtctgcaaaaccaccactagatggcggtacctacacagttattctaaggccagtagggaacatggtctctttttcagtaagcagttggcttcacaaaaagtaagtacttcttttaaaaatctaaatttctgtattattattagatacagcaactgggtcacagaggggtggaggtttaagactacgtaacatctttgctacatctgtgtgaagaacaggatgtgtctttcctagttagctcatcgtcaagacattcaaagtttcttatatcgtttcctaaaacagcataaacaaaagatttaatttctgtgtagattattgtttttgtgccaataaaagacaagatatttgtgcttgctcttacaaagaagaaatcaagggaggcagaaccttatgttattccttctagttaaataaacatgatgtctaaggcaacccacccaagttgggccttccaaactattacttaagaaaatgaacatcagattcagtttgcgtttgttttaaaggaaattgatttgaataggaacccagaactgaagtccggtttcttcccattttccatcttcatatacatttgacagtaggaaaagcatggaaatattattttggttatgaaactgccatgaaaagctgcctcagcatgtcatttaacggaaagagctccaggcaaagccattatgtggatgggcaaatgagaggaggctgggaagaaaccacatactgcttgcgtgagtattaagtttaagccatggaaagagagaatgagaggctagaagaaataaaaatgatacaaactaagcactgtgctctcattttcataggaaatagcatcagccattcaacaatcattccctgataagtgtgttcaatccttaaaacaatttcgaaattacttacgattaaaaacatatttcatcaatgctggaaatctaagcaaccactttaatacgatactctacacacactcattgtatcttgtgtttagagtatgttacagagtacactcaaatttcacatacaccagaataggagaggaatttcggaggctttagaggtgggatttacctttccaaaacctcacattatgacaacttatgttccacttctcaactttaaattttttaaaaaattaattcccaggacaagttttgtattatatttctatttgaatatgaaatagaaaacacattaagaaaaaaaaagagaactttcaaccagaagagggcgctatcctcaaacttaaaatttccacactgtactcataaagtacctttgcaattctgaaagatgcttcagcataatccagcttaatcattgccttataatcttagaaagaaccctaaccatatccttgaagggtggaatgaccgatttgcacaatattctcattttcaatactcaaagtagccattataattccaagttaatgacaacagaagctgaaaaggtatcattctgtagcatcacaatcttcataatttgtaacttttaaaaatgcttaactcttgcattcattcaactgaaatgtgtggctcctttatttgcctgcgcactccacaaaaaaaaaaaaaaaaaaaaaaaaaagttatatcttggaatacatcattttacaaagactgctatttttcttggtatcttagtttaaggggcaataacagactactctaggctgggcagtttattatcaacagaaatgtattcctcacagatctggaagctggaagtctgaggacaaattgccagcatgtttgggttctggtgaaggctctctttggggctgcagctgctgacttctcattgtatactcacaaggctggagaatggggcaagcgagctctgagttattttgtgtgtgtgagggcattaatctcattcatgagggcttcatccttatatctgagtcacctcccaaaggctccacctcctgataccatcaggaggtattagaggttaggatttcaacacaggaattgcggggcagaaggtagaggggacattcattctatagcatttgagtaactggaaaataaagcagacaagtgagaatttgaagaagaaaaggaggaagaatgggaagggtgctgcttttagaaattcctgttcactgcagaaaacaagacaaaaacaagaatttatgtgggcagagaagataaacacaaccgcgggactcactctggtgagtaagatgtctgtgtccacactcatcctaactggaggaaagttgactgctttttcctacttttatggctttgagtaggttccttaacatacttagtatttccattcctcagctgtagaaagcaaacaataataagaactacctctcatgcctgtaatcccagcactttgggaggccgaggtgggcggatcacctgaggtcaggagtttgagaccagcctggccaacatggtgaaaccccttctctactaaaaatacaaaaattagccaggtgtggtagtgcatgtctgtaatcccagctactcgggaggctgaggcaggagaatcacttgaactcgggaggcggaggttgcagtgagccgagattgcaccgctgtactccagcctggtgacagaatgagactccgtctcaaaaaaaaaaaaaaaaaaaaaaaaaaaaacctacctcataggcactcttcatccctacactctctctgtttttttgagacactgctttctgattttcgtggtgggaagggttggcttgcttagttgcttatttatctctcttgtttctctctctcaatagaccctaagtttcacaagcacataaaccgtatctgtcttatccccctccattcccagtgtctagaatgtggcaggcccacaacaaattctagctgaaggaatcagcaaggagatgttatggagctctaccaaaatactaacccagaacttgagacatggtcagtcatgagaatttccactacactctgcttctgtgatgttaatttttatattaacatataaaataatggcatatatagattttgaagtgtgtgctaatggcataaaattgccctcataaataaatgaagtcaaaacttactgatttaaagaaaactattaagtaaataatggaacagatgctgtgtgtaaatgtcaatacgtgtgaaagtggtcatggataacagaagtttgcaaaactcactagatggagaataagcataacagaagcctggcaccaagagtgagggtggaggtcggaggaagtttaaggacttggtttcacagctgggcattttggagatggctgaggccagcagacagaaaagcccagacttcccacattgagactgcacagggctgcagacatagatttgtattcccaggtttaaccacctctctaactttatggaggagaatctctgattgtgaagggttatgacttaccaaactacccactggatgtcttcctgtaatgttgagaagcatccatagtttcctatttctttgtaaataccaaacctagaaaactacacatgacagtcaagggcactattctaaatattctaaatgctcagagtatgtgagagaaatttggaaagaatcctctggctcagagtcaacagatgagagaaggaaagctactgccttaggtgtttgggggcagaaattttccattcctgagaagcaaactgaggtaaggatagtcaacattcatgggcagtcccagtttttgttgtacctttaaaaaaaccaaagcctaaaatgagtttctgagaaaagaaatctatccatatatcaatggaaatttgtatacccagcaaatataagatagtatcagttcttcaggaggaattatcatgaaacctgtgcacattgacacgttctggacaagtagttattcttttttgagatggagtctcgctctgtcacccaggctgaaatgcaatagcaccatctcggctcactgcaacctttcaacctccacctcccagcctcaagcaattcttctgcctcagccaccccagtagctgggattacaggtgtgtgccaccatgcccggctaatttttgtaatttttgtacagataagatttcaccatgttggccaggctggtcttgaactcctgacctcaagtgatccacccacctcgacctcccagatttctggaattacaggtgtgagttaccatgaccggcctgacaagtagttttttcaataagagaaaaacaaaataaaattcaaacacatatcttataatttaagagacagagttcagaaaagaaataaataccacctgaatcctccttttatgtgaaaatatttaattccatttaatcatacaaaatctgcccatataaattgtcttccaggtctgggcccaattgccacttaaggaaaaaatacatgaaaatataccacaggggtatatacccaaaggattataaatcatactgccataaagacacatgcacacgtatgtttattgtgtcactattcacaatagcaaagacttggaaccaacccaaatgtccatcaatgatagactggattaagaaaatgtggcacatatacaccatggaatactatgcagccataaaaaaggatgaattcatgtcctttgtagggacatggatgaagctggaaaccatcattctcacaaggacagaaaaccaaaccccgcatgttctcactcataggtgggaattgaacaatgagaacacctggacacagggtggggaacatcacacaatggggcctgtcacggggtagggggaggggagagggatagcattaggagatatacctaatgtaaatgactagttaacgggtgcagcacaccaacatggcatatgcatacttaggtaacaaacctgcacgttgtgcacatgtaccccaaaacttaaagtataatttaaaaaaaaagaaaagaaaatataccacaggggaagataacattgattggatcatctcagatttcacttaattctatcctgtcaggggccacttactcataaactgcttaattgaatgggtacattttcaatcaattgttttgtctcatgaaaatatatacctggtagacagcgtgagcactgacagcttcctgaagccatctgagtatgtagagcaataactgcaacacgagggatgctgtaaatatagggttgccctctgggaaggctttcacctacaattcttggggaggctcagagaatctgagaccctggcttaaaaactcactgagacagccgggcgcagtgactcatgcctgtaatcccagcactttgggaggccgaggcaggcaggttgcctgaggtcagcagtttgtgaccagtctaaaactccagctctactaaaaatacaaaaaattagccaggagtggtggcatgcacctgtaatcccagctacttgggaggctgaagcaggggaatttattgaaccagggaggcggaggttgcagtgagctgagatcatgccactgcactccagcaggggcaacagagggagactgtctcaagaaacaaaaaccaaaaaacgaacaaacaaacaaataaacaaacgaacaaaaactcactgagacctgaagttcccttcgtctctccagccaaacccatgattaccctcaagtactcagcaaataggccttttgtccttactacagactgaattttcagttccccccaaattcaaagccctaactcacctcaaactgagattgtacctcaaaatgagattgtattcggagacagggcctttaaggaggtgatgaagttaaaatgaggccaccggggtgagcactgatccagtctgactggtgtccttctaagaagcggaaattaggacatgtaagtagacatccgggaagcgtgcacacagaagaaaggcagtgtgaggatgtggtgaggagcgtagtcaaaaagcaaggcctcagaagaaagcaaacccagagacgccttgatcttggacttccagcctgcagaactgtgagaaaaacgtctgttgcgtaagccacccagtctgtggtattttgttatggcagccccagcaatccagtacagttctcaaagggaaagctgcctgataaatcaccctgtgcaatgtctatgaggcaaagtgatactaatatagaatctgacttttcagacacggaaaaattttaaaacaaataggtcaccaaggatttgtctaagtaagtgaaaattctagatgaacttgaaatactcttctcattggaattgtctgtctattttggatgccatttatatgggacatctcacacaatacttttttttttctgttgctttctgagttgattttcttaagtatagtttagtaaaaagagatgcaagggtatattgcataatctctggtaaatctgcaactgaaacacactttcttctttgaaaaaaataaataaataaatttcccgggtgtggtggctcacgcctgtaatcccagcactttgggaggctgaggcaggtggatcacctgaggccaggagtttgagaccagactggccaacacatggtgagaccctgtctctactaaaaatgcaaaaattagctgggttggtggtgcgtgcctgtaatcccagctactaggaaggcagaagcaaaagaatcacttgaacccaggaggcggaggtagcagtgagctgagattgtgccactgcacttcagtctggactacagagacagactctgtctcaatcaatcaataaataaaaattaaaccctaataaacatggagatctctgtggtttagctcttatataacatcacattacactatttaaagcaagttttgttctttactctggtttctcatgggatgttatagaacttggttcatatggcctgtaatgtacttcttacacaattttttctctttctcaattatctatagcacaggttctctccaacctttcattctccaaaactccctccctacatcagctttctcccctccctgtaagtccaagccttccccatttcttccaactcttcatggtgttgactggagtgacctcttccaatgaggtctttcctacgccagactgtcaagcttggtccttctctgtctgatctctggcatctcaaaatccaggactctctctggtcatatagacacacatcttcatttaacttgcgtgagagaaagatgtctgaaatgaaccagttaaattgtgtacttgagaaacgtacccttaaagataatgagccatttcttaaaagcgttcacctaatcttaagaaaggaggtagccatctctaagccatcatctatatgtgtgttatcctcttatttttggaatgacacatctatgttacttgatgactacaaatagatattatggattggaaatttcattttttaagtctgaataataaacattcaggatgtgactatgaaactgatgcatttatcaatgatttaattctgtggtttgcgggagtcaagattacatgttccggaaaagcccaaagtttgtggatatctcaccctttaagtgatacagtattttacagtaaaatgattgtttttatcaatagttgatgcctagcatgctccctttatattgaacgcttctgacattggcaaagcttggacatattctgagcaagaggctccattttcattttgtgtgaatttttggtttgtattttctaccatcactagtcacagaagccactcagccttcccttcttctcaactgcatcctttgatcaacactacccacaattatagataccgtcccatctatgcctgtctgcctcattaattctatttatttatttatttatttttagagacacagtctctgtcactcagactaaagtgcagtggcgtgatcatagctcagtgcagcttcacgcgtctacgcacaggtgacctccgggccactgtgtggctaggagtacaggtttgtgccactgtgcccaagttatttaattaatttattttttaagaaacagggtctcactatgttgcttaggttggtcttgaattcctggcctcaagttatcctcctgcctcagcctcccaaagtgctggaattacaggtatgagctaccatgcctggccacctcattcttttctcaaaaacatcagtttttttttttattttactttgtccatttatgtttcttacacagtatttatgtcttatgcttttgtatgtcttataaaaaggtctcaattttatttgagttttccacatttgaatgcttataacttctgttttctttgcaaatctataggatgtcattgttatatttgggttgtattttgtttcacttttttactgggttatcttcttatcactgtgattatttatctcaggcacaatgaattttactgaccttcaatattataccaaagaattaataagataagttatgtattgatatctgattcttagagactgaactgagactctaaagaaactagttaacaaaaatggtttgataggatagctgccaaatttacatgataaacactctggtaaggttcccatgtcattcctaatgtcactatatatatgaggccaatggagatgaaggaataggcagaatgagaaaaaaggcagtgctgtgatagtaatcagaatagtatgatgtaaggatatacagcttattatacgaggagtattttcagattgccccccactcctagcttaccaaaaagcatcttatagttgcaattctcctttcctttccttctttctctctccttaagatgttgcacttaaatatataaaatacaaaaaaaaaatacgtacacacatatccacacacatcttattctaggagattaaataaaaacctacatgtatacatatcagacttatatgcatatatgtatttggatatgtgtatagtatactctgaagatgagaaataaaatgcaggatgggcgtggtggttcacgcctgtaatttcagcaatttaggaggccgaggtgggaagattgcttgagctcaggaattcaagaccggcctgggcaacatggcggaaccccgtttccacacacacaaaaaaatacatatatatatatatatatatatttgctgggtgtggtggcacacatctgtagtcccagctacttgggaggctgagcactccagcctgggtgagaaagcaagaccctgggaaaaaaaaaaaaaaaaaaaaggaaagagagagagagaaagagagaaagaaaaagaaagaaagaaagaaagaaagagaaaaaatgcaaagagccactcttttaagctattctccaatagattaagagaatgagaaaaaaataagctgttaagctttttggaggtgatatagtttgaaagtgaagaaatatctactttcaatgctagatttcagctttacatttataagttcctcagaaactatctgaaagttttgtattcctgcacacttagaaggcatatgaaacaaaaaaggtaaagatagaaaaagctaccctgcttcaaaataatcagttctttctgtgggttaaaaactactaatatatttggcttatatatttggtgtatcaatacttttcacccatatataataaaattcatttccaatctttggctacattatcaaaatgttttaattaattgactatgagctgacattttcctagaagaaatatcaatttttacataacagtccatccaggaaaaaaatgaaaaaaaaacctctataatttcaacttttacattcttgaaagtatgagcatactaagaatttggtactttaatgatataccattaataataataagaggtgctatttacagagctcttactaggcaccatgttaagtgctttccaagaagaattttctttagtattcacaacagtctaatgaaggagacaccattattttctctcttttacagatgaggtaactgagatttagagaggtgaacttatgtggctgaggtctattatctctagtaaatgacagagccagaaattgaatctaggtatgggtaactccaaacaccacactcttaaacttttctttatattaccaacattttaaaagacttctccaagtgctaatcctggcttactgtattagctttcgtaatctttgacattaatattggtcaaaagctatatgatacctgtttgttgcagggaggtagaggtagtgactaagaaattagtacaacagcactcactaaaatattaatatatattcactttcaaattgcttagttatgactttaacacgttaaaaacaagatagtaaatatttgttgaatgtgccaggtgcaaaggagttacagaactgaatagggataaagacttcatgttcaggcccttagaacagcattgaagacacacttctgaactctggaatgctgtgatttctatgtcacatgtcaaccatttaacaaataagttccttccctccttctccctagaacaggggttagtaaaatacactccatggagtaaacttgacacactgcttatatttgtaaataaatctttttagaacaaaccacatccactcatttccttatcatctgtagtttcattcatcctacaatgacagagttgagtagttgtgaccgtgactatacgactgcaaagtttaaaatttctaccatggagcccactatagaaaatgtttgccaacccctccactcaatctggataagaatcttcttaaagataatctctatatacagcacacatctttgatagctaagcttatagaaaaatcctgaatattctccagcctcctaaggagaaatgagttctttccccctaaaattgtccattctattggtgtgttaaaaaaatcaaattatcagtgacaaaattatttaaatcaagttggtactacattatttcaagatcactgggaattttgattatgctatagggctctgtaactggcagttttcacggttgattttatggttttcaactaaaataataagagacactgaagacttgctataattcattgttttacatttgctttcttattagatttggtttgttttcaaaagggcctttaccatcattttctttccttttctagctgaagcaaggattataaaaatgaaccaaatcagatcaattcatatagtaaagttaccaacatttctaaagaactaaaataaaaaataaaaccgtgactccctaggcaaaatactttcaaataacatagaagtttacagtcaaaagaagcaagtgaattatttgccttgagacaacaacccactccccaatcatgtacattttctgttttcgatgaatggtttctactttcatcatcattcacatgatgatctaaaaagaaaggactgaggcaataataaaacaggacctacaggaattgaaggaaaatccaatactacttacattaatatagaattccgcatacaaactccttccccaaataaattgcaggtatagcagaatataatatactgccaaacatagcatgtaatattatgatgacaaacataaactctcccgatggcctcaggtaatcaagcacactatagcttcgaaaaaagattatggtcataacatttgccaacgtttctcatgagaagtctctcctgccttctttagtcaaactggggccaacactttcattacattcattctccgagtcagaaactttgcaaggcactgtgcaagattttttgaggacatcttctcagaaaaatcagggaggttttatgtccattttacaggaaactaaggttcagagacttttaaatgtgttccctcggatgatttaactagtgtgtgagagagaacatattctaacaccagttttcatagcttcatgtccaaagcacttttatcattacataagcaatagaaggtatttgacacgtaatctttttaaatttatgttaaaatcgtcaaggaataaaaataaagctctaaaatagattgataaatgtgctgcagtagacaagaccccgttgaatttaaaaatcactggtcatgtaaaaccagtgaccaacctctagttgccaaaagagtggctttgttcctggcaagagaaagaagggaaagggagttagattggtgattatagaaattgtgccatggatttggtattaaaacaataccaatttgggacacacaagtcatgacatacatcaccaagttgtggaggcaggcggaggcattattcctcatatctgcccagaacactgcttggaaaatggtggtaaatgacacatgaagaattttacttatttattttattattattattattattttttgagatggagtctcgctctgtcaccccggctggagtgcagtggcacaatctcagctcactgcaacctccacctcccgggttcaagcaattctcctttctcagcctcccaagtagctgggactaccagcgcgtgccaccatgcctggctaactgaaggatttttatttttttatagctgcacagcaccaggatgtagataccaggctgagaagcagtggcctcttagacagtgccataataaaacacccttcttaagagctatacagagagaagtcatcaagaaaaaaaaatagtaggaaagggatagagaacacaaacagaattcagggaattttttttttaaaaaagaataattttaggtggggtgcatagggtagggcacagaaggggctaaggtcctgaagttcttcatgggagaaagaatgtttaatgagaatgggaattaatattaatattattctaatttttcttaaccccaggctactgagactgaagtgcagactgttgcctgtcttacaaatcaaaaccacagtatttgaccactatgccaggaatgttaaaatctgactttctccaacaacaagtgaacatttcagtttttagtgttttaatatttagtatgaatagagtttttcactaggatatttagtatttgatagaccttacatgtcttatctcatttactaatcctgaaaaccttaggcctgtagtaatattatcctcgctttacaaggaaccaaaactcatcgtctctctgcctcccttatgttgctttgcagtttggggagcatagtttttgtttttgttttcctaaataaaggtttgtgcctctaaggtaatcaggatatgtattttttatttccatattgcagataagaaaacaaaggccaaaaaataataaattatttaaagaaatgtacatcataatagaaacagatctggggctaacatcaggtttcctgactcctggactggcattctctacattgtacaacaattactcattgttgtttatcttcagcttctagcaacagacatgggaattaatcactctctgaacatgcttttgaaggaaaataatggttgagtggatgaatggaaggctgacctattaataaaaaagcacaaaaataaagacacggttccaataacatctaaaaaagatatcatacatatcatcacatttcctaaaccacattctctctcaaaaattgcaccccaactttcattcccagaaaacagccttcctattcaactgatagagtcagctttaaaattactgatcctggaatttttttaaaggggctttaaaatggccaattatcacaacaggatggtatatttcaaaatttccttatatcaattcctgaaccaaccttcctgaaattctcccagttccatgtcttccctagtacttcatttttgacacaaaggttaaaagtaaagggatgaaggcctgctccagaagacagacaaagtgaattttagttccagtatatagcaggtttttgacgttagtaaaggtagtaaacgtgccatgcatcaagccggtaaatgtcacgacatctcttgagttgcccaagccagaacacctccctctatctcccacttccttgatcctaatccattatacagtcttatttattttagctataaaatatatccaagaagagtctacaactctccattcttacttcctctgttgtcacccaagcttttatcacttctcatctaaacaaccctctgggccagtcttcccacatccaacgtggatcctccccaatatgttcttcacacaacatccaaaaatctttgtacaatgcactgtgatgtgataacaccattaccttccctaaatgtttcaatggctttctttcagctctttgaaaaaaagatcacaattttcaacattcagcctctaacactggacctcacctgcccaacccccaccattaccctgccctctattgctactggtcttctctcaatgtctccaaaatgctaccctatctgctgtctcaggtcctttccctttgcccttcccacctttccccttgtctgtccttcttacctctcagttcaatagacacttccccagtgaagcttccagacccctgttatacaaacaggcaattcctgtctccagagcactgatttcattggcaattttctactaattagcaaattatcttacttatgtctgtctctctgaacagaataaaagctccatgagaactgagacaaagtctctttatatccattttacctccaaacataaagtacttgatctccaggcaaagatcacggggaatagatcagcagtcaaacaaagccaggctcattgcaacaagggagaaagcaaccacgtggaaccatgaaggaaaggtctcagtagaggttattaagaggggcttggtacaagatttggctttgtgttagaagattttgtggaagattcagacaaatctaattttcctctcaactggggactgtgaattggatttttctgttgaatgctgaaaagcaaggccaattctatgactgggtatcttagtagttttcatttagaaggcaagaaggacaatgcaaggctaaaatgatggtaaagaaacagcagtcatgttagctgagcacacatggtcattttcatggcttgggttgtgttcttgttttgtttgtgatcagacatgattatagagtggtcttgtttttgtctcactccatcatgatcatacagtgaccttgtgtgatgtagatattctgtgaaattatatatttgatgaacaaacactgaattagcagttacaaccaagccagctcagttgaccacagaaatttcactttttctttttcctcactaataaataatcctgtgacttggttgtagaagtcattcatcaaataattgatgaaaacctgaatgaataaatttagccactcttagcatcagctgcttcatgtttgggggataacatttcacctgctcaaattagaccagaaaatgactttaaaccactgccactttaaaaacctataattctaagatattcaaaatttacttgaatattcatataacagcctatagatatgttatcataaatataaaaggaaaactaagttatagaattttgtgacttaatgaaaactttattatctccctccacacaggcacttacattcctaaacatacaatttcattctgtcacattccactgccattccactcactaacaaacaatatattgaaacctgaaatgttagaacgctaagaacaaatttatacaaagctaagaacaaatttataatgtttacctgacaacagagaaatgactacaattcaatggagaagaaaaagaccacaaattaaaaatattccttcactggtttaagaggtagagattaggatctcactgtgagagttcactctcattgcagaacagagggctgagaaggcagaaggacatacagccttttgaacatccacatgtggtaatggttgcactactctagaaatctatacagaatcactggatattacatttgcaatgggtggacttcatggtatgtaaattatacctcaataaagctattaccaaacaaaagttggtggaactccatctagatgtattgatatggttgggctctgtgtctccacccaaatctcatcttgacttgtactctccataattcccatgtgttgagggagggacctggtgagagatagttgaatcatgggggctgtttcccccagactgctctggtgcactaccagagcaccacgagatctgatggttttataaggggtttctgctttcattctctcttgccaccaccatgtaagaagtgcctttcatcctctgccatgattgtgaggcctccccagccgtgtggaactgtgagtccattaaacatttttcttcccagtctcgggtatatctttatcagcagcatgaaaatggactaatacctgtatgtccacctaacaggaacccgaggctgtttaccaaatatcctgcagtctcactctttaaaacaccttcatctgtaatatctctatactctctgcctccatgaattttcccctctatggaagatttatcaagcaaaatgggagtggaaaatctcacccttccagctacacccttcctgagccctggccagtaagcaagttcatctcacttgaacacttgaaccatccagactgtggacttcatatccaaaggccctgtgcttggcagggcatgatacaggtgtggcacatattaagcaactcagtaactcatagtagtggtgttaagaattaggcatgatgaaatgaatgtgtcaagaatgtaggttacaaatggagctgcttttcctttaggaattttctgtttagatggacacatcaattgtatcctggttttcttctgacatataaaataggagacaagtgacactaataaaacagcatggtagttaagggttttttctgcctttcatatgcttaaatgttaccaaaacattatatactctggacctcttccaaacgaagctgcattagaggcttcaggtcaatgttttttaaggtacagtcccacaaaagttaaggtgggacaataaaatacatacattgtgtcatgtagcatcacagggtgttattcagtacaatatagcaccccatatagtatttagttactacttgcctgaaaagaagatctatgtctttccatcttgccgtttacaattctgtatttatttgaattatttcaacagtgacctgtagttattacattaatgttacttgtgtactcagaagtaaaaaagtgtgagaaaattgtactaaaaatttgtcaccaaggccagcaaaaattacttttatatagaagaatcttgttacaacctatgcaaaagagggagatgactgattaatattttagttatactctttcaataaatatgtagactacctgtcacatttcaggcactgtattcagcactgaaatacaactgtgcataaatgcacactattaacttctcaaagttcatgacctgttgggttagacattaaacaagtaattatttttttaaaaaaacaaatcagaagttgaaagggaaaacatatgagaagtatcaaatatgcatggctaaagtatttttccatgaagatgaataggaatctatagacattaaaagagcagttcccaaccttttcagcaccagggatcggtttagtggaatacagtttttctacagacaaggagggttggatgggatagttgtgggatgattcaagcacattatatttattgcactttatttctattattattacattatactatacgatgaaacaatcataccactcaccataatgtagaatcagtgggagccctgagcttgttttcctgcaactagatggtcccaccttgaggtgatgagagacagtgacagatcatcaggcattagattctcataaggagcatgcaacctagagcccttcacatgcacagttcacactagggttcatgtgtctatgagaatttaatgctgccactaatctgacagaaggtggtgctcaggaggtaatgcaagcaatgaggagcagctgtaaatacagacaaagcttcgcttgctcactgacactcatctcctgctgtgctgcctgattcctaacagaccacagactgcgactcgtccatggcctgagggttggggacccctgcattaaaagtccaattctgtcctgcatctggtaatttacacatctccatgaaggccagctacctgatggcatgcgtgttaatacatggccatctaatctgtgaatctataagaaggatgaggggtcactcaatctagggcagcttgccatgcatatcaataaattaaattatggttacctatataatcaatacacgttaatggctacttattgattcatcaacaacttattctttcaagttctgaaaacacatgagttgttcccagaaaacatgttaataacctgtggcttaaggttgatgagaacattccacaatgtgtcatgacaatactgcattagtgtcagtgttccttcattgcccgattggaattaaaattctctattactcagcagtccacttaatgggacaaaatttctgacctatctaatcctcattacacataaaactaattgcatccatgagttactgaaataaaatttagatcctcatgcatcatcaatcaagggtaaatttagcaaattgaagcctttcttcaatattgcttctgtaactaagtaatatatatgtaaaactttacgtaaaatttaggaataaaactggaggaataaatatttccctaaaagctaggtttacattgagtatgactggccaaggtgtttggtaagttaaataaataaataaaaattgtattaacgttaacatatatgcatacattaaattacaaagaaaattatttcactcagaatgtatagttttgacatatgtatatcatatatcatagggtagaaaggataatacttagtggtttctggacttgagatatagttttgatattgtcacatcccaacatggaataggaatctgctttagtctcccttcttccttagatcatagttaatacagttgatccttgaacacacaaatttgaactgcatgagtgcatttatacatagattttcttcctcttctgccacaccttagataggaagaccaatcctttcttctcttcttcctcctcctcagcctactcgacatgaaatcagtgagaatgaagacctctattatgatccacttccacttaataaatagtaaatatatattattttatgatcatcttaatattttcttttctgtatcttacttcattgtaagaatacagtatataaaacacataacatacagaatatgtgttaattaactgtttatgtcatctgcaaagcttccagtcaacagtagactattagtagttaagttttgagggggagtcaaaacttatatatggatttttgcctacattggggattggcaccactaactcctacattgttcaaggtaaactgtatatgcaatggatggctagccttaaatgatgtgtgaggaacacgttaatgataacattcaaattttagaattctctccaggtttattctctttcatgaacatgattccattagctccaaatctataattttggggatgattcctttgtctaatctgcactcagcactagaagagaggagctacaaaagctctactagagctctcaaggagagagtggctctgagaagaaactctccaagatggagaattcctgacacaccatgccaggcttcacagctcaaagatttcaaaaaatacatgttttctcagaagagcaataaagtccatgataaattgctctggatttgaaagcattttgtgatggttaattttatgtctcaacttgactgggctgtgggatacccaaatagctggtaaaacgctatttctgggtgtgtctgtgagggtgtttccagaagacattagcatttgagtaagtagactatgtaaagaagatcagattcaccaatgtgggtaggcattaatcattccattaagggctcaaataggacaaaaaggtggaggaagggcaaattcactttctatcttgagctgagacatccatcttctcctgctcttggacaccacagctcctcattatcaagccttcagactcaaaggctcaccccagtgccgctaacccctacctcggttctcaggcctttgattcaaattgaattacaccactggacttccaggttctccagcttgcagatggcagactgtggaatttctcagcctccataatacgtgatctaattcccataatgcataaattaaacacatacacacactattagttttatttctctggagaaccctaatatgcatatgttcacctaaaacatgtttaatgtaggtatctcatctttccaggcttcatcatgcatacctgggcagttatctagtgtagtgcatgatacaagaaactaatggtattattttgcatatacctaatagatttacagtgtctacagtttccttacttatttaaaccacaggaagtttaattcttttttgttatttaactctacacatgaactttacacacttcaaatgctactctaatgatttgcattttcaatcataagtttatttaatttgtagagcatctctgacaggtcagacttatattagccttttacgattcacaagggaattaatgagaccagggtcctgcctgtttagaactgacatcctagaaagaagtaaggcattaatccaattatcatgaagatcatgtaattgcctcctatgcttagaatgcatgtcattcttttaaggtatggtaaatggcagcaaccgttttacaagcaaagactccagagtctgcattcagacagctcactgggaaaagccaaggttagatcaccaagtggacagagaaagacaccatgaaggttgaacaagaggggactgagaccaatggagactgctgagcctgttaggaaaggaggatgaagataaaaagaaaagaatcatttaataccacatatctgctatgtgatctcattatcctatcaagtacataaaacaagaacaatgcatagaaatattcaatagcataaaatcataaaactggtaagagattacaactccaagaagtgtgatctctcttcaaaatctttgtcaactcctccttcccccaaccctcccaccttctttttgcccaaacctcttaaaaatcagagagaatttggctgggcgcggtggctcaagcctgtaatcccagcacattgggaggctgagacgggtggatcacgaggtcaggagatcgagaccatcccggctagcatggtgaaaccccatctctactaaaaatacaaaaaactagccgggcataggggcgggcacctgtaatcccagctactcaggaggctgaggcaggagaatggcataaacccgggaggcggagcctgcagtgagccgagatcgcgccactgcactccagcctgggcgacagagcgagactccgtctcaaaaaaaaaaaaaaaaaaaaaaaaaatcagagagaatttttcctagtacccacagatttttttatgagaaggaagaactattattagagatgactggcctattgctaggctagtgtattccccaaagagaggcaatggattcccttatacatcaaacaccaaagacaaaaaaactcttgagtaacagtctgaatgaggtaaacaaattcagaaagctgtgctcattgcaaaatggggaagggaaatacaggttttgttatcttttaataccaacaattaagttaacatgaaaattttttttagcgccaacatattccattcccactttactcttactataagggacagagtaggcagcattagtcccactttaactaacagagaaagacatttaccacatgcttgacttgagccctctggctagaaaacacatggcaaaagtaacacaaatgagagaatcagggatttcttagtaaacagcaacacatttcagatttacaatactttaaaaagcaaagatcaaacatgctactcaatcctacttgataagctgcctccatttccaaggttaaagatggataagagtaaaacccaacatctgattattccatgaactctctcatccactatttgccatagggtatacagtactatataaggatttgggtggaatagtgaaggaatattttagactttaattaagccatagttcatgtctaaaagaaagcttgtaagctaacaaaatgaaatagataacaatgtaatgttatccaggtgttttcaataaaaccttgccttttataatcccacttcaggacttctgaatctgcagcaaaactcaagcgaagtgggtaggattcgctgagccttccactcatgttgtgatgggagctactcatatatggccactgaatttaaagagtaaataactggagaaagaagagataaaacagccttgtagacacatctgagtggcatatttgtttttcttttccttcctgtaagactaaatgaatgtagtatgtgtgatttgaccaagaaaaggaatgtgtggaatgacaggataaaggtcacaggatagctagcatgatgcttgacagaatttaaactaggcccatgaaagaatgttccaagaaagctgcaaaatgtgtctcaaccaacagaggcaagatctcgtgagaatcccttgtcatggttacaaatgaggccaaatggcagttaatagtggaggttgccttgaaattctaaatatccacaaacattcttactgtttgatgagctacaccaatttttcagtgaataaagttaagctgaaatatttacaagcaatcatgtgctggataaattcatacatgtttggctcaagaaaaatgtctctaggtatcccatgtaacaaacaaattggtatattcacaataactattttccagaaaataaaaattaacgcatctagttctacaaaaagaggctactttattttagattatcatcatcctttattacttaattttttcccttaagatgaatactattaactggactcctaacagtctattaattattaacatcaccctttgagaatctaagaaaataagcattgtattaaaaacaaatattgctcttttataataccctccagaacaaatgtaatggtgggaatccaggcacagatatttaaattaatactctacatattatagggaatgccagcaaataaatgcaagatttctgtattccaggaactcataacatagctggaaaaaaagagacaaactaaaaaaagtaaacaacacaaaaagacaataccatgagctatcagctgtcaagaggttgggctagttattaaatgtcagcatccataagagttgtttagctaaatattatgcttgtacatgcatgaagctgtagtaaaatgaatctcaatccacaaactcaaattgcaaaaaataagtcaatttctttattttcttaaaaccaatttaaatttgactctgttctagcatcacaccatatgatagaaaatcaaccacaagaacacacaaagatcatacaaagatcctgggctcttacataatgctaagaaattgggtgctttccctacttttcagtaaggctattggtcaaaatcactggtttacctactgtctcacccaggataagcttttccacagccagaaattctgatgtttctgtgtagtgcttgggatataggattcctatgccaggatccacactttcacataagacttgagatacaggattcccgtacctacgtccagtcttgtgtgtcatactcaggataaatcctgtgcctaggtccagcttgcctaggtgcccccaagaggctacatcttctaatggcttctaacttttccagatgttgccataatctgcaaagtttcctgatactcctggaatactgaaaacctctggattctgccaacctggaaagaaaaataagtccctttcatttatttctactttccctttttagaacaattcatatcacctctgcaacaaatccaagcttctacagaagaaaccaagagtttctagcatcagtttctattttctgtcttgcaaaatccctagctatctggttgaaaggagaaaaaatgtattttaacaagaacaaatagtattaacaacacaaattaaaaattattaccatagattttcctgctaccaacaacacagagaaaaagttatttaataatttttacaacatctagacaaatatataggtaagatagaatcatccatctctcaacaagaagttgttaccatcccagagaaaaacttttcagaaacttgcccaatggtgactaactttgaagtgtaacacaagtaaagcaatttgaggacaaagatccatttgtactcatgataaatgagtacaaaaccataaagaaacataagtaaatgaagagtacagagaagagaaacaggcaaactaatgcaaatataataacatagttgcatagaaaaaccctttaaaataaatgatatacatttcaaaaatgtcaaaaatattaccaggccatatactttctcacatcaaatgcagtaaggtataataggagataggaagtctcccctttagacccttgtgatttatccttcgtttgatgagcacttactgcaaaaacagaaaagctccctgaaagagttgcatcaatcacttttgccagtttctgcataaaggtagaatcattcatgtcctagatctgagacagctctgaattaaatatgataccaaaagtacctgtcaaaatgcattgagtgtctcctatccagatattgagttaggtgctttacatgaagcatttcatgtaacagccagagaagttctgtcaagccggttttttttaatcattattttacaggtgagggaaccaacgctccaggaagataagtcaggttttcgaggtcacactgctagtgactgggaatcacgaggttataattcacatatttctaatctaaccttttctgatctaagaccctatgaaataccattgatctaaatcaaagggatatttgagcaaaaatactaacctaaaaccttaatgaaatctgactgatatggtttggctgtgtccccacccaaatcttatcttaaattgtagctcccacaattcccacatgtcatgggagggacccagtgtgaggtaattgaattacagggatgggtctttcccatgctgttcttgtgacagtgaataagtctcatgagatctcatggttttataaaggggagtttccctgcacaagctctctcctgcctgtcgccacgtaagacgtcccttgatcttccaccatgattgtgaggcctccccagccatgtgaaactgtaagtcaattaaacctctttcctttataaattacccagtctcaggtacatctttatcagcagcgtgagaagagactaatacactgacgtacttctaggcatcaaaggaactggctgagccccgttaagagcaaaaggctgaagagggacattttcagactcgtacacctctaaggaaaggagggacctgcaaatgcccaagcttcaaaagtcagttcactaccttcagactaagagggcaggtaatgtttcccccaggcatgtgatgtgctccgtggctgtctcagtgttcagttccacaggaaataccatcctgatatgacagaaacaattaaaattgacacagaacttgtttccataaaactaaggagtaagcctgagctctaacaatcttaccggggcaactttggcaacatcacatcctccttcttaaggccatttttcaacaactttatagaattgctgggagtcagacaatgtaagcaaaagtactagacaaccaacagaacactatacatattatgcctgttattaattcatttgaaagttatataaggaatgctatgaggatcgtgtacaccaggttaaggtggactctaaaaccatctgcctggatgaatctcatctcagccaccaactagctagatgatcttgggcaagttactttgcctatctgtatgtaccccaacctcatctgtaaaaaggggataaaaattgtcttttgtgagaatcaaatgtgctaatataaaatgaagatgataatgtaaaatggggataccagtaaggattgttgtgaagaacatatgtgataatgtatgtaaagactcttgtaatgttataagttaggtaccattgttagttaatatcaatcattaccaaaccaccaccaccatcatcactcttagtacgattatcactaaagatgattaaaggtctaagagttatttatgtaagtgatggagtcctcagagttttcaaacaagataaaaggaaaaaaaaagcaaaaagacctcaagctttaacatttatagcataattatttcctgtgggtgtgcagactgacatctacaagtacataccaagacagaaaaaaaattgctatgttttgttatcatttgatataagctggatgcaaattatcctgtttgtgaagctaatttccattctcataaaagtactgcctgtaaaaatattattctagtatactttttaaatgagaaactgagttcacaaagtcttttattcagatctctccaagccagcatattatcttctccccattaaagagctttaggccatctgtcccatctagactaccagctggtatgatctccagaaatattcctcaactgtaggaactaattgggtttttccatatgtataaattgtagattaactgtatttaccaataaaaaaagttcaatttcatctttgtggcaggtgacctgatcttaataatgagggtgaatctcacaggcaggtcctttgggatggttgtaatgtttctactatcaaagctgttgcttgtgacaactctgggacattttttcttatacaaaatcaaagccagagttatgaactcatttaaaagagcaactgtaacagaagaaaatgtaggtttagaagaagtgataatgacatcaccagaagaagggacactgcaaaaatgtaccctaacatagtgttcataatgctgttatacaaaacatgatggctctccaagataaaattaaccatttccagataggattaaacataactctgaatatctatggacatgtgattaaacattatgaattcaacaaccaagctataatataactcatctttgtaagggagacacttaaaaagaagaggaaaggtgaggacctaaaaaagtgaaataattcacccatcaaataaaatgtctacagaaaaagatgactcaggaccaccaggagaacttcaaaagccaagtcaaagagctttagcgtttcagacatccttacagtcagttgttcacgtctccattgcattctctccctccctttctcccagtacacagcaccacctttgttctcccattaacccttaaactgggaagtctcttactattttctcatcttcctgccatcctctgatgaggatttgttatgaggacctgtgtttggtcatcacaggtgatctccacatcccacccctataattattagttgaccccaaagctttcattaggaatactctatgcctgacttttaaatcaggtagcaaaatcattgtgaagctgcccaatctggagcatatttcttgggttcggatcttggttctgtcaccaccagcttgaccttgagcaatgtgcttgacctcactgcccttagtttccttatctataaattgaggatcatgacaatagcatttagctttaaaagctgttgtgagaattaattaattaatgcctgtaaagctcttagaaaaacgtttcatagtatgtgcttgacagatgtgagctattattttcatgtcactaatgttgaccctgtgttctcctcttctattggttcctttgctcttattatcttcattccaattccacatattaagatccctgcccatccttcaagacccagaactgttgccagttcttccactgttgcaggaagtcagggaccccaaatggagggaccatctggagccgtggcagaggaacataagttttgaagatttcattttaatatggacatttatcagttcccaaataatacttttataatttcttacacctgtctttaatctcttaatcctgttatcttcacaagctgaggatatacgtcatctcaggaccactgtgataattgtgttaactgtacaaattgattgtaaaacatgtgtgtttgcacaatatgaaatcagtgcaccttgaaaaagaacagaataacaacgatttttagggaacaagggaagacaaccataagggtgactgcctgcggggtcgggcaaaaagagccatatttttcttcttgcagagagcctataaatggacacgcaagtagggaagatattgctaaattcttttcctagcaaggaatgttagtattaataccctgggaaaggaatgcattccttgcgggaggtctataaacggctgctctgggaatgtctgtcttatgcagttgagataaggactgagatatgtcctggtctcctgcagtaccctcaggcttactagggtggggaaaaactctgccctggtaatttgtgatcagactggttctctgctctcgaaccctgttttctgttgtttaagatgtttatcaagacaatatgtgcaccgctgaacacagacccttatcagtggttctgcttttgccctttgccctgtgatctttgttggacccatatcagtagttctgcttttgccctttgtcctgttccctcagaagcatgtgatctttgttagaccctgattagtagttctgcttttttggcctttgaagcatgtgatctttgtacctactccctgttcttacaccccttccctttttgaaacccttaataaaaacctgctggttttgaggctcaggcaggcatcatggtcctaccgatatgtgatgtcacccccagcagcccagctgtaaaattcctctctttatactgtctctctttctcagccggccgacacttatggaaaatagaaagaacctacattgaaatattgggggtgggttcccccagtattctcccatatgcccctcagcttctcactcaaaaagcatcaacccctgttctgaaatccccagggggtaaccccaaactcagcttcatattttctaacttatattgtagagatgcatgttcatgtcttgtcatatttatatgtttgtacatttctagacagtaggtgctgtgtttgtgtttcccagtggcctgccctaattgaaaacccctgatacatatacagtagatctgagctgttcaattttgtagccactagtggtgtatggattttaaacaaattaaaatgaaattaaattaacaattcagctcttcagtcaccctagccagattttaaatactcagtagctacatgtgagcactggctactatattggatagcacagatatagaacattttcataaccacagaaatttctgttggatactgctgcaatagatagtacttgaataaatgttttttaaatcccctctgtattttagaaatgtgattctcttagaaactttctatctcatcagagctttaatcaaacaaatgctgaaaatgaaaatgagatttaggtcatcaagataattcattctgtgagactagtaaaaaacaaaacaaaacaaaacaacaaaacacttttttttctacaagtagagtagtagtgagggaaccaggaaccagtttcacattgcagccaggcaaacagcttaaaagatgcaaaagacatcacatcctttcaaaataatggaaaatgcctactctgtggttctagcatgaccacactttaagccatagctaattcatgcaaaattctcactcagatttctaaatttcttcataaagtttcaaacagagtctttccaggaaatttttttaaaaacagcatattttctttgcactgatattaggtgaggttaaaaccctgccagggcttcctgttgcacttagaatcaagtcaaagtcttttggaatgttcttgagtttcatctgtcaccaccctctctgttactggctggcttgcagccatgctggccttctttcagttcatggaaacaggcagctccccaaccctcccagccaacacagctcacaacatgctgcacaacacacactgtgccagatttcttcagtcttcaccttgattttcactccctcagagctgtcttgcctgactactccttccagtaccttgttattttccttcacgtgtaacctgatatttgttgtttatctgtttattgtctatatcctgcagtagacattaagtttggtgaatgccagaactatactcttttatttcccactatttacccagcatcttatgttgcagtggctagatacttaacacatgtttattaaatgaaaaaaagaagaagaatctcagataattaattttgttgaaggaaataatgatttttatttttaaaaaaggaattttaagttaacttagttttgtgattgcctttatgtgtgctgtggggtaagggagagagagaagatggaacgaggtttaattttgaaaatatcacataaaactatcaaatttatccttcgttcaaatttgtaaggtttgagagacacttacttattgttagaaaattatgagacagtcctttttggtgtgcaatatgagatttggtctcttttagggaaatagtgaactaagatttaatcttaaatattcattaaatttagtggcttaaaatactggagcaatgcccagatggaaagtggcaagatatttaatttgatatagctatctaaatgtcctctgagtactttttaaaaagcattttcattaaaaataatgaattgtttcactctattagtttgggttagaaagttaaaaaaataaaataaggcagatacactaagaaaatatcaaatgatcataaaaaattagatgtctccttgaacttatttttactcttgtgcaaatcacattacatatctatgtaataaacaatatacagtataataaattattttaaatgacactagattataagatatgtatgtatatcttatgtatgtgtgtgtgtgtatatatatatatatatatatatatatatatatatatatacatatatacacatacacacacacacatacaggcatgaagtactataaacttgatttcctatatatgtcgacccacatgcagagctggtttatccatggtcagacaatacatttttgaaaataagccaattggatgtatacaaatttggagaagcacttaagctatgcaaaaccacacaaattatggtccctgaattcagctgaacaaaatatacaaattatacaaattactaccagagtggcatgaattctgctaccttcctctgccattttaattcataagtcaagttgtgaccttaatcaaatgtaattttagaactggaaggggctttagaaaggttcggatgatttgtttattttgctctgctgataatttcacatttgcatcataattacatttctctaagttcactgacatttcagttagcttcaatgatcattaaagttttttcttctttaatctacatttgggtcatgctcatagggctgttcatatgcaaagaaacccatcagaaaatggctgatttccacattgtacagtcattctacttgagacactgaggttgaaaaataattgtcatttttaactaaacattatgcaactgataactgaacatggttatcactgataactatcaggcatattcatttttggaagatactgaaacatattttcagctgtgttatgcaattcataccatgtaccttgttgctatttgaggaaaagacagttttaatttacatctcctaataataaaatgcagttctcagtgttagcaattgttagctagtgaaaactcactgttctttaatttctacataatatatatagacgccactgttactcaggtggttagataccccaggtagataacctgacctgcaggcaattgtcttgtatgtcttgacccacccatgaagcaagagcttaaagcaaaaagtggagacacctttcaattccaatctcttactctaagaccaaagcatcctcctgtaggtgccattgaggcccaaaagattcccatgaaatatatttttaaggtcactgaatttttccaccatatattcaagaggatacatttcactggggaaagagaagtcagagccattccatttaaaaagaaatccaatctcttttcagaaatgttacccgcagttgaaattgagcagggaaatttaaaaattttaaatagtggctgaagcttagtatcatatggaattttaaaatttgtcacagaattagcaaacctgagaatacatattatgaaaatgttttagtgggatgaataaactcttcattgcagagtggaatatgcagttagataaatgcaagtaactcaatttcaggctttcttgtgaatcatcacagcctcattattacccggttgtcaataatgatgttagatgaatgaatgaatgaatgagtacagttgtccacattgttctatatttgtaataaacttcatatttaaaacatttaaattgaaaattttataccctattcattaagcctcttataaaatgtcacaatgaaacaattttacttaaatagtgatgactactacttctcccttggaatacaacatcttttctaactcacatttttacaatgcttttccataggagaagcatgtttgacaaattcaccaagatgaagcgctaaagctaatgtttacaaaataaaaaactggtgcacagaagacgtctccaacttatttagcttccattctacaatccacaaaataaagtaatcattgcctctgcaccaggattacacatgaattcatcaggatttctacctggcatcctagcatgtgatttaccaagagacatattgatattgtcttcacaggacataaaatagaacaaataatattttccattttcattatgctttcagaaaattaaatggcaaagagcatactgggaatctgttatgagatgataataaaattgtgtaattagtcagtgtccagaggcagagctgttctccagaagtcttcttgaggtttcctaagggagaaactttcttccctctgggattttattaggacaaatccagagtctcaacccaataatccaacaagcagatataaccacagggtactaatccaaaatgtcatccaggactccatgataatattatccagaaacaaatgtaactccctatttttatacttaaatttatctcttgttagtttctaaccatatattcatctagtgttttgttccatggtaaattggtagtttacatgggattacaatgaagggattataaagcggtagagattatttgcccagcagatggtttatgtatatttaaacagatatgaataagattttacaaaagaaaatacaagcttattaccagtacaaagtatattattaattttccttttttttttttttttgagatggagtttcactttttcacccaggctggagcgcggtggcgcaatcttggctcactgcaacctctgccttccggtttcaagagattctcttgcctcagccttctgagtagctaggattacaggtgcccaccaccatgcccagctaatttttgtagttttagtagagacaggggtttcaccatgttggccaggctggtctcgaactcctgagctcatgatccaccctcttcagcctcccaaagtcctgggattacaggcgtgagctgaccaaataatttttacataaataaaatatttggccaaagagctaaacttaaatataattttcctgattataattataattatttagatacagcatgcatatctcttaaaataaaaatatctaatttactatttctctctctcaccttctttcttttctgaaattcacaatgttcaaacttgattagaaagatctttctagacaaatctttcatacaagagctactgctgacttcatagaaggcatattatcaattaaacagtacttcgccattttataatatacactttaacaaacttttaaaatattatttatttacatgaaagaaaatttgttatatggttaaaccagagtttcaaattaagtgtatgctagaggggttacagaaaactatattattcaattttaaaaaaataaattctaaaatttcaaagaaatacaagctttcaacagctgcattctccttgtccaaacataaatgtgcatgccatttttgttctgtcttaaaaaaaaaaacaaaaaaactacagtccttccagatcttatacatctcaatacactggtacattttttaagaaaagattcttgctccccaccccaaatacactaaatcagaatagggtaagggaaggatgctgaaatttacacaacagtgggcatacaaggtgtttcaatacacatcccaaaatgtgagaatgactactcacctgagaaatcaggctaaatagttagaaaggcagtcagtgactcaacttttaaattattgagattctaattctaaaaacatgacttttatgaatccctcttggtaaatcacacacataaaaaaaaatgaccaccgatttttcccattcctgtataaacacccctctacaatgcagctttgcagctcctcccattaagaggtggaatgcatatctatacctctgggtatccatttttggccaggtgacatatttttgctaacaggacattagtgaatgcgacagaacagagagtggataagagctcgtgcaatggggcttgctgcttttcatgtttagctacgatgtgaagaagcctgggctagcctgccagtgaaacaaccacctttgcaaaatatcataacaatgagaaaagctctgatctaacggactccatcttgcttctaacctccaagctgctcctgttattcctggatataggccaaaataatgttgggagaaacttggtttacagtttaattttgaaacgaagatcataatagccatttcccaaaacaaatcctcttcttgcctggggaccagactgcctatgtaagactaacaaattagccacaagattagaaatacggtttaggagtcatgcagccagaggccgcaagattctgaacttcctaaattgctcctagggataaaatcactattgttaaaacctaagattggtgctcaaggcatttttcagaacctgcattctgatgcaccagctactaccaaccagaccagtaatctggctcaaccaattctgtgatcagaatcagaagagaagacagcaagaaaaatccacttggaccccctatgatttcatttccaacctgaccaatcagtactccacactctctggccttgcacccacaaaattatcatttaaaaaccccagtctctgaatgttcagagagtcttatttgagtaataaaactctggtctcctgttcagccagctctgtgtgaattaaactatttttctattccagttcccctgtcttgatagatgggctctatctgggcagcaatcaaggagaacctgttgggctgttacaccagatgctagagacacagggcccagttgcctccatcattcaatcaacagcaagatatgtgagagcgaggccatgctgtccccatccaatctactagctgactgctagtgaggcccagagaccaaaatggccaaactataatattgcaataaggcatgttgcttaaataactattattataggtgttttgttgtacagaaaaagctaaatgatagaccactttcacaaaaaaagcaaatagaagacgatgtttctgatgttaattttggtagtgttcaagctttaccacattctggaattatttcacatgttttcatttcaggacttgacgtaagtggtagacatatctgtacagaactagatgaattcaagaagtttaaacatactttttatcaagtgccactgagagatgtgaccaatgcaggaagaaaaaaatatgtataaaatgaacaaaatactttgtagaaataaacatgaaaaaaaaaacctgcaactggaaaaaccagctctgacatttatttttgacttttacaaaggaaattcacttgcattgttgaaaatttaagtttaccatggtaactgcttcctcacacatcatttttattcccaacaaaggtatttgtagacgatgatatacactctgttgaataggaaatttccatcataatgcttgtgtaagatattaaaagtcagatcatcaggctgcttgtatatataaagattttattacactcaaaggataattagaatggtttccacaagattgaaggtaatgacatgaagtatgtgaagatgctttaaaagctttcaagggctacaaaatattgtatactattacagcgacaaaaatattattttgaaggagacttccactatttagttttattcattgatttatgtaacataagagcactgttctgtgcctggctcacggttacctactaggtacattgaagttattactaaggtagacaattccatgctctcatggaaaccatattttagcaggaaaaacaagacggtttcaggtgtttacaagttctgtgaataaaacaaaacaggaaaatgtgagagaggatggcagataatttagaatggagaatcagggaccccttagggagatgacatttaagatgagacccgaataaaaagatagagccggtcatgcacattttgaagagctgagtatttcactaaaggaggacagcaagctcaaagaacctaaagtgcaaatggaattggccttttcagtgtccaggaaaaggccaacatggctgatacctagcgagccaaaaaagaagtgctaagggataaggttagaaaggtgcacagtgggcagagtatgtagcattttataagccatgcagagccatctggatcttatcctaaatgtctgtgtatatttgaaatctacataagtcatttttgacagttacatggggattttgcctgcctactcgacttcggtaatccaccatatgaatacagcaagcatggaatgttaactgaagcaatacaacaatttctaaactgactactaaatgagtaagactctggaaatattttgaaaggcaggatatttccacaaaagattcacttctaaaaccctttaaatatttcctatacatttcccactcagatatcttgatcgtagcttatttgtgtatcactaaaacagtaacaacaataaaaaaaatacagaactagtcaacaaggtgttttttaaataatttaaatctaggataaaagctataagacttaatcaaaaatttttaaacggtcactgaaataggattgttttagtaaactggtgttgaggttgattaaagatatgatcacatgtgaaaaaaataaagacaaataaaaatttgcaagtaattcagaggtccaattactctcctaaaacccaaataatagtaagttggagaaaaatctgtgctatacatagcaaaatatattttattccctctataaattaactgtataaatatgatcatctacatatgcaaactgaatgaaaaagtagaaaagatcatgttttagctgaaaagggttgaaaagtttgagatttcaagtaaatactgaaaacctaaaaagaatagcagaagggagcttgaaaaacttttctgaggctgtttccacaatagaagttttaaaaatacacacagttgaataatacagaaaataaattgtcatgaaaacaaatctgaataaatgatgtgtagagttactgcttcttcacatacaatattttggtaatatagtagatcccccctaaaagtaaacttaacactgcatcttaaataataatacaattggttgaatacataatgtgaataagcaataaattttaagaacacaaaataaattccatttgtgtctaaatatttcactctaaataggtgctcagctataaaaatccagtgtatggtggttttattcaaccataaaatctacaatatgctctaaaaggaaaaatggttacagtttgtgcatctaaaatgcatccttagtaaaaattcataaaactgcaacctaggagacttaacaacagagtaaaatcaatggagtaaaaaatacttcttgagaaatttcagtgttttgcagtatagaagaaacagtcctaaggcttaacaaaatacttttaaaaatttctaatgtactgatctgttgaaacaaaaaggaagaatttcagaaaggccaaaaacaaagtgaaagcagaaactaatagataatcaagcatcaaagtttggttacatcctcaaggtctctgccaaattctgaaaactatgagattcttttgtgaaaggtgttcagagaggacagaaacccctacataaatatagaaccacaaaataaataatcttgccacaaaaaataagataacaagcaaattcgctggttttgaatttggcacttggttaagaaaaaataaatacactttcctaagaatccctaaccacaagctgaacctcccatgaatttacaatctaagtttacactactgtgtcatacaaaacagcaagccaagaatttcatttaacattttccaggtgtggtggtgctccctgatgtctgaaataacaaaagaaagctttctctggagtcaaatgatttcaacccagggctgaaatatttctcatatacaaaattttgggtaaaacgagccgctctaacttataaacaggaaaaaaggcaccattaatgagagtcatgtaaaaaaaaaaaaacctgtagaaacaagaccacaaatacttcacttcttagaattatctccattggatgctaaatacatctattaatagtatgagaaaataaagtaaaaattaaaaatataaattaggaataaaagactataaaagttggtacgtatattttaaaaaatctaatagaatttttaaaataatacataacaattgaaattaataataaaatgattaaacggattagacacagtatattagaactggtaaactgggaagcagacttaaataagtcatcctaattgaaggacagataaacaaagacagagggaatatgaaaaacttaagatattctgaaggtagtgtaagaaggtctaataacaatgtaactgaattttagatgaagataataggagagaatggagaagcaaatatactcgaagatataataacaagactttccaaaactgttgaaagacataaaccctaaaatctggaaaggaatataaattgaaaacaatgtaaataaaaataaatccattcctggacacatggcagtaaacctaaaaaatgccagaccataacaagattttaaagcagaataaaaaacaaaaagaaaagaaagaacaggtcgcttacagactaatagtgattagaatgatgactgacttctaaataatagtaaaggcaccatgaaatcatgtctccgagtgctgagaagaaaaaaatgtatatcaaaatagaagtatatattcaattttattgttgaaaaccaaaaagaaatcaataaaatttctgacaaatgcccaaggagagtttaccacgaacacacactatctaaaataataacaaatatttttaaggctgaaggaaatgttgcccaatgagagctttgcaatgcagtaagaaatggtgataaatacatggcttaatattttggtaactctgcaaaaatacatataggggaaaagcaatatgggatggaaatgaagatgcttttcaacatattgtatcccaatatacccatcataaattaaaaatattctaagtaaaaaaaaaaaattaaatgctggcaacacagcagacagtccccaacttacgatggtttgacttaccatttttttactttacaatggtgcaaaagcaatctttgggtttggatcggttattgatttcaatagaaaccataaccccatcacaagacaagaaactcctctatttatgatagagttacatcttgataaccattgtaaagtaaaaaaaatcatatgtcaaaccattgtatgtcagaaaccatctgtagagagaaaaatagcactgacactgaaagggggtgatggtcattcaaacattcttaaatccttgtatagcttgaaaagatgggtacacatctctattaatcatagatttcattagtaataaatggtaaggtataagggtaactagtaggagaatacaaattgagtgtagattttccaaaaaagtagaggaaaaaaatggaataacaaaagaaaacctaaagaacagcaagaatgagttttaaagaatagaatacaaggactaagaaaaagcacaaataatatagaaaaaaattcaaattaagttgtcctcagtttaaaatagcctgttacaaaatgttgtatataagcttcacagttccacaaagcaaaaacctatagcagccataaaaaataaaaactaagcacaccaataaaaattaacgtaatagcagagaaagaaagaaaaagaggaagaaaggaacaaaagttctataaaacaaccagaaaacaattgttttaaatgacagtagtttttatctatcaataagtattttgaattgaaatggattaaattatccaatgcaatcaaagcataccaataaaaattaacctaatagtagaggaagaaagaaaaagaggaagaaaggaacaaaagatctataaaacaaccagaaaataattgttttaaatgacaatagtaagtttttatctatcaataattattttgaatttaaatggattaaattatccaatcaaaggcataaagtagccgaaggaataaaccaaaagttaagtacatgcagcctacctaccacagactcacttcatctttgaggaaacacaggataaatattaaagatggaaaaatattttccacaaatataaatcaaaagacagcatagggagctaaatctataccaaataaaatagactttaagtcgaaaactgtaaaaagaagaaaaggttattctagtataaaaatggctcaattcatcaggagaatataacaattatatatatgtacccaaaatgaaagcatttaaacctataaagcaaatattaacagatttgaaggaaggtagattttaatacaatcatagtaggaaactggccaggcatggtgactcatgcctgcaatccaagcactttgggaggccgaggcgggctggatcacttgaggtcaggagttcaagaccagcctgaccaacacaatgaaaccccgtttctactaaacacaatacaaaaattcgccgggtgccactgtgctgtaatcccagctactcaggaagctgtggctggagaacctcttgaacctggaagccagaggttgcagtgaaccaagatcatgccactacactcaagcctgggtgacagagcaagactcagtctcaaacaaacaaacaaacaaataataatactactaggaaacttcaatacacattttcagcaatggacagacagatcatccagacagaaaatcaataatgaaacatccaaattaaagtatatgttaggtcaaatggatataaaagacatatatagaatgttccacccaactgcagcagaatacacatttttctcaagaattaatgaaatattctgctggacagatcatatgttacgtcccaaaagaagtcttcagagatgttcaaaatttaaaatcatttcaagttcttttcctgaccacagtggtatgactagaaatcaataacaggagaaatcctggaaaattcacaagtatgtggaaattaaacaacatgctcccgaacaaccagtgggtcaaataaaaaactaaaaggcaaattttaaaatatcttgagacttacaaaaaatggaaacacaacatacaaaaacttctgggatgctgcaatagcagttctaaaagggatgtttatagcaataaaggctgacatcaaacaagaagaaagatctcaaataacctgacattatacctaaagaatccagggggaaaaaaaatcaaactaagcccaaagttaaagaaggaaggaaataaaagtcagagaagaaataaatgaaaaagagaccagaaaaataatagagaagatcaaataaaccaagaattggttttttgaaaagataaacaaaactgacaaacatttagctaggttaacaaagaaaaaaagaaagaggactcaaataaaatcagaagtgacagaggaatcacacttaacaactgataccacagaaatacaaaggatcatagagtctactatgaacaattatacactaacaaattgaacaactaagaagaaacaaattcctagcagcatacatgtcccaagactaaatcatgaggaaagagaaaatctgagcagaccaataataagaagattgaatcagcaattaaacatttttcatcaaaaaaaaaaaaaaaaaaaaaagcccaggacctgatggtttcactggtgaattctaccaaagatttaaagaattcacactagttcctcttaaactcttccaaaacactgaattggagagaacacttccaaactcattttatacagcaatcactacccagatatgaaaaccaaacaaggatactgcaagaaaagaaaattacagacaaatatccctgaggaacatagatgcaaaaatccttaccaaatactagcaaaccaaattcaatggcacattaaaaagatcatataccagaaatccctgatgaacctagatgcaaaaatccttaacaaatactagcaaaccaaatccaacagcacattaaaacagcacatatatcacaatcaagtaaaatttatccctaggatgcaacaatggctcaacatacacaaatcaataaatgtgatataccacattaacaacctgaaagacaaaaatcatataattctttcatagatgcaaaaatgaagcatttgacgaaattcaacatcctttcatggtaaaaatgctcaacaaattaggtatagatgataataaaggccttaaatgacaaactcacagctaatattatactcaacagtgaaaagctgagagcttatcctttagaaacaagagaaagatgcccactcttgctgcttctattctatttttataagggtgtgctatttagtgtattgtggctctgacataaggatggacagaatggcaatgccagagacagacccagtactatatggaaagatggtgagctgtgtcaattagagggaaaaaatggtcctggggcaactaattacccatctgaggaaatcatcagtttgaaacccactctcaatccaaaacaattccagatgaattaaattcttttttgtttttattttttttatttttttttttattattatcatacttttaagttttagggtacatgtgcacaatgtgcaggttagttacatatgtatacatgtgacatgctggtgcgctgcacccactaactcgtcatctagcattaggtatatctcccaatgctatccctcccccctccccccaccccacaacagtccccagagtgtgatgttccccttcctgtgtccatgggttctcattgttcaattcccacctatgagtgagaatatgcggtgtttggttttttgttcttgcgatactttactgagaatgatgatttccaatttcatccatgtccctacaaaggacatgaactcatcattttttatggctgcatagtatttcatggtgtatatgtgccacattttcttaatccactctatcattgttggacatttgggttggttccaagtctttgctattgtcaataatgctgcaataaacatacgtgtgcatgtgtctttatagcagcatgatttatagtcctttgggtatatacctagtaatgggatggctgggtcaaatggtatttctagttctagatccctgaggaatcgccacactgacttccacaatggttgaactagtttacagtcccaccaacagtgtagaagtgttcctatttctccacatcctctccagcacctgttgtttcctgactttttaatgattgccattctaactggtgtgagatggtatctcattgtggttttgatttgcatttttctgatggcaagtgatggtgagcattttttcatgtgttttttggctgcataaatgtcttcttttgagaagtgtctgttcatgtcctttgcccactttttgatggggttgtttgtttttttcttgtaaatttgtttgagttcattgcagattctggatattagccctttgtcagatgagtaggttgtgaaaattttctcccattttgtaggttgcctgttcactctgatagtagtttgttttgctgtgcagaagctctttagtttaattagatcccatttgtcaattttggcttttgttgccattgcttttggtgttttagacacgaagtccttgcccatgcctatgtcctgaatggtaatgcctaggttttcttctagggtttttatggttttagatctaaagtttaagtctttaatccatcttgaattgatttttgtataaggtgtaaggaagggttccagtttcagcttcctacatatggctagccagttttcccagcaccatttattaaatagggaatcctttccccattgcttgtttttctcaggtttatcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggctatgtgggctcttttttggttccatatgaactttaaagtagctttttccaattctgtgaagaaagtcattggtagcttgatggggatggcattgaatctgtaaattaccttgtgcagtatggccattttcacgatattgattcttcccacccatgagcatggaatgttcttccatttgtttgtatcctcttttatttccttgagcagtcgtctgtagttctccttgaagaggtccttcacatcccttgtaagttggattcctaggtattttattctcttggaagcaattgtgaatgggagttcactcatgatttggctctctgtttgtctgttgttggtgtataagaatgcttgtgatttttgtacactgattttgtatcctgagactttgttgaagttgcttatcagcttaaggagattttgggctgagacagtggggttttctagatatacaatcatgtcgtctgcaaacagggacaatttgacttcctcttttcctaattgaataccctttatttccttctcttgcctaattgccctggccagaacttccaacactatgttgaataggactggtgagagagggcatccctgtcttgtgccagttttcaaagggaatgcttccagtttttgcccattcagtatgatattggctgtgggtttgtcatagatagctcttattattttgaaatatgtcccatcaatacttaatttattgagagtttttagcatgaagggttgttgaattttgtcaaaggccttttctgcaactattgagataatcatgtggtttttgtctttggttctgtttacatgctggattacatttattgatttgcatatattgaaccagccttgcatcccagggatgaagcccacttgatcatggtggataagctttttgatgtgctgctggattcgatttgccagtattttattgaggatttttgcatcaatgttcatcaaggatattggtctaaaattctcttttttggttatgtctctgcccagcttgaattaaatttaaagtgaaaagcaaaattttaaaactttcaggaaaaaagtttcaccctaccttacagtagggtgagattatttttaaaaacacgacacaaaatgtaaactatgaaagatgataataaattctactacataccagtttaaagagtgaaaagacaaaccagagacaacagaaggctacttacactaataaatgactatttgcaaactcccattactaaaaagtgaaaaacaaataacataatagaaaattttaaatagtctataaaaaataaaaaggtgatcaatctcattagcaatttggtaaatgcaatttaattatgaaataccattatatataactactaacttctaaaaaaattaaagctgtccaatactaaccttggatgaccctgtgaatcaatccaagctctcaacaattattagtaattattaggagtgcggaaaatggtgcaccaactttagaaaagtttttccaaatgttttcttacgtttttttttgttagtttttttttgttgttgttgtttttaactaacaatcttacttgtatatgtttccaacatttacaaattaaattatcggtattttcataccctatagcccagagttcttttctgaagaagctttcatgtatatgtatcaggggccatgcatgagaatgttttctactgtttataaagactagaagcaaacaaataccaatcaaaaacagaatggataaatcaaatgaggcatatttgattcaatacagtttaacactgaaaatgaataagccacaggaaatagcttcagcaaggactgacctaaaaaaaatatttagcaaataaaatccacaaagaatacattcagtatgactcaactgtacataattcaactataagcaaaactaaaaatatatggcttatgggtaccaacacaggtggtaaaagtataagaaaaaacagggcaaaattaagccaaaattcaggaacctctttgggtggactggttgtgagactggcaaggggcacaccacccctaaattacctgcaatgttttattttttcagctgggaagtgggtgcattgttttcacttaggttcttaagtttaagtggtagatcattgggtcttacatattccataacaaaatttttttaaattacaaagagaaataaacaagaaggactcagctgcacttcttgatgacatgccctttctttagacaccctgggaaaactcaattattgtacatcaacagcttttgcctgaaagtagaaagcctagaaaggagataattgcctctccactatctgtgattgggaaactatagcccgctgggaaaacccaggtgcgcagtgatgccaagagatgtcctatttttttccaagttttaacacaagagaatggtgtttgcactcccttcgatttattctacttcaatgtacattttccagaaaaaaaaattgaaaaaaatcacaaaacatggctgttggaaaatttgcagttaactagttctctaatatgttgatgttttaacatgatgccttacttcacactgtaaaaaatgctggtctctaaaggacaggggaatgttgttatggaaagaaataatggaaaatccagtcttgctattttctaaaagcaaaggagcttcttcccagaagagcccagcaaatgtctcctgggtttcaactagttccagggccctgaaaccaggattgtggtcagacaactgagatatattaatgggcttaatctaggagccagatggatttgtcctctcccaaagtgcagaggtattaatatgttgctgaagttgtggaagctcaaaaaagctgggataaatttttttttttttttttttttgagacagagtctggctctgtcgcctaggctggaatgcagtggcacgatctcggctcactgcaagctctgcctcccggattcactccattctcctgcctcagcctcccaaatagctgggactacaggggcccgccaccacgcctggctaattttttgtatttttagtagagatggggtttcaccatgttagccaggatggtctcgatctcctgaccttgtgatctgcccgcctcagcctcccaaagtgctgggaattacaggcgtgagccccgcgatcggccaagctgggataacatttatcaaaagaaagaggcatggccaagggcggtggctcacgcctgtaatcccagcactttggggggccaaggtgggtggatcacctgaggtcaggagttcgagaccaggctggccaacatggtgaaactccatctctactaaaaatacaaaaatttagctgggtgtggtggtgggcacctgtaatcccagctactcagaagactgaggcaggagaatcacttgaacccggaggtggaggttgcagtgagctgagatagcgccattgcactccagcctgggcaacaagagcaaaacgctgtcaaaaaaaaaaaaaaagaaaaagaaaaagaaagaaagaaaagaaaagaaagaggcagatagatagaaaagaaaaaaaattgacaactactcatttttagggtttccataggctgtttctttctctcccatacctctcagagataattaaataatttcattattgtaagtccatgaagttgttcaaaatgagttagctgccaaaatttaaaatcatttaattaagatggctaaaagacagaaagaaaattttataaattggagtttgggatcctgaataatccaagctgattatctgccattgctagtgaaaaggcttttcttagaaattccatcaatatttctactaaaataatgccttaatttattttgggcagcactgggccaattatctccaggcatgtttttctccctatgcctgtcattttgtggcattacattaaattgtgtttaaaaatattccataaataatgaattattacaaaaataatttattactcacttaaaagctataaaatattaaatataaaacttaaggacaaagaagtaatttctaattcacattgcttacacaaaataataaggcctgcatcttctgttacactatggaaaagaaaatatttcacttatttcctttcaggctccaaagggcagaaagaagagtgaaaactctttaatcttcaacccccctggactagcaataactaataggaaccccctgaaagtgacatcaaaaaaagtccggaggccagagtgccagaacttctgccaagctaattattctcatggtattgaaaaatcactctcactcttgtgttgtaaaagtgggacaatcgcaatggacaattcctaatgttcttcgtggactggtagctcacatggggctttattactccccactggaacaataatgagagttcgtggtctcatggagaacctttccaccccagtcatagaagaatgaaataacttccttagtgaatttcttctatgtattctggttacccgttggtctaccatcattttatatctatggatacattaatgctatgaccacacaacacttttatgaattcgtattgggctacatattaacattgatatcacttaaaagatagtacagccatcagcactatgttctgtgctgaatttcccaccatttctctttcaccagtgtaaagaagtatacatttgtatctatagggaggtacaaacagtttggggctctggatccttagaaaaaaacaaacaaaaaaccacttctgtactttcttactggactacaaaattttctgcccatattatatctgatcaatcaaagaaatgaactaaattttttctcttgaatatctcattccctattactcataatagccacatgatatttactgttgcatatgattttctatgaatgtccttcagtcaaatagtccagttacttaaaatatagtaagcaagagaaaaagtcatttttgagggcacaattgtgttttctgaattacattaaaataatcatttagaaggaaatatgcctctagcaagtttgatcaagataaacacaaaatgctccatttcattgaaatttatattctctcaacactgaattttattatatttaaaagttttttagcatatataagtgtatagaaatcctagtatctatgttcacaaataaaatgtaattgaataataaatcaaaattaaacttttaataaatagtattatattccattagaagttgcaacgtattatctaaatgtaacaatgatttatttgtattaaggttcatgtgatgcaaacataagtcagattatagaaatctgaagttagatgtctctaagtcttccagaggaactttaaaacaatgccaagtatttgaaaaatattttgtaatatatgtcaggtgacacacttcccccatctttcctagaaaaagaaagaagaccagttgcaaaggctcacgtctgtaatctcagcactttgggaggccgaggtgggtggatcgcctgaggttagaagttcgagaccagcctgactaacatggagaaatactgtctctactaaaaatacaaaattagccaagcatagtggcacatgcctgtaatcccagctacttgggaggctgaggcaggagaatcatgtgaacctgggaggtggaggaggttgggtgagctgagatcgcaccactgcactcctgcctgggcaacaagagcaaaactccatctcaaaaaaaagagaagaaatagtgtgcttttctataagtactttctctttttttgaagaatgcggaccaatgctgaacacggaatcaagcttgggataagaatagctagaggacaaaatgctggtgtgtgggttattatgcaagtaagatgccttggatctccgtctcatataaggtggaaactctccctccccaccctacatcttgccactctcatgaattccaggatagttggtagtttcctaatcaagagcttacttatcgaaaatactccatggcttttgtagaagcttctgtttgacaattcctcactacacattggttctttaccattacaaagcaccgcggaggtaagttcattatgcacagcagatgtgtagggcacatttgggataatggagaggggttagggcatggcaagcacagaaaacaacttgaaataagatactagatacaactgtgctgaaactccaccaaccagccccagcaagaagaatgtcattccggtgatgggtctccatagaacctatacattctaccacactagtgagtctcctctgtagtctgtagtcttccaccgtagacgacgttgcacaagttgctctctgaatttacaaatgccttttattttatgtgcagaacagctgtttctcttctgttgtgccctgctcttgctaaatatgcattttgaggaagaggcaatgttgaaagaagctaagaggggttgaaaattcatgtttcaaaccaaatggctcaagatggtgcacatctgtgttttcttctgaccaacttacatccctctttttccaataatggcaccccaattttgctttgagaagctatccacgccccttgaataatatgttggtggggttgttaaagagtttttctttcccaagccaagaaatgagcaaggctttgaaactatattctcttaataccttttcactaaaattttagtcttgaacagactgaaacaagcacataaaatgcccagaattcatcaccttaatggcatcttgaagacactatgtattaatttgttatagccagacctgcataaaggctctggtttacttgaaagtcaatgtctcagaattttcttcagtgctgtgagctatcctgtctcatcaataaatttctttattgcttatgtcatgcaccaccagtttctattgctgacaaccaaattaaactaacttatatcatggggatattttcctaacagagctccatctgctttgaaattaattgttgctactgagtatgtgaaataaaccattataaattgctttttatatgtcttcctaatatttgtttcataaaatttatttttaaaataactataaaattattttttcctgctgaagctatccttgaaaacttttaggaagaactctgaggcatgttctttcttacaattctcataatgcttatgaactaaggcagagatcaccaacattcttaacgtcaaaacattctaccattttactttctcaggtcattgcatttgaaaaggtccatacagatcatttaatccaaactcagcagcccaaaaggaattctttccatattatacctaacagatggttacctggtctctttttaaacacttgttagcaggaagctattcgtttatttgaccaacccattacaattttataagaatttatcatgagaatgttcatccttgtgttgaaaaagaatgtgacttccaaccttattctttctcccaatgtctcttttcctcttcatatgcatccaggaacttctgcctataaattttatttctgcataagtgatcactggcatctggctacccttcaaagattttaagatgactgtccaatttcatggaacatatccctgttctcctaaaagaattccaagcaaatcattgaaccatatgaaatctataggtcaaaatctataggttgttttgaaattttctgaaggattcttaaagtgattggagacacagggtgtcaaaaatcctaaatgatatttttaaaaaattagctctgaaaaaaacaagtaaggattagttgtttataaaatgttatggtggttcctttaaaacaatcatttcttaagagtcagtgcacttaagattatctgaaaacaagttatcacttcaggctctcaaacaaagttgcttcttttgtgcagcagcagattaaaggtggcgtccttcagcagcaaagtctatgctgaagaccactggaaatgctcctcctttttaggaacccttccctcagaaattgatgacaatcacaagaaaccacataccttggcagaacctgtaagtgctgaaaaagtaaaatgctttgaacatttgccaggatttattattcatcaataaaatatattatttgctaattcatgccccaaaataattattcatgtctttaaaattttcaaagtaataaccataatatgcagaaagttgattcagagttcagtaagattttttaaatgcctaccatatatgtctctgacaagaggctcctcataccttattactaatttgacatacattttatatacaaatagttttacactagatttttagagctccaatgagatgcttttgctttttttaaacagtctatgttgccatttcaaattggcacattttttcacctaatagagattcctaacaagtaatatttatctctgaatatgtcattacttcaaatattactctctcttatattaaggtaacagtacgcaatgttgtacaaatgctttttatgtacaagtactttgacactagattttatgtacaaaggctgtattttatgtacaaatacttttacgcattttatgtacaaatattttaacactaattttttagagctctatggagatacttttgctttttctaaatattgcatattgccatttcaatctggcacatattttcacctaatacagatttttaagaagtaatagtcttctaaattgtctctgatagttcttacttcaaatattactttctttcatattaaggtaacattattacaacgattattaatgtagggctaagagtaaaacagcttgaattttcctctaggctctgccatttctattcctttctgtaccttaatttcctcatctgtaaagatagccattctaccaacctcactgggatgttgtgaggatttagagttaattccttgtagagtacttagaacagtatatggcaaataataagtgctcagtaaaaattagtgtttcatacctacatttcagaattaaaactttattatcagaaaataaatgttttgctttatattattttaaagtagatgttactcaaattctcttaaagaagggtaaaagccccaaatttgagcaaaatatgtgattcatcctgtaaattagcatcttttgaaaactaagttaacttgttaaaagctattgttatttattgggagaatgtaaaaaataaaactcagctactaataatagcttccacttctcgaacaccttttatattactgggactttgtcaaggatcttatattatatcttgattaatctttccattagcattatataactgatattttcatttccattttgcagatgaggaaaccaaggattagataatacagtttgatggggtttaagacatgttagcccaaaaatatggcaccttgacattggagactatagcagaagcaggaaggtcattctcaccttcccctcaaatttggtcctaaaatccaggaaggatttttctgaccttcccttgaagtgggtcataagaccctcattctagagtggcttccatattcccagaagaaagcaaaatcctatctctgaagaaacaggatacagaggagaatctgaaccaactggccctgctaagttctccccagtttatttccattagatcacactccatttttccaatcacactccatgctgcctcttcatcaaacctagcatataaactcaacttgacatgactaccagaaatagctggaaagagaaagaaagaatacgacaattacaattgcaagtaatatgacaatatgaggtcttcaatgaacagacaggatagtctcaaactcctcagtaagttttatattttattactttcatgaacatgaatgaacaacacataacacagcacagtgccttgcacaaacattcaagaggtgcctagacagactaacaggacctttcaatgcattcaattccaacatttgttaattgcccctaagcatagtaactgaaaggaatagtaagataataaatgagttctcaccacagagagcttgcaatgcattcactcactcactctacacatatttatttacatccttacatgttgaaggtaatgggaaccaaacatgaatgagtcaagaatcatgcattgaagaaactcacagtatttcagaagaatttaggacacatatacacaagcaattagaatagaaaatagaaaaagtatttcctaagaacacagaggaaacagtgtttgagagattaaagatgggtacatggaaaaattgattatcattcttcagcctgcacagtgagatatacattttgtatacgttatatgcttcaaatgtttttaaataaatataatacatgggtagaatttataaacgtagagataagaaaaaaagctggttggtaattataaacagacaaacagcataagcacaacaatctgacagtcaactccaaaatatggaattacttggcccttttttagcactcttttctttgcctctcctatgtccacaccagaactgcaatttctagattgcagtacaatggtgaatggggatcataatcttcctgctagctgaccttcattttttgaatcctgcttccttttccaagtccattgatgaggtgaatgaagtccaagaatggctacgttttcagaatttacatgggtattttaagaaaacctcattccaaaacccaaatatgtccctgctttatctttatgagactacatatttcaacaggacacagtgttcatgaagtcattctattattaaatacatgtgttctatgttatgctgaaattgataacccactacatcacctcccaaagaaggttgtgtaaacttgtcacaaaaaagagaattatttctgtaatttttccattgagaaaaccaaggctgagaaaggttgtataacttatcatattggtaataaatagaataaagattcaaaaaaaaaaagaggttctaaaactgcactgcatatttggatgcaattttggtttacggttttaattcaggaaacaatatcaagacaataggaaggatgtttaaaacctacccacatatacttacttatttgtcactttgtttgtttctaggcactaactctgcttccttacaacatttcaagtacctcccaataccattgctctattatccaaatagagggttggcaaattgcttctgtaaaggaccagtacatgttttaggctttgcaggttatacaatctttaccacaattactcaactctgctggcatagcacaaaagcagtcataggcaatatggaaattagtgtggctatattccaataaaacttatgtatggacattaaaatttaaatttcatataattttcacaagtaacaatattattcttcttgtaacttttatcaaccatttataaacataaaaatcgttccaagtatacaggccttacaagaacaggtggtgggccagatttggcccatttgcttacctctgtcctaaatcataaccacgattcttagaaaattcttttttccaaaagcataagagcagatttttttaagtgtttacctacttttcttgctttttttcttgcaaaaggaagttacataggagcttgacacttcttagtaataaaatttacttttccgagcaccttatatcagtgatgcaaggtgaaaaacttaaccctttcgattcgacatgtagcttggcaccagactcactaactgcctaagttagttaactggattaactaaattagacagcttccccagtacagtgttttttgtcttctagctttgtgataactcattcgactttgaaatatcttagtagctggattggctaaatgttctgactcacaaaatattttagtttttagtaagtatctgttcaaagattcttcccaactgcagtcttctcctcaataacagtcatattaaatatgccctagtgcttatacgtgattgcctctgtttttttgtctgttttgttttgtttttactgctaaaagatttgatcagctaactcagtctcttactgagacttaatgtcatataatatggatgcttcaatattatacttattttaattttcctattgtgctcttttcaaaacactcatagatctatagtttctttttaagctctaatagaaatttctattcttgtccatgacactgggatgaaatttgagatactaatttccatgcacagaaccaacattaatgttctaatttgtaacataaattcaattcttgccaataatttgcatatttcagagagataacatacagacagatatagatacacatatagaaagataaaggcatttacacatatatggcaaggggatatacacaaagagagatagagaatgactagagttcacagagtacagctagacttcctgagttcaaatcccagctctgcttcttcctatctctgatctttaacaagtcatctaacaagtctgtctctgtttcttcctgtgaaatggagacagtaatggacatgcacgtcataggattgctgcgagaatgaagtgattaaagaatgcttactagtatagcatacattcaataagtgttggttattattatgatgcaccagctacctgcatttgtatttgactgatttacagtgaccagatctcaacttatactagcttgaggatttatttgttaccccaaatggcaagtccaaggattcaggcgatcctattttctggaggctcaatcagtggggccaagggctccacctgtcctgggttttccatcaggctcccaccatggcatggataaaatggtaagtggcaaccccagatccctatacaactgagcaatacctgttttttccatgtactctggcagaaagtagccaaggagaacactggcccagtgcaaagcatatgccaatctatgttggatagagaaggggagatgagtcaaccccacctaatgtattcacaaccaagaagatgagaaaagagatcctgggtagacaggaacaacagataagcaccgttattcacaattctctttatagacattaccctttgtttattctgcaggtgagccagtttggccttgtctctgttgcaaaatccacaggtcctgatgtttcagttcatcaccttctataaccaccaaagcggtagtaacagaagtaataccttttttccatacttgatctccattttataataaaagcaccctgacaatctcaggttagtaaaatgcaatagttgaaatacactcagtgctgcactttttacatgtcgctatcccctaggggtatttcaaaagaagaccagactagcccagtaattaaatgcccccaagcatacgtggtaaagccatgttatggcagatgtacttttaacatcacacaaggatgtctagcagcacctagtgaaaaaaaacacacattttcttgtttcaactctaccacttattttagaaactagacaaatcaagcactaagtttctatatttctgaaataaagtctgaaatatccacttaaccaattacgcaggaatattgtgaggggattaaatgaaatatcacacgcagaagtacttcatatgtgtaacgaaaatacttagcaatattatctgtaataattaaattgttttttgtttcctaatccttctcttaatcacaaaaatgatttctttctttagtctcaggtttcttttgtgctcttagaatagctgtcacttgacaccctgttgtcatcccttacacaaaatatttcacctttttttatcttttctgacactacatttactcactttctctgcaatttttatgctcatctctatgttctctctttccctgtctcatttccttctttgtctctctttgctcagttttatttttttaattggtcattatcccttcactagcaacaaaagcccgcctttcctttttcctgtgtggcagaaccattgcaacacgctggttggaatgttcagatcttgacttcatcttggctatttgactgtattctgtcaattcagaatcactgcagaggagcttctgagtctggcaccattctgaaggtttaacattgtgggaagtctcactccagataattaaaaaggttgaacttctcagcagctcagatatttgagtagcctctcaagttccacttaatgaattaattctctgtgcttcttgaaaaataaaccactcaccctgaaaagcccatggcaccacctgccttcagcataaggattcaacatatgtgggtgtttgggaggactgttttagactgaccttggaactggaaataagaggcagcagctgaaagcagacagaacacacagcttcataatcaggcagtgctgaggtcaaattctggctccgtcgctcacccagctgtgtgacctccagcaagttatttaggtgttctgagtgtcagatgactaattcataaaatggacacattaacacctttctcatggaaatttatgaagacaaaaagcactcaacaagcagaatccatcatcattctcattagcatttttgttatttaaaaaatctaaacattgctctaaaatatccataaaggcctaattctttcaacagatgttcttgatcatgatttttgttatttaaaaaatctaaacgttgctctaaaatatccctaagggcctaattctctcaagagaggttcttgatcatcaccgcaggtaaacattatgggttagatttcagatggcacccacctcgggagcacgattattgaactcaatccttaaattatttctggagaatatgagtataatccagaacatgcaatcaggttgtggctgggaaaatatgttcactctggtagcaagtatcacagggtgctaagaatacatgtgggttctaaaaatgaatgggacctaaggagatactgccacaagagaaaagggttactttgtgatatacatatatgtgtgtgtgtgtgtgtgtgtgtgtgtgtgtgttttcctctaaaaaatacattgtgaaataggtgattggcacatgccaaaccttagttgtatttttaccatttgttggaatcattccttctaagagaaacaaaataaaaggaatcactccgtctacctgccggtctcagttcatttgcaatgaaaatattcatttctaatgaatgcaatattttatgacatagaacaggattaattctgttgtgcaatcctgagactttactctgtattctaatccactctattcttttagctgtgcaaaaagaataggagagtgcttatggcaatatcaattatgcacatcttgaaagggggcattataaagagagaacattaaggtgaaccactgtgttagcacgtaattcctgtgataagtggctttttttctaatctaatggcatctctttctattataagagtggatctttgcaatctgcaaatcagtctggacatcagagaagaaagtcacctaaaaacaaaacaattattgaaattttgcctcatagagactgatcagcagcaaaaatcagctctaatcagtgtatgctcacatcgtcccagcagaaaaaaatcaatccaaaatattgatcatcatgttttattttgctgtcagagacaactagtaccagatacgacagtacttatacaaaatgatggcaataattacctgaatttatatccaatttagatcattattaaaattattttaacaatataaagaaagaatactagatgtgaaaattctaagggagtagatgctgctcttcaataatctttatgcacagcaaaagaattcagtaattcccaagttgataatactaaattaattacatattatcaaattttgataaatgtgtgtgtgtctgtgtgtctgtgtgtgtgtgtgttcctattcactacacaaataagacttaggccttcagggcataagtaatgtaaatgtaactataatggcaaagcttatttgctaaaaaagaaaaatgggcctagaacttacatatgctgaattccatccagtattcctacaacacatttcaactggtgaaaatagtaagtccaagacagagtaactgaaacagagttattttgtgagataaacagcaaaatctacaaacctcaaataactttaaaagctaaattaaaaaaaaaatttaaggacattatagagatctttatatttggtgctgtttaggacatataaaataatatcatcccgaccaccaataatacagatgaaagctatcagtcagggtcctcatacttcagcaactgagagacactaatgaaaaatgtatgttttattggttactaacctgggtgacacagtggccttgttgtagagccctacaaatattcaaatcaatgctatgatttgaatatttgtcgcctccaaaactcatgttgaaacttaattcctgggttaatggtttaatgggttttaatggcatgggaccagtggcttcataagaagaggaagagagaactaagctaacatgctcagcccctcaccgtgtgatgccctgtgtcacctcgggactctacagagagtccctaccagcaagaagtcccttcaaccttggacttttcaacctccataactgtaagaaataaattccttttctttataaactgcccagtttcaagtattttgttatgaaccacagaaaacaaaaaaagctcatttaatttcaattacatgattttttttcagttttaaacttttattgtagtacaaaataagattttttacatcagtttgatcccgataagatcatcttgaaactggagatggtcccattcacctcagctcactgactccacgctcaggcttgctgtggagctcatgccttttaacccaaacactacatattccctcattaaccgtgcactcaacatttgtgcaagattcaaaactgattgttaggcatgcataaataaagcagacaaagtctctaatcatcataaagcttagagtcttgcggggcagactaacacagaacataatgacataggaaaaaaaacactaaaagcactgtgaaagaacacgataacctagctgtggtaaagggaggagtaacactcaagtttctaaaacaatgtcaagaaaactgaaataaggttgaaatatgctgatatttttaactttcgatcccaccctagcagacagaagagagccacaggcattagtgcagggagggaggagaggagaggggttaagctagggttgagagtccctcaggaaggcattcaaatcccacttacacagatgagaaaaccaaggctcagaaaggctttctgaaaatccaacactgcatgttctcattcataagggggagctaaataatgtatacaggggagctaaataagggagagctaaataatgtggatgtagagtgtggaacaatcacactagagactaagaagggttggaggttggaaggggttgagggatgagaaattacttaatgggtacaatgtacattatgcaagtgatggtcactctaaaagcccagacttcccctaaagcaatagatccatgaagccaaactgcactttaccccttaattttatgcaagtgtttaaaaattaaaatgaaaaaaatacaaacacgggcttgtgtgattccatagcacatagctttatcccaaggtaagggggcacaccttaagacagcccccactttggtgaaggctgctagtttctgggaagctagcaaaacatttctccaaccaaattgcggaaaagctatatataccacgtacactaataataaaaaattgccaacatgaatctccaagctttagttttttaaattgtcagatgggtgcataggtgaaggagacaagaaacactggccaggggagactctcaagatactggaaccctcgtctcagttctgtcttaataaaatttttgcttttgagttaattgtttcatgcctatatgctgtctatggtaccctcttagtataagaagtctagacataaaaaacctctacaattcaattaatatgtgtgtgtgtgtgtgtgtgtgtgtgtgtgtgtgtgtgttcacagattatagagattcacagctgacaaaaaataacttctgggagataattttctagtgggaaagaaacatcaacaattcattacaaaccaataaggtcactgtcaagataagtgtgtggggacctccaaggaagctctctattttactaaagtccagagagtctgtcccgggaaggcttccagactgcagctcattggtttattcagccagtgtgtactgaatgctttttataagctttgtcctcattgaggttctggaaataaatattgtcaataaagcatggcccctgccttccatgaggcaactcacaatctctgctaaaccccagggaaagggtggttcagctactttttaggaagaattctggaagaactgagaatgtttacctcttctaacagtcttctctcattcacgtttaatttaattagaaatggtctaaattgaacttcggcagagcaaagcaacaaaacaacctgagaaactctatttgttaatagggtagatttaagtcgatgttctctaacacagtaaacataagcttaaatgttccctaattagagatagtgtgaacccagcagagaataccaagtcctatggggtgagcccacagagtcacatgtgctcagagtcacatcagtaactcagcatcatacatgacacattcaaactcactctgcatgcaactggtctgtagatttatttttatttactgattttctgcattttctattcatatttttaagtagaattctaacagttttactgtagacttttgccttacctcagttggtacacaattccaaaattcacctatctcactaaaacagtgaagaaccatgatttccttactgttacaattccccacaaaaaacaaaaatgaatcaggtcattgttacttaagtgataagtaccttagagaaagctttttaacatacaatcacagatcccttgttgaagaacacttttgctaacagttttgccttgctgaattaggaaaaaacattctttcaaggacagtagtaagattgaccaggtttctttgtactctctatatttgaagaaattgagccagttcagtccaagtcacttaaatcctgagtcttgattgcctaatttgtaaaactgttcagcttcctgccagactcatagggttgtagtggggagttcagtaacataaggcagcatttggaaagttgtaagaaaaaacaaaaatgattatgaagtcactttaaaatatagggctctaatattttactgtcaatcactttcaaagcagtgggacattgtaggcaaaacaccggtctgggaaatgaaagacccaggagaactaagttttcatctgggtttatcagtggctgattgacctttgaataagtcatataatattttctgagcttgtttcttcctacttattagagaaactgactatattatttttaagtcccttttcatttatagaaatcagtgtttccatgatcatttgttaattcaattaacattttctgagcaccctcatgacccaatcacttcctaaaacctcacttcctatcacattacttattagggttcaacacatgaattggaaggatacaacagaaacattcagatcatgcaaaagttacacatcagaatctgaccagaatcaagaaaacattattaatccaccaggccataaacataggggaatatctgagaaaagctatctgtctagggtatccataagaaaacaaggttaagcatgaagataacaaaccttcaaggtaagaactagctgggctgccacaggcaagtcacttaacctccctggacctcagtttattcatctgtcaaataaagagtttggggtcatgtgccatccatggtcctttgaatagcatctaatgttgtcattaagtgctgctctgtgcaaggccttgagacgatagaagaaccatatgacccgggaatggtaataagttcagtgatcacacagcctaggttgctcagggcagtgtctatttatgcctgttgtcctcagtaactgttcatagccccaatagcactctgtcttcccaagtttcactctccaaagtgttccagtttgagtgcccacatataaccatcaccctagtaatcaggcatatacgcacaagctgataaggcaagatgataaaacggtaagtatcaagaaagggacagacataactgctcctgcactcagcagtgcaaaaattaacaatctgtttactggattttctaaggcttcatgaaggagttgagacagaatttaaacctacaagatgagatagctaaatggaggggattcggtacaacatatacaattatgttgaatgtcaaactgcttctcatcccacatattaattgcagagcagagtttttacttttttttccatcaatgttatatttaacttaatcatccccaaatctacattggtcttctccccttttgagtgtttatgaccccaattgcttaaattccccccagtgtacaggtgaagaatgacaaaggcattgcctatcctgtgtgaatctagtaaacctctgtctaccagactttgataattgtctgggctctacccttggcacaccattctttgtactctacatttgctctttgagaaataccagtcatctctaatgtttgctagaattgactcctaaaccatattctaagcgattgtgttgagccttgacatctcttttggaaaccaggcccttctttccaacaactggacatggccacttggatctccctatttcttctttggactctgaagctcaccctctctaagagtgctaatacaacatttgttctatttcatttctattagatacttaaatgtgtatctgccttgagagtttggactgtgttttaatcaatattggatcattagggccttttcttgtatctgacagtttccaatgaatactattgaatggaaatggctgttgattttcattccctgctctatcatttgcccctgccaactcttcttattcttgtctttgactagagatgacagatactcccaggattttaaaggtcatttaaacatcgtctttaagcaacagacagaatcttccccctacagggagttcaatggagagccgtctattgttcaattttcggtatcaagctaactcagaaagggaagaatcacccctgtatctccgctttcccatttttctagcatgacagtctacataagagtttttagtttatgactttgtctctctcagtcttctctcctgccagtgactgcagtctgacctccgttagcttttcttcaatctgttttacaaaatcactctggcattctattttcatctttgttttccagtgtctaaaccgctgaagctgtgacctttcaagcaaatgtagcaatggtaccagcgcatcctctgattgaaaaataaaaagtgagcccataggtagtataattattctgtgtgtgcaggagtggtgtctgcacttgcagaaggcagataattggatttcagattattgttaaaaatatgcacattccacctgagccctagcagtttcttttttctgggaccctagagaaacttgaaacttccattcttctataagttcttatccatatacaattggcttctgggtcctacctgttctatcccctggaagtcgctagcccactctttattcttcattttttctgtctccagaatgctttctactgctccagtactcgccaccattataatccatctggacagtctgaaactatcttcttgtttgcacccttgcccttcttccctccatcttccacacacttcctagaattaccacaagattctatctagttgggcttttccttcaaacttgtcaatgaaaccttttagcccacatacagtcttttaaaatttaaatcaattaacaacattgaaaaatcagaatatgtctgttaaaatgagagtttttacttaacagttctagcagttctaggccaccattcctatacagtcacaattagctggagctgactagtagctgcctcataaggaaaggacagaagctgttcctgttgccatggtctgtccccctcactattgttaacattttgacatcaccttgggtggggtcatttatcatggtgctgatatatcaccagaagacttcactcatttacaggctggctggttcctggagaccgtgtggactctactctatatcttattagatgtagggatgccagaataataactaataagtactcagagctacatttgagggataatcccaaatggggattaaatttatttgagggttcctgtagatgaatataaagttgtgagtggctctctttacagaaattttagtaaacatcttattgatgccagtggcagcccatctggagtggctgctgccatgatgccgcatgcggcgggagaggactggccggggctgccaccatggagtcagcaaaagccaggaacaggcggaagctccacccccttctgagttggcagggcaggagccttgcactccccaggtgcagctgtggcacccagctgtggctgcagacctgggcatgcctgtgcacttgggggctggaagtaggcaggagccccaccttcccgggcacacctacagctgcccaatctgtggctgtaaatctgagcatctctgcactctcaggagccctggaagccctccccttccactgcctggcctcttcctactccaagcacttgagggtgcctgctccttctgcctggcctttccccactccaagcgcccactccaatctcagagcaaagtggaggctgagcctgagtgctgtcacaacctggctaggtatgtgcactcttggggcagcactgacacaccagccccctgctgccttggactcctccagactttgggcaccgaggagcatgggatggaggccaagggcagctcagagctggcctgctggcaccactcagcacaaacagtcttggcatcatgaacagtggcaggaggcagataggctcctgggtggaaagacacaggtgcctggtgaagccccaccttcaagtggggaaaggcctgaagcctgggggcaaggctaccagttctgcagagtgggaacttatgttttttctgggcctacccatggccttacatgaaccaatcagcatacacttcctctcctttgaagtccatacaaaccccagaactcagccagattcaaaaagagatgacatgaccaccagctgcagaaaggagctacctacccccagggtctcctctctgctgagaactaaaaagagatcacaagatgatcagctgtggaaaggagctatgcatgccagggtctcctctgctgagagctgaaaagagatgacaggaccaccagctgtggagaggagctacccacaccagggtctcctctctgctgagagctgagaagatgatggaatgaccagttgtagacaggagctacccaccagggttttctctctgctgagaggtgagaagacaatggaaaaatggacctgtggagaggagctaaccactccagggtcacctctctgctgacagctgaacactcgtcaggacaccctgcctgaggaaaggagctacccactgtgggtctcctctgagctgttttataactcaataaagctcctctttgccttgctcactctccacttgtttgcatacttcattcttcctggctgcaggacaagaactcaggttctgctgaatggcagggctgaaagagctgtaacacaaaaagggctgaaacaacccccttgctcgccacattgcaggcaacagggagagaagggcagtggcccttcagggagcccagacttagctcccaagccagggctgtgacaccctctttggggttctgcagtttctggtctctccaagcttctgaatgccaccacattccccagtgccagctgtggaagctgcttgctgtacacctggtccagcagcagcctcacagggaggtggcacccgtgatggtgcctggagctgcccaccccaccgcagccagcatgcttggctgcgcacagtggctggaccccatgctcactcactcacacaaccctcaccacttcagtcacccttggcagatatgggatccaggctggtagcatgagctgagctcagcctgccaggtcaagagggcccagtgggcaagagcaaaactcaggcaaaggcgccactggccacagaagtttccagctggtgaagtgacaccccaaggatctcataacattatcaagttttgtcacggtcacttctataattggatattttcagtgtgaaagagaacaaagaagaaaaatggctaggaaaaagtttaatttcttgatagctctaagaagtgcttttcttgtcattttctggattgattactagcacaagataaaatgaaagtgtctcagctttctctgaaatgaaatttagcttaaaactctagtggcccaatttctgcctcatttcattccctaactctccatggagtttacatagaaattatggttatgcgatgaagaattcaactcaaaaggttcactgtaatattacaataaaaattacttttacaagcacattggcatttttaatatatttagtttataataaggtaccaccaaaataaagttaaaagcaaggtaacttgccatcactcctaattgtgtgtgctttttagacaaaattttaacacagcttaaaaattttctcataaatcaaaatcaattaatttcctttttaacagtatttaggaaatcctactgattactgttttaagacaacttattttcctaaagttattgtggctgttagctgaaaccacagtatcctaagatatactcatatagagtattaattgtttatagttcttaggctccaaatttagaaaacacaggaaatttagaaaaacaaacatgatgttataataaaactgtgtgggagtaaagaagagatgggaatctataggattatccaaccctcaaagcaaaatcagacacaaggaagatcctcgaaatcactgctcttagataagggaattttatcagacataggacataagaccaaaaagagtaactgtgagtaacaaacttcagccaaacataaataaacaatcttccagcaacttgccacaagttgctgaactagtcatccctatgcacacttggcaaagggcaagacatttccagattttttgtggaagcaggcagaatggtcgagagagacagacacttgacttcccttcatcgctgtcctgctatccttttgaggaccctttcacctggcttaactggcctgtaaggtattgttagactaaccacttcttaagaatagtgctctcgggtggatcacgaggtcaggagatcgagaccatcctggctaacacggagaaaccccgtctctactaaaaatacaaaaaaaaaaaaattagccggaaaaattagccgggcgtggtggtgggtgcctgtagtcccagctattcgggaggctgaggcaggagaatggcatgaacctgggaggcggagcttgcagtgagccgagatcgcgccactgcacttcagcctgggcgacagagcaagactccatttcaaaaaaaaaaaaggaatagtgctctcatttacctaaagaatcatgtcaaatggtctacttctgcaactagagagtacagctatcaattagtgtctgaatggagtttaaaaaattgattcagaagggagtggcggctcatgcctgtaatcccagcactttgggaagctgaggtgagaagatcgcttgagcccgggagttggagactagccaggcaacagagtgagacttatctctacaaataataacaattacaaaaactagctggtgatgctggtgcatgcctgtagtcccagctactcactacttgggaggctgaggtggaaggattgcttgagccctggaggtctaggctgtaatgagctgtgatggtgccactgcactccaggctggacaactgagagagacgctatctaaaaaacatcaactgattcaaaagggtattgaaccaaacataatttttaaatgcatgtatttatgatcaaggagaagatttgtcaataatttttgttttgttttgtttttttgagatgaagtctcactctgtcgcccaggctggagtgcagtggcacaatctcagctcactgcaacttctgcctcctgggttcaagcaattcttgtgcctcagcctcccaagtagctgagattacaggcatgtgccaccacacccggctgatttttgtatttttagtagagacagggtttcactatgttagccaggctggtctcgaactcctgacctcaagtgatccgcctgcctcagcctcccaaagtgctgggattacagacatgagccactgtgcctggccagatttgtcaagaatttagaagagtttaaaatgtttcatatttgagatgactataattttaaatgttatgacttttttcccatttttgctaaaagaatataattattttatctcacctaaatatgcttaaaaagaaatttgatacttgaacagtggaatttgaattctgagatctcttaaaacacttttaagataattggcttatcattagactcagatttctactgatactaaaaaaaaaaaatcagatataacattttgtttttaaaggacatttagagcccagatctcaacatggatgcttgtatacacaattgaagttatacacatagcctatgtagttgtatagatatacacgtgacataactatggctccaataatgtgctagtgtcacagtctacaaatattcattcttttattttgctaaatcttgaaactgattaatttcttcccttatagaaaattctgaaatttttttcttacccccaaaactgcctgttcctcccacccagtcaacagccactccattcaaaaactctcagtgctacaaatggcaactatattttccagagcagaacaaactattcaagaatatcaaaaatggggcagttgtcagatgtacatagatattaaagattgagtattttgtcatcaattattcaaggtgtaacatcctagaacttaactcatctcttcaataatttcacatgctcattctagcaaggcttttcatatttcaaatattacaaagtataacttatttccttaaagatgtttttcaagtataaccacacaatgggagttaacagaactcactggtttcaagggatatgaattttttggtaaatttatataataattcaatttaaaaagtcaaattaaaccttggagtcatctttgtgtgctctttaccactctgcatccaatctattaggaaatttcttcagctcaagctttaaaaatattcccaactttgggaggccaaggcaggtggatcacctgaagtcaggagttcgaaacctgcctggccaacatggtgaaaccccatctctattaaaaatacaaaaattagctaggcatggtggtttgttccttaaacccagctgcttgggaggctcaggcaggagaatcacttaagccgggacacaggaggcggaggttacagtgaaccgagatcatgccactgcactccagcctgggcgacagagtgagactccgtctcaaaaaaaaaaaaaaaaaaaatcccagcatctactttcactgctggcaccactattaaattgagtccatagcctctgtctcacacctggactcacacagtggccaccgaccattgttctttcttccaactattgttcttccttgattgacaaacatagccccagcaaacgcgggtcaggtcatgtcacttttctgctcaagaagtctttataacttatctcactcagagtaaaaccccatcttaaccacagcatgcttgatctggcccctatgctatgtcttctctcttttcctctcactgcctcccaccctcctccaagcctccttaaacatcttgctgctccttcactacagccagggataattccacctctgagcttttcatctgttcttccctttgctctgaagtctcctccccaagaagtagcctggaccatactctcacatcatccaggaccaaatatcacctcatcagcaaggtggccttgctggccatctaatctaaatttgcccctttcccatcactcactgttactttaggctgctttactttgtttctcagaaggaggtcagcatctatctagttagcatgcttagtgtccatccataggcaacagaaacagagggagaccacaggcaggacctcatcaattcttcaacaaatattgttatttatttcctcgtgccaggcatagtcctagatgctgacaatataactcagaataaaataaaattctctgttctaagggagcttaagttctcatcaaaagagataagaatacataagtaaaatacaatcaaatgatggtaactgccacaaagataaaaaggcaggaaaggagaatagggaatgctgatgggtaaaagcacagcagaggggtggtagttttcagtatagcagacacacaaagcttcatcgagaaagtgacatttaagtaagggaagggctgtatttgtcttgatcactgatgattcccagccagatggtaggtgttcaataaatatttgttaaatgaatacgtaaacagaattaaggggcccagcgtggtggctcacgcctgtaatcccagcactttgggaggctgaggtgggcagatcacgaggtcaggagatcgagaccacggtgaaaccctgtctctactaaaaatacaaaaaattagccgggcgtggtggcaggcacctgtagtcccagctactcgggaggctgaggcaggagaatggcgtgaacccgggaggcggagcttgcagtgagcccagatcgcgccactgcactccagcctgggtgaccgagtgagactccgtctcaaaaaaagaaaaaaaaagaattaaggtagaattctcaaacattcaccttaagtgattttttttcccatactttggtactgttaataccaccagtttcatcatcatcgccaacaataagggcaaaaaaattaagtgttcatactactatttttgctgatgtggcaaaaaacaaaaaaactgttattctatgaagtcgttattcttcatcaaaagcaatccagaattatttcaggtaattcctaggcagcttttggtaagtgtgttatccatatatatggctaataaattccacggattgaattttttttttttttttggcagatggtctatttagaaggaggtcagcagatagaaatagacagaaaaaactattttaaaaattcctggatgaagtagatagcaacagcattctgcttcctggcctgtgggagtgagtatgtcacataaacctgaactgtcaaatatgtactatcccctctcaatttgtaggtaaggggatggcttcattaaccgagtaaggacaatcagtgccctgccgctatttttgatagatagatggggagggggaaggtattgcttctcttttctgaggaaggaagagaggcacagaacaaataggacaatgctagaatccgtcttacccaatgcatgaagagaatgaggccagacccaaagcaaggcagtgacacacagggcttagagcaggagaagaaatggagaaacaaaaagtagaaaggagaaaaaagggaaaaagaaccttcatgatcttgcttgagctcctagatccaaccatacctgcaactatccccacagatccatttcctctattagctgtgaaagttgaaattggtctctgagctttgtcactaaagctggcctatgaacatatttacaaaataaaggattatctattatatgtgaagaggctaaggtgtctcggttttccttggcaaatgcaaatattaaacaacctacaattataatttgctttaacacaaaaacaattagtctttgattttcctgtaatatactaatgaagacctgaagtaatgtttttccacggtagaaatgtaataattctatgaaactctgatgaatagtgactttgttacatgactagcatcagattaatatttccacattcccatgaactcattgtcataatataataatccaaagatgggttatagttttcagcacactttctcactatgagatggctaaactgcttaaattccatttttgctgcgtcttagttaatttccatggataatactgcaatatattctgcataaacccaaaatattctcaaacgtttataagcaagggaaacacaataggtaacatagattattttatttattatcaaggatattcacaagatcacattttattttgtctcatactgatacaaacatgcttctccataacaaccaggtttttaggaccatttcatttttgcatgtgtgctttaagaaaactggattggacatgataatgccctatatgaaaaagcaatgagaagatgttcatttgtgtgactcatcaaaactgccagactgaaaaatctcaggattcctccagttattagatatctgtcatacatgttcagtcctgggattccagaaaataaaaggattagaacaaggtatatatttttcaattgatgagggataagaaatatttccttccctctctcatacatctacttttatccacatgtctggtatcgagaaaagggtgccagggctagaatttagatttgtcaaaaagaaagagctcccagaatccctcatagtgaacaccagatccttatgcaaaactccaaagtcccatgaagactggttgacaaaagcaattttaattaccttccagtgaaataaaagagagaaagaatgctgggtaataggcataaatgcggaaaattgggtttcctaccagacatatgcagaagcagcaagcaactcagttcagcacatgccacatgctgatgatctggacattgacaagatgatgctgaaataaactagatgactgaaataaagttaaaaagaaatatcaccacttagtgatggaactccatgcatggtcccaaggagctataagagaatattgcctctctttttttttctgctgtttcatacttgaagaatttaagtcaaattttaaaaaaaagctaattgatgagaagagagaaaaaaatcctaaataacaaataactttcttttcaagatgataatttatctgtttgacttctgaaagatagatccccataggaagcaaaagatgattcagtggttcactcaccattcatgatcacttccatcatcaataaaaacaaacacaaacaaacaaaaaaaaaaagaagaaataagtgggtgaggaagggaggaagaaaggaaaggaggaaggggaaaggaaaggatagaacaagacaggataggacaagagagaaaaggaaaggaaaggaaaaaggaaaagtacaaggaaaaagaaatcagcctgactcataatgttgtactgatttctgaatttcacatcaaaatatgacaaatgagactcttttttaatttttattttatttatttgtttatttttttgagatggagtttcgctcttgttgcccaggctggagtgcaatggtgtgatctcggctcactgcaacctccgcctcccgggttcagtgattttcctgcctcagcctctggagtcgctgggattacaggcatgcgccaccatgcccagctaatttttgtattattagtagagatgaggttttaccatgttggccaggctggtcttgaacttctgacctcaggtgatctacctgccttggtctcccgaagtgctgggattacaggcatgagccaccatttgtaggtgcctggccaacaaatgagactcctttaaaacaactagaaaggtttcaatcatacatttgccaccatatatatatatatggtgtctcatatatatatatggtggcaaatgtatgctatatatatattatatatatggcatctatctatgaagtgactttgatgaacttaataaaaaataaatctcaatacaaaaataaatgcaacaagactagaagagttatttcagaaatgattgccacggctgcactgtggatttaaataaagcttgcagagttgcattcctatggcttggtaattaaaataattcattttttctaaatgttataaaaacatacagataatcagcagcttaaattgaaattggtgcaaacactgagactttgcacatcttctctggattcaggcaaatcacagcaagtcttctccatttgcacaactaactgaaatttgttatgtaaaattgccttctccacttctctgaggaggaccagggtcaagctctgtttattcaggggaaaaagcagaaagcagctccactaccataaataaacctgttgtcttttgccataatatctgtagggagttgctgctcccattcataggacaggcgccccaaatgaggtacagtctggccatgaaatgtagaaggaattagtaaagacagtctcttctgattttctgatttttaggaatctacacttaaagagtaggaatggtcacgtgcataatgcatacaagacactagaagagaaaggaaaagcaggtataaagtatgctgtccttatccatgcacatcgacaatgacaacaaagtacttggtccataaatactggtcaaactgtatttctgtttcagaaaaatgtaaaactctcaatctaattccacacctattcaaagtgaattccatagttcagcctggatttttttttttttttttttttttttgagatggagtctcgctctgtcgcccaggctggagtgcactggtgctatctctcagctcactgcaagctccgcctcccaggttcacgccattctcctgcctcagcctccccagtagctgggactacaggtgcccgccaccatgctcagctaattttttgtatttttagtagagacagggtttcaccatgttagccaggatggtctcgatctcctgaccttgtgatccaatggcctcggcttcccaaagtgctgggattacaggcgtgagccaccacgcccggccagctcagcctggaattctaatgcttcaactttagtgttaatttgtatcagaattaaatttaagtatgtgtctttcttgctaaattgtattaaaaattgtactctaaaccaagatctgcctccatgacatattgcaaatactagaggtgcaataaactgttgaatttaatgtaatgaattcagtgcaacaatttgaaggaaaggttcatttaagtaaatcacccaatgtagaagtagaaatgagtctcacttttcataaaaaaatttaccagagggggtggggtgctgtagaaagcaagtataccaactttctgctcataaagtcttgatatgaattactagagtcagagttagtttgcaaattctctactactacattctctgtctctggagtccaaaacgtgcacaatactggacagcagcttctacagaccagtagcgttcttccagttccttaaaacagatcacactagaggttaggacaggattgacttctgcagggcaaaggatcactgatgaagctagtcactgagttttctcaagacagaaagcagagatgctggagcatcccatagcacaagccacaaccaggccaaaacctctacatggaaaaacggttctcaccaaatcaattgagcaagtgagaatcctctaaaccacagaaacaatagttacaggaatccctcaaatttaataacatattctaaataaatcttttcatcaatatcaatcttcttaatctttttagagccatgttttcatcacagtgagccaataaaacaaaagcatttgtaccttctaatttacagagatggtcttttttaaaaagatgtccaaatgatcttcaagaatcctttcgggtcattctagtgcaccctatatttttgtcagttaccttagttttaaaatcatccttcactgtaataacaaaaaaaagaatgagaattccttatctagccaaaaatatttgccgacctagaagtcttgcttgaattgctcctagtataaccagagggcaagggataattaatcttttcagtctctgaaatcctatggatagcattttcatgtgtattcagtaacctaaactcacaaaggccaacatcagaacacattcattcctgaccaccattgacaaaatagcatagatattttattgaaagtttagggcttgagaacaataaaatgggattatcaaaaactgtactatttccaataacccaaagttattttatcaaggggatgtacacattacgcattttatatgtgtatattgtaccccataaatatgtacaacttttatctataataactaaaaattaaaatttaaaaaagaggttgtataggcttagagtggaacctgatagcctaaatgtatgactaagtctgctactgatcgctgctatgacaccgttttcaaaagacctaacttctacacctcttggtttctttatcagtaaaatagaagtaagaatagtagcaacctctagtatttgatagctaacactaaggtacttgaaagagtgtctggctcataggcacccagttaaatgctaactattgttactgaatctaattctatttcctcaaggaaacacagatgtgctgacatccttaaaacgtagtaattgactgtcgatttggagataatgagaatccatcctgaaacacatttcaggaaatacaatttagaaaacatttacaaaggcaggtggtatagaccatggggtggcttcatatcacgcctccagaacataatgccataaagaaaaaaacccattggaactgatctttctttgaccacatatttacacgacaggttgatagcaaaaggtgtttataaaataggctgacggcaacaggattatttgttaaaatgttctcactgggaaaaccagtagaagttccaaaataagcctgaggagaagcacctcttcactttctcagaacactgaaaaccctgtaacctaagttgaccctatctattccaatcttatggggtcatgggtttctttaatatccaagcaacttgaccccattctctatcctatttgcttgagggacgtcctgcactgctgctattatttttgagcatcctgggggagggagcctcgattttcttatcatttctaccccaattttctcctcccagctagatcctcattgctctgtacaccatcctgtggtcctcttatagctccttgactcagcccatgtgtggagtatggagaactccttttcctttattctccagagcacatcctctacccagtaggctcctagaaggttgagaatgacacctgaggtagaatccaaaacaaaaccgaatctaaattgcattatttgacacttttaagtttctgggccttcctgtcttcaaggttttctttcttactattcattctcctcctaggtctcaacctgggccacgatccttctaaaaacctttcaagtcccctatttcttcccaaattccagggccccagactttgttgaacagccagggtcaacctaaattccctgttcctgtattatgcaaaacaattcttttcgttctctcttatgttttcacttttaggaattttttttcctttagggcttacgcttaatatctctctctcttgctcttcccccccaccgccacatagagagataaggagatagatagatagatagatagatagatagatagatagatagatagatagatagatagacagacagacagatagatagatatagatctatagataggtatatcgcatacacacatacaacacacatacaacacacatacaagcctgatgcctggcttaggcaatgaggtgtctgagagataaccagccagtctaaacgcatttaaatttaacacatgaaatacctgcatattctgtcatagtaaataagtgggctttttagtcagcaaaatctggctggatcacatcccaggactgtcttataccatctgtgtatctgcggcaaggtaagtaagattaggaggccatactagctgttccctttgtaagaagcccagtggactctaggtcccttgcaacttagcgtcaccttagtgtgtcagcatctgttttgcaaggtaaagagtttgcaaggtaaactcttttgcattcctatacgataccaccagaccgccagatggttacatgttctcaatacctagtaaggcctagagaagggaacaaaagtcttttatttgtgatgtacctcccccaatctccagccgatcagcactgaaagcccaggaaactactagttataaatttctgccttgtgggggctagggatttctctagggtcccgtatgcacaactagactcagggtctagcttatagtaacctttatgtcataacagtaaaaaacacacccctaggtggagattttatatgctactgatacatgtgatgcatgttagaacatgtagatgctaagcaaatgctccaactgcaggtctgcttttgcatacttgacctcatcagtatgagtatgtatgaacagctcccataaaaagaattcctcttaaggcactatctgccatctctccctttgagcagcttgcttcgcctctcagagtatacttttgttttccaataagcttctttgtttactctgactttggactcgctctcaaattcttttgtgtggcaaagtcaagaacctgaaccagcccaccaacaacatattattggacaaggtaagatcttgggaacctttctgaaactcatttgctcatttatgatagagggagccatatttcaaatttgttgtcaggattaaacaagatgaggcacatgaagcaattaacatactacatggattagagttaagtattagtaataataaataatagctaactaaattcaaatcgagtaagaaaaaaataccaaatactagtaaaggaaaaaaagaatagacagaaaaacatgtggttgacaaaaattctctccttgactaaattttaatcaggatcctctgagtccaattaagccccattcttgagcatgtccttcaagagcccagttttttttttttaatactttaagttctagggtacatgtgcacaacatgcaggtttgctacatatatgccatgttggtgtgctgcacccattaactggtcatttacattaggtctatctcctaatgctatccctcccccctcccccctccccgctccccacctccccccaccccacaacaggccccggtgtgtgatgttccccatataaatcatactgctataaagacacatgcacacgtatgtttactgtggcactattcacaatagcaaagacttggaaccaacccaaatgtccatcaatgatagactggattaagaaaatgtggcacatatacaccatggaatactatgcagccatataaaaggatgagttaatgtcctttgtagggacatggatgaagctggaaaccatcattctgagcaaactatcgcaaggacagaaaaccaaacaccacatgttctcacttataggtgggaattgaacaaagagcccagttttagcaagattcctctcaagttgcttttgccagaatccatcaatatcttatcaccctcaatatctgatccaatttctcatcctccaccatctcccagtgaatttgatcacccaggtttatcttcagcaagaatcctgttaggccaatttagccagatccccacctccccccacccacccccaccccccgccttacccctgagatttcctcttagaaattttctgttcactgatcccctctcctccactcttctccttggctttgatttcccattatttcttgttatattcagggttgagcccagtctttctcccctgctgcaaaaccacactgcagttttccctgcaccaattggaatagtcctgaataaagtctgccttaccgttttaacaagtgtctgaataatattttttaacacggagaaagaaaaaaagcaatgggaaatgatgatgccttgtcccctggtagatagaacagagagcttaagtgtcctatcagctgcaattccctgacctgggaatctctgcagccctcagagaaggggagagccagaaggacccagctgatcctgactacaaaaggttgatattgctgaactaattcacagccactgtcttatccccaggaacaaaattccctccaacccacctaccttctttctcacaggccccctgagaaacgtgaacgcctggcattcatcattcacactcagggcttctgaactcctactccagcgctatgagccaggatttattctatcaggtttctgcctttgtccttcagagtgctgaatgttttgataatcccctttaaaggcaggagtgatccacaggctaaagagaagcagcaggcgttttgacgattgtaggtatgaatagactcttgtttcattccaggtcgaagtacagaatcgtgacccaaaggctagtgatccaaaaacgagatttttataatgccttagaatacatgaagaaaggagggacagagaaaaaggagatgcaaagacctcctgataaaagttatcttaagaaggaatagataatagattcagttaccatgaatgtatttcactctttctgtgtctcaaataatatgcatacaaccctaagatctaatttatttcatttcagcaaggggagtatgcctgaagagatgtactggcaaatatttttcaagaattgttaaaattgtcctgaggttgtaaagcttcattatttctaactaaatggcaaatatagtattaactttttctatgaagccagtatagaacacatccatacagctgtcacagaaaatgtaaccttcaccttacaattgtttcttagattccacttggaagtggtctggaacttaaaacctaatcattcatgatttccaacatggtccattagctccaatattcatgtatagattcattgatatcattagtaaaaatctttagaaatgtgaaccacagaaaggtatccaccattttgtatgtgcattttctctgtcacttttcaaagtatgacagaagtagagagaaccacgttgtccaaataaaacccaatctctttgaatgtttaaatattaaattaatttattcaacaaagatttagagagccttccaggtataaggtgatatatacttgaaacgagcttgtagtaaaaaggtttcctctcatagaaaaggagtgttactaaacctaaatgatacaatgcattatgcaaaccaaccactcagctgacccacagttgaaagcacttactgcctcatagccatgcccatcaattacagaactcatttctgctgagccctagatagacctgaaaatctacctcaaaagaacaatgcaaaaacagtattatcagtccatcagaattaaaagaaatgaaaataatttggccttttagagttagctaatacacacataccacagtgcctggcacaaaatagtcactgagaaaatgtttggtcaatgaatgattcactgaattcactgttgaaagactgaattattactattggacaaaatcatgagactaaacatttaggacaatctatctgaacatacaaacagccttgccaaccacaacaaaattataaaaataagacccaaaggaatccctaattgaaagcatcccggttacaaaataagtcctgaagtgaattctgtaaacagatcaataggaagtttcaaataaataggtcttgtaggagtaatcaatgctgtctgggtgaaagattcagcaggcttctaaacaacagagggcatttatctttgaacagattccttggccatttgagggcaggaaggtgaacaaggctgagacctattgtcaggctagctgaaattctacctccccatgcattttgttcactctgctcacacaagataatttgcttgctctctctacattttctgaagacttgcaaggcaaaaatcctgggctcttgccaagctgtattacattcactgtgactgatacgcatagccgcaacaaggagtagcactgttattcgaagggggcacttaaccatatcattgggtggaattgttagaccagaatggttatgtcacattcgattacaatgtacacaacatgttaagtctaaagcaggaattatttatagaacccaactttcattgttagagaagcttcctgagactgcttgaattcttactgttccctccttctctaaattgctaaatgtatcttttaatattttgctgactaatctcagttgcctcttcacatttactctctgtccttctccatcatgctgcatgaggccgtctgtccaaactgctttacctgggttcctgagctctctggctttcagctggtttgggggttgatggagacagacattagaatgtatgttctctgggatctgacccacagagggagagagaatggctgtgctcctttagataaggctgtaactcctatcaggaggtatttccctgcagtgatagccacagctctctccagattctggaaaaggcttcttcccctctcagtttcatgggttagtaatggctcctgatatttgctactccttgggtgctacaccattctattttgcttctcttttttacccacaaattggtaaattgttctctcacttaacctctcttcaatcaccctatttcatgccaggattctaatttatataaatacatatcacaacatttagcattctttttactatttttactacctttccatatttcccatctgattcctgtataaatttctaatttctaacttgattgtatttctctgaaacaaggagtgtgccacatcctctgggctcataagatttcaatagagggtaggaattgatgtggttctcgaactcttattgctgggaaggaggcatatttgagaagagttctgacaacaaacaacgacaactaaaaattgttgagagctcactatctgccagacaactgtgacagacattttccctataagtctgtgttttatataactaccttgtaagttatatcttattattgtcatttcttaagataaggaatctgaggcacaaatgtaacttaaacaaggtcacagagctagtcagtagaaaagccacgatgcagacttgggtctgtctgattcctgagttcatgccctttcccactatttgagatcatcactcataatggacaccatgactattgctccagtgagccaactgctgcaaatagagctgattcttcattagacacagagtcaccagcagccaatagagacaggatttgattaattctggaattaaattcaaacaaataaatagatagaaataagtatttctgtggttcatgtttttcacctatttactcataaaatgcttttctacgttgaaatagtcagtggtgatttggacatgttgcacttagtactccatatctgtgagttgtattaggcatttctataccagtagaagtgatttttttggcacaatgtctagtatgctgtaagcacttaataagtattataatcaattaagttgttatagaagccttcttgtcaccggaaatcaatgcctgtgttcagcactgagagaagaacattgtatccttcacaaacaaatacgatttttgattatttgatgctgaaaaattaaatatggcaaattttcagatgagtataattgcactgtattaatcacacaggcctgatttcattatagtaaatgctaatttaatgtcagatgcattttttctaattggcacgagaaatgcttttacttcacatgccacatgaaaatatttcagatcatagaatttcagaagaaaatacaagcttattgacttagaggcatttcaggacaagtaaaatacattcaaattatggtctacatagaaaaaggagacttcagaaaaatcaatttaagttcttaattgtttttgaaccatggatccctttcacagttttgtgaagcctatggccttcttctcaaaacaatgctttccaatgaataaaagaaaatacacaggtccataaagaaaattaatcatattgaaaaaagctataaaaatattacaaaagtaaaattgtgacatagtgatacacttcactatgaacgtattaactatcaatatgtagaaatgggtcaaatactgtaatttttaactatatctgtaacaactgcaatgtgatattatgattatgattctatctatgattttactggaggcaaagttgcacataatctctgtgctttgttgcttacacacccataatttaaggaccttaaattcactggaagttagtaaaataaagattacatttttattcctatgtaagttcactgaacccttaaattctattggtgggtcctgggttaagaagcagaagcaggattgtaagcggagtactaaatgaggaaatacattaattagaaagacaggaggaaggaaaagactccctttctccaagactaagtggaaagaaaactggggctgttcgagtggaattaattttagagccaaatatactcttgctccacagaacaaaataaaatgctattttaaaaaaataagttaaaatagatttcaagcagactgcctcatgaaagtctttgaaaacagaatgtgctgaattttgaagtgattgacaggatgaagtgttttttaaaatttctaatgtatatttcatcataaaaaagtgagtgaaagttcaaaaaaagaaaatggtaggactatacatttattttatatacatgataaaatcaaacatgttttgtcaacgggagacttgagtctggattatttatgttagcacactctcaaatttgtagtgataacaggccatgtgcaagccagtccatctgctagtggccagacaatcttagacaggcaccactcaattgcctggattaggagaaaaaaaaaaaggattaaagatcagcaaaaatacactgactaagaacaatatcagcagatttaaaaataggtccattaaaaccaaatactgggctgggtgcagaggttcacaactgtaatcccagcactttgggaggccgaggcgatggatcacctgaggtaaagagttcaagaacagcctgaccaacatggtgaaaccacatctctactgaaaatacaaaaattagccaagtgtggtggcgggtccctgtaatcagagctacttgggaggctgaggcaggagaattgcttgaacccgagagatggaggttgcagtgagctgagatggcaccactgcactccagcctgggcaacaagagtgaaactccatctcaaaaataaataaataaataaataaataaaaccaaacactgagttaccattgtcattaaatgtataacataggaccaaggttggttttatggtgttaccctagaatggatcaggaatttagagggcatatagtaagtattactcaacaggactaaatggtcaccatagtaacaatctagttactctgtatcttaagtctctcctcctaatttccctcttcaatggccacactgaatttccgggttcttggtttttcctaccactctcctttgttctctggcaatgactgccctcctgcctacctgatttttcaccactgcatattctgacctgaagaacttagttccattttagtacagatgactaatctccctgcagatgcctctattcttcctggaccaccaggtgttctctagtcctgcttctgtttctaacccttctccttttacaagaatatctcttagatattaaatcttggtccagcaaaaacctagaaggccttttctctccatgtcacacaatagacactgaggaatgttctggggttgtggacaaagagccagagccttctcagaacaattcagatatgctgagtgagcacagagagatttctgagaacaggagggtaagaacttccagagaacacaggcccatggaaacttacacttttgtatgtgtgtgttttgggtgtttgtttgtttgttgtttgttttgagatgcagtctctctctgttgcccaggctggagtgcagtggcacagtctcagctcactgtaaccagtggtatggtctctgctgactgtagcctccacctttcagatgcaagtcattctcctgcctcagccacccaagtagctgggattacaggcacacaccaccacgcacagctaatttttgtatttttagaagagacagagtttcaccatgttggccaggctggtctctaactcctaatctcaagcgatccacctgcctcgacctcccaaagtgctgggattacaggcatgagccacagtacccggccttgcccttttgatttgaagatcactgtgtcctctgatcaacactttctgcatacagaatagttttcacatcttctgcctatattaattaagttcatattgttttctgctattggtctgcattctttcacctactaccatcaccctttcaagaagtatgtactttctctgcaaattaatgttcctggtcccttccagctaaacctggcaatacccaagatgacaatgagcaatgctttcaacattattttagcaaatttactactttaaagcttaggtcacccttagggcaatttctatatttaaatgaattattttattttctttttattctggacaacatgaacacaaacgtgaagactcatagacaatacaatgaaatatggtcagacaagcaagctacatgtacttcccacaccttgtgggcctcagtactctcgtttttacaaaaaggacagtggatgttattagaatgaagtgagatgaacataaagaagtgagctgagtactacttagtgtctccttaattgggagttccaagacccttgtgggtccgtggcaatactttcacttacttatgatgaaattcaaagaaaaatgcaatgaatttttcagaagacaaaatttatccaactaaaatattgttttgtatccttagattatcatgtgctgcctacatttttgggtagagctctttctttcataaaatcattatgattatagacagtagcttttccccccttaggtcctttatattgcaaaatgaaaatatgaacatatgccatgtgatcacagtccgctttttaaaaaaattgcacaccctcaaggaacttagagaggtctgaaaagcttagatccttgtcataaggcaaaaaagtttctaagcatagttgaactcttagttgtcttggaagctcagaggtatcatattgaaaccaagcaaaccccatgaactggaaatgttttggcagtgctactcacccctatccctcagcatcctctccctgtcagaggccgcggacctgtgagtcactcctctcaaatcagaggccaatctgaccagcatggctgcccccttcaggcaagcctgactgttggctgaagagttccctggactcctgcattcaggcttcttgtccaaactttaactcaatagatcgacttcatcattttgttctgttttcctgaatataaagtcatgtcttgcatattgtaaagatgtagaaaacacaggaaagtatcaagaaggaaaatggaactcatcaataacccaccattaaagacaaccaatttttccctttgagtattattttcttgtttcgataattcatatattatttttatttttatataatttgaataataatctattgatatggtttcgctgtgtcctcacccaaatctcatcttatagttcccataatccccacatgtcatggaagggacccggtgggaggtaattgaatcatggaggcagttacctccacgttagtctcatgatcgtaagttttcatgagatctgatggttttataaggggctttttttccccactttcactctgcacttcgccttcttgccgtcatgcaaagaaggatgtgtttgctttcccttccaccatgattgtaagtttcctgaggcttccccagccctgcaaaagtgtgagtcaattaaacctctttcctttataaattacccagtctcaggtatgtcttattagcggcgtgagaatggactaatacatctatgtatagttgactgtcttgctttttaaggagatatggcatggggagacttttgtcatgctattaagcattctccgaaataactgcatttattgaccaaaaatgtttcatcatatattttttattatttaaaaatagcctaatggaaatgtttgtttataaatctttgtaagaaaatataattatcatggtaagcaaatcagcagaattattgagttgaaaggtatgaaattttaaggcattccatgtagtcaatgtatattagttttcctaatttatattcttaccatcaatataagaatgtctgtatctcccatattggtacctattcttaaccacagttaatctgaaaattgaaaagccagcagctagttatttttatattttcatcattaaaaactactgaggttgaacatatttgatctttattagtcatagttcttccttggtcattgttatacaggttgaattaagttttttcaacataatgttgttattctgtttatttctaagggaaaaagaagagaacaaaatgatattaactgagaatttactgtatggcatgtataaagctttattccaatcttgtagtagctctcataattattctggtggatagccatctaggtttcccagcaaatggcaatgctagaatccaaaccaggtgtgtctgtcttgaaaaccttgagcttcacaatctggtacgcttccaggaatgctaacaatgtatgcaacttaacaatgaccctatagttttaacctcttacttcttatgtggatttgtcaagggcaaaactaaaccagaagttgcaaaaataaagataaaactcttattaattgatagttttccattcttcctttcccaagaatacctgcttctttgtttgggaagacatttgtaatgttaaattgttaagctgtaattgttgttggagtatagttcatttttaaatccttacagtgaattataatattttttaaagtctccaagttcttaatttcctggctttattctaaaagaaattctcttatttcactctagagaaattttgctgttctgtcttgactaatatttttcttatggatatggctgtcatttgttttccgctaaagacattattcaaagagaaattaactctttatattgaaataatgcaaatgaataaacgtgctatcataatagggtgaatgtagagaagccagcttttcttcctaatgttaatatgttggattatatgtagggtttaaaagctaaatgtgaaggcagtgaaagaaaaatagtaccctaggataaaatagtaaatattattttcaatcaataaacttatgatgagtatttgaaaccttaatctcaaacacattcaagaaaatatagtactataactaggtcactgtccttgaatttttcaagggcttttgacctgatctaatgattctagtgaatagactaaattgccttatcagaactatacagtaattgttaagttgcacacgttgatacgcacacagtattaagcagagttaaaaagcagtagtatatctgggtttgtggaaattacccagtaataaaaactcacaatgtaaataaaggtcatttatgtattaataagtttctaaatatgttttgggtgaattgcaagtagtccattgttaatgacagtttcccaaaacaacaactttaaaatctttgaggcatcttagccttgacccaaacttagctcaatatttttctgctgcttcatataaaacaaatgctaccagtactcacagaaatctgaggacctgccactctcatttactatagacccgtatcccatgaacatattaagacgggaaaagatactacgcatggaaaagattatttccacacaaactgggaaggatcaaggctggttccaatcaaaggaaatttgaatctactaacgcttattaagcagaaattgtatctactacatttatagttgtgtcttcatatgaaagtgagtgcaattaagtatattatgtatgtgagatgttacctcctctttctggaattactgcacagtttaatagacatcaaagagtaagattcataagaaggaaagcactatgctatgacatttaacactggcttattcaatgctcaactgactcataaagtgactattactgtctcaccactgtgagtgaaaaaatgaggctcagagtgattaatttgctcaaggtcacacagcattcaaatctggtaggcaagggcttgaacaaccactaaagaagacagaaagaagcagaagacagcgaaaaaagcattttacaaaacatgaagagtttttcaaattttgtgttttgagacttagttgatctttaatgtctccaaggcaaagttcaaagttaagaaaaatatgcatttcaaggaaaagaaaaggagaagaatttctggagttgggacacggaaacataagtagatgggcagaggaaaagcttgcagaagaagaaacggaagcatgtaggagaccagacagaatcaaaatagaaactgagagactgtaccaaaagtagcctaaagcagtctttcaagtggctgcgtccctgacccctgtagggaaagggcagagggagtttgaactagtgtggacttcaggaagcttgggcttcatttaaatgcatggagagctcatcagcaaaaatgaaatggaagtctcatccatgagtgacttttcctaaggagggtctcaagaacttcttttccagaataaccagacattgccatgtgagcttctgaggtactatagttttgctaatgtagtaaaaacaaatattaaagagctcaacagaatgttttaatacctgattatttttttccctgaaattcacttaaattccatgtagttatttagaatctggaaataaaattaaaatgtaccctgaatagaccttatattctatgctctctaggcccaagaaataacattctaagaccaaaagatagatgtcaaagaaaggcaaataagctttataaaagacatttaaatggacaaattaaaagtttgtttctgagttgttgttttttttttttttttataagagacaaggtctgcctctgtcactcaggcaatcacagctcactgcagccttatactcctggcctcaagagatccccctgtgtaagcctcccaagtagctagaactgtaggcaagcaccagcatgcctagctaattatttaaaaaaatttttttagaaacgagcgcttactagttgcccaagccagtctcaaacccttggcttcaagtgatccttttgccttggcctcccaaagtgttgtgattacagacatgagccacagtgtctggcctaaaacatttttaaagttggggagagttagattagactgataaaggtatattaatataagattttatattttaaaaatcttagatacacgtcatgtgtgatgaaccattgctcctgtgttctgtttgatctaaaagcaaagaacttactttctttgtgactactactttggcagacacataatcccaattaactttgaacatatttccattttagcaaatgtcatccacagtgctactgactatccacattctgtatcttttttcggctataggcttattgaaaaatagggtggaggtctttccatagtgtttgtctttacatttgtgactaacaaattcctggcctatagcaatcactcaatagcttattgatgaaacaaccttcaaatcgactgatgaatgaatgaagtgaatggagaatggatagggtgaccaaatgaatggcccaatagagacttctttttggaataagctacacacacattaaatatttctgttgttagaaatattcgggagtaggtcacatcatcacttgctgggaatatagtagcaggaactcaaacgtaaggtaatcaaatagattaaaattgctttgtaggcttcctccaaactgagagcccttcatcctatttactgttaatagcataaacgaatgtaacctatccgagtgagttgtaggaagatatattttaggatgataataagcccaacaacaataacatacatttgtttcaaagtataagtacttcctatttgctggcggcataatggccagttcttggtgacaggctactatgcaacataacacttcatttcaaaggaagaacatggggaatagcgcatggagaaaggttgtactcagagggccactcagttctgagtgctacaatgcccaccaacctcaggaggagcacttccagacaagaaagtacaatggagccgttgtcgttagaagaaatgccctcctcgtctagccccacagttagaggcctggtctcggcacagtagtttcccaagatggccagatggatggagctcattatctttacaaaattccaaacgggataaatgggacttatttcttattaattccccaatggagctaccattgagggctctaaattttgttatttacaatcatcaagtaagcagaaagaaaaagagaaaaaaagaggaaagaaagaaaggagggatggagagaatccattaagcaggtgatctatgataaaggcttagacaatgtgtcttcaggacatgttgctagggccaaccagaagaaaaggaatgccaacatcatcacttgctactgtccccctctctcactaccttctagtcattctgtccctcttacagattctgaaagacgatgatgtcaccaccacagtcactgccttccctcttcctgaaactctctaccaccaggtcttcagtggctcgtggctccagctcactactcaggagtccatctcagtgataccctgccaacaaaagtacagtagcctcccccccactactgttattttcaaacttgattatttaattgggtccttcatggcacttgtcacgatttgtgtgtttaatccatttacttccttatgttccactttgaccattagaatataagctccatgagggcaagcaaagttttgtgttgttcactatggcatctctagtactttctgcaattcctaggatgtaactggggtccaataaatacagaaagcaagaggaagaaaaggaaacagaggctgaggaagaaatacttgtagcatttatcttattttataaaagtcttccataatttcattcaatgttcatttatcaagcaattattattgactgcaggaagccactacattctgtagaactgaacattgttctattcgtgaaaaaagtcttatgaaaaatacagatgccatatttagtaaatgagtagtattttgcttcattgttattgcaaaatcctaaaaaatgcagccacatcttcatttcttgacccttgatctacaactctttctttgtcttgtagcctaagaactgcaggaaatagaaatgaatcactttcccaccaacttctatttcttgttttcttgccacgggttctattcacccacttaagcatcttaagtcaatcaaatttttataaccaaatctccttaacaaatgcaaaactcacttcccaccaaacaaccctaatttagcacaaactttaaatttcaaaggaaatttgaacgtgttttgctttaaatgtcaggactagattttcagacggaataattaagagggaggagacacttccttccaataaaatagattgctagtttgtggaaagtactaagaatattatgtttttttccatatgctactaatgggcatcctgatgatcacatgaagcttgcttctttgtcctgattgccacgaagatgagaatattcgcactgaaatccaaaggatagacatccgctcttaaaaggcagatctatcggcttgtgtcttctattacgcctgcagttttcaagtatcattactcattctcacaacaatccataatccccttgtcatgtggataaggcttgtggattattttttcttactattatataatatgtcatatttcttacataagtaagcagttttttagaacatgaaattctgtattgtttggaatgaatgagattcatgcagtttttgaaatgttttggaaattttactgaaacttattatgattttccaggtttaatgtttagaatctgatcatcatgactgaaaagttatgttataaactgatttatacagcataattttccaattcattgagggtgaaattaagctccaaaagtgccaaaagctttcaagatgccagaaaacaaataaaaagcagatctttggaaatgtttttgcccaacacaagcatttttcacactacatcctatcttctctcccaggctgttttctgaaggtcctcccatttctctaattatgtcagagaaggcttctcagttactaaaatgtactgcccctcttcaacacttaaccctaatgtatttttacagagggagtaagcggatgggtttctgccagcaccagggagctataaacagttcccacagggggtgagagacagggtctacataaagcttccatcaaaactgtaaatcccaaatctgtgaatgcagaggttttccacattgaaaagtgtgattgtgatctttgtgtcttaccaagagatgtgacatttaataactttaaatatctccaaagactgacttcaagatcagtgatattctcagtgaagtaaatgcacctgatacctgtggcaaccatggagggcacacacacacaaattacatttggctaaattacaaaagctcttctttttatttttcatttttcttcattttaagatgttcgttatattaggaaactaagccatgtataataaatgcttttgctttagagagtgtgagcgttcatttgaagaccactgaaaaaactggatgaaatcaaacagtcaggaatacaggctaaaagccctggtcttaattaaagatctactaagcagcaagctattgacatcattgccagcttcaggacaaagataaagtacaaatttttttaaaaagagaaaactgactttgtgtaaaatatagactctagacacaaaatacatagaaaatgctgtccttaagagtagatgataatggcctggtgtcttagtcagtttggggttctataacaaaagtaccacagatgaggtggcttaatcaacagagatgtatttgtcatagttctgcaggctggaagtctgagaccagggttccagcacggtcaggttctggtgaggactctctccctggtttgcagttggccatattctggttgtatcctcacttggaggggcgcagaaagagttagctctctggtatcttcttacaaggacactaatctcattcatgagagttccacccccaagacctaatcacctcctaaaggccttacttcaaaccaccatcacatttgggattcgatttcaatgtatgaattttgggggaacacaaatatttagtccacatcacctggggacaggatgctccaaagagattttgaatgatgaatttcacccttcccccatttaccttcctaaattgtttcagacacagaaacttacgaaagaaaatgaatattttctctttagtcattgtcatgcttaaggaaattatgctgaactcatttgcatgaagatgattcagccttctgaatgatttccttaactaacacagttattattatagatgaggttatataactgaaaagcttaaaagaggttgtaaccatcctttatatattctaactcataaagaaaatattgctgatgattgaaaccagttgattttgcagaatatttgctgatcataaaaagtctttgaaattactttttgaatttccaatgtaaagttgggccaatgaggaaaaagaaacttctggtaaaactttctacctagtgttttatcattagttgttcaactatgatagttcatatttatgtaacacttactatgtgccaggtattgttctgattcttcttcattatttcattttattgtcacaacaactttatgacttatgtattattaggtatgattattatcaccgctttacagagaagaaaattaaggcagagagaagttaagtgacttaccccaaggtctcacagagctgggattcaatctttgctcttaaactcactaaactaaactgattctgaataaggataaatacaacaagtttaacactctgactcatacacagaataacttaaagaagagtaagggaaaactggtgcaggccacaagaattactcatggaggtcctctgtggaacattatgcaaagtgtgttggataatgtttatcttttaacaaccaaagtagaactggtgactaaattctccctgtgcttagactcatacgattcagatgcaataaaaaatgagtcaaaacttcaggtttgtatttccataataatgttgcacccaaagccttgtgaacacaagaagataaaaggaaactagaaagaaacaagactttcaaaaagactaggacacataagggtgattaggagccactctcctcaaccgttttcctttgccctcaggtgcaatcatgccagaagcagttaattctataccctcccctttgttaatttcatattttgtatgctctgtgtcattacattcaccatgctattataactgtccacaccttctgaagggcttctgctcctgctcagagctggcctacagctactgtcttcatgactcacataactgctcaaggctttgcttcctcatctccaatctgaaacttctatctcactgagcttttttggtctttggcttcacatccagtttagctctttttatgcagtcacatggatcacctgtcaagttttacttttactactacaagttaagcatatcgaatctgaaaacctgaaacttgaaatgctccaaaattcaaaactttttgagcatcaacatgacacaatgacaagttagcctgaacacactactttttcactatattaatggcatgtcatatttttattgctaagtatttatacgtgaatgagtgtaagaaaatgattgcttataggtacaatataaatttagagtcaggagtgacagtgatgccaaacaaccacaggttatccacacaggtggctgagatagtgacacttttgcttttccatgggtcaatgcatgcaaactttgttttatatacaaaaattatttaaaatattgtataaaattatccttgggctatgtatataatgtgtatataaatcataaataaatctcatgtttagatttgggtcccatccccaagatatctcattaattatgtatatgcaagcatctcaaaatctgaaaaaaaaacatctaaattctgaaacacttctgatctcaaacattttggataagggatattaaacctgtactattaatagctacctgaaggcattgcattaggtactcaacactcatttaccacaaatgtagatcaaccatgcaaggcaggagctatcatccctatgatcctaatacacaagggaggccagaggtttctcttggggagtgacatttgagctgatagcttaagtacgaaaagggtttcaatttgtgaatactagaaacaactaccctaggcagatggttcagaacatgtaaaggttttcgagtaggaaaaaacctagaactaacaataagctaatgtggctagagaaaaacctgtgagggacagagtagcagagtggcccaagaagggaccacacaggccaggcaagaccgaataatgctggcttcatgatgtatttcctccactcaactatgtactcagtaatgccatagaccgtgtttccacgtttgattcatgtgggctcccagagtcttgtatatttgctcacccttagtgttagtttgaatattggttttggaattgctggtggcattgatgatgaatttgttgttggtatccacaatggaattggtggtggtattggcgatggaattctgatgggattgctggtcacattgatagaggcattgtggtagtactactattcactagagtagaaacacagtgaatgtctactgatgatcaccccctaaatgaagacctgtcttaatgcaccgtatgttataattcacatcattcagacgcaaatgatagttaacactgaagcctagatgagaaggtgaaaagcaattaaaatgtttcacctggttttattaacatgcttgaccagaggcagacttaagaatttggaaaagctgaatttaaataatttatataccttaatgaccacatccccagcataattctttctgtacttctggaatatgctctaactcttgtgtaaatacagtctgactctccttgaatcccttaagtgtgatgtcatctgggaatgttcttcatagaaataacagatttgaagagcctaaagaccaattttatattttattagtaatttggtattcatccagatggggaaagggaccagaaaatatcccctttcatgagaatgttataaatcacaaattcccttaaaaatgtacaggcagcttcataccagatactaccacaaggatgaggaagacacagtccctgaactttgtatccatctaatgataccacttactcagcaccacatacttgtattaagcacatcatgtctattatattatttaatctaatggaaatgttattattccaattttatacttgaggaaacaggcctagagaactgtctttcctcttgggaaaagcatgcatttatgtcagccagaccccgatggatttcaatagtgatggtacaatgtccaagaagctgaagaagaaacccaaagccagagaatgaaacatagggtttattaagaagacttacatacagggcagttcagtagtggcagggtagacaagagaactgtgaccacttgtaaaaagcatgcagtttatatagcattttaacttagctttctcttccagcaacctccacctggcaaccttcatttaacccaaaacaaacagcctagatactctgtatggcctgtgttccaagggacgggctggaggttcagatgttcctcatatataaggaatgaatccctgggttgaacactcttgcatttcttagatgttcctcatagataaggaatgaatacctgggttgaccactcttggatttcttagactccccatagggtctaagaatagaattcagggtatgcttaaattaagtgactgctgtcaggtacatctgccatacaacttgccattcatgaatctcacctccccccttgctccttggatcaacaacctgggaaatatttaagtattgcttagtacatcaatgaaccttaaaactaaggatccagggtctatgggtgagaattccataggaaagttccatagggttcttcggatccctaagaaacgagtcagcgacaaagaaacacctgaaggatagacaccagtgatgaatctgaagtacatatgggcacaccctctctgagcagggtgacagatttttaccagtgtattgtgtagagtgaggccaggacttggagggaatggaagacctgtctaagtgcacagggtctaacaatgatcagttaacatcaacgagtaaacaattaattcattaatcattttgtgtttttctcataacattttgtccaaaggaatttaaagcaaaaatctgtatcaaataagagaaaaccatttgctgaactctaccaataattcttttatgcctggctcaccggtttctgaaattctacaatcagaaagttgtccctttaaatcaaagcactatccttagaaataaattaggaattcctaggcatggtataatgtagagtaaattaatttgcctctgtctctttttcagaacggttttgattaattgagagttgtggtaagaattataattaataaagaaggggaaagtttggaagggaaaggctgggggtgatttctgtcaacttacagtttaaaaattacaatgtgaaaatctctggatttaccgaggtacatccctaatagaaatacgtacatgcttaccaaagatatgttccagactgttgagagaatgctgttgtcaatagctaaaaaactgaaactgccaaattttccaccaatactagaataaataaaataattgttgtatattcatgcaaagaaccaagggtaaattaactattgctacataaaacaacatggatgaatctgacagatgtcagatgtcatgatcaacaaacaaggtctacatgaaagagttcatattaggtgactcgatttatccaaatacaaaaaaaaaaggtgaatctaggctatgctgctagaagttgggattgcgattaccctcacagggcagggcagttagtgactgttgtagaacaatagggaagtttttgtggtgctcattagagtgtgtatgtttggtgtgtgaaaatttctggggctctacattaatgacatggccattttctgtatgtatattatgactttaaaaaaaaaaaagcaaaagcaaaaaagtaaaaaaaaaaaaaaaaaactattgattttgcatcagaagtctacttaaaaaattaggtcccaacaggttatacaatcttaggtgatcacttaacctctataagtcttaattaagttgtctataaaatagatgccaatcaaaaccgattaaaatagattacaaattgtaatatgctttgtaaattataaagttctgtacaactgttaattatttagaccagtggtttacaactcttgctgtgattaagattcacctaagaagattaacaggggcaacaaaatagatatgttattcccactaccctacagattttgatttcctaggtctggaaagaagccagtgcatctctattttcagcagttccacaggcgatatagccacagctttgggccattgatttagaaaatatcttcttatttcaaaagttaataccccatttcggttttgtttctgagatctgaataactcatctacattttgccaatcacaagttacagacacaatgacatttcaggtaacctaatgcatttagataacaaatatctgacgagtaagcaagagccttaatgagcaaaaagatatttcatattaaaccaggcacccagaagcaaaaattgtgtgtgtgtgtctgtgtgtgtatgtgtgtaaaactcacaaataaattataagggcagaacgccttcctagtaatatccaaagcctgagtacatgccattgcatatctatgccagaaatcatgatccaatgtatgctttggttttattttccctccacttacgaaatgaacaccagatgtcgaaacagttttttataacgtttcttctgacatccttttcatgtttttaatagtatgttgttccaacgatgaggcttcttggacttataaaattgctagacctcaagaagtatatcagttcccatcaatgagtaaaatgtataaaatcttaatggtttggagtttttctttgaatccctatgatattcaaattgcatcattcatctccccctaattttctccttagacaaattcattacacacaagaaagagttcagagcaaagcaatccaacatttgcaatttacttgtgtacatgttgccccaacagtagatactgaataatggttgaatttaacagattagtccttttgagactagatcatttcctatagccaaaaataagatactagattttatgtagcccagttgtggagatgcagttaaaaccaactcttcctcaaatacatgaagctgtagttgcatggtatttttattggccaacatatagttttgtagtggattacatctgaactgaattttcagtgctgctgtgtgcatattaaatgtttcccttacttcctgctttaggatcctaattagcattatgcataaccttgaaaataatctagtccagtatcattctacacttttatcatatatatgctatggaataatctgtcacctagatcacatactgaatttttttttaaataaaacaatgaggccaggcagggtggctcaagcatgtaatcttagtcctttgggaggcccaggaagacagatcgctagaggtcagaagctcaagaccagcctgggaaacatggtaaaaccctgtctctactaaaaatacaaaaaaaaattagctgtgtgtggtggcacgtgcctgtagtccaagacacttgggaagctgaggcaggaggatcacttgaaccaggaggtagaggctgaagtgagccgagattgagctactgcgctccagcctgggtgacaaagtgagacccagtctcaaataaataaataaataaataaataaaacaacgaaaagctactttttaatgcaatctctcctcaaatttttcttagaaacttgcttatagttaattaggtatggttcattaattcctacctgttctaaaaactaaggcactacaaaaataataggtacatcatttgtgactctctgaggaaacacagagcttacaaaaaagaaacctagtagtaacatagagataatatgtcattttccattttcaacaaatcatgtcatcaaagacataatgcagagaattatagaatattcaacagcaaacattaaaaatttacattctgattagtgttattttatcacttataaataatttaaataaaagtttggtactgttctgttatttgacattgctaaggtatgaacttgccaacagaagttggtttttttccatcttcaaagaaaatctaaactttaatcttttacacaaggcagggataaaatccttctactacttagtgcagagaaaatgctgagttaaatgtcttgataccttagtactccatctctttcctttctgttgcttctggaagccatctgaagatcgactatcattcctgtagagctgactcagtctttcctcattatccctgtccctttaatccatgttctcttatctcttctctcttcttccccaactttgttccctcattttccaggtgagttggggggctttccatccatagtgggactgctgccttacatttctcaattggaagatgaatcagttggacaattttgtgggacatctttgatatagatgtcttgctaaaccttgatatgccctagagtatttgtttgttttgttttattttcttctttgttttggtaataagataatcttgattgagcaaaggtctagaaagatgagcttacttttggtcaaaatgagacagacaactgatttcaacatttctttttctctaggtatgtgataaggacaaaagataaaactctctcaaatggtacttgaaatatagagttaagggtgctgtgaacaacagagttgcttttaaaaccatttcatcagcacaataccgtggttgaaaacatgagatactaagagttacgctatctacattcaaacgtcagctctaccacttattagctgtgtaaccacagcaacctctctatgtcagtattaggaatgataataaatcctatttagtaggatcaccacaagaattaaataagtccacacatttaaggcacctagaataggacctagcagaacataaatgttcaactattaaattattttaatatattttgggtttcattaggcctgcaaaagtaaggtaagtatctatagtctggatagcgagaaccacaacaggaaagtgattacactatactttgcatgaacaaaaaggagctaattagaaagtggcccatagcatctgtcctcagattgggaatgggaaaagaaccttcccctgtactctcccaattggtggccatctaacaacatccaataagactcagattgatttatttatacctctctttttctatcaaggtgccttaatgttgctaagtgatgctaagttctagggtgattctagggtgcctgaaccatccagacatccctaaagaataaatgaatgttggtggaaagctgtttggtctgtactgatgaggctttgccaactccatcactaacccagggtttcagatattttactgtaagtttgtttgctctaatccatgctaagacctttccatacattgtctcacttcctccttacaacctctctatgcgacagagttcatcattttctccatcttacatatgaaatttcactatttgccaggcacttaaagttcagataaaaattatgcagatacagtcaccactctcttagaatgtacactttcatagagaaaagacattgaaccctattaataaaataatgtgcttaaaattgttatacacacctaaaggagctccacaaggtactatcagccctggttttagagactacagaaggacaaagtatatgtaaaaatatagctggtagcccatgggatatccaagaaaaaggacttgtgtttgcaacgaagctggggtagaaggtatcatggcatattctaggatatgagagaagacctggcttgttggaagtcagacagagaagaggagtaaggacaaaggaaaatgtaagtgtggtctgttgaggctatcatgaaaggcctcaggatcatgttaaatattttgggcatgaggcatatgacaatgcacagccatttaaatattttaatcatgtcagacatggtggctcatacctgcaatcccagcactttgggaggccgaggcaggcagatcatttgaggttaggagtttgagatcaggctggccaacatagtgaaaacctgtctctactaaaaatacaaaaattagctgggtgtggtggctcacacctgtaatcctagctactcaggaggctgaggcaggaaaattgcttgaacccgggagatggagggtgcagcgagccaagattgtgacactgcattccagcctaggcaacagagtaaactctcaaaaaaatacataaataaataataaataaataaataaataaataaataaataaataaatattttaatcatgaaaataacatgcttatatttgtttataccctggctatagtgtatagattggatgttgcccctctctcttgcatttaactcttcagcctctctttggtggtatttttgtgtaaagctttatataagactttaaaatttatgctttacttttactataagagaacagtatgccctttagccacatttcattttttaaaagatatttataatcctcaagaaacgatagtaaaggcattgtctatagaaatagagatttgagaataagaatttttttttcctttttgcctatgttttagtatttcagaagttctaataagacagtaaaagaacagcatgcctttaaaagcaaggttctaatttacataccaacttaattggccatgagatcttcaacttctatttcttccagcacaagtatcagaattttttttcttgcccttgctgtaaaaatcctcgaagagtaaatagatttatgtaacacaatgttcttaaaactttgacctagtcataattcagtgtgattttaattcctttatacctaagtgctaggcaacatgccacaatgtgaaataggaaggggaaaaagatatatttagagtttggagggcaagaaaactttaaaaaacaaaaatagggctaataattgtaaaagggctttagaatgaataatctaaaggacttccaggaatgaaaatgaaacactcttagagagcagagaaagacgatcaactagaagcctccagtgattgtcttccccacaggaactccaaattgagcaactattcatacaaaaaaaagcaacttcataagaaccaaaaatcaggtaggcattcgcagcacctggttttaacatcatattaaggaatgaggcactgaatacaggagggaagacggttttgtatggcctacaccactccatcaccatcccctggcagcaggcacgtggtgtagagggagaatctgtgtgtttgggggagggaaagtgcagtgattatgggactttgcattgaaatgcagtgctgccctgtcagagtggaaagcagaactcagaaagtaggacagggaagaactcagccagtgtggatggagggagcatctagacaagccttagccagaggcaaagtgtccatcccattggtccaaatctgagttcctgcaagccttgccaccatgagctaaagtgccctggggtcctcaatcaacttgaaaggcggtataggccccagttgccaagctgcaattcctgggcaagtcctggtgctgtgctgggcttggagtcagtggtcttgggatgcacatgacctagcaagatgccagctagagcagccaagggaatgattgcatcatcatgcttccccaaccccaggcagcacagctcgcagtgccagcagagactccttccttttgcttgagaggtgaggggagagtaaagagggctttgtcttgcaacctgtatgccagttcagccacagcaggacagggcaccagacagagtcctgaggctcccatttcaagccttagctccccaataacatttctagacacagcctaggccagaagggaacccactgccttgaatggaaagagccagtcctggcaggattcatcacctgctgactaataagcacctgggccctgaataatcagcaatcatacccaggcagtacttgctgagggccttgggtgagacttagagctgtgcaaacttcaggtgtgacccagaataatcccagcttggatggctatgagaagaaagagacttcttctgtttgagggaaggaaagagaagtaaaggggacttcgtcttatagcttgggtaccagctcagccacagtgaggtacagcaacaagtacactcatgtggtccccgagcacagacctaggctcttagacagcatttctggacctgcccagggccagagggaagcccagtgccctgaatggtgctggtctgatagaaccccaccatgagctgatggtagttgtggccacagggagaggcacctctgcatgtggaaaggggagaaaacagtaggaatgaatttgtattgtgatttgtgtcagcttagtcacagtagaatagaacactaagtaaatttcatcatgactaagtgggatttatcccagggatgcaaggatagttcaacacacacaaatcaatcaatgtgatacataatgtcaaaagaatgaagagcaaaatccaaatgattattttgacagattccaaaaaaggcatttgatacaatcaacatcccttcatgataaaaaccctcaaaaaactgggtataaaaggaatataccttaacacataaaagccaaataaagaacaaatccccagatggtatcacgctgaatggagaaaaactgaaagcttttcctgtaacatctggaacaagaaaaggatgcccattttcaccactgttatacaatatagtactagaagtcctaggtagagcaattagacaagagaaaaaagtaaagggcatcaaaataggaaaggaagaagtcaaattatcattgtttgaagataatatgatcttatagttgaaaaaccctaaggactccatcaaaaaaaaatattagaactgataaaaaaattcagcgaagttgcaggatacaaaattaaccagaaaaatcactagcatttccatatgccaacaatgaacaatctgaaaaaggaattaaaaaaagtaatcccatttgcaacagctacaaataaaataaagtacttagatgcaaacttaattaaagaaaggaaggaactctacactgaaaactacaaagcactgatgcaatatattaaagaggacacacaaaaatagaaagatatcccatgttcatggattggaagaatcactattgttaaaatgtctatactacataagcaatctacagattcaatgcaatctctattaaaatatcaatgacattcttcaccaaattaatatggaaccacaaaagccaaagctatcctgaatacaaatgaaaattaaaaaaaaaactggaggaatcacattctgacttcaaattaaactacagagatacagtaaccaaaacagcatggtactagcagacacatagacctataggatattttgtttcaattctttgattgcatttctaatagcaatagtttttcttaaattatagaaaaatctcaacatatatttcaaatgtgaaaacatatcaaaagttttcattgtttctgtaaatctgggttcacaaaattaaccactaagagaatttgcagatggtttactaaaataagtctgacttaaaagtaattagaaaattcggaggcacttcaatttaacagaaaaaacaatcatgtaaatagaaaaccagagtgtcctatctgataagactgatggaagcctattgaaaataatagagcttctccactaatttggttgaccgattcatttcctgaatgagtaatcctcatctttgcctgcctttactttagccaagagaaaggtccttcttgcctggctccctaaaatgagaaagtagtaccaatccagtaagctgccatagcttttgggtggtgtcctataggccatcaaaagactgggaaccagggactttccatatttagtggattaactgcattttactaaatatgtcatttttcaaacttttctacaactatactttgaatatactacatttgtaaaaatttgcatcttaagttttgatttctgattgtatgtctagtccctaggaatagtgtaaacattgttatgctagcaataatctatacctttctacttttttccctgccatatttctatttgatgtgttctccattgcagtaagtacatgcttcagattcagatccacttcaaaatatactgagttttctgtgcataaatgtcactttaatgactacaacagttcatcttacgaatgtaccataaatagctcatttcttcagtgttcaacatgcaggctacttctgctcttctgttataataaatactgtttcaatgaatatcattttctgtaaattttcatttgcattttatgctacttttaaggtagaattccagcagaaagattcaaagatcatgaatactttcagttattgagatacattgccaagtgctttcaccagaagttgtaaaagttttcagctggaaactgcttatgataaaatgttatttaaaaagctgaggataaaatttaacatatagtgtgcacttaacctgtgaagtgcaaagtgagggggtgggagtagtctggctgaaggagaactattttatcactgccattgtttagaattgcccaagcatggtgacaacaaaaagcagacccactattagttggttttactattgctattaaattcccttcaaacagcgcaccctctcgtgcttacacctgaggggccactgcttttaattacataaatttatatacataaaataagagccatatatcaagttgttgacacaagcaatgtgtagtttatttattaaacaatatctattgtgtgctcttcatgtgcccacaccccatgaggtagtagagatggaatgttaaataagacaaagttcatgctctcaagaggtaaagtgggggctggaattatgggtgattttttattctcttctacatactggcagtgcccacattttgcaaaaatgaacaaattacttttatttttagaataataataaatgcattaattactacaagttaaaactgctatgatgaaatctattactacgcattctttaatattgcaaactagattcattactccctccacaaactttgttttcatacaaggggtcatttgaaagtcccaaagagagacaatataaaaatgcaaattgatgaatgtaggttgaaaaatctggggaagttcccatgttcagaataggccctcctattccctccccgatcccattgatctgcccaaagacacaccttcaaaaagtgtcatggaattcctcagatacaaccaacaatagatactttataaatttaatagaatcacaattacaaagaggatttgaggatgttacaaactgtgtctgagtcattgccaagtcatcagctatattactttcaacttttgaaatgtttgaagaacatgtgctttgttagaaacctgggggaagggatgggaaaattctctgagaaatttctgccaagagggaaggaatgaacagaagtgatgcctgtttgggtggtgtcatataagatctgggagttgaggcctcatgaatacagggcatttccttcatcacacagaggacatcatcatccatttatttatattacaaatatttttggtatacttaagttataaacataaagttatcctggatatatagaagtgaattaaatatttgaagttttgtccttatggctcttacaatttaataagtctaataaaatgagaaaacaaagtaaataaatccatattttcaaatttgttataatataaaagaacgtggtggtctgagaaagaaagataaggagcccttatgtaagatgagatgttcacagaaagaccttctgggaaagagacattccagctgaatcccagggcaaaaaggtgctagatattatagagtgaaaggaaaaactttcaggtcaaggaaattgcaagtgagaggctatgacacaggactggtagcatgagaagctctgagagatcatttggctataatgaagtgaacaagcgggagaatggtgtaagaatgaagttggaaaggtgggtaggaattaagttatcaagtagagagatatctggagaccagtagacagaaatatatggttgaggcttggagggatttgggaaagattataatggaagggacttcatagaagcgggactgctgtgacaatcagtacatataggaagccaccgtattttctctcgaaagagagggacccagaaaggtgagttcacatggaagtcataaatgtcactgtttctgggcatcttcataagtcctaggtagcaggaattggagggagagggtatgaaatggaaagcctgcccataatgtctaatgactaagcaacacaacagagcatggttaccaagtaaaccagggtgatcactggtcatttacatcctactttatcacgtagccactggtgcaaactgctaataaaatgaaattcagtgtctctaatctctgattgtgtctacaacatgtacagtatgtttaaatttgatagaagtatagaatgatagtttatttctttattccttctgaagccatcttcctctcaatttgagatatttttttgacatggataatgcaggtcacagaaggaagccttcttttttctttgaatagaccaggaataggaatgataaataacaaataactgaaattcaagtcaatctgaagccaaaaagaaaatctgatgatataatattattaaccatatggaaaacccactttaattgctacactaattctgctaccaataagattagtgcagaaaagactgaatgaagtcacttcaatattaattggtctttcaaagcttaaacagaaatggctattttaaattaatttaggaagactacaggcactgattgtttcaaatagtggcgtgaaaagagaaaaagtaagtgctaagaggcttaagaacattattaaactcatttattattcttttttaatatagagtaaattatagaaatcttacaaaatcaacagaaggaaagataataggctatcatgaaatatgcaatttattttttaaatgggaaaagaactattgaatcataaatggaagaaccattaggaagttatgtaaatgtttccccttcgagtaatataaatcccatatcaccctaatgtgtacaccccaatagttttattcattatcataaatttcagaagtctcattccttcacaatatatttcaaaggcattttattttcatttttaacaattaaacaattttatcgtctcatatcttcaaaatatattctgcagtttgttaaaaagaaatgggacttgcctagcaattaacaacgtagataatggattaacttgattttgctttacttcattgttatctttcacctttaggaattacaatttttaagactggaaacagaaagggccatgggtagtccaaaatttcagaaatcatgaatattctttgttataatcctgccatagggactttgcattaaaaacaaacaggaaaaaaaattcttcagtcccctccctagcttcacctcttaccaagagagcaggctcatgacctaagaatcaaataggttctagagtcagacatacctggattcaaattcttgttcctccatttattaataccataattatatgcttgaataagtaagttattaaccacttctgggcctcagctttctactctagaaaacagacacaaagatatcccacaggaaccacttacagtgtatgtgacaggatctaatataatacttagcagacattagctgttccataaatattcattttgctttccttaaaagtcagttggcatacattttcaaaatctggctgattgaaccagtgtctcaccaaacatcttttcaaattctagaaatctactgtagaagtttagggtcaaaacagtggagtcatcctgaattatcttggatagaagacataaactttctaagtctatttccttgccagtgagatgaacagtaacacagcctatttcgctgggtgagagcagaatttctcagcctcagaattatagacattttggatgaaatcattttttgtggtagggggttgtcttgacaattctatgatatttagcagcatgacaagcctccatccaatagatggcctaagtagctccatcccaagtcacaacaaccataaacatctccagacattgcccaatttattctggggaacaaactaagccttcattgagaactactggattagaataagtaaagtaacttgaaaatcacttaacatagtacttagaacacagtgattttcaatagatgttagtgattaatttttacccaggtataaaattaaggattgcatttctgattatgttatctcttcaatattatgcataagcattggtgacagtaaagaaactgctcaaagaggagccagatttttccataatgaccccaaagccaccaaaaataaaatgattagatacaattcttttgggcaaatattcatttggaccttgggtataaggtgatgctggcatcctgctctgcctgacctccttctagggaccattctgtctttcctagttggtgccatgctgtgtctgtgtctcttaaagcaaggttacatcatgctgctcaggaagcaggctgagcaatgggaatagctcaactctgcattgagttatgccagtttgggcttcatgcagggctgatgcagcttgcacatggctatcacttctttttttttattctattattattatactttaagttttagggtacatgtgcacaacatgcaggtttgttacatatgtatacatgtgccatgttggtgtggcacatatacaccatggaatactatgcagccataaaaaatgatgagttcatgtcctttgtagggacatggatgaaactggaaaccatcattctcagcaaactatcgcaaggacaaaaaaccaaacaccggatgttctcactcataggctatcacttccttcgggctctcctttctttcaaaaagccttctgccaaatctaccatgtgaccagcatgtgtgcacatcttctgtgtacgcttcaaaagtgcaggtgtcacaaataaatgagttcacaatttaggatgctgttagtagattcctgactttctctgaaagttagaagtgtattataaaaacaaaacttacatctatatgtaagttgactgcatcagactcaccccatgggcattagagtgtgacattagtagtgagccatcagtaatgtcccaatagatcccactgacttgccacacgtaacacttgtttgcatagaccacaggactgcaaacttcagcagccactcactcccagtcaaatccaggccctcatctcttttccaaataaagtgttattgaaacacagctacattcatttgtttcattcatctatgagtgtttcaggctacagtggcaatgttaagtggcagaaactatatgacccacaaatcctaaaatatttactacctagttgtggtaatgtgataatgactcccaaagtcattgctatgttctaacttgtgagtgttaccttatttgggaagagtctttgcaggtgtaataaataagttaaggatcctgaggtgagatcattctggtgtatctgggtaagccccaaattacagcaaaagtgtccttgtctaagacaggtagagggagattagacacactcagaggaggaaaagcgaacgtgaagatagaagcagagattggcgtgatgtagccacaagccaaggaatgtcaagacatgttggcagccaccagactctggaagaggcaaggaagtgttctcccccacagcctgccagggaggatcctggcccttcagagcccatgctggcaccttgattttggacttttggcttccagaactgtgagagaataaatttctgtctgttagaagccacaaagttcagggtaatttattacagtggtcccaggacattaatactctggccttttatagaaaaagttttctgcaacaggcaaaacctgtaccaattaatgcatgtatctactgcccaacataaggaagaaaatctttacacacctataaaagctatctgcataccctgccctgataacatctaaatgtgatatttaccaagcctgtgtacatctttttacatacatcaataaggtatgcatccaaagcaaaacagtatcatttagaatatgttacattttacataaaaggtatatttttatgtaagcttctaaaagttgcttttctagctcactataatatttttaagatttatccactttgatacacgaagctttagtttctctcaatgttttagtatatcacaattcctttatttactctcctatggatggacactaaagtatttctcattctcattatgatgaagactactgctatactttgagtgtgtcccccacaattcacgtgctggaaatggggttcttggagtggcaatgttggctggtgggttgttgagaggtgattagggcattaagaggaattaatgtcactcttgagggactgggttaattctcagagcagtaagtgaatgagttctcgctcttgcaggactaactccgttactgaaaagagtgggttgctataaagcaaggccgcccctcacacgttgtctctttcacacacactagcttggtcttccgcttttccaccatgttatgaggcagtacgaaagccttcaccagaagctgccaccatgttcttggactttctagcctccagaactactagccaaaataaacctttttattgctacaaattatccagcctcaggtattctgttacagaaacagaaaacagaggaagacaagtactattatgtactttcttatatacgtctcttatgcacaattgtaaaaataactccaggatttttatttagaaatgaactttatggggaatgtgtctcttcagctttatgatgtcaattgcctttgaaacgaattcaataaattacactgcaatcagtagtgtttctgtgttcctgtttccccaatcctcaccaacccttgacataagcagatttttaaatattttttccatgtgtatgaagtaagcatctgctctttagagtaaagcttgccttagtacacaataataatgttttataaatgttaactccccaacttcatactcacagtggaaataaggaagcaagtttatgatagaaaaaataccaaaaataataacaaaagaatttttaaagacatagtttaaattgtatctggtatacagttgaagaatcggcaaaaacacattggattcactgtgtgggactttacgtcaaccattttaactcttgtgcaaactttttttgttcattaaatgggaggttactctctctgtggccccttcctgctccaaaagtctctgcctgtaataaaaaataataaaaataaatagaattccaagcaaagttcacaattctatcactttaatgcctcttttcttcagaatatatgaacacttgcacaaaagagtcatatatcctttgggtggttttctgctgtatctgcctacctctacaaagcaggaactattccacacttcccctcattccttcagctccagctgtcctggccttctttcattccctattgctccaagaggcaacattcttgccactgtatgactagctaatccctaccctccttcaggtcttggctcaagtgtcacctgtttaaggaatccttccccaagctccccgtcaagatcaaattcccctgtgatggcttcctatgcaacacacttatccttgtaatacaggcaagcccattattaggcaataaatgaggttcaccattcaatcatataaaatgtgggatcatgctagagtgaagtttgtggaaaaccgttacttttcagtttctctttactgtcacagaaggcagaaagataaacacagtgaaaggtatctggaatataacggactgaactaagagttcccaacaataatgagattggagaggaagttagggatcattcagttccttataaggtttaggaaggattttagagcttattctcaatttaatcagaaatcattttatttctacagtgtcttattatatttttcttccgcaatcataaagtagttgaaaaaactactgaactacccttcaactccttaatgaggtttgccctaagaaattaagaactggaaattgagaatggagaatgaacactggatcaagcatcaaagtcaactatgttataactggttctacaactctgagtttgtgtgttatgggatacgttttcttgagttttagtccacatgaactctagtttatgtgtcattagattaatgtccatcttattacctgaaaattaaacttcaggaaggtaggatttggtgtaaatacagagtaaatgttcagtaatcactagttgaaaggaaatgaaaagaaaaaaagaaccatatcaatagtttattactgggagagaaaaagagaataggacactatagaaataatacactttatcattaaatttaggataagcttcaaagtcctttctaaaccctctaagggactgaatgatgcctaccctctctccagtcttatattcccgtgcccctcactcatcatcctccagccaagtaaatgtctctgaattcttcagtcagcccaggcttctccccctgcctggaattttcttctcccacatctttacttaagggtctcctcatctttctcaccttgtcttacacatcacctcctcagagaaactccatctgaaaagcctatttaagcctaacctacccatacctccaaatccagttattactttctgctgcttgtttatttcatagtcttctttctaggcttagacatgtttcttaatttgctttgggtttactcgtgtgttaacttctttatgtatgcaagctgcattaaggcttacctctttgtattctcaactcctatcacaataactggttcagaacacatactgtattagtttgttttcatgctgctgataaaaacatacctgatactgggtaacttataaagaaaaagaggtttaatgaattcacagttccaagtggatggggaggcctcacaatcatggtggaaggcaaaagtcacatcttacatggcgacaggcaaagggagaatgagagccaagcaaaaggggtttccccttatgaagccatcagatagatctcatgagacttattcactaccacaaggatagtatgggggaaactgcccccatgattcaattatctcccaccaggtccctcccacaacatgtgggaattgtgggagctacaattcatgatgagatttgggcagggacacagccaaaccatatcacatacttaataaacattaggtgaataaacaaacgaagatgatgctaccctgaaagcatagttacctgtgcagggggagggcacagagctcataaggagaactcagaggaactacggtgtctctctctgataaaaggctcaaacactgacacatctacccaaaagaaggagatgaggtcaggtaatatccaatcttctcttccagccagcaggacagccagctggagtcatcagcatcaatgcaaatgtgttgtctataaggtctaaattacatcaatttatcatcaaactaaaatttaaaacatttttcaagaaaaacacacaagcaaaacatacgaaagtattttattccaagcagcttacatgatttctcatgaaattctgggtcttttcaaggtcatcagaaaacaaaaccaagcagactggaggcttctacatatccagtctcctgatttcatcatagaattaaatataaggcctcatttaggaggatcttgtgaagccccagagattccctcaaaattcattctgaaattacagactttagttctaaaaacaaccatgattaagcatgacatctacagatgcttgctcttcaataaagctgtaatttgggaaaaatcaaagccataaggcactaaattatataagggaggcttttcattactctctaatctagctcactctgagttaagaggcaaatgaaatttgattattcggccagttacttttcagcttctgtgtttaatttactttttctcagaagattaaaaaagtcacacgaactattattaaatgtagatttgaacttgagtttgcttttttaagatcatttgttaagtgattagtatttttaaggggccgaggccattcatttactatgatttaccctagcttagtcaataagatgccttaattaaagtatagctgaaatctgctattcattttttaaaatagctattccaaataaaagtggaaagcaaccttattttttattgactgtttacagtttctttttttttctagtgcatacaatgagttgacagcctcaactaaccaaagaactaatttaatatttaaaaagatcaattttggcaactttagaaccttcaaatcgaaaagtcctctttacaaaaaaggagttcaaacaatagtctccactaaggtgttgctgtttttaattaagatatgaaagatggaaggtttataaaaagatagccaacccctaacatctactgcaatgttcctatacttgtcaattagacaagatacaagttttctgtgcataatgtggcagctatttacatattctacaaaaatgttttaatggatttacaaagaaaaagaaaactggttagaagattctctcattttaactgtctagtacttcctaacatctatgtccatgcaatgaaaccacctgagctttaaaatgaagacaaaaagagagtgagaattttttacaactccaatcctgagaggcgcttgactttttttttttttttttttttttttggcacttgactttttgagatgggatttctgaaaatattcctaagttctgaaaggcagaaagaattgatattcacacacacacacacacacacacacacacacacacacacacacacacacacagagtctggtattggtgatgtacctgctagacccctgcccagtatcatcagcaatagcagggtcctttagtacttggtgcttggtcccatcttgtaattcaatcattaatgatttcatggatcctaattcaggcacagccctccagtcttcatcagtacagacacggattcttcatcatcattgcctgttcggccaagatataatctctctttttagttcttgctctttcacataaaaattccctttacatctgaagatactaatacatactttcatgtcactaattctacaacatttgcaaagcactaactcaccctcactgatctcctggcttcctaaaaattaggtggtaacatttctttatctcttttacatcaggcaattgccttgtgctataaccataactgcaacattatttctgtgataactcaccgagagcatccctggcttttcaaaactctcattttttaaactgtaatgaacacttatcaaatccctattatgtgctgaatattgttatgggtattggggatacaaagatgattatgatattgtccctgtgttcaaggggtttgatgactatggtattgtccctgtgttcaaggggtttattatatagtcaggaaaatggagaatctgactgatgtttttagcagtgtgtgaaaagtttcatcatttatttactcagcaactatttgagcacctcatatgcattagtctccatattaagtgtcaggtatacaatggtgaagaaatcagttctggtttttgtccacatgttcatggagtttacaatctagtgtaggaaacaaacaataagcactgaagtaagcacaattttaaaagtcaaatcgatgttagagctatgacagaaataatgtggataaagaaatacaatatactggaaggggtagggctcaacagtgaggcgtctatgaaggtttccccaggaaggtgaggtaggagcagatctggaaacacagaatgagctggccatgtgcaaaggtcctgagactgaaagaagggtggcatagcttaaggataggaaagggcaaggccagtgtgactaaagcttaacagagaaagcaaagagtggtgcaagatgaaatggagaggtagaagacagatcatatattacattatatgttttatataatataatatatataacataatataatatacagagagacataatatatattcccttcattgcaataagaagccattgaaattcttttaggttgtggactatatttacatatttttaaaattcccctctgaatatcatgtagagagtaaactgaagaagacaggagtgggggctattgtggtaatctaggtaataatggtgggttagaccatctactcatttagcaaaaacaatcactaacctatggtgcctttgaatgtgccccctccaaaatgcaggtgttgcaacctgcattttaatagtattaagtagtgggcctttaaaaggttgttaggccataagaatgctttcctttgaatgtttcttataaaaaaggggtttggtagccaggcatggtggtacatgcctgcagaccagctacttgggaggctgaggcaagaggatttctcgagtccaggagttgggggctgcagtgagctatgatgctacaactgcactccagcctggtgacagagtgagaccttgatttgtattttgttttttttttctttttcctttttttttttaaaggtatttggctctcttgcccttctgccttctgccatgtgaggacacagtattcctccccaccatgaggggagccatcttggaagcagagagtggccttcacaagcaacctctctgatcttggacttgccagcctccagaactgtgagaaataaatttctgttctttacaaattatgtatttcagatattttgttatagccacacagacaaattaagacaagcaatttcttgtgccaagcattgaactaggatttggcactgaataagcaaaatccttgctatgacaaagccatcagtctagttggagaaacaaaagacaactgaagtaatcgaataagcattacatgttgtgtgataacaaggactattgaaaaaaatatggcagggtaagagattatagcatttgggagtgttgatggggttatgttctgagtgtaacagagaatcacagagtggtctaaatcagcctggggagggaatgaagacttctgagaagagaaaacacttgagcataagtgggatagtccaaataatataaggatggggagataggtggagggatgtaggaaagtggatgtagaggaagatttcaggaaccacacccccaaggcttgaatgaaagtttcagtgtagagagccaaggaagacaagactagagccagcagaggccaccgcatgaaacaaaggcctgtgcaaagctgagaatttggcccttcatccaagagctatggaaagggcttcaagcaggtgaataaattagaactatcaagtttggcattatggaagatggttaggaaggaagtcactagaagacaaggaagtcagtaggcaaacattgagcataagccaaaagatgatggtgcctgttaaagtagtgggaaagagggagatctgagagatatcaagtatgtagaatggacagaacttatcacactgcttggatgtgtgcataggggtgggtggtggaagggagaatagtctagtggaccacgttgtgagatgcaaaatcccttacaacctgctctttctatatgctctgacctcacctatgccagttcttccacaccctgtgacattaccagtgttctgtcagcccctggacatgccaggctccttctcagctcatggtctctgcaccatgtgtctctctgtctaaaatgcttcccccaggcctttgctggtttatcccttctcttcaggcaggtctttctgctcacatgtcacccacctaaaaagcgcttccctgatcatcctaggccgatcttgattacacttcatcacctgctcctctcttgcaaatcatcttacttttaaatcacatacatgttaatttgctcagaagttggtttatccacatttctgtttatatgtttatttacatatatggggagagtcaccgctgagctccccaagagcagtggcatcaccttcaaggtttaccactctgttcccaaccccttgcaaatcctcaataaatattttttgaatgaatggatggatgagcagaggaactgggtaacaaattacatacagggcttaaagcttagtagtgaagctgccaagtatgaaaggttcttttttttggagacacacaaattaaaaacagaaaggtacgcatttgaaaaaaaaatcaaaagaagaaaaagacaaaaatgagagcagttgaatcttataataaaatgtttacttcagaccagggtgctgtagcggcacagagagtcagtattttaggctttgcaagccgtaaggacactgctgtaactactcaactctgctgttataaacataaagctgccacagacaacacataaacaaatggacatgccagtgttacaataaaattttactcacaaaattggctgaaattggccagagagggatggtttgctgactcctgctttatactaatctaataaaggtaaaaaagagtgacacacaattgaagcatataaagaagaggacctaatcttattgagactcttctatgtgctagaccttttgcaagatcctttgtctacaaaactcatccaatctttttaacaactccagtagataagcatcattatgaacattttgagttccaagaggaaaaataacttatctaggtcatacagttaaggagccaggccttaaatccaggaggtctttctcctccaaacctccacaatcatcatatatgtttttatcaattcttcccttatagccacaaaatacctttctatccctttttggagagaggtataaacatctgtgcatatgacataaatatgttgatttcaactccacaaacatttacctattacatagtatgtgccaggcaggcattgtgaaatgtgctggagattcaaaattgtagagaccatctctttctacgatttgtcaaactgtagcttgttaatgtcaggctctgaatttcaaagtatgtcatgttcttttttattttgctagaatcgctaatggtgctctccaccatattaatgatgtgtcttccatggccctttctgccctttgtaaacaaccacaggtgtggattttgttttgtctgtgtgcaaggcttgctgctgagacatttccccattagactgctgcccacagcaccagctgttgttacaaactgctgattcccagccacacagcttttcgtttccagttgcttcagatggtataattcgctgtgtccttgaagcctgcatccatatgtttgggtcaaaataccttctcatcctcactggaccaacataatatcaagaatgttatttctctaagtgtttctcagacaggcttaagagtaaagacgtgactatatgtgccactggagtacaatttttaaaatacctgcttctttccagcattgtcctgtgtgacgtagaatttagccaataaaaatctcctatatttcttatctagttattaaaattaaatctcaaagttacaatcatgcctttttttccagttactttttatgcaatgacatcaatatttaagaaaattgtctgaggaaaaggaaaaagtcctgatgtcataagcaatctcagactattcttcactttaaaaactttattcagaagcctgtacctacaaaatttagggtatgggattatttcatagaaattctccatgattacatgtttccttatcccattacagtttcaacagaagcaatcaatatttcacattatcagtgtaccgtctaccaacatcctattctatctataaaaagaaaaagtcatatagggaatattttgtctattattttcaaagaaccaccactttcagtatttagcatggttcactgtgttggaaatcaaagtgaatgctattctgggaaaaagctgggctttgaggattttcaaagaacaactcaaatgacgttatttgttacctagcttgccttggccagagttctgtctccagcagaattggggccaatcaagagttaggatgctccttcttatcagcaatatcaaagcttctccctctgtttcatcctctgagtcaagggagtcaactaaatactgtaagttctctttcttacatcctaaattgttcttccatcctctcctcctgcacctctctcttctagcacctgaggcctttgagaattctcaatagcatggatgcaacagattcatcaaccttgtggcttctttgcttcaggtttgctcctctgtggtccattccttatgtaatcgactagtgtgatcatgtcattaatgataagaactaatatttatttagtacagttttgttttttgtttgtttgtttgtttgtttgagacagagtctcgcactgtcgcccaggctggagtgcaatggtgtggtctcggctcactgcaacctccacctctcgggttcacacgattctcctgcctcagcctcctgaatagctgggattacaggcatacaccgccacacccagctaatttttttgtatttttaatagagactgggtttcactatgttagccagactggtctcaaactcctgacctcgtgatccacccaccttggcctcccaaagtgcttggattacaggcataaaccaccacacctggcagagtacaggtatttttatgcattactaattaaattcaaaggcacacagatacgccccaaaccactatcaatgccatttttcaaatgaaaacaaaacaaaaaaggcttagagaagttaaggacttgaccacatccaaagagctactaaggggtagattgaggattcaaaccctggactgtctaatccatatgtgaccttgttgtgtcattctatgcaaaatttctatttcacagatacaatatctgattgatatagcttaggtcagattccaccttttgccagagagaataaggcagcttcagttacagttttattaacagtatatctaataaaagaggggtcgattttcaaataaaataaaagaaggttgcaattacaagacgaatgagtactggattggcaaaagcaagacgttcatggtagtttctctcagtaatcaactgaaatctctcattcagacatgatctcaaattctgttattagatagatacagtagacactccaccttgcagtgaatttggctcttagagtgctacaagatggacactaaaatatggattaactgagtggtgtcattgggttcaagaacagggaagagctaggactttgacacccccattaggtggtggcaacatgtttggtaaaattgtgacatattttaccttgacttagagaccttatgcccaccaaggtggtagtattaggaaaacatcaacatattggctatatttttctgccttcagaaatgtcctataagagaaatgaacctacatcagagtgaaactaaaaataatggaaacataactgtgataaaaacaggcactttgaatgctgtacttctcatactttggaatcttgctggatgaaaaaagtatatttttgtaccaccctacagtaagcgggagatataggaaaactggagctcaacaggaggtaaaactgataagattggacaactagttctttccatgcacatcgtattagaaaaagagttccacaggcaaagacacgaaactgtggatttgctgagtggagttagtgggttggagaactggggagagtcaggtggtccaggctaggactgtgacacccccctccactgacagtaacatggttggtcaaactgtcacctaattcaccttaacttagagaccttatgcccaccaaggtagaagaatactaaccagagtaagatgcctgccagcaaatgcagaaataacagtggtgcgttttatttgaaacaaatttctaattttcatagggagaggccattcagctaaaaaaaataagaaacctttggttttaagacagtgtccggtcagatcactaactatggtgatcaggggatgaaattttcatgggcaaaaaaatagactggaagcctattaagtatgtgaggaaaacgttttgccaaggaaacccaaaatctagccacgcttccttaagtcaatcctgagatcttggaactccatttctggggacctgcgctgttatatctgggtagacctgtgaagtatatccttacctataattgaccccagtagggaccatggagaaatataaacaaagaacatcttataagacagaacaagaggccaaaggggatgatgaacaaaagagattcttccagaaagcagacaacctaggctgccccataactgactacagaatttaatccactgtcacggtagagagttttgtcttaacagttctgcccctgtccagcaagatgtgtgtgctgcagattgtagactatagcgtgttcccttcctgtctttttccaaatgggaatctaattgcagtttacaattgcatattcagaatattgggggccaattaagttttaactacattgaacagctatgaaaatccatatccagttactattgagatgaccataaatcacccagagatcttggattcgaagatagataaactggatgaaacttgggatggtcaccctcaaggagagggtaagcacattctaagtagctttggtaatgttaaatatatatttgggaagaagctttaataaggatgtgagacagcccaatggatgaaccataccattcagcattagtagcctacccaatggccatttctcctttcctccttgataacagaaatacgattatgtttaaggtggcaatatgcccagctcctgggataaattatgatgagtctatctagataaatcatggggttcccatagccctttgccaaatactcactttcctactcaccttgcagcttcaggtagccaaaggagacctaagggtgagaatatcaggggtggaaaagttctatactctgataaagggaatatttccctttattttctatacttagaaaaatgtggaagtcattttgtgattatgaagcaagcaatcaacgcaaggataaaaaactcacatgctgcagattgcagaaaagtgagagaatctggatcagatttcttgttaagtaaatcaaccttataattgatgtcatagcggagatttatgttatagttaaaaaaaggtctaattaaaaaaccaattcataagctgtatgcagcatatggaagaaagacacatatttgaagaacagggagcaaagatgatgatcaagtctttctgaatcctgacttatttaaagactactgtctataccgttcttgaaactgttattttcacaaagtattatcttttctttaaactgatgctgaatttgtgtagtatgtggaactgttaataaatatgcaaagggtcaaatcataccaaaatagacaaaacactttactaaatacaactgagtacagttgactttttgtatctgtaggttccacatccttggaaccaaccaaggattgaaaatatagttttaaaaattgtctgtactaaatatgtacagacttttatgtgtcatcatttcctaaactatatagaattacaactgtttacacagaatttgccctgtattagagattatgagtactccagagatgaattcaagtatacagagtgatataatggattttggagactttggggtgttgtttgggaggtgggtgaggaataaaaggcttcatagtgagtacagtgtacacttctctggtgaagagcacactgaagtctcagaattcaccactatagagcttatccatgtaaccaaaaatcacctgtaccccaacctattgaaataaaaataattataattaaaacaataaagtacatgggataatgtacatatgttatatgcaaaaatactataccattttatatcagggacttgagcatccatggattttggtatccaatggagatcctataaccaatcccctatggataccaagggacaactgtatttactgaactgttaccagcaggctgcagatatagtcagatactaatggacacttaaaattgaaaacctgttaagaagtgcactgtacattttctttgtttgcttaaaagcagcttcctagaagctgtctagttctacctcgtgttaatcttttcacatcctacagagttttacagacttttagaatgcatcctggtaagtgctgtctctctaatcattggacttttacttttaaggccagctttacaagatattttcctttaagtgcttgagttttccttgtttagcttctctgatatttttttcaattttacttcttttactctgcttaatactatatctattcatttttatttaatggtttgtttcttccctaactaattaagattctcagtagcatttgactcagctgtcacgccttccttcttggtttccatgacatcacactcctttgatttttcttctccatctatgacatttactcttggtgcttttgctgtgtccttccttgctctatctctaaatgttaagaagtcccaacacgtatgcctcaccttcttctcttctctatgcatgatcttcccatgggtaatcatgttctgccccaattttaaagaaaatatacattacaaggctcaaacattagtatcttcaatcccaatctctactctaaaatatattatctaatatatccaattccctagttgacatttctactcagatatctagagataccttaactctgacatagccaaaaccgaattggtttttcagcccctttccattcttctttcctcagttttccccatgtcagtaagcaaggccaccacccatgcagtagctcaagccaaatgcctggaagtcatccttctttcctctcagtccacatctctcagttcacaagtctgcttactctacctgcacaatacatcttgaatctatctaattccattgacattccaatctaatgtagtcaccaacacctcctgcctgggataccaccataatctcctaactcatcctcctgcttcttttctccccatctcaatatccatttcccataaatcagccagagtggtctttttaaaaatgtaaattatatcccatcacttctctgcataaaaccctcctcatagtgtcctaacacagttagattcaaatccaaatgcagcctccaaggttctccctgggtgatccggctcccacctacctcactgactcatctcacatctctctgcctcactccctatgtgataacttctctggcctcttttctcatcctcatataatcccagtttattctgctttggagtctttgcatgagcagtgtcttctctcgggaaaacttttcctccagatagtcacatagatgaattttacttataatctaggcctctgctcaaagtcagctcttcaaagaagccctctctgaccaataaacctcaacaagccaccctactgctcttggcccatgatgctgctttccttccttccttcccaacaagcactgtcttcctccaaaataacctacactctttgagagcagggactttgcctgactttgtcattgctgtgtgcctgtttcctagacacaatacacatgcccagtaagtatctggtgaattgcaaataagtttattgggttcttacgcattagggaaccccttcctaaaattcccttagctcctctaccttaggaaaagtattttcttttatatgcttcatggttttaagattaatcagaaaagacattttggagctaattctttattcattcaatcaagaaatatttactgtgccaaacattttgctatacaaagaaaaatgagacagcagattcattatctagtggtacagaatggcatgaaaatgagtaagtacaatataaactgagatcaatcaaactactaagatacctactaatgtggccttgtgcaaagggggccagaagtggagtgaaacaaaaatcagtaatgaatacagaagaaggatgacatttgctacatataaatgagtcagaggttgagctctataagctacaaggagaaaagactgcatttgtttcatttctcaatcccatacaatgatgccctccaaaatcacaattacagaaggagagatttttctttgtaagtcacaatgttattataacccgaaagtcaagttttactgaattcaaggacactgcttccaagtatcttatgtgattcaattacacacaattctatattatcataatgcacggtgacagattacatagaactgccgtaaaatagatgctctctcaatttatcctccttctcacagctgccaccctattctctgccagcttccactgcaccctctgtcatcacccactgcccatgtcccatggcttcccattacactctgatctctgatacaaagaatataggactaagcttctaccaacagactggcctgcccactggccttcaaatgtgccttactcaatcctacattctcaacccaactacccatttaaaataccttttcttcttatgccaagtatggtggctcatacctgtaagcccagcactttgggaggccaaggcagatggatcatctgaggtcaggagttcgagaccagcctggccaacagggtaaaaccctgtctctattaaaaatacaaaaattagccggagtggtggtacatgcctgtaatcccagctactttggaggctgaggcaggagaattgcttgaatccaggaggtagagattgaagtgagccaagatcatgccattgcactccagcctaggtgacagagtgagacactgtccctaaataaataaataaaataaaatacttttccttcttgcttctaatattcaaatgctacaagttcttcaagttcaaggggctcatctcctccacgaagtcttcccctccagccactctagcccaccgtgggctcatccttctctgactacacacagcattcactgcctctgctggctatttgcagctttttacaaacctcctggaattgtttaaatgttcatgtatctgagttttaacaatctcctaactagattatttgattttttaatatggtggctctgtcttctagttcttgtctatccatacccataaaaaacagtggtgtcaccagaggaagtgaccagttcccaaatcccagcattttacctgcatgaacatgttttgtcatggtgccacagaagagagtcaggtataggtcaggagtataggttaaaccagtgattgggtttctacttctacaatgcaaatccttttacacttagaccaaaaattataggtgtcaataatcacatatccagaaaattagtagatacaaatagtctctgagataaattaatgtttcttgttgaagaaagaaaaataaactcctttaactgaatagtaatataaccacaaatggtttttgtacataaggaggacaatttctattaatgaatatatttcttttttttttttttttttgagacggaatctcgctctgtcgcccaggctggagtgcagtggtgtgatctcggctcaccgcaagctctgcctccccggttcacgccattcttctgcctcagcctcccaagtagctgggactacaggtgcccaccaccacacctggctaatttttttgtatttttagtagagacagggtttcactgtgttagccaaaatggtctctatctgctgacctcatgatctgtccgtctcggcctcccaaagtgctgggattacaggtgtgagccaccgcgcctggacaatatatttctatataattcagccacatggtctttggattaggcttctggattaacaacaaacaaaaagctttttctcttatctgcaagagcaactttactggctgttgtctccatcaattttttaagggtcagtgctgactccacaagcatagatttggagtagataaactgttaatttcaaataattttctcaacactcacagtggaaagagttattcaggctgctgccctagggtccctttcctatacccctctcctccctctcctctatcctcctctgtcactcttctataatctaccactcctccctggcccccaattgtttaagttgagtttgatcatgctactccattggtaccttctgctgctcttaagcgaatgtcctgagtccttaagatagtggtcagtgatctctagcatgcattttcctaatctctcttgcatcacctctcttctctctcctccttactcactctactccagtcatacttgatttctgtcaactcttagaagatgtcatttcatttttttcttttttttattttattattattatactttaagttttagggtacatgtgtacaacgtgcaggtttgttacatacgtatacatgtgccatgttagtgtgctgcacccattaactcgtcatttacattaggtatatctcctaatgttatcccttccccctccccccaccccacaacagtccctggtgtgtgatgttccccttcctgtgtccatgggttctcattgttcaattcccacctatgagtgagaacatgtggtgtttggttttttgtccttgcaatagtttgctgagaatgatggtttccagtttcatccatgtccctacaaaggacatgaactcatcattttttatggctgcatagtattccatggtgtatacgtgccacattttcttaatccagtctatcgttgttggacatttaggttggttccaagtctttgctattgtgaatagtgctgctataaacagatgtcatttctttttcatcctccagggctgcactcaggagattcccacttcatgaaattccttttccccccaccctctattgtctgcctaactctcacttcttccaattaaatgttacttcttcatgaaggtctctaggaaagtttagattcctctgatgcagtctttaacgacaaccatgaactttctttggtaatactcataaaaataatttaatatctagcggtccactatatatcaagaccccacgataagagagactggtgatcccagcaaattccagtgtctggcatataattcatactcaagaaatttgttgaattaataaatgataatgggacactggagctggaagacctaggttggagccccatttttgcttactgtgaccttggacaaatcacttatctcacagatcctcaatgtcttaatcttcagaaagggcattatcatcacccacttctagtatactgaaagaacaaaatgatatatattcagctaaagagttggtaacttggaaaagatttatacaatttagctgttatttttaattgactaaagatagccataagattcactgagctatatacagccaatacttaatcagcaattgctgtggctaaaagctttctatgcattatctcaaataatgctaacttttacaatacttctagaacgtcagtattgttattatgaagcctctttacaggcggagacaagtcacaaaataagtgatgaatctgagattcaaagtacaaaaggctccaaagcttaaatgagaccacaacaagcctacctcccattactacaaattaaactccattacttagaagaagagagttcagttttcagagcagaaaaactataactttgctcgagtctagtataaagctgagaagcaggtgttttcactatttgaatcattgagaagaatccaacactttaaagaaccctcataatcaccatgaccatttgttaagtgggccttgtgtgccagtctccaggataggcactttacagttgccagtcctaaatttctccaaaaccatcaatttaccaatgagaaaatgagactcaggaagaacaaatcaagcaatctgtcttcctataagtcgagcttcaaggccagggttgatcccacctctctctaactccaaagctgtgctcttcaaactactacctcttagactacctctaagaacctatactgagaagcctcataaaaacatttatccttaagaaaagcatatccattattaagatgtatatcctttctctaagtatgttgtttatattattgtaaaatactagtgaaacagataaccctgtggccaggtatattcattctctattgttgctgcaaagaattaccacaaacctggctgaaaacaaacaaatttattatcttacagtttggtaggtcagaagtctgacactgaactaagactaaagtatttgaagtactggtgctgggttcctttctggaggctctaggaaagaactcatttgtcttttccagcttttaaggccacctacattcctgggcctgtgttccccttctatcttcaaagccaaaaactttgaatctcattaagcattcttctttagtgacatctctctctgaccacagtaggaaaggatttttacctatgaggacccatgtgatcagactgggcccactgacacctgatcaccctggataattgtcccatatcaaggtccttaacttgattatatctgcagggtccctttagccatttgaggcgacatattcacaagttccaggaataaggaatatggacatctttggaggccctttagtctgcctatcacaccaaagcaacagatctgctaggggcccactccacctcatctactaacactctctgggaagaaaagcaatactcagtaactttcaaataccagggactcaatggaaccctcaagacatagcagaggaggcctagaaattagagcgcaaaagtgagagctcctggagacctgtatccatgtcttggcctcatgaatggccataacccaccttagagctggggcatcccaacaaatttcaacatagtgtatttatcatgctgtggctagagaatgagtaacaagtattcggtttacttttttactttcatgtgtaatattcaagtcgcattaccttgtttctaatgaatgtgggagatgtatcagtcttctacacaaatttgagagaatctgacaatgagtagaaagaacaaaggctttggagtcagatggacgttaaatccattatccacatgctctgacaattgctgcatgagcctcagtccctgtatttgtggaatgatgacaatactcacccacacgatgaggatataaggatctaaaccatttatacgtgtacactctaaaacagggcctgacacctacaagagcaaaataaatgttaagccctctccaagcagtctgtctacataggttataagtataataatcatagcaaaaatacgatcttcatttttggatcctttctcttctcacccactcagtaactggaaaagtgcctagtccagattagactatatatatatatatatatacacacacacacacacacaccatactgaagttttcttttccctttggatctagagaataaacccctggtttggatcagtgatgaattaaagagtcagcttgggctagcaagacctaattccctgagtcaccctctggagccctggacactgctagatgacttcacaatactcacacacagactgtgaaacttaaaaaatggtcttgcatgtaagccatggtgggttattaacatacaaaatagattaaaatacataaaacagcccaattcatcatacccagcatatctttaataagagcacaagtgacaactggatgaatgttttccagaaacctgaagacagatttaaatcacaaaataccctgtaatcaaagagtaaatcaccttttcacctaatgctaaaagaacatataaattagaagagtttgtggtaaacaaactaatattttagaagctagttggtgttttctagttctaatcattcataaagcccaaatgaagagagactacagtgtatgtctgactcttgcagaaatagtatctatttgggataatctccccctgattaagcaaaggattataaatccatgacacacttctcaaatcctaatcccccttctctgaaaatgatgcttcctcctatttcgcagaatgcaaatccgttgcacatgtcctccccaaacctaatttattccctaatgtccccaagaagagactcaataccccatattccttcccgagatcaacctaacaacaacctaactgagatataactcagtttgtatatctacaaactgagggtataaacacaaacaacatcccatctctgccccagaacaactcaccctcttagagagacatatacagcaataaagtattgcacaaatagtattcagcacttaggaggagtaaactatatccacgaatgcagctagatctcaaaaacataatgacaagtgaaaaagtcttaaaatacaccatttgtgtaagtttaaaaacatacacataaaacatattaaacactgctcatgcatactgacatgtccagataaaggatattaaaattaatgggaaagataaacaccaaattcatggtagtggttgtaactgcagaggagaggcgattaaaaaggcaatgttgtaggtgataataaatatgtcaactttattgctaacattttatttattttatggaaaaaaaggctggaagcaaatattttcaataattgttaactagcaatttggggcaggaatccccaggtatttgttactgtctacattcttcagtatttttataagtagttaaaattgaaatagccaattgcatcatgtgtctatatggcatatacaaggtacaatagtgcactaaaagaagaatagttctttctattgtgcttttacgccatcgttctccactactcaaccactgttctaatgaggccaatgcctataaacatgcccaaacttttcctgctaaacaaaatgaacccgccagtagttactcccaagaactgctcagtctattccttttctttctcagctaaacttcttaaaagaattgtctacacctgctctcccacatctccttaatctccttactcatatccaagcccactgcaatctggcttctgccccacttaaattgcttcaactcctaactgccaaatcctttcaattctcattttacttaaccatgcaaagcacttaagataattggccaaatattggaaaacttcccttgccttggcgtccacagtactactcttggctgtcattccttttacctccctacatgttccatctctgattccttctcctgttgcagtcacttaattctagtctgtttctctagtagtacattctaagctctattctcctcctaagtgacctcttctgttcgcatggctgtatctgcaatccactggctcctaaatgtgtatttctagccccttctgggatcaagacacacaccttcaactgtgagctggctatctaacattctttgcaagtatcccaacctcaatatgtactaaagcagccatatcctcaaggattccgctgaagattaaagctagacatggggaaaacttctctactcctacttttcttccacttattctgatacagattgtcttcttgattatacctgctactgtatctcttgaatgcaacacctcttctctaccttccacactgctttaattcaggtctcctggtctacattgttcgtaccatttttctaactagttcccatgacttctatggaactgcctcataatttcctgctaaacagaagcaattgactttaccttgcttaacaccattcaagagcctgcagattttagtttaaactcctcagtcataaaagcaaggctctgaaatagtctactaccatctacttttccagtcttacttttggatacatttttctacactgccagtattcaagccacatggacctctcaccattccctgactatggctcgatttttcacacaaatctgagcctttgcacaggctgatcctacctctaaatccctctctctcctccacttgataaatctcaacacagttttttaagatccctttgggatgtcatttccttctgcaacgtttccttagcttctctaagtaggtagttattcctgcacctttgcttccatgaaactttgtagctggctctattttagcacttacgtcatgttgctctaagagctacttgtccacatgtccctctctcccagtgaattgcaagcaggtgctagtcttttgtgatggtttattaattcaatgagtatttgagagccaaccatcagcagaccctgttctaggcttatgccatatactgaacaaaacagacaaactctaaactcatggagtctcaattgctgagaaccaaattatgattagtaaacctcagtcatgatttggagatgtttaaatcatcagtaaggccattacaaaatcagagtgttaactaatcttactgtggtagcttttgcatgtcattatagaacaacatctctaactacagcccatcttttacttctttgcaccagtgacagaaatatgcacctacaataggagctttaaatgattgaagctcagcttttttttttttatgaaaactatccttttctttgttttttttaaattatactttaagttttagggtacatgtgtacaacgtgcaggtttgttacatatgtatacatgtgccatgttggtgtgctgcacccattaactcatcatttaacattaggtatatctcctaatgccatccctcccccctccccccaccccacaacaggccctggtgtgtgatgttccccttcctgtgtccgtgtgttctcattgttcaattcccacctatgagtgagaacaggcggtgtttggttttttgtccttgggatagtctgctgagaatgatggtttccagcttcatccatgtccctacaaaggacattaacttatcattttttatggctgcatagtattcaaatgtattcaatggtgtatatgtgacacattttcctaattcagtctatcattgttgggcatttgggttggttccaagtctttgctatcgtgaatagtgccgcaataaacatacgtgtgcatgtgtctttatagcagcatgatttataatcctttgggtatattcccagtaatgggattgctgggtcaaatggtatttctagttctagatccctgaggaatcgccacactgacttccttaatggttgaactagtttacagtcccaccaacagtgtaaaagtgttcctatttctccacatcctctccttgtctttagatgcctgtaggaccccttccaagagacagtatacaattacacattgtagttgggtaggccaatactgactcagtttctccacaagtcagcagacatcagacccacactgcatggattcaagaaacagaaaaaaacacagacaagctctgtgtggttgagtcagaaaatgtccacatgttagtgtggtaacctataccatatgccttttttaaataggcactagtaccatgagtatctaatgtaatctttgagtattttgcagacagagaaatttaggcttctccgtaactgatacatgtgtcgtgagtgaaacagtgagaaactcggaaaacagaaagaatttgccactaacaaaaaaggacaatgcagtgtctgatccatgaagaaaagttctcagctggaacaggaacaacagtaactggcctgaagccttgaggaaggatgaatagttaataagagattgcaaggaatcattacctatgtgatacttgctatttgtgttagcaaacagataaatatatagggaagttacttgctgatacaattgcacattgctgatagttctttgccgctcactggtttgttttaggctttaaagtcttctatatcagacttttctctttatactagtaaagcataaagagaaatgcctgtacaagaggttaccagtatcattttactggtgttctgacagaaatcaaaactttcaggccagtcaactgagcatgccttaatttaaaggtcagatacaaggatgaggtgaaccagaccagtgaaatcctaagtctggtgtgatcatcactgggtgtgtacacctggaatcagcaataaaatattactactgccattgtatctactattatctaagaaaaaaaggagacaagctctattaataattagcatacatacatctaaatgtatacatgtataatctatgaaaaaatctatcaaaatgaagaacatgccctagatattttacagataggggtccatgatcaaaacattttggagactgctgacctagacaccagatgactaattgtgagttctacgtaacagaccacagtcagatttcagaggtaaagcaaagcagaaaagaaaaggtaaacgaaaaaaaaaaaaaaacagaacaccaaaatagagaaaatgaaaaaattattccagatatcacaagggcaagcagtacaaatacatgatctacagtttgctgattatagaaatattgtcttctgttttttgctgggtgcagggaccaagatcagataatgtgatgtgactatttggttatcttgttcccctgcttaaaacctgtgatcacttctcattgctcttaaaataaagtccaaatatttaataaaactcagactcttagccatctggaccttatcttttgtcacttgctgtctttttgcaggggtggaatggggggatgggaaggacctcctcatttcacgtatgttctctaaccttgttcttgtctatctctaagtgtaattcaaatgttgacccaatttctaattcctttaatcattattttctgacttataaaacatattaagtctttttcccatatgttcctatagcctcctgtgcttgcttttctgaaaaactcagcatactcagaatgtatttttcaaggtctttcttccttgctagccatctgtgaggacagggaaggtatctgtaaccccaaagcacacagcacaatgtttgatgtataagaagtgataaataaatgtgttcattggagtgaagttgaatgaaatgtgtcctgacacccagagagaaaaatagtttgcctctgagctgcctaagtacttgctaatttaataggatgatggcagaaatatgagacttacctaatagttaaaataatatttgactgctgttttatcagtacctttaaaggcatttcatattccactggtaaacaaatatttgagtgcctcaatgggtcttgaaagtgctatggtgtctttactctgggttggcagacacccaacaattaattaaaactgctttcattaaggcataatattgaaaggattcatgacttattctggcaggacagaggatagctgaagttcattgcttacagtaatgttatgtattctgagttggttagtcttagcaagattccctgtgcccattgtccttggagggggttggaaatgcaggtgcatgatcaagcagtggagggaagggagtatgagcagctatgcaaatgcaatgctccagataaaaatctctttgcccaggataagatatatccttcagaagcttgcctatgtactgcacttccaacgactaggctgccccagactcttatcaggcactagtttgtccacagtggtcattttcatcaattccttcaactcaagctcagggaggccctgcaggttactttcattgccatccaaacccctcaagcatttaatggttctttttcccaacccacaaacctaagtactaaggtttcctcttcccatgtaatcacttcccaccaggctccaccttcaacactggaagtcacaattaaaaataagatttgaaggggagaaaatatccagactatataagatctctatactgtatataacatagaaactcacagggagattttccagttcatttgctctttaactgcatgcaccaccaaactggacaacaagcactaattcaactaagccaagcccagtcctcccagaatgattctagctcagctcagagtaccacgtgccaccctccactcttcccctgtccttccctgtccaggcaggacagtcaagaaataagagttcagagtataggctgtggagccacgatgccttggttaataaatacacccactctctcaatcactggatgtgtgactttgggcaagttgcttaacccctttgagcctcaatttacttatcaataaaaaggatatttaaaattgcttgagtgtccctcttaccagggtattcctctagcaccccaaatataatattgaactcaatgcttttgaccctatgtgcatgcacatgtacaaacacacacacaatttctttcttctgtcctctgtcatctgaataatatcctcccatcaccataagcaaaggccttcatcagttaccccagctggagtatagagcctgcctaggtgcatgtccttgactcctgctcctccttgatctcccatctaactccacccacacattcaatcagttacaaagaccaaccacaatgccccaagaaccttccaccaacacccttctctaactataccttcctacttaatgcctcgacaactttgatgacttctcaatgacctttccacctggaaactctcccttctttaatctttcatttacatcagacaagaggactcttcctaaagcatcactttgattatgccattattgtcctcagaaaccttaaatgcctacccactacataaaatccacgtttcttagactctccaatctcatgtcacagcctcatcacttctcaggtcaccacctatgccatccaaactgctgtccctacacatttattcatgcctccccactaaatgcttcttctcaatccctctgaactccactggctattcagagtgcagctcttccacagaatcttccccaacaagtcaccccagagtgacctcctgttcccttctacactagaggaccagatttatcccttccagagagcaaatgtcacttcctcagaactccctccctccacgacccccacatattcccaatctttcctctctcctgacttctcatcctcatgattaaagaacatttttctcaggccaaataattataaaaatgaccacaactcacatttatagggccttatctatttgtcaggcactgtgctaagcacttcatatgcattaattcagttaatcctcagtgcaacctggtgatataggttctcttcagtgattcgcaacttaacatagatttgagtacattttcatagaaagatagtagaaaataaacaaatatacccaaaagaaatgaagattatatatatatatatatgcgcacatgtatagctacacacacatagtatatataaaacagcattatcaaataatagtatagcatatatcgtatgtctatatttttttcttttacgaagtatataaaaactatgaaggaaagtaaagcagggtaaagagattgagagatgacagggattgagagatgatatggtttggctgtgtccccacccaaacctcatcttgaattgtagctcccataattcccacacggaactcactgagagataattgaatcatggggcggtccccccatactgttctcttgatggtgaataagtctcacaagatctgatggttttataaggggcttccgcttttgcttggctctcgttctctttgcctgctgccatgtaagatgtggttttgctcttccttgtcttctaccatgacggtgaggtctgcccagccatgtagaacgtgagtcaattaaacctctttcctttataaattacccagtctcagacatgtctttattagcagcgtgagaacagactaatacaagaggcacaggatgggttgttatattagatgaagtcatcagagaagtaccatatcaacagagacccaaatgaagtgaggaagaaaagcaacagaattaccgggcaagaatggtccaggcacacattaagaaactaaactacagagaggccatgtggcttctcaaggtaacgtgatagcaggcacagtatgtgaatcctaattctgactccaaagtcttatccttagccaccaatcctcaccttccattaatgttctgcagcagttcattctattagccagctctggatttttaaaactctcttttttccctgttagttaacaaatatgggccttctacatgccagtcactgacctccattcattggaggtcacttacctctacaatttcttctccaggtataacacgtttccctggtttcacctctatctcccacccttattctttacagttctgactctagactctattccttatccagttcatgacttcagttaccattatctttctgcaactaattcccaaactggcaccccagtttaatttgatagccagcttcttgggagcaagactgtgcctcattcatctctctattcctaatactcatcacaatgctggacgtgtaataaatgtgtgcttctctgaaatggattaaatttggactctgcatttccatctgcctttgggacagtttgacctggatgttttcccagtatctcaaaatcaatatttctaaaaatgaacacattatcttccctccaaaacctgttcctccgcctatattccttgtctctcaccgcagcaccacaaagtatcacagtcaccaaccttgccatctttctcccccacaacagtcatctcacctttccattcccactgcctttacccttgttcaaacgtttgttttctcttgcctagactaatgggaccgcctcctcatgatatcccaactaatggtacttcctacacagctatgcaaaattaattcccttcattctgtcactttttgtgaaatttgatggtcttctatccacaaaattgaatctcagtatcatgttccaacccatatggcccaatacctattgggcatcttctccactttgatatccaagaagcccttaaatttcattgttcttcaaaactaaccattcaggtttttttcaaccgaacctccatctctgtatttcccatcttggtaaatgtatgccacccaacagttcccctggccagaaactgagagttgctcttgtcttctatttgtctgatgtgtactctctgccttccactgcatgaccaatgccttgctctgtccttccttatgtctcacctgcagctatgccacacaagtctctgcctgctgttttactccctttttgtccattgactacgtcaccagttatattcccagtgtgcaaatgtggtcatgctgtgctcttgattgaaatctatcagtagttttcatactgcatcacatcttgaccgtgactactgtccagcttcccatctcatagttttcttcttccccacacattcccacaaaaccatacaaaattcttactgttccctgattgtagtaccatgttctcttggtccagcctcaggaccacagttctccctgcctgaaacattcaaaattcacctgccatctgtccctgaaaaattcattctcattctccagtcctatctagtctaagtagctttctacgactatcccacttgcgtagtatgacttatacctgtttccaaagcagtctgtgcttggtgttattacagggcttttgaagttctaattttcatctctcatttctatctctttagattcagggcttcttttccatgggatatttttcaactctgtattctagtacttagaagaatacttgggaaatgatgttcagtatatgttttgtgaaagaatcaattggctcacatttggggaagcccccatgatatgaaggagtagtaatattatttaatctacagaataatgctcttttctacgtaaggtttgtgttgtattatacatgattctgtattatacacgattctgtattatacacgattgtgttgtatatacacgattctaaaaaactactatcactcaataacaaaccatgtgattatgatagatttactgtgtgttccttcagcttattatttcacagaagacaaggactgcacctactgatatccttcattaagaacatacgatggggtcctaggaaggtatttagcacgtggctttgaagatgaaataaactaacatacgctgtgtaattaatacacaatttgggtcaagtagaattctggggtagagaaggaagatatgatttaaatgtttaattcctataccttaaacaattaacatatctttttatattctgaaacttttactagcactgtgtctctcatataggaggtgattgataaacgcattttaaatgaatgattgtttaataacattctcaaaaatatttctaaaactacacaacacaaattacattaaggctgaaattataactgtcattgagatctaaaattttgctgtaacagtagttatggaaggccacaatctcatgctcagggatccaaggataaataaagctatgtcttaaattgcaattcttctaacaagttagttttacccttttacagtttaatcttcccattgtagtggtggtggacttttcattctcactgtttattctgagaggtgaacaacaattttcaaagtactttttaatgactaattttcatttggaggttacatccataactttaactagaggacttacagggtgtagcggagactcctgtacttaaattacatcagaagtgttagtatttattaccttccagcttcccagtttagatgtgtgccctttcttaaaaactatcttacaacatctccattttaaaagatgagatttattctataaatccacagtaggagaattccctcactccatgtccctggatattgtattttacaggttctggcttcctttttccatgtttctcaatgcctggttctgcactctcattgttttatacttgtccccaagattttcctccccacaacttttaaattaacacagtgcacctacgtttcagagtatgtgccaactctctcagatatcatgacttcagcagaaaatcctgatgaaactggaccatgagcggacagggaacagataaccactgcaataatactgtgcatcaaagtagaaaagactcatcttcaaattaaagggagtttatgaaagtagatgatatggaaaaagtgatttaaaattcttggaaaggatgtgagaaaagttgagcagaatgtgactttcacaagtgcttgaaatattagatgatgtataataatatccctaaaataagtgattcccaaaattaagtttaaaaattagagaaacatcctatttaatttgaaaattcctacaccaatttgaaatgcctctgcctacaccagaacatcatgtaaattcccaataagagacctgagcattttcaaattcctttaggattatctttaaacagaagttatagctcacttgaactctccaagcttccaaatcatatgttttatgaaaaaggtacatttctttacagacttccagtatcaaagaaggtttttaaaatctttaaaatagcttagataatgtaatgtctttaggtgactgaaagataaacccatattacaattagaaaaattggtagagggtaggaagaaatggaaaatagaacaaacacagaacttcaagcccacttcttctcatagctttattctataggtccccaaagagtaaaaggtcaagttcaatatcactgtgtgcttccacttggacaggaacagcacttataccaactggaagtaattttgcttttaaatatccatctcacttcatccttaactctgttatgagaatgaatattttaaaataaacatgtttaggcatttattttctcctcaacttgactatcaatgcctcatgcatattcagttactaaatcttggataaacagtaagctctttagaagtagactctatgtctcagtcgtcccaatactaagtagtttctttgtaaatatttgctgaattgatctcatttcatcattacaggatctttataagctacaagtagatatcattaccaccattgtacagaggaaaaaagaaagaaacagcaacattaaactcaatggctacttcatatattctcgcctttctaaattaaattaaaatttctctaaattaaacttctctccaaatttaacttgttcttaatactatatctcacagagttgttttataaatgtctgtttgttagttctatattattttagtttttttttctcaaattccctgtggacacaagaagactggaggatcagttccactacagtagaatgggttggagtacaaccctgtatctttgcctttagatgtaactataagacacttttattcatggagtgaattaccatatgcaaagcatggataaaaggtatgggctaggccattttttaaagtagtttctcatgctatcataatgaatattcattaaattataaaaagttataacccaaaataaaacccctggcagaatatctatttggagatgtagatcggtttaagagctacatatgctatatatacccaatattatcatgaaactcatgaagacatttagaagtcatgtcttttcttgtaaaaaacaaaataataagattttcagacatcttatcatatgtaacaatgtacaaacagcacaacaaaaaaagacagattgtgggggaatcgtcattagactgcagtagatactgctatcagtccaatctgattttgattctgatctgggctatgataatgtcacttcttaaataaactgcttcactcaaaagctccttcagaatattaagaactgttgacatctggagatggaagtctatttttcctccaaaacctttttgtagtaaagacctattaaaaaaaaaaaaacagatctaattccctaaagacttttcatgagcagatgttgtctgaatacaaaaggggacatttccctaagccaatacaaatttcaggtaaccaaaaagttaaaaattgttgctgtaaaatgttttgaggactcatttttacctaaataaataattggggtgggacaggtagagggagagaagtttctaaaaggtcaataacatatccaaagggtatttaaactgacaatctatttccaatgagagagccactcaaccacactggctgtgttcgtttaggaagaaaaatcagccttaacatgagcatgaaggccaaatgctcaatatggaaaattctatatttatatccatgttcaaattattccttatattgtcagagtgtgtgaagagcttttatgtttaaatactgacagtcacccctttttcaggttttctaatgctacgtgcatgtgtgcgcatatagcacagcctgtagtgaaaagactgggcaagaagaggagatacagccacagcaatgacagcaaaggagctgaacttctgcttgtctcagccttgacacacttttcacttcccacttacttccctctcaatacagcctgatttttcactgtgaaatctgatataaaaggaaatgcacctgaggaaatgggtgtatatacactgaatgacatctccatgcctttttaaattttcccattcctttccacatccactgctgtaatgcaaggatctatcatctgatgagaataatggtggtggatgtggtggtgtaggcattcactcactgaggggaaatttacaaaggaccatttgtggggttaggggccaggagatgtgaggcccctcagactactgatgttggaggtgatcattgatctggaagggagtaagaatgagggaatgtcatagtaacaacacccaaagatgacattgatgactgccctaaatacacaaaaacactgggcatctattaagctctttttcagaaacactgtacactctgatagtcatggtgctatagatgcaagaacattcacagttcaaaggagcattatcttgatgtcatgtactgtgctcataaactcagtccactgaatggaaagacatggagccaaaagtcactttcagccaatggcttaacatgcaatcaaatgtgaattgtaactttggtctttggtgggtctaccatgggacaacgtgatttaattcaatcaatatgtttaaatatctactagttttttgttttgttttgttatgttttgtttttgagacagagtctcactctgttgcccaggcaggagtgcaatggtgcgatctaggctcactgcaacctctgcctcctgggttcaagcgattctccctgcctcagcctcccaagtagctgggattacaggtgtctgccaccacgcccagctaatttttgtatttctagtagagaacgggtttcatcatgttggccaggctggtctcaaactcctgacctcaggcgatctgccagcctcggcctcccaaagtgctgagattacaagtgtgagccaccattcctggtctaaatgtctactagtttgtgaagcattgtagaagtgcttactagaggtacaaaaattagtaattcttgcatggtactacttgccatcaaaaagtcaacagaacatctgcaaatgagacaaattatgtccagtgaattctgccttgtcattcagatctatatcaacaataaaagaaaaacaacttatgaaaattcaaagaataattatttggggaggagtcagggagaaatcagtaagcccgcaagagaaggacactacatttcagatgtgtcttgatggatatacagattttcaccaggcaatgtgagggcaggaagttaattctaagcagtgggtaaaacaggagatatagctggttatggtcccagctactcaggaggctgaggcaggaggattgcttgaggccaggagttcgaggctgcagtgacccataatggcaccactgcactccagcctgggcaacagagtgagactctgattcaaaagaaaagaaagaaagaaaaaaggagatatgtttggagaccagggaacagttcagtttagccagatcaaggtgtagacccagctgcgtcatgattttcgtaggagccttgaaaatcaagctaaggaatttgtatttttgattctataagtaatggaggggggcattaaaagattttgtgcaggagaatctatgactcaagttaggtttcagtaaatttagttggttttgagtggggagaagcagttagtgcaaataggatgtaaccctcatggcctagaaaggatgctgagaacataatcttggtggtagaaatggaaattgaaggaagagacagatataaaatacagaaagaaccaacaagtcttggtgacttattcatcatgatgagaataccatagagaaggagactcttgcttttttttttttttaacaacatgcctcaaaaaatgttgccacgataattgttttcagaagatagagcatgtctttttagacatactgactttaaggtgctggtaaaactttcttatgagtctgacgagcagaagaggaatggagcagactatacactcaagagataactccccatcaaaataagaatcaaagccacactttgattaggaagagagtatagagggagaagataattaaaagacaaccatgtgaaaggctgcacaaaatgggcaaaaagaggaaataagtgtcataaaaggagatctggctgggcgcggtagctcacgcctgtaatcctagcactttgggaggccgaggcaggaggatcacttgaggtcaggagttcaaaaccagcctgaccaacgtggtgaaacgccatctctactaaaaatacaaaaagaaaaaaaaaattagtcgggcatggtggcgggtgcacccgtgatcctggctactcgggaggctgaggcaggagaaatgcttgaacccaagaggcagagattgcagcgagccaaggtcacgccactgcactccaccctgggcaacagaatgagactccgtctcaaaaaaaaaaaaaaaaaaaaaagagagatctgagagaaatcagagaaaggagaataattcagtgcaagtgggaaaggcttcattcattcaatatctgttgttgagcaaatattacaagtcagacttcatgctcaatactggggataaagtggtggacaggacagaatacttctgctctcacagagctcacagtcttccaacacatgttggtaaacagcatgaaacatcccagtgagttcaggacgacacgaattgagaaaagtccctcaggacctttaaccaaatgaatacttttggaatgaaatgggtgcttcaatgcccaagggtaaattaatttataataatgggtgcagttatataattttgaaagatttttcagacttgcaaaggatccttgaacaaacaaaatactcatctccccacaaccccctccctgcctcacacgttaatctacttgaaatagtcgctaagaagagaggctattaagtaaaaaaacacattctgttatgtattattgaaaagcaatattattcacatgttctggaaaaagtgagaacacgaaaaataaataaaaggacaaaaaatagtaagaagggcttaataatttaagcccagaaatatatcttcaaaacaatcaaccactacctggcctacaattctccagaaatcttgcacacagattttatattgcatggctcattaatttccaaaccatccacagctttattttatgagagggcataagcttcaggcctggggagagagggtggctgaatttcaacactttgtcctatcatttgtttagtacacctcttacatttatatgacataaagaaaataaaataatgattgtatgatgaaaagcttttcatggattcagaataaatggatttttcaatattacccttgtggaattactaatttgagtttgccttatttttaaaacacatgaaacttaagccaaagccacgatacatccatcaaatggcaattcaaaattgaagacatttttttactctactattgaaacatacattttcctcatttttagttgtagattacatcacataacatctgccatctctaagttagatggcacaaattaaggacaccaatgaataattttgtagttttttttttcctctgaccttgtttctgattctctttcaaacatagttgaattatcatctccctcagtctctccactgttagcaggattacgttctgattttatagcaggagtgcaaaatatgggattagacaatgaaatgaaaaatgtattttggtcaggctttgggtttaacatggaagctggcagggcaaaagtgagcactctaatttgtaagaaaccttctctacttgtatgtacttatgcacaactcacccattttctgtcctctctggcattaacaatgtcaattacagtgatttacaggtggtgttcatcagttagcatactagatgcgtttacttgttgagaagagagtacggaacgaactttttaaactaaattattataaagtttcagaattgcaactcgactctgttctgtcatttccaacatttcctctctactttccattcatgtagtttcatcctttgcctttcagcaaaccatttttcacagtgttctatctctaagtcaggtcataaaatacatacacgtacgcacacagactcacacttctctaattcttgatttctctatcatccacctacatttctctcagttagatcttccagttaaattttgcttagattccagctaaatcatcttataaacctccattccagagatatatattcaaggaaaaactgtatcatagtacaagatagtttgggagttatataaatagcctacttattggaaagagaacaagagatcgggactattattttaaaacaaaaatggaagacagagtttaagcctttaaaaatcatcccttctcatcccaggattagtaaagaccatcctatatctgatcacaagtaagcaaagtacttatgcatatgtttggtgaaaatagtattacatatttggggatcattctctaatattagctttgaagcaatatcaacaagaataaaaaagataatccaaactatttttttctttattcttctcatcatatgacaactaactaaaaatttgtgaatacaattcaagaaacaggtgtcaaatcaattctcagccagaaaactcatcactttggtctcaccttagccaaggtataaaacaacatatttctgttctctaaataaacagtgaacacatgctgattctggagatagcagtaaaaggtttgcttttttaaatgtatagtactccccaggtgtgacttcatcttcatttcccatttatagtgattatggccacccatgaccctgtgcatagtctagacatgctgattcaatccccatccggttgatggaagaacaggtacagtcaaagagctgtggtcactgaggagccaagcaatgcaagccatccagatcctgagacgacattcctgccatctgctccagccttgagttccctgggctgccgtgtgtgaatgtgtctctaataggacagcgctagccctctaccctgtttattctaaagaactgcaaagacagagaccctacgaactcaactcaacaccccaaaactactcagccctctacattaaacacgccactcaggaaacatttgatctcttaaagattgtaagcatttctcacaagagataatctacttatgcttggctcgtaatgagtgggcatctccaggcataagtgaaaacagaactaaacacagttacaagtcaaatgtggggctttacaggtgatgttcatattattttttccagtccaaaaggattaagactgttctctttaaaatttcatattcaagtgagactagtgtcctcccggttacgatgaccttaactattggagtgaggaaaagaaagggagggtgtccatttccatttctcatggccataaattcgaatgattgactcaagttgttgaggtgactccatttccctgagtactaaagaaggcagcaagtggaaacacctctttgcttgcaagtttacagccctcgagtccaagtttttcaccctctaaacccaaactatgctatagccatatgtgaccccttagcttatgtaatcagggagaggtccagccctttatcactctcatgtgccccaaaatcacttccattctctttccggctcctgtaaaatactctgtacacatcaaaaccacctaataacaaatcgatgcaacccaagacgctttgtggaagggcatcgtctcctatttctctatggatcccaccaaacagcaaaacatttctccctgctttcgcagaacgcacgtttctctgaaagccaagctcctaacacagtgcccgataccttaacaaggctgtactgtatataaattatttgcaagtgtcactgaggaccattttctctgaacacactaaactgaagctagccataaaacaagccatacgctcctgctttagaatctgacatgggcaagatgccgccagtatattaccaggggacaaaaatacagttgtaatgaagaaacgtgtgggggcatgaaggaaaagtggaaggcgaggatcaatactatttcagctcattaatccccaggtgttaggggaaggaagcgtgcggtctggagtcatctggcagatgcataaacaacctcggaaattttcagagaaggcaaaagtacgcacaggatcgcaggggaccctgccaccggcgagtttcaaacacacttcaaacatcttttcttccccgacctggatcttgcatgcacccccctctcctttgcaccccattcctgccgctcccacctccccttcccagtcccgccaggtgactgtgtctcatgcagcgaaggcaacaagcgtccccagccgaggaagggaaggggcagccgtcttggctcgcgagggaaggagggcggaagcgggcgcccgctcgcaagcttattgcatcctaccgcctgtagagctggcctcctccagctgagccgaaatgctttccaccctcctcacattcatgtctagggacgcagggtgcagaagcgagactcgagagtccaccggccaggggcgtctgtccacgggtctgcacgggagcgcaccgccgctcggcccgggggcgtccgtggcgctgggagc

SEQ ID NO: 366 - DNA, 588361 bp, Homo sapiens
agatctatctggaggagtttctgtggagccagccaccctcaccaggtgccttccattagagtttaatgctttgctgcggtttcctgaaagagccccacagagagtgggtctcgatgggtcctgaaccgcaccacaaccggccagtgaggtgaggggcgaaggtgaggggcggcggcggggcgaaggtgaggggcggcggcggggagaaggcttcgggaccccacacggtccgggggaccgcgaacgaggagcgggggtgcggggccgcctggcgtccccgtcgaggcggtcttcatgagaacgctcagagcaggggcgggcaggcgagggcttcgaacgcacacactggggccccggacccgcgtcgctgagctggggagcccggcggcgcgggccggggacggcacgggcactttggccccgtcattgacagttggcaccgggggtcctggtcggccgaggcggggcgtggcgccataccggggcgtggggcggcgcagagaggctgtacctggcaggtacccacgtacctatcatggtcactgggtaggtggcggctgcgggccaggaacaggcccatgcgcgcagcggcgccagccgcgcctcccaccagcggctctcctgggttaaatcctccaggcctccccgcccccgcgcccggccctaggaatgcgcacgcgcggagggcgcggcccagggcctgctgggagtcgtagttctaacgcgtagtttctcctcacgcctcctgcccccagccccccaccgccgccctttccggcttcaggcccagcaatcttacgtcaccggggggcggggctatgcgcccgccgtgttgaccagtcgcttagcaaccgggaggcttacctttggaagcttgttgcagctctagccaaggtcctgccctcttcccgccccgcccctagggtccagctcccttcacctaggagctgccaaacatctggatcaacctgggcactacgaggggttgaatttctaccattatcgcgccttttgatatttttttccagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtaagtgatcttcctgaattaaatgcactcgctctgaatcaggggacacgagatttacagaggttggccagccttaggatggactctgagccatgtcctgggtggtctttgccaaaaaaggcagttacttggcaagtagcaaacggtgccccacagtgtgtggggggcaggctaggttgttagaatcttgggcaagtgatgtactctgcccatttataagcaccttcctgataacttatggtttctggaccgcccaaaattactcttaagctatttacacgaggaaaaaagatcccctttacttactaattcctaactagccccactcagcaaagggccttatagaaggtgagttcttagaaatcataaactcttgcaaaatttaacatgagctgatatacaaccgggaacataaactcatgaaataatctataatgagaaatttcttcacttcaacctaggaaattttagaatatcctagcatttgctctaacaacacttgtctcttacaaaatgatgtcatcttcttagagtactgaaagccaacttaatatgaacactgtttcctgacaggccttttaagatgatgtgctttaaacaatacaagctttagctcatatatctctgctactaatacaattcatatttcatctctattatttgtagtaataaaaataaaatattctaagtatcattagagaaaaaagattaaaaatatatacaaatattttagctgtctgcatgatagtatatattttttaaaccttcctatttgttaaatagctttacacttggtatgctaagacagattttgctactgagtaagcaactgtctgggaatgaggcattaaataataaatgcatctttcaaatttgtgtaatttacaccctgggaagatctgagttattacatggcaattcattatgttaaatgaatagtgttgttttccagtgtcacattatttcctttgcttataggttgcaaacctgataacttattcctaaacgacatacttaaaatacatgaatgaaacagattacctatagacctctaggccaggttcccatgtggctatgcaaaacgatatcctaattattgggaagtgtgtcaggtgatttacagtagttaaaattcttggaaatggactaaaattctgcttgttgtaactaattctttttcatggaatttcacataaattggttctcctaggagtcaagatgatgcatttatcagcaataccataaccattcaggttaatcatttagtttttcttctacacaatatttacaattttgatgttttttaatgttatactttaattttttttttactggttggggttcttttctgttttttcctaaacctgtattcataattcttgtatcatattaattctttaatataatcttacacctaaagagatagttctgcaaaatctgatgtttctgtattgccaaatgtaataagtatgcctacatgacttaaaaaaaacattgattatgaagcaggcttctttataaacaacttaattgagatccattatcttctctttttatgttctaaaggaaaatcttgtactagcaatacctctcttgccattggaaatcgtaattcttaaatgcaaacattatttatccattcatctatttattcagtcaacaactgtctctcttttttttttttttaatacccagtgtttgctaagcacagttctggggatttgggatcagcaaagcaaagtccctgcccttagtactccgaggaaaaccaaaataacaacattcaaatcttgataaaagaaggctggacaataccgtttatacaaaataacttcagtggtacaggaaataaaaattttcaatttcataaccaatatttacatttcaccatttttatctttagcagtatagacttctcagcattataaggtgaaaatgtcctcatctctttctgaaggtgtattttgattcaggacgtgtatgccaatttccagcttttcttaattgcaacctcatgctccaagagccaacaccctccaaaccacttttccagttagataagtcaacattccaatgctcttccacctaaaacatgaagaactgtatatatcataaggagttatacagagactcctgatatttctctgagtgcgatagtgatacaagtacataaacttgataataaatatgtttcatcaaatgggctgtgcaagcagaaatgcttatttaaacaatctggatatgagagtgcaagattattgaaaaaataatgataaatgtaaatggcaaaatttttaaaatctcaatgtcaaatatttttcttcaatagaaactagactttctttccatgaaatttttgttgcattctataagaaaacaagcatcacaaaagccctgcaatgaaataatattcaaattcacatttttatagtgcttgcctataaagagatatgagatacacaacttgaagatttcatagttcattttcctttaaaagtcttgtttggggtgtgatagagcccatgaccagaaactagtaacccagtattttgttgtctttatcttgtcagatactttctgtgctgaacaagcttatcacgaagcaagttagaaaatcgacccagggttatggtgacagagaagttgagttcagcctaagctttctattacagctttccttctcaaaagactatagatgctttatgctcaaagtttaggggaatggaataaataatttttttaatattaaaggttgagtattcctattccaaaagtctgaaacctgaagtggtccaaaatacaaaactttttgagtgttgacattacactcaaagaaaactcttttgagcattttggatttcagattttcagaactggcgtgaccatcagtatataatacagatatagtcagctctttgtacagattctgcctccatggattcaactaaccttggattgaaatgtttgggataaaaattttatctgtattgaacatgtacagacttttttttttgagtcattattccctaaacaatagagcatagcaactatttatggagcatttatattgttttagatattataagtaatatagacatgatttaaagtatataggtagaaatgtgtaggttacatacaaatactacgccatgttatatcagggacttgagcatctgaagattttggtatctgcaggaggtcctggaaacaattcctcatggagactgagggatgactgtattccaaatttgaacaaaaaacaaaaacaaatccaaaacacttctggtcccaagcatttcagataagggatagttcaacctatactttacatgtatagtgtgttttatatttaccaatcatgtgctcatttaacacgtagtggtaatcatcaatatttataaattatatattaaaatattaatttggcttctgtaacactgaccaaataacaatagcttaattaagatggaagttgtttctctcataatagaagttcaattttgtaggcaatcccaggaggttgggcagcattccccatgaggcaggtgcaggggcataggagcatgtttgttctttgcatcctgtaaaatgacacctgagacaaggggggctcgagaccaccagggtcaaatacctgccctcaagaaggaggaaagtggaagcagagagcttcccattatgtgcatgacccagacacagcaccccactttcattctcatccaactggccagaacctagtaataaatacacctacattttccctttttgcaaaagcctatgaaagcttgacccatgaagcaactcccaagcccacgtacctgtctcctcaggaaaaggatgaaggaagctatgtagttccaaaagggcatcatctccaacacctacttcaggtggaggagagaaaaatgggtatggagcaatctgcaagaatgaggcaggaagaaatgaagagcaaacagcttcactatgagggcatgtcccagaaacagcaatcctcactcctgctcaaatccattgccaaaacctagtcttatggccacagctagttgcaagagaggctgggacatgtagtctttaactggtagctctgtgtccggctcaaactcacaatgttttattactgtagccaaggaatattgggggataattagaagtgtctagctccagtgctaaatgtgctacattattagtgaagaaaaggagagagacaagtaaaataattacaatacaaataaacagatgtctctggcagagaagtactaatgatgaagggaccaagtggcgatgaactaatgggtgccctcatcaccttttgtctaggcttgtacaatatcatccacctatcaattggttgactccctcaatcaattatcagtacaattacactaatctttctggtacaatgttctgctcctatcactattcagagcttttggagcttcccaattcttatagaaaaaaagtcaagatacttccccagggccagcaaggtcttgtgtgatctaatcccattctgtgttctaaaatttcatctcccactgttctcatttgcttcagtcaatctgaaccaaggaaataaactcatattctttatttttgtgtttctgtttatgttgttccctttgctcgaacacccttctccctacatatctgcatatacaaattcattctatcatcaggtaacacatatctattgatcacagactatgtgcaaagcactgttttaaatgctaggaatttagcagtcagcaaaagacagaacacatgctgtcaagaagcttatatttttgtggccagcaaaatgccaactgctttaagaagacttctttaattctcccttcctgtcacccacatagaaagttatcctttattcattgtgttctactttgtattatggtcatttctgctcatgttttatctccttatgtaaattctccgtgagggcagtatccacatctaagtcactttttaatcttaaccagaacctaacagtgtattcaataaatatttgatgaatgaaggaaagcaattctaccctttcttcttatctcatattctcctactttcttattataattgttatttgtctctattttgaatttttttaagccatcctctctaattgtggagcccagaagctccctttaaaacttgagaaggccgaatcatggcattcgtcacctcaacccctcaggtggctccctgcctcactcagagtaaaagctaagcttcctctattgggaaggccctgtgtgatctgcccacccttgctgctttatgcaactctgctggccctgcctccggaactcagttagtgccacgcctttgcccttcctgtttcctctgcctgaaatgcattttaccctgtgtgtcctcatctcttgatgcttcaaatttctgtttaaaaattagctatttagtgagcctcttcctgaccactctattttaaacttcagacccttaacaatcccttccatccctgctccagcactcccatctcccttccctgttttatatttttccctctaatattaatttagttgagcctgtgtttttcttctaccagagagtaagccccagaagggcaggaatttgtttatttcacccattgctgcatcctcacctcaagaaaaatttatggcacatagtagctgccatttatcttattttgatcagttgaattaatgaaagactatattttatactataattagacaatcatcttcaaatcagtggctccaaagaaaatgccaatgatgttatatagatattaaatctagaaatgagaataatttgcagctgttttatgcagtatcataaaagttacacatgttcattgaaaaaagttaaagtggtttggcttagaaaagctttttcctgtctaagatgatgagaaaaaattcagtctttttttcctggattctgttttacttttaattttttattttgaaagtttgcttcaccttaagtcattttgattttggaaggtataaattttgacttattttccctaaatggccagagaattgttacattaccctttatatacttaaattaaattatatcaaacatcttcctatcaaatttaggaattcctatccaatttaaataatatatcagtgctgtttttattatttcaagtaactttattaataattgattacttaatgtcatatatttattctttcatatataatagggctagtgatcttcattccatttggcttttccaaccaatcttatgaaaaggcagagtagactgtgtttttccacttaatgtataaatctcaaacaatttactattttgtggttgtttagagatacttattaaaggatagagcaaggactggaacctagatttctaggtttttcttacaacagttctctcacatattgtaagtgaatcacttggtgaatatcaaaccaaacacactgatacaaccaacacccaaatccagaaacattgtcaacaccacagaaccccatctgtctctttgtagtcactacccaacattcccacatgctaaccttcttctgactttggccaacagactagtttcacctgtttttgtacttctatacatggaatcataaagtatgtaattgttttgtgtccagtttctttcatcaacattctgtttgtgagattcacccacattattgcatacaactatagttgtaagtaaatccttcatgtttatccctgtctagtattttcttggatataccataatttatttatccatcgcttcctcgatgggtatttgtgtgacctccaatttagaactgttacaaatagcactgctaggaaaatttttacactttttttggagaaagtatctacgcatgaccaaggacatatttctgggagtggaattgctggaccctaagtcatgcttgtttggctttagtaactaaactaaagctgttttcccaactgatttttcaaatttaaactctttccagtgctatatgagagtgctgtttgtgctacagtctcaccaataattaatattttctttattttgcattttaagtattccagtaggtatgtaatgttatatccttgtcatttgaatattaattttattgtgactaatgaagttaacaacttcttcatatatttactgtccatttggatatactctttattgaagtgtctttttaagacttttgactgtttttctcttggcttgatttggttttttatttatttgtagtacttttttccatctatattctaaatgatatgaggcacttgtctagtattgtatgtattgcaactacagttacccactctgtgagtttcctttccattctcaataatggcttttattgctctttttaaagttacatactttgtgaagaaaaatgtttacctcaaacatacttgtgtatttcttcataatgtttcctcaaccagtttcaactagctcacagtgaaatacatatacattaagacacatgacttggaaaataaattggagcgattggaaatgaaatagaataaacaacagagaaataataaaataaagtgtaattaaagtagaaagcttgggctcaagaaaagaagcatcaattttgtcattcataagagtcagtatatttatcaatggatgttcaaatttaattctgagcttcttggcatctgttgctgaaaggagaacattatacacatctcattatcacaaaaggagaagcccatcaatccctatagggaactgaagctttctctacactgaactctctgagaaattggtcatgtcacattttaaatacatgcaacataccatatctacatttttatcttttgcaagaaatgcagtgaaaatatcatccacaaaagatttcagtgagagctaagtacacgttattaaaatgtatcttggcaaattggattttgcctgatattaaattgttgtagtacatgtacgtagactttcggtggtccaatttgatctggaaatggaatttacagtgctcacagaaatgtgtagattgtatatattttagttattgttctcagttcatttcatgatgggagcaagatagctgcgtttttgtagttggcagggagaaaatgtgtaatatgataagagcacagagctgaacgacctgagagggtctgagtccaggaaagtttcctgaagggaatcatgtttggtgaaatataacagttgagaaggacctaggggagtgtgcaaaggctgagagagaccaggctcccagctactgtggttttcaatcttattttctgcctttttttttttgccataaataattatgttgtaagttctattcattatatacatgttaaaaattatttagattgcatatatattttatatattttgagagcatatagagtgtatatacctacctgtatgtttgtatagattgcaatgtacataattataataccttatatggaattttatggattccttctaatatgctaatattttacatgttgttgaaagctcataagcatttaaaaggcttcataaaattctatgctttgaatttgtcataatttactttgtctttcacttaggttgttttcaagtatttactattagtgtatacatagggttgaaattagtatctttctataaaaagttttttctgtattttacagtatttccttgaaatacaatttctgaagtagatgtactgggtcagagagcttatcaatcttaaaaccccaatcaaggttttattaatactgccacctgctgtgcttgaatgtgcctattctagctcctcctgtggcctgcctaaggggcttttgacttcccggaccttgcctgctgtctacctcctcatctgccagtgttgagggtcaggatctcagcacctctgaaacctattcatgatacaaatgagggggttgcaaacatctaaggctgtagttctcagattgcaaattgtaatcacttgaaagattcccatttaattcttctaagtgttctggggttgatttaattagtctttaattaggggttgagaacatctgggtacatagtatgatggggaagatctcagaaaactattttctagatggctactcaattttcccaaagacatttattatgtaatattttattccccattgctttgtgtgttctttttctttttgtgtgtttcataattctacataatagagatatttgagaggaatttttaacgaatgtccacagttttaattattgtggtaattaaaccacaacttggtaatatgttttagaaattggtggggctaatttatcctgttaattcccagaatgtttattttaaattttaacattttaccggtttaatcttccaaatgaccttttaataagatgtaaagtcgaacatcattttgagttggaaatgatcatataactcactagcaaataatgatcattgtataacagtcttcacttatagtaatataatttatcattccatgcttataggtatacattttcctaataaatatttttatatttattttataccaagccatctcactaaccaatgttttcactgaattgcatgtattttattttaatcatgttcttctacattttgaaaaatttaaatctacaaataaatatagaaatagaaaaagaggcatttattcaccatctagatttaataaacaatatttttaattgtaacattatattcttataagtaaaacaataacctcactaagagagccacagcttaatttgtactctgtcctttcattcctagaggcaagcaggatcctgaaatttgtatacattattcctaaatatgcataatgaatatatatgtattcgtatatcctatagatagatggatacagagatagatgcagagatatagagataatagaaattcaagaactgttcttcaggttactttttcatctgagctatttggttacagtgcaggtttctgtaatgccttcaggtcatattcagttcattaatagcagaatgctatcagtgtacgtaagacgttcagatgtgactttccccatcttgttagtattttgtgtcacaaagtaacagcaactgggtacaaattatactaacacagctaaatgcagagtgacacagagtaatagtgtcatagattatacctgtttgctatgggttcttcttcctagttctgtttgtgcacttgctcttggaagcatctaatgtgaggcaagcccaatctttgtagatccttacaatgtccctatcattttttcaaaaggcatagcactatactgtatttactccaatatttcatttttaaaggtaaggaatgtaatattttaactgtggtagttcattttaattagaatgattattaaatgctctggttacaaagttgcatgtatgtatagagctttgtaaacattattttccccataggtttccccatacactttgatatttctagttagccattttgttaaatggtggttctccaggaatgcatgtcctgttaatagcaaatttgtttacctgctatgtcatattccattgtgtgaataaaccagctttttagttcattctcatactgagggtccgttaggtttctacattgcagtatcataacatcctattgtaggattccttgtgcatgaaggccaaagttcaccagatttggaattgctgaaagatgaggtataacttcaactttaatagagtttgtcaaatttctcttcaaagtagtatataaatatttatattgtgaccaacagctaatgagaattcttttttccaaatgcttgtttccaagatcataaattgttggtatcagactaaaattgtaccaatctgaagtatatgaaataatatcttgttttaattttgcatttctctgattactagtggtcatgtttcctttttataggagttttatcatgtagatttcttcctctttagtgtgcatattcatagcctttgcccattttttctgttacattgtcagtccttttgttattgacatatagctgtacttaacatactctagatatggatatgttctggatatggtatgtacatattttcttgcagttagcgacttgtctttatacttatttttacatctttttaatacataaattttaaatttaactttaggtatttatacttatcacattcttcctttatggttttggtgtttttaaaaaatttttgtcggccaggcgtggttgctcacgcctgtaatcccagcactttgggaggctgacgcaggtgaatcacgaggtcaggagattgagaccatcccggctaacatggtgaaactccatctctactaaaatacaaaaaattagctgcatgtggtggcaggtgtctgtagtcccagctactcaggaggctgaggcaggggactcacttgaacccgggagccagagattgcagtgagctgagatagtgccactgcactccagcctggcaacagagtgaggctccatctttaaaaaaaaaaaaaaaaaaaaaaattgcctagtttcaaaagaatttttttgatcctaatattgtaaggtttcttctatgtgttttattcttataatgttcacacatacattgttaattatttaactgcaaatttacttttaagatgggaggtaaggctttcttttgatcttttccatatggagagccaccaagacagtaccatctatgaatactaactgagtactctgtattatgtcccattagtctctttgtctgtctctgaaccagtatcacactgcctttattgttgtagctttacaaattttgtatttagcgagatgagttcccccaatttgtttatatcctagttgacgtcgttgctttcttactatctataggaattttagaataagcggtcaagtttcatgaaaatttccttggagattttaactagaattttattcaaggtgcaatttgtgggacaatatcaatcatcttttttttttttgagacggagtcttgctctgtcacccaggctggagtgcagtggcgtgatctcagctcactgcaagctccaccttccgggttcacgccattatcctgcctcagcctcctgaatagctgggactacaggcgcccaccaccacccccagctaattttttgtatttttagtacaaaaaatttagtaacacccctgtgttagccaggatggtcttgatctcctgacctcgcgatccacctgcctttggcctcccaaagtgctgggattacaggcatgagccacttttttttttttttgagatggactcgctcagccacccaggctggagtgcagtggcataatctcagctcactgcaacctctgccccctgggttcaagtgattctcctgcctcagcctccaaagtagctgggactacaggcccgcgccaccacgcccagctaatttttgtatttttagtagaaacgggggtttcaccatgttagccaggatggtcttgatctcctgacctcatgatctgccctcctcagcctcccaaagttctgggattacatgcatgagccaccacgcccagccatttcaattttttatattcttaatttgctaagggtgtttttcttaattggaagtagtattgaattttatcagacacttgctgcatctgttgtgatgattataagatttgttcctcttcagtctgttaacgttaattatgtgaatacatatattctaatgctgaattatccttatattcttttacattatttaatcatgatgtatttagcttaaaaaaacaagcataaattattggtgtctctgatttaccaggcagcaaagtccttcctagtgatccaccacaaggtgcttttgtcatatcattccaagatgaggtactattgctagggtagtcttttcaaaactgtgtgttattgctagggtagttagtgtcttcaagatcaggtattattgctagggtagtgtcttagtaggctgggtctgtcataacacaataccatagactgggtggcttaaacatttatttctcatggttctggagactgggaagttcaaggtcaaggtgccaccattttggctcttggtgagggctctcttccgtgcttgcagatagccaccttcttgctgtgtcctcacatggctttcctccatacatgtttgtgaggagagcatctctctctctctctctctctctttcttgtagagccactaatcctggcctaaaggccccattctcaagacctattctaaccctaattactacccccaaagccccatcttaaaatacttcacattagggattagagcttcaacacattaattttggggaacacaaacagtcagtatcaggtaagagatgggattgctgtgtttggctcatctgtcaagactggaagaaggaccatctcttggagttcttggctgccagaatgaaacaatatttctataaactaaaagaaatcaaaaaccttcctttggaaagaaaactaaatgtgtgtaccacatttgcattctacaaaaaatatttattagattttaatgatttttttacatactcataatttttttgcagtgagaacagttaaatctactctcagtgattttcaagaatgcaattcattgtgattaactatagtcaccatgttgtacaatagatctcttgaatctatttctcctatttaactaaaattttatgtcctatcaccaacatcatcccaactccctcatctcccagcttctggtaagtacccttctactctttgcttctgtgagtctggcttttctagattccacgtatgatatggtttggctgtgtcctcacccgaatctcatcttgaattttagcttccataattctcacatgttgtgggagggacccagcaggacataattgaatcatggggagtggtttccctcatactattctcgtggtagtgaataagtctcacaatatctgatggttttataaggggtttcccctttcatttggctctcattctctctttgttgccaccatgtaagacatacctttcgccttccaccatgattgcgaggcttcttcagtcacgtggaactgtgagtctattaaacttctttttctttataaattacccagtctcaggtatgtctttattaccaataggagaatggactaatacaacatgtaagtgagattgtgtggtatttgtctttctgtgtctggcttatttcacatgcataaatattctccaggttcatcatagtgtcataaatgacaggatttctttttttttctcattccctcaagcacttactctttgtgttacaatactcttgtagtagttttaatccttctctttttaaggctgaatagtattccattgtctatatatgctacactttctttaactattcatccattggtggatgcttaggttgtttccataccttggctcttgtgaataatgctgtaataaacatgagagtgaagctatctctttgaatactgattcaaagagaatagaaagaagatattcaaagaatatcttctttgaatacaggttcaaagaagaaaagtggaattgctggattatatggtagtttaaattttaattttttgagggacctccgtactgttttttatagcagctgcaccattttgcattcctgccaacagtgtgcaagggttcccatttttccacatccccacaaacactagttatcttttgtctttttgatgataacggttctaacaagtgtgaatatctcattatgcttttaaattacagtgccctgatgattagtggtactgagcattttttcatatatctgctgggcatctgaatgtcttattttgacaaatgtctattcagtccctttgcccactttaaaaaatttgttcttttgctattgagttatttgagttcatgtttttcttttactattttgggtaattttaaacaattattttcattgtaaaagagaaaaattcttatgtagagtcttaagaaaatacataaaagagaaaagataaatctcaaatctcattttttagtgttaatcactcttgaattattcccacatctctacatgccttttttgtttgtagaattggagtcatatcatacatatatcatactatattttacattttagtatgaccaatatattctcattgctaatttattaatgttttttccttgattggatttatttatgctttggttttctttgtatgctatctctcgaactgacataccaattcttccagttttgataatggatttcttatttctactctcacatatttttttcttttgctttccattattaaacttttttactgagtttttgaattatttatttaatgcctctttttaacagttttattgagatgtaattcatatacatataattcactcagttacagtgtaacatacagtggcttttagtatattctcagagttgcacgtatatcaccacaatcaattttgaaacattttcctcatgctaaggaaaaaaaacccttaattatcatccaccaaatggcttattggtcccagctctaggaaattgttaagctattgtctctagaaatttgcctattctagacatttgtcttttgaaatacttttgtttgtaatagaaattattgttcttgttatttaaaagatatgtaattgtatttttgcttccctcttttatatggttgttacttatgaggaattatttttcctattggttggggctttctgattatggtttgattatgattttaaaaaatacaattgttgcttgatggttatttagtttctacagtctaagctgcttgaagtttattagagttttggtctagaataggatcattttctagaaatgttcctatgaaaacttgaaaaaaagactttttttgtctgtagttattctggatcattaaatgcagatcatttgtttcagtgggaaagatatcagagacatctatataaagatattattcctggctgggtgtggtggctcacgcctataatcccagcactttgggaggctgaggtgggaggattgcttgaggctacagttcaaaaccagcctgggaaacatagccagacccccgtctaaaacattttttaaataagccaggcattgtggcacataactgtaatcccagcttcttgggaggccgaggttggaggattgcttgagcacaggagaccaaggctgcagtgagctgtgatcatcactgcactccagcctcagtgacacagcgagaccccatctctttatatatatatatttcataaatataagttgtgtatagtaagaatttggtcagtcttaggcatatttgaaataggtacataagttttggtattcccttctgtttattttctatatccctatttagtaatccataaaaaattgtttaaagattttaaaaacatgactcactgctaaaaatcaaatgatatcatgtaatgtttatggcttttgtgattttgatcagtaagtagaaaatgcaaaagaaaacaagttataaacaataatcagaaaacaatggagaaaatgtcatcaaaatgtattttttcgtctttttttaaccatatcacagaacctagcaaattcatgtttcaggagctctgaaaatgacctgacaataggtaacaatatttatttatacttccttttgggcccagcattctagactttttctatgttatttatttcctggaaaatatatatttatacattcaatggataactttcatatttaatggccttaaaatgaaattttttaaaaagattcaggaagatatatatcattttgcttctgcttccttagtaagaattgacttaaaaatccatgtgccatatatacactactgaatagccataaaaaggaatgagattgtatcctttgcaaggacacagatgaagctggaagccatcatcctcagcaaaccaacacagacacggaaaaccaaacactgcatgttctcactcataagtgggagttgaacaatgagaacacgtggacacagggaggggaacaacacacacaggggcctttcgggggatgtggggtgaggggagggagagcatcaggacaaatagctaatgcatacggggcttaaaatctagattttgattgataggtgcagcaaatcaccatgacacacatatacctatataacaaacctgcttgttctgcacatgtatcctggaactttaaaataaaaataaaaataaaataaaaatctctatgcgacattgagggagttgtgaggacacatacttgaccagacagtggtcttatattggtgaaaagcacatcaaggtttaataactaggatgactgctgattttgtagtacctagaaaataagacaagagacattgagatttaatacttgaggtccaacaactgaaactttcaagcctgtgtgaggtaattagttagtctgtggtagtgaagaagtgttctgcttagggagagatttatttttaagttttttgtgtatatggaagaatcatagcctaaacacaaatttaagatattattattcatgaatttgcttctttttcaaagttactgtcattttgggaaaaaagtgtaaactgataatatcatacataataattatgttgtataaataataatttatattttagaattatcttcctaaaccagttcaagttagccattgatgtgacatagattagagaaagtaatactataaaaaaattatgtaataaatgccaaataaaataataaatacaagatagatcatggctaactaccttacttttgtggtttttgcttagaagaaaatctacagagaaatatatttcacaggttgtctattctaaattaaagtagctatgaataaatagtcccagagataagcagtaaatcctttaccaaattttctgtgtcctgcaatttatattttaaggttattttgcatgataaaactgtaacattgttttaaaattgagtaaaatgacacagtgttaaatattttcacttgagcacaaaaattttttgaatataacacggtatttaaatatagtttagaattttatatgatgtagtgattatagacagaacagtaacagttgtataaggtaaatactagtaactttaaacggtaatgatggatgcctctgtttatggtttatttcccattgaaatttcttaaggaaatgttatatttgctgatgatttcactagatggtacacacattcacacaaaattatcttctgtcattattaggagtaaatatgaagacgttttaggcagtcatcaaatataacttttacatacaaagaatgaagcataaatagccagtgtcttggtctcccctcccctcggtgctttgcacagtgtcatagacataggagatgctcagtaagaagtgttctggattttttaattctagcttagtgtgtgaaagtgattccgctcagaatgtccatcccctgttttacatttctttcatattcataacttacaggaaaaaagaggtaattaattgactaggatcttgcagatatataaaaggacccttctctgtatcacacttggccttcttatttatgtgcagaatttgattgatttgaaacttatcaacacttgatactgcaacaaattgacaagaatgatgttttagtaaaaccaaagaaaccagaaatgttgggaggtgtgatgtttaatactgagtgctaattggattgaaggatgtaaagtattgatcctgggtgtgtctgttgctaaaggagattaacatttgaatcagtgggctgggagaggcagacccatccttaacctgagtggcacgggttaatcagctgccagcacggctagaatataagcaggcagaaaaatgtgaacagagagactggcctagcctcccagcctacgtctttctcccatgctggatgcttcttgctctagaacaacatcggactctaagttcttcagttttggaactcagactggctctccttgctcatatatatatatatatatatatatatatatatatatatacacatacatatatatgtatatatatgtatatatatatgtatatatatatataactataaatatatatgtaaaactatatatatatataactataaatatatatgtaaaactatatatatatatatatattccattagttctgtccctccagagacccctgactaatacaggaggttatcaaaagcatgtatcagcaccagtacactgggtatattagacaaaattgaaatgcttctagtgacctacgtagtacaaacaccaagtttacccagagctaatgcagggaaagccagaatcaaccaatcaaccagattgagcgagccaggataggacttaagctgaccaagacagaggagacagtttaaggtgatttcacatagacaataattttactcagaatccagacctagatcccaaggtaaactaagatccagccaagagtattagtaatgggagacggggctcaggaaatgtagagattcatcttaatccacaaatatccttaaaattcttagtctcccattaggagacacctgggctaacatcatattttctggaaagaagggagaacattctggagtgcagatgataagtgggctaaaaaatgatttcagactgctgtgctgatgttagcacttttcataacaatttaagttttactattctaaaataattaattcaacctattaattttactctatggttttttaaccatagatctcacctctctaactctagtcaatcactcagtgataagtggcatttgtcattaaagaaagtgggttggagtgaatctgctgaaacgtattaaaatattggaaaaccaagtcagaacttgtattcagggccggggctgtggctcacgcctgtaattccagcactttgggaggccgaggcaggcagatcacctgaggtcaggagtttgaaaccagtctggccatcgtggtgaaaccccgtctctaataaaaatacaaaaaaattagccaggcgtggtggcacctgcctgttatcccagctactcgggaggctgaggcatgagaatcgcttgaaccccaggaggcggaggttgcagtgactgagatcggaccactgcactccagcctgcgcgacagagtgagactccatctcaaaaaaacaaaaccaaaccaaacaaaccaaaaaacttgtattcagtttatagtggaaaatccatatcatcaattttccattgtcagatttgaaaatctcttctcaaatcaataattattttctaaagtatcaatgagattcacgcacacagttaacaggtaaagtatagaaaatggcttttctgaacctatcaatccctgaccgcagcctactcccctcccccaggttcacatcccttcacctctaccacatttaacccttttttatttcaaatattaaaataaaaccatttcaaatctctacgtattatgcttatactactacttttttcaaaagcttaattgaagtatcaacaataaaccatatatattatagaatgtgataagccttgacagcaatcaagataatgaatatattcatcccctctttttaatccctcacactcactccttccccccttctccagttagccaatgatctgctttcttttactatcaatgagtttgcattttgtagagtttacataaatcaaattatacaggatgtattttctatggatctttttagtcatcagaattattttgagatgcattcatttgtatgtaatactttattcctttttattgctggaaaggattccatttatatggatatagcatactttgtttaaccacctgctgttgacttgggtggtgtccagtgcatgattgttaaaaacaagtacatactctgaacattgttgtacaagtatttgcatggatgtatgtttatctcatttggctaaatatctgaaagtggactagctgcaccgactgtcaagaaggtgagaggatcaaaactccaccatgtcagcttttcctcggctggcacatgaagttattaatggcaataacaagaatatccttgccatccctgagacatacgaaagatcttacagggatatagtttatacttattacagagtatgtataatcctgcttattacatgaagatcattctcctggggcacaaaataaaaggaaacatatttctttttttatttttttgagacggggtcttgctctgtcgcccaggctggagtgcaatggcgtgatctcagctcactgcaacctccacctcccgggttcaagggattctcctgcctcagtcccctgagtatctgggactacaggcatgcaccaccatgcccaactgattttgtattttcagtagagatggggtttcgccatgttggccaggctggtctcgaactcctgacctcagatgatctgcccgcctcggcctcccaaagtgctggcattatagacgtgagccaccgcacccagccaaggaaacatatttcttactgtaataagtgtaaactgtatcactgaatatagtaatactttcatattatgggaacattcaccattgatttatatatgctattaaatacatagtttctatagaagctttattgaaatgtcatcagattatgaaaaccaaatccccataatttttccactcatgtatatttacatttgcattcactgtctccattgttgattacccaatgtgtactgatgtttctccttacaaactatgatagtacttaacattttgcttcatttgttgatactgatttgttccgtgtacataaaacttaaatttatgtctgccttcacttattttctttcaaagataccttaggagtctttcacattttataagaaaccataaattttatttcagccttaggccaaccgctggctttcttgccaacctagatgcatatatgcaatttagtctgtgagttttgaaaatttgaatgatagcacattaaactggaataatgaaccaataaaagtttttatggcatttggaaaaattacttctcaaacattcacactgtcattttactcattaaaattattctaggatcataagttagaccatgtattcctaaggcttgaaaaatcaacagattatttctaatgatcattgatttgacctgactgcaggatgataaaatcttattttggaaagctagactaggcatttgtaattatattttccatcttcaactaatagagtaaaattattggaaactctttaagatagtgtccacaatgctgtttacagtttaagtgctatgatttgccacagttattatcttcatatagtcactgccagtgtgtgacattgggtttcatcagtaaataagactactgccacaacttcagagggttttcagagagattaaattaaatgttattgtgaagtacaaggtacttgctcagcaatatggaagtcacaggtattatgtgctcagatggtaggtagttttgtatttttcacaaatctattaacatataattgtcctgtcctataaaccagacctttagggattttataggattctaatctttttcttgatgctttagccactagtggtcgtgagttacgtgctcaggaaggcatgtgaatgcttatgagtgagtaaggtactattcatgtttgtctaatgacttcattggcctttaccttcgtttacaaatgcacttaattcaataaggaagagtccttctcctgaaggttttacactagtcaaagatgtttccaagccatatacattatttttatttgtgtttatgcatatgatacaagccattttagaaatgatttttttttttactctttagaaagcacttcagagttagcataacatctaaccatattggtatttctgttttctgttataatgagtgaggatgatccttatttttaaaagaagtaataaaaaatcaaagaagaaaaaatttcatatctaagcattttagattataatttggcaactgtgcattaatccaaacaaatagagcctactgagattattcatgttcccattagtcactcacatattggtgtctaattgtcatttgtttctgctgtaattcagttcaactgatgtaattaaataccattcatctagcagcagttctgaaatcttttttttttgtaagacatgataaaaagtatgagttttctataaaatcaagtttacattcagttggaaattttccttttaagttcttattctcaaacttaattgtcaatatcaaatagagcttctcagatgagggatataggctaatttcaaattttctctgaactacaaatatgctcttcattttctctagtctaggcctaaattgctgtgcttgcatttgtaatcagaaattgattgtgttactgtggaaactggaagagtgtattgctggttaaagaaaaatgtggtagaagaactgctgttattataattgtctgccatcttaaatgcctatcattttgaacaatacattgataacattttcacactccaaccccaaaatgcttctctccagaacactgctttgtggtcagtattagtcttctgtatcgatctgacataaaatgccttggtcacatttctaatttgtttctatgttgaactataatttttacatggaatgaaattagtttccattttattcatacttacatggcacatcttagggaaaaaacatgaagtatggtaaaatatcagttatttagaagccagtcatctgaaacatttcaacttctgaccaagaagacacgaaacaagttccaaaaattcagatgaagaatttttaacatctgatgctaaagacagcctcgaagaagcaaagctctattttacacacatacacacacatgcacacacacgcaaagcaatattatgcattttactgtgtgaaagcaaagatgaactctgtttttaaaaagtttgccttttgtatatgagaggcaagtatgtgaagactgaccaaaagaatgaagaggaaatcaaaaccaggaagaggaaaatgaccctcagtagaggcaagagttgggggagttaggattggagatttccagcacatattctgttggaccagtatccagtaacatcaagttcctggaattttctggaggtttccattgctttcctgattgtgacaaggacaaatgcagaaaattatctgtgactttatagtttaattaaaatattcccaaagccccacaagtcttgtcttaggaaaccaatgtttcccaaaaggcatcaacctgctgaaaaaggttaacagaacatagcatctatgtactttaaaccctggctgaaaagagactgaatgtggtggcacactttagctctagagtgttgaggacgagaataatgttgtagttactttagtttgattttcgtatgtagtaccagacactaaacaaatctgctttagcagaaaaatattaaaatacataataatatgtgtgacatagtctaaataatgcattgcctgtttaatgtattgttgagatttgtatgctagctctttggatcctcctggcttgggttcttcattccaccatatactttatttttctttaggcttttatgtatttatgtatttatttatttttatttaaaacttattaatgttattttgattcacaaaccataattctatcattttgggggcacaatgtgatgttttgatatatgtatacaatgtggcatgattaaatcaagctaattacatattcatcatcttgctcaccatttcttatggggagacacttgaaatttactctcttactttgaaatacataacacattattattgattatagtcatcctgctgtgcagtagatctcaaaatatgtttcttctttctacctgagactttgcacccttcgatcaacaactcctcattccctccctctccacccccaccccacctcagcctttagtagccatgatacttcctacttctatgagttcaactttgttatagtctacataaacctgagagcatgtggtatttttctttctatgccctgataatttcatgtagcatagtgtcctccacattcatccatgttgttgcaaatgacagcattttgctctttcttaaggctgaatagtattacatttaatttatatcgcaattttttatccatttgtccattgatgaacacttaggttgattccatgtcttgactattgtgaatgatatggtttggctctgtgtccccacccaaattcatctcgaattgtaatctccatgtgtcagaggaggaacctagtgggagatgattggatcatgggagataattcgatcattcccccatgctgttctcatgatagtgagtgagttctcatgagatctgatggcttaaaagtgtgtagcttttttcactctctctctctctgtctctttcctgccactatgtaagacatgccttgcttccccttcaccttctgccatgattgtaattttcctgaggccttcccagccatgcaggagtgtgagttaattaaacctcttttctttataaattacccagtctcaggtagttctttatagcagtgtgaaaatagactactacagtgaataatcctgctatgaacatgggagtgcagatatctctttgacatattgatttcagttccttatgatgtatactcagaagtgggattactgggtcatatggtagttctgtttttagtttatggcagaatcttcataccatttctcataatggcaatactaatttacattcccctcatcaatatgtaagagctcctttttctctgcatcttccccagaatttgctttctttcattttttgatacaagccattctaacaaatgtaaggtgatatctttttgtttttaatatgcattttccaaatgattagtgatgctgagaattttttcatatacttgtcagccatttgtatctctttttttgagaaatgtctgttcaggccctttgtccaatttttaatcaggttatttgttttcttgctttgagttgtttgagttccatataccatcagatgtatggtttgcaaatattgtctcccattctgtgggttgtctcttcggtttgttattgtttcctttgctgtgcagaaactttttagtttgatgccatccatttgtctattttgcttttccttttattgcctgtgcttttggagttatatccaaaaaataactgcccagaccaatgttgtggagcttcctcccagtgttttcttctagttgtcttaccctttcaggtcttatagttaagtttttttttttatctcttttgagtgatttttacatatgatataagagcctaattttattcttctgcatgtgaatattcagtggtctcaacaccatttattgaagagattgtattttccccattgtgtgttcttggtacctatttcagaaatcagttcgccataaatgcatgggttttcatgtctgtttttatggcagtacaatgtcattacgtcaattttttggaagagttggagaagtattggtgttagttctttaattgttttgtagaattccacagtaaagccatccagtgctgggctttcctttggtgggggacttttacaggcatgtaaaagtcttattcaatctctttacttactactggtctgttcagatattctatttcttcatgattcagtcttggaaagttctatgtgtctaggaatttatccgtttcttctagattatacagtgtgttggcatataatttttcatactggtttcttatgatcctttgtatttttgtagtatcattcgtgatgtctcctctttcacttgtgatcttatttatttgagaaagctttcttttttttctaattcatctaactaagggtttgtcaattttgtgtatctttgcaaaaacctgttagtttggttgtttttaaattatcttttagtttctaatttgtttattatttattctctgatctttgtcattttctttcttctgctaatttagtggttggtttgtatttctctttttagctccttgaggtatgacattagattgtttatttcttctttttcttcttcctcctcctcctccttcttcttccttttcctcttcttctattttttgagacagagtcttgctctgttgcccaggttggagtgcagtggtgcaatctcggctcactgcaacctctgcctccctggttcaagtgattctcctgcctcagcctcctgagtagctgggattacaggcacccgccaccatgcccggctaatttttatatttttaagtagagacggggtttcaccatgttggtcaggctggtcttgaattcctgacctcaaatggtccacccaccttggcctcccaaagttctgggattacaggcatgagccatggcacctagccctttcttctttttttgatatgaacacttatcactataaatttccctttcgggactgcttttgcttcattccatacgttttggtgtgttgtatttccatttgcatttgtctcaaacatttgtcacaaaatgtttttttttaatttcctttttttatttcttctgtgacccagtggtgttcaaggagcatattgtttaatttctgcatatttgtgtatttttcaagattttttctcatccatttcttgtttcatgccattgtgatctgaaaaaaatacttaatattatttcagtcctcttaaatttgttaagtttggttttgtggcctaacatggtctatcctgaagaatgttagatgatcacttgagaaaaatgtatattctgctcttgttggatggaatgttctgtttatgtctgttagatccatttgttttaaagtttaattcaagtccaatgtttctttattgatattctgtttagataatctattcattgttgaaagtggcgtattaaggtcctctactattatagtattgcagtctttcttttccgattatttaataattgctttctgtatataggtgctctaatattgggtgcaaatatatttataattgttaggtcttcatggtgaactaacccctttatcattatgtaataatcttctcgtcccttttaataattttttttacttaacgtctactttgtgtgttataagtgtagctacttctgctcactttcagtttatatttgcatgaaatatctttttccaggcctacattttcagtctatgtgtgtcatgactagtgaagtgaccctcttataggcagcatgtggttggatctttttttaaaaatttatttagattctctgagtctttctattgggtaatttaatccatttacatttaaggtaattattgcaaggtaagggcttgctattgccattttgtaaattttttttattgttgttttgtagttccctttttactttctctcttgctatctttctttgtggtttgatagttttctgtggttgtatgctttgagtcctttttaaaagtaatttgtagaattattctatttgcttcgtagtcaccatgagacttacataaatatcttttccttataagaggccactttaagctgagaacaactttcctataattgcatgtaaaaactctaaaacactctttacaatacaacctttatcatagattaaatactcatatattcttggatttttttttctggactcacgattctgttctactgtctatttttctatttctgcaacaatactattttgccttgcttattgtgaatttatgttctatgttgctatttattataaatatcaaaattttgttatagttttactttatattttcttaatatgatcaatgcaatgttctatttccagtttatttgaagtttaaatcttaactaggtgttaactgttgaggtgatcatcagtttgctaatattttgtttgtgaattttatatttgtgttcataattgatactgatctataatttttatttgtatattattctttttgaatatcactgtctactgtgaaaataaaactggcattagaagattaaagaaacattatataaatataacatgggggccacacactgtggctcacgcctgtaatcccagcactttgggaggctgacatgggtggatcacctgaagtcaggagtttgagaccagcctgactaacatggtgaaagatgagcagatcacctgaggtcaggagttcgagaccagcctgactaacacagtgaaaccctgtctctactaaaaatacaaaaattagccgggcgtgttggtgcacacatgtaatcccagctacttgggaggctgaggcaggagaatcgcttgaacctgggaagtggagtttcagtgagctgagatggtgccactgcactccagcctggatggcagagcgagactctgtctaaaaaataaataaataaataaataaaattaaaataaaacatggttgctacacatgcatgaggaagtaagatacattggcttgactaatgcataaaatacactggatatcaataataaaaagaccaatattctgtagaaaaatatgagaaagagatatgaataggcaatttacagaaatgaaaacaagaatggcccccaaaaatatgagggtgaaaaataccatgtcaaatgaaatgaaaattatactcgaattattctctcctatgaggttgtcaatagtacgaaagtctgaaaacttactttaatggcaatgctgtaggaaatcaggcactctcatacatttctggtgggagtgcaagttggtattaattttatggatggaaaatgttgaacatcaattaaatataaaccaaattaaaaagatatagtggcttgggtgtccaaatactacagttttattattagctttcttatctgacagccgtgtaagattttacatgtcattatttttcttgatctattaccttttttaaaatgaactatttgaaatgtgtaatttttatagactttacaagctctagactctagtgatatatatatgtcacacagctgatatctgcacatgaccctaaatatgcataaatttatgttatccatgaatgaaagaacggctctttttcttaatttcttttttcttgactatagcatattttcatcctgtgtataggatttacaaatcagtttttacctgattttgaactgttccatcttcaaccagttgccatatgactacttggttcattatttgtggtaccatttttgtagataaaaatatgtagatgataatatgggtttgttgtgcatattcagaagcactgtactgtaatcattaagaacatggacaagagagccagattacctggcttggaaatcccagatatactatccatgtgctgagtgcattggttcatctctttcacagttttctcacctataaaagaggttaataagagtgtatgcctcctggggctatgaggattaaataatctattcaaaacactaagaccattacctgctaaatatacatttgctatttttattcatatgaggatatagatgtctatatcatgaattgaaaataagccatttttttgaaaagcagtatacatttctgaagtcttgaacatgaataatatttaagcatatttcactaaaaaatgacatgattttgacccactatataaaaaattataagattttggaaagttcttcatattgtagtgtttaaagacttgaaacccagtgtttctagccattgaagaaaacttagactacttctgcataaattgacatggaattgcctttattattgatctgaataaagtgggtggaggaacattcatctgatgaggagaagcagctccctagaacacagagatattcagatgttttccactatttacaattcatcttgtttattaacctttaaaagcagattccgttgaagaaaacaaattggcactacaaggagtaagaatgcttttgttagtgagggactcacagtgcctttccaattcatacattgtcttctgatgagtgtgggtattgggctagaattttggcatctgaaagtacatctatgtgagccgtggctcacataaccatggctgtaggttatgtgagctgtgagaattttcaaattacctcagacttctgagaatattcttggtcattgagaaaataagcagtaataaatgctccagattcacatccacatctcacaatgttgaaagaatagtgggtatcatttatttaaatgaattttacaatatgcttactccattatttcattttcttaggaattattctcccagctttactaatagttgtggtgactcatatctttctcactactttgaccaggtctgaatatactttggggtacaagagatgtgtattcgttggctatataaaggtggtcgatctgctaaggaatcttagatggccagagttactggaaattcactcaatagaatgggtgattatataggaactattatttttgctgttaatataaatgcatcttcaggtatattatttgtgtttgacacactgttctaaaagtccgatattaggactgtttttcttaaaaataaatattcaaatatttatgattgtgccttagctatggttgccagaaatagagcctgaagcaggaattgtgtgcatagatttgtgcaaggagcaagtgaagcaagagggcagagagaagatgagcaaggatatggcttcaagtaaagttgagcctcaacttgatcccacaaacagattataccaaagtttcattcctgattgatttgaggcaaaggagggaggcttggtacacgagagctcttcttgcagcagtcagtcgtcggctactgatctgactactccaagtgcggtgtatgactcccaggtgcctctaggcaaggctactccagtatgctaagcacgatccttcagaaaaggttacaggtgtcagctgtcagccatggcacacacaggagtccctgggatctacatgggacatcaacatccaaacataaacaaaggcagcactttcatcacatcacatgtggactactgcagatggagtcagctctgtggtgatcagcagaaggggatttcaggctgactgaagcaccaggccacgctgtcagaggcaggagtgagtgtctaatgtttaaggagcattgtgagaggatccttgtgagagaagggggacagtggcagatgaggagctcagggaaataggaaagaaccagggtaccaagagacttgtgagccaaactaggcgcttatgttttatgtgtcaggcaaagccgatgggggtgtgtgatggtttgatgtgatggaggaaccacacggaggtcagtgtggctggaggaaagtgagccaggtagagctgagatggtaggaactgagatgagatagtgggacgtttagaaagtgtgaggctgtagaggtcttgggaaggcctttggcttttacctctttttccccaggtgggacgggccgttgaaggattttagggtggcagtgacatggtgaaaggatcactccagatactccgcccagagtataccattgtgctctgtggtgaaacagggagaccagttaggaggatttttgcagtggttgaggcaaaaagagatggggactcagatgagggttgtcatagtggagatgtggaaatgtgaataaattcagggtagatggtctaactgccagcacttactgatggcttggccgggcagggtctagggatttgtgggatcacatagcagagtagaatcttctggccttctttctggccactcttcaccacagggcccagtgtcctcatggtggctgatgccccagcccgcctcgtgtgattagataggatagatcagatttccctaccacatgtgcccctagaaactcagattcctctgtttaacccaagcaaagccatttagctccccaccttatccctgagtccaactctgcttatccagaaatgaattatttgttggcagtgctaaacaaaatgccatctgtggttgggtcttaaccctgtagcaatatagatgagctgagctggtagaagttgtaaaaattatatttcttttttatttcttactacaattctttttaaatataaaggcgcaggatcacgatttatttgcttgtcagtatggagtattctattccctttagaaagcataggaagttttggttttgcatgtctcagtctgctctactgtctgtgctatgcagtgtgccagttatatctcttttaatattagagtcccatgtattagatgataatattctaatcttataggtggagaatttgagtcacaagggttaagtgacttgctgaagataaaacacccagtagagtgaatttcaaaacctgagtgaggctgggcacggtggctcacgcctgtaatcccagcactttgggaggctgaggcaggcagatcacgaggtcaagagaccaagaccatcttggacaacatgatgaaaccccgtctctactaaaagtgcaaaaatcagctgggcatggtggttcacgcctgtaatcccagcttctcgagaggctggggcaggagaattgcttgaaccagggagatggaggttgcagtgagccgagatagcaccactgcactccagcctggtgacacagcgagactccatctcaaaaaaaaaaaaaaaaagaaacccccccccaaaaaaaaacccctgagtgacactaaatttacatgttataaagtctctaaacattcaaagaaacaagcagatctaatgccaagttccacgtgggcagggagctctgctgtcatgttcattgtatcaccatccttgatgacattaactggactttagtaggttctcaataaataataaatcaagtgaatgaggcattgtccgtgtggcactggaaacatggaggaaggagaacttaatcctgatggggagctttggtagatgtggtatttcaagggctctctaaaaccaagaaagagttcagcaggttgagaatggaaatccttttactccaaggtaagaatacacagtgaaaaaagccaaagagttatgtaaggcatgtttctcttctgtggaacaaacattgggaattgacattagagagctcatctatgatggatggcttaggaccttgacctccttgttaaggagtttgtacttcatctctgtccacacaggtgagcctttgggggtgttaaggagtgaggatcatgaggtacctgggattccttttctttagtgttgtactcgtgatttttagcttaaaaggccagaagtgtatagggatttttaaaaaaggctttagaaaacgatgtctattttggtcataacagcacttaatatggcagggataaccatggatgttgactttgcgttctttcattatgcatgctatttcacattatgtgaataggtggttatttgtatcttgttgcatgctaaatatatcagatttaaaaatcaattttacatatagaacactgactaatcaatttaggaagcagattagttttgcgtttttcagagctctattgatttgattataatgttgttttacaacaaagtataactttgatttatgttcagatgttaagtatttatactagtttaccatatatgtgcactatgttgtttctttaatgacactgaatgggccaggttttcactttaatggcatttaggaatacatttaactaaaaacatccactcaaatgcacgtgggttatgtttgcatgaaatcaattaatgatcctggcaggttctgtgtttttctaaattttaggacttgcctcacacaaatcagaagtatccagactttcaaatttacaatatccattcaaacttgaaatgcccttgattaataaaaatacatgtgacaggagagtatagctctgcttttaagctgttagagagaacataaaatgattatggcttgcagtaaatgttattatggacctgagatgtttcctcagggattcagcaatctcctgcactttctttaagactgaccctctctccttgagaagcagcaggaaggagggatgtggaggcaagaccgctgtcaggtcacctgtcacaacgctgacaaggctctgatataaaacctaatttacagttgaagaagcacatccattatccttctgattttaaaatagaacatacatcagcaaaatgataaaagaaagtgcttaagaattatgaatgtcaaggactatttcctatcataaagtcacaaccctttttgaatattaccttaaattatagcagagtttaacgatattcacaggctctgttctctgaaaatgagtatcacagtatttcaactattgataagctaataattgtgtattaactatcgactgtctttgagatcaagatctaggtagatggtggcatcagtatttagatatttctttatgaaatagatgtgcaccagaactttgctacaaggacttaaataatgaattattttctgttgacttatattaaaagtacagcgttgttttatcttcatttataattaaccttcagtcggccatgtttcttccttattcctgattcatctttttcctgttattctcaactaaagacggatatcaaacaaatcctggaatgtatttttaaaaactcgactatcttcttgaagtgaaaataaactgttaaagtgtctgctctaagaccttggattttcttttaaaatggggtgctccaggcccggcatggtggctcacgcctgtaattccagtattttgggagggcgatgtgggcagatcacgaggtcaggagatcgagaccatcctggctaacatggtgaaaccccgtctctactaaaaatacaaaaaattagccagttgtggtggcacacacctgcagtcccagctactccggaggctgaggcaggagaattgcttgaacccaggaggcggaggttgcagggagccaggattgtgccactgcactgcatcctgggtgacagagcgagactccatcacaaaaaaaggggggagggggagttgctccatattattgtcatcataaatttcattgcaaaaattatgtattttaataattggtgttatggattagataattttaatctttttagcattgttttaatattttcttataactgaatcaacacaaatttaaatgatttataatgggctaatttattagaataatatttgagatttcacaatttagaagcagaaatgttgaaatagcctattctagcaaaaactcagcattatccttaaattacccatgtccatatttagagatagaagatataatttcttatctattaactattttctgcttttaaaactaattgttcttcccatctctgctatatttgaatggactatccttagattgtcttcttcatgtctgagaattttatatttaaatatatgtttaatatacaagtaagaacagacattaaaaaaacctctggaatccaaacttttttttttttttgagacagagtcttgctctgttgcccaggctggagtgcagtggcatgatctcggctcagtgcaacctctgcttcctgggttcaagcgtttctcctgcctcagcctccctagtagctgggattacaggcacctgccaccacacccggctattttttttgtatttttagtagagacggggtttcaccatgttggtcaggctggtcttgaacccctgacctcgtgatctacccacctcagactcccaaagtgctgggattacaggcgtgagccaccgtgcccggcctggaaaccaaacttttacatttatattcatatatacatacctatttatcatcatcatcatcatcatcttgttctctctacctatctattcataaatctattatctatctttgtatctacttacctacctacctgcttgcctgaatattagtcctatctgagccaacaaggctaagatgcattttgaatttgactcttggccttttgtaagtctgccaattgtagaataaatgtccagcacgcatgctaaggcctccttattcaagggagagggaaacccttgaaaacattttactctactctgactcagtacccagtactattttccagtgcaactctaccccctttcctcgcccccaactaaaccctccaggtccataaaactgtgggagccttttgtttatggctctctcaacagtgagaccacgtctacatctgctgatccacttgaccggtgacctgtgtccattccatgtgggaacatggaaaagggagagtcagagctttcttgattttagcctcttgtttgtaccattatcgtaagtgatggtaacatagtggtaccagtttggatgtattttagatttttctcttctagaagagctattaagattaaaataatctctttttctcaaaattttgtagaacatttctggagcatttcggggggcatttctttagataaacatgtataactatttaatattttatacagtgattggattctttaaatgctaattttgtagaacatttctggagcatttttgggcatttctttagataaacacatataactatttaatattttatacaatgattgaattctttaaatgctatgggagtattcaatcttggtgtttcttcttttttcttttttaagaagttttattttatttttagttgacaaataatatttgtgtatacttacagagtacaatgtcatgtgtcaagatatgtggatacactggaatgatcaaatcaggctcattagcatatctgtcactcaactatttatcatttctttgtggtgaaaacatttaaaattctctctttagctatttaaaaatatgtaatacattatgattaactatagtcacagtgctgtgcagtaggacaccagaaattactcctgctacctatctgaaactttgtccccattgaccaacgcctcctctttccctgcccagcctctggtaaccaccattctactctctagttctatgagcttgacatttttagatttcacatgcaagtgagtgcatatggtatttgtttctctgtgcctggcttatttcgcttgatgttttctaggtttacctttctcatgttgtcgcaaatgatagaatttcctgtttattttaaaaatggaatagcattccattgtgtatttataccacatttaaaaaaatctattgatggacccttaggttgcttccatatcttagatcttgtgaataattctgcaatgaacagaggagtgcaaacaccttttcaatgtactgatttgagatcctttgtgtttatacccagaagtgggattgccagatcatacgataattctgtttttgtttcttgaatctattttgtttcttgaatctccataatgttttcaaaatggctgtacgaattttgatatttcttcttgagtcagttttctaagttatatttttctaaagatttttaatctgaattttcaaattggttgcataaaattatttaatatgttcatattttaaatttctgatctatctgtgatagaaattaagtcgggcatctaactcagtagtttttcttttctaaaaaatgtaaatataaaaggctataaatttccttctaagtactgattctcacactttttttctatagtatgttctttactgttcagtttgtgaaatttttaaatttgcattttcgtttattctttggcccgtgtgttattttgaagcatttaataatttttaaatatatacagtttttaaattattgacttaattgcaacatggaaaaacacacggagtctatgatattgtgaagacatactttatggtgtaatacatgatacagttttataaggttttcaggagtactacagaagaatgtaacgttattgaattgtccatatgttctatattttatatgtgtgtatgtatgaatttgttcatttaagagttttttttgttctacttaactatttgacttagtaaaggagagagctgggctaaagttttccactgttatgatagatgtgcttatttctttcagttgttatatatttttatttctatatttacataaagttcagaatcattatatccttctggtgactataatttttatcattatgcattgacccttttttctcttaaagtgtttcttcttccttaaagcctatttgccttatatatctatttcagctttcttttgtttaacgtttacttggaatatatttttcatcttttacttcaatattttcatatccttaggtgtttttttttgtttttgtgattttttttggtggctgtcttaaaaatagaaaataagttgggtttcatttatcttatacattctgacaatttggggagaatttaacatatttacatttattgtgatcattgatatgtttagatttatttctgccttatcagtaaagaattttgttttcttattctatgactatttttaaaaattattatttttaactgattactttgttacttattatatggggtttccccctcctttttgaggattaatacatgctatttctattcttttagccattatttttgaatttttactacacatattttccttaataaaatctaaatttaaactagttttatttatttttcaaacagtgtaggaaatgttagaataatcaaactgcaatcaccactcccctgaattaatctgtgtttttcactattttagttttttcctttttaaaaatcccacaaattagatgttatgtttattactttaaataggtgattggagagatgtacaagatgtttagcattgtatttgcataccattatttttgcatcttattcttctgaaatcattttccttcttaaagagcatgatttaccattgcctttaatgaatatctcctggtgattaactgtttatgctcaggtgaatgttttcattttactgtcatttctgaaagataaatattctgggtatgtaattagaggataatagtgattgtctctcagtacttcaaatatattattcaacaaccttgtggtttctgttgttgagaagtctgctgtttttctaattattgttctttttttgatgatttgccttttttctctggatgtttttctaatttcctctgagtcttttttatcagacagttttgctttgatctcttggcattgatttcacttattgtgctttcaatacattagaaacattatttattgcatttggggaatttggaaaatcacagccattttattttcaagtattatatctcctatatttctctaggacttaggtaactgttaggctttctcattctctgctctagatattttatattttaatttttaaaatatttcaacataatttgttcagctatattttctatattatggattctctcttcagccaagaaagtctaagttgatcaaagtttttatggactttttcactgaattctgaaatactaatatatggggggtgttacctgtccttctaaaatgcctttgaacctttcttattttcttaaagcagattttctaactataacctaaatccacacatttgactgacaatgctcactttaagtccaaattattttgggaatttaaactcagaagtgagcttaaactttgatatttgtgggaagactctcttggctacctttcatggctgttataaacacttcctgtttgtatagcactctgtgcttaaccctgttgattaacttcctgtgtcttacaattgcccatttttctgtcttaatccaactctatattgcaaactgagggctcccttttcccaccatggtaaatgtggaggcagcttcctggaagaggccttgaggtcacatcacaaacagtaaaacagcatatgggggagaatctcctcggaagaggacagactaaacttgtaatctgcacaccttttatttaaaccctctcagtatattaaagtcctccaagaaagacagttgtcatagggagtggtctagacatagccaacttttcctccatgaaaagaataagcctttattttgttcagccactgggagtttcgaggtggttttttactgctctaaaacctaacttatcctaataccggggacaaacgttatttactctggtgacaaacattatttctattttacaagtgaggataaactgttagggaggttaaattacttgttcaaagctcatacgtgttgtagcaaggactaagtagtcttaggcatagggctcagctttttaaacctaccttgatggtttttgtgcctcgtctatagggatagtattttctactccaaagtatatgccatgatgatccagaggatattgatcatgcactggtaagaagaatgtctctgtataaacaaatgttggtataatataaacattgataaattgtgagcagcgatctttaccttagctctgaatgtctaaatttcacttggaatttttcagtagatttatatgaactcaagcattatcctacttaaaagaaggttagcaaaaaaaaaaaagaaaagaaaacttatcaaaagacttttttaaatccaaaatgacactatataagtgtcatataatttataggttaaggaagctatagataatgatatcattatgactgattcttattgattacattaaagtgatattaggcatttcggatttttcagatgtttttcttgaggcctcctagattttaaaaatgataaacttatagcagttttagtggccctcattatttttatgagtgacttcagggctatcacaaataaatgaaaagtctatgcaatttcaaggcaaaccaattaatgcccccttccacctaaattatctcaatatttcctacagataggtcctagagtaatgctgctaaggctttttaaacttgaattccacagatgcaatcctttcagactttaaaaatgtttattctcctcagtgttatatattccaccaggtatccttttccaagataattctatttcaattgaaaatcttttaattcattgcacaattatagttgagcatttcttggcacaactacccagatttgcaaggccatagctcttaggtgcctatctgactgaaccttgaacctatggcatccattgtagctggtgataaaagttatatcagctccattttccacagttcttaactgttaagaacaaccctctctagctttctcataaatcaactttgggattattggcatatgagctttgttcaatttttcaagccacataaaatagattttttccatttcatcaatcacatttcctcaacttttgctcttgatggccaactgcaggggcagttttcagaggctctgtcactcatttggtctcctcatttctgtttgattattgttatatacacctgcattttcattgcaggcatcctcctcttctcagtagggctttgattactcacactactttttgcttaacagacttgattttaatgagctaaataataagaaatctgacaaaataagcataaatatagcaaccattttctggactaataaacaacttggtgccctagtaattccattggtaatgtaaagatgtgactgcatgttggtaagataaagatttgactacctgtataattttatattgattaggtttgataggcttaagtttataaatttaggtattttttgttgtcacggttttatataagggattttttttagttctaggggacaatccctaccataaaggagtttataatcagggcactttttcaaatattcctgttataactcaaaataaaattacaatgaaatacattagtattcttaatattcatagaatacaaactctgaaagtaagattagaaatatttcttacttatgatgaaataaccttgttattaccattttagttactttatgatgaaataaccttgttattgccattcaagttacatcataacttaaattcttgggtagaatgtcttttcagagtgctccaagtaaagactatttgaattatctatgcaagtacctactaatatttaaacttttgatgatcttttcacataatggaggacaacgggttctatagataaacacccacatcagtggtccaccattcctcttccagggttatatttcattgtgttctgattttaaagcaaattagggagtctgtttttgccaattttcccatgttgctgtggttctgagtgctgtgattatcaagacgatagaagtggaaggcgggagtggaggtggcttctacagtcttcagtgcagcatccactacagagttaatggcatttttacgaagaccaggtgtattttgtacttttttttttggtacacgtttctcaaactatgttaaaattaaccatcaatatcaaagtatactgtcaagaaaaaaagaaatgcttatgatgaatattcatagctgttagtatctttggaaaaggtgggtaatcatttttaaaaatagagtaattttctttggaatacataactctcaagaacattttgatagctatatacatctaagaaaagtgtattccatttattattctgttaattaaatatttgttgatcattactgtgcatgaaacattctctcggatggaggtaagtggagctcctccttgttaaggagaatagtagggagatgtgacggctgcacaaatgactacatttccaagcaggataaaataccctgctctgggggaccaggagaaggggaaatcacttctaatggaagttgatgatagaaagaatttgtgaaaggcttttgcatgatattttaaatttgataaaaagataagatggaagggcatgtgcaaagtcacaaagagggagaaaacagaaaatgctttccatgaataatgagttaacctgggttgttaaaaatgtatggaaatactgtgtaggcatgacagatgaaatccaaaggatttgtttccagtccatcattagcaccactaaaataatagaaattatttttaaaaagcatacatctaaaatagcatgagaataactacgagagcaacaaagtgttggatgcggtaaagcttccaggggtgtaactgaggcaataatcaaagaaacctgaaaatcgatgtgcaataaagggttacaagatatttaaagaaagcctctaacacaaagagaaagaccaaagcaaacaaaagttttaaaaatccttgcaaagagtaaaataaaatttgggaaacaattttcttggagaaataaggaaaaagaaattatccttaaagcaggaaaaggaggttagaacacattttgaaaagtcaataggagggagagtcctaagagacaacaatgaaaaggcccacagggctcaccttaccctgacccatgaattccaagtattgagagaccatggaggcatttgagcaagtggtgaatgatgaggagttttgtcttaggatcattaacctggcagcaatacaaagagtaggctagagaaaagaggcagagagctaggacaaaagttactaaggaaaggaaccaggggtataaattccaaaagaggtggcaggaatagaggacagatttagtttttacagaggaaagaatatgagggaatgaaaaagaattggatatgtagacagaagaagtacagggaattaaagtgttgagagttaataagactcaaacttcagttttaagcctttgcatttgagatattggtggaattgcagatagaaattattatcaagtattatagagactattggtttctaaagactgagagatgaagaatggatttagaatcacggaggtcaatggtgatcttgcagggaacagtgtggctggtatggtaggggtgaaagcctactggaataggtttaagaggctttgcaaagagaaactagagataataggaatactacttgcaaggaatggtgccacagaaggttgatagctggctgagaatgagttcaagagcagactttattaagaaagaggggagaatttctatcttatttgtgttttccagttgggcagcagagaatatcctaatattagaaaattttacaaaattctgtcatggttttcataaatgattatagcttgcttttcaaaatgcacaaactgattgcaatacaaaataagtagcacgaatactttaaaaatagatgtagatattaataatactagataatttctggttagtatttacatcatggaagaaaatataaatttagatatttggtatttttacagcttgtcatttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatttttttgtatttttagtagagacggggtttcaccttgttagccaggatggtctcgatctcctgacctcatgatccacccgcctcggcctcccaaagtgtcattttttttaattaaatagaaaccttattttaggtctttacaggaatcagcatataaatgtaaagacaaatcctggcttcttgctggaaaatcctttaagaaacataattttcatggcatcttgtggtcttaatccaggtaaagctctgcttttaaaaaaatgaacaaaaaatataaactgcaccaaaattcaatattttgttactttgctgtctccatctttaagtgctcaattttattcataaaacaattgaagtaatttaatttcaaaccatttgggttttgtcatatttactcccacattacatgcacgtggtagatatggatggaaagcttttgacgaatggtatttttttcaattgactgactaaatctagaaacaagatctcctactgccccagtgccagatgggcccaccccactctctccgactctgaagtgatcaaatgctgtatgcaggaagctgtacagctttgccaattaatagctgcagactcaattatgaacaaaagggcagccagcctttagtagggaaaatcaacttagtagggaaaatcaaaatgtttagccaaaaagcatttaattgtgtttctttaataatgaagtcccctttagatatgttcataaatcaggaatagttaacaggaaaaatgatagatatgtttgtaatgctacgtagttatggaattgctttcccatagatcttttctgattgatcattatgttgggaattttttgcatgtgtgatagtcaaataatggtatgggagaaaagtcaggatattctattaacaagataatcattttatcctattcttgtgtttacatcttctctgttgccatttaattccccacttcaaggctgtttcattgtctccatctctactgtatttagttaggcttttttattcttaatgtttttttctagctttcttgtagtctgtgattagaaacacataaaatttatctgattagttagtgggaattaatcactcttctactactgaagcaccctgctttgttgtattcttttattattccagacatcagaatgtaatattttaattctatatgaccatctgccctacccgactagaaatccctgaagactggagctgcctctcacctatctttgttttgctggtagtcagtgagcacggtgctctgcatataacaggactcagggtttacccaacgatggcctcagtgtttatgttccccatcacaatcctaacccccaaggcaatgatattaaaaggtgcggccttggagaggtgatgaggtcatgagtatggaggcctcatgaatagcattagtgctcttctaaaagaggccccagagaatttgttctccccttccaccatgtggggacccagtgagaaggtataacatatgaaccagaaagtggacccgcagcagacaccaagtctgctggtgcctaaatcttggacttcttagcttctgaaacgatgagaaataaatttctattgtttaagtgacccagtttatagtattttgttatgacagcctaaacagattaagaccctaatcaagagtctacatttgacctctgtgcttacctgttactagtaatcaaaacattttagactttgacaaagataattgcgtaagtgttagaggtatatacttatccattgttaattttaatcaattttacataatacaaatgcattattacatatgcttttcacagaacttaaatgccctttgataactatgtacttgagtcataagtaattatgtaatttgtctgaaatgcttataataaatagcataagagagatttaaccataaaatgtaacatttatttacatatctatttttcaaattatgtgcacatccaattttgatatgtgtaatgttttctagtgtctatcatggttcagtgatgttttatcttcacttctgaatcattttgaagcagattctgtatatcagcttcttttccttgcctattgaactttctgccatgtagttagtcttagctaacacttacgtattttaacatttaaaaaatccttagaaatcaccttgtccacccattttcattttaaacgatgaggaaacaggtacagagaagttatagggcttatataaagttagtataagtttgtcttatgataactctaagctcaaaggtagatataggttttgtggggcttgaagctgatataacttgggaagccctttttaagaaagggaatataaaattaggtgagaaacttaatattgactaagaatgagaaaaaaaataagagcctggcagataccacaaataaaatccatccagaaaataacactgttacattgtccccgacatctttgcaatatttttctctgtatttattagctacatattccttggtctttacttcgtgacagcaattacataatgtcattttctgtggaaaacaaagacagatgatcagattctcctgtagcattgtcaatggaaacttgctttttactattgacagttaagtttctttcagcttcacaacttattattgctgttgccacatcttcgactcccatctgcctgtcctcattcaggtcacacaagccctggagcaacctgctccctggttgttttccagcaaacaagactccagaccctcactgtcaacaatgagctggctataaacctgggtctttgtgctcctcaaagcagggagcagagcagcaaccccctcagatccttctctgggattaaagatagcgtccagattctgaggcacaagccaacaggggatagtgctggccgcccattctcctgccctgggcctcaacatcagaattgaaaggtgacccaggctccaacctgctagcaggtggctgatactgggtctcctgagaagagcatttggtaggagcccatacaagtgaggggcttggagcttaagcttggttaatttcatagtcagtctgcttctgcctatggcaaatccttgcaaaaggccagacactgtttttctctttactaagaatttacagtattgtaactgacccgctaagtactcaggtaaaaatatttgtgattctcctgtgtctccctaagccacatctctctctgggtttttaataagctagcattaaaaggcataagaatgatacgttggactttggggaaagggtggcagggggatgagggataaaagactacacattgggtacagtgcacactgctcaggtgctgggtgcacctgaatctccgaaatcaccactaaagaacttattcatgtaaccaaacaccacctgctccctaaaaacctattgaaataaaaaataaagttgaaaaatagctagcattaaatcaaccaactatttctctgggtgaatgttctgtcgcacacttgcacaaaccctgatctctcttcaggggcctcttcaaaagttcagtatcagactcacttggctccctcgtgccggctgtgtgacgttgtttttctccacttcgggacatgcagttggccatgtgctcacaggcctctgctgtgttccctgtggcaccttcgcagactgagtggcttggcatttggctgatgtaggccatgtgggcacacactcagcttattgataacatccctcagacactgccatttccaacattttcattccggatttcagaattcccatcacaccatcccaaattctactaagtgtcagaccaggccatgctaccctgtcctttcagggcttacagagactttggtgagatgttggatttggtcatggtgctatttattgttattattaattattagttttttaatcacagcctcctatcctcaagttctaggtaaaattgccaaagtagactcctttgagttttgggatttttttaatttggtgcctgtgatttcataaggaaatattttattttatacttttactgtagagatgcatttaaagtttaatattaacatattctggagcatcttaaggaagacagccttataactgaatcctgccatatggttcaaatgcagctgatttgaacaacatttactgcacttgctttgaactaataaaagaaaaaacctccctaccttctttctttccttccttcccaccctccttccttctttccttccttctttcattccttccttccatctcctttctcccaaaacatatttgtagtgaacacatcctttgggccaaacactgttttggcccgtaagtatgtagttgtgagctaaccgacactattcaggcctcacagagcacacagtctgaatgtgtaaaatacgcatttgcaacaactgcaggtgaatagtgtcatcgtttgccatatgaatgaaggtttttcggtgttttggggggaggaaacaggtgtgagaattgcacgatgcacggtggcagagcagcgctgaggctaaaggaaaagtgagtcagcacggtgattgtggcgttggttctgactcagtggcagtggagcagcttctgccccatcaaaagagtattatgtgatgggaagggggctttgtgctttttcctgttttaaatacaagatctgggaatttgatttgttcctgtggttgtataagtgctataagcgtaagaggtattgccttgtttttatatggtttgtttatttttatttatttaacaaacacgtttaaagcacatataacctgtcaggggctatactaggtgttttacaaatttcagctcattttatttacacatattttaggtaaaagcaaccaatacaaacttagaggttgcggagaatatatatatgtatatattttttacctttatgtactcactcaagtttaaaataccttgttgaagatgaagtccctggtgaaaatgtagagactcagggaaatctaagtggcaaatattcaaatgcattaactttccccaacaaaaagcatttccttgcctcagtctctgaaccaagactcttgatttccttctggagaagctccttagttcctaatacagaccggcaggtggagcagcacgccctgaaccctccagcaagcctgggcctgtgtggcgctcagagcgagcctagcggggttgacccctgaggttccaacactactttatttttatttatcaacttttattttaagttctggggtacatgcgcaggatgtgcaggtttgtttcataggtaaacgtgtgccatggcggtttgctgcacagatggatccatcccctaggtattaagttcagcacccattagcggttcttcctgatgcgttccctccctctgctccactgacaggcccaattgtatgttgttcccccaccccatgtgtccatgtgttctcatcattcggctccgacttataagcaagaacacgcggtgtttggttttctgttcctgcgttagtttgttaaggataccaacttccagctccatccgtttccctgcaaaggacatactctcattcctttttatagctgcatagtattccacggtgtatatgtaccacattttctttatccagtctgtcgtcaacgagcattcgggttgatttcatgtctttgctattgccaacactatattttaaaagaaaatatttctacttcttgaagggcatgggccttatctacagtgctgggttgacctggttacaagaaatccacagaaaacataatctgatatttactcccattacaatatggtacacctgtcatacttcagcaagcaaactgtaaagggagagaaaattcacttttatttgaactgctctttactcctctgaggcttccctggtttgtggcaaacaaacattgtaacagcttcacctagaattcaaaattttaaaccatctaacaatgttataacagatgagtcttggagcttggaggccagggaaaagatagtcatgagcaaaaccagtcttccttctcttagaataagtattgagagtatttatttgtgcatgtcaattcaataatgaatacgaatgtgacctcgaaatagtatgtagtccatttctaatcaagatggaacagcagttcttctgacctgaaacaactttagacaagacgtatgaaacaatgacactcaagccattaaacatcaggcaatgaaggacagtaatcctcaagagatgggaaacagatgaggtgagacctacaattgcctcaacttactgcctgggaaaagttttcagagggtggaagcctagctgtctccttgagttcagaagatgaagcttagaattcaaggaagttaagtcggctagaattcacaggacagtatgacacaggaatgagatgtacaaagagaactcaagatctgcagagggtccccctcagtgcatgtgtgtgaggaaactaacagaggcaggggaaagaagcacctaaaatagtaaggtggaacaggggtcaaggctcaacaaagtaagaaatagttccttttcccaatagccagagtggaaaacttaatatttcaaggggcattgagtagagttctaaaaaggatcctcccacactaagagggaaaaatgaaccttggtaaaaatgctaatttaggaccacctaacaaagcttaaaggcaagactttaatatttgggctcacattaatcccaaatattctaaataagttaaccatgttccagagaaatttcaaaaatatttatagctataaattaaccatgatccaaagaaatttcaaaaatatttatagctatactaaaattcttagcctgtaaaaagtaatatccaaaatgtctggcaaccaattaaaaattatcagacatacaaagaaggaaataaatacagcctaaaataaagagaaaaatcaatatattgaaactgacccagaatttacagataatagaaataggacattaaaatagttcttatgactatacttcatatattcaaggagctagaagatacatcttacattttaatagagacatagaaaatataaaaagatccaaatcaatttttagagttgggaactacaatatctaagatgaaaagcacactggatgggatcaaaggcacgttagatattgcagaagaaaagatttgtgaacttgagaacagccatagaaaatatccaaaaggaagcagatagaaaaaaaattaagaaaaaaagaacattttttcagcagtgagacaactagaattgacctaatatacatgtaattcaagtcactgaatgagagaggagtgggagataaaataattgaaaagataatgaccaaaaaatgtccaaagttggtaaaaactatgaacccacagatctaagaagctcagtaaaacgcaaacacaagaaagatgaagaaaatgacaccaaggcccattataatccaattgcttaaaataagtaataaggagaacatcttaacagacatagaaaaaatgacacaatgtaaataaaggaaagatgaaacctatgacaccttgggaaagaaatgcaggctaaaagactgtggaagagcatctttaaagtatgcaaaaaattatgaacctataattctttattctgaagaaatatttttttaaatcaaggtgaaataacaagttgttttcagatatacataagtcaaaacaaattctcaccagcaggcattcactaaagaaatgttaaaagaagtccctccagcagaaggaaaatggaaatagaagaaaccctgtgtctacacagaggaaagaagggaccagaaatggaaactataagagtaaacatactttatttttcttattattttaatatccaatattttctgattatttaagtctttaaaattaatctactgtttagataaaaattacaatgtaataaggttcataacatacgtaggattaaaatctatgactacactagcataaaggcctgaaggaaaaaaaaagtatattgttgtaaggtttttatatgtgtgtgtgaggtatagtatactatcacttgaaagtagacagtgataagtttaaaatgtttactctaaaccctaagtgaaccgcgaaaataaccataaataattatagctagtaagccaaaaaaggatataaaacacaataataaaaaattcttgagtaatccaaaggaaggcaagaaaaggagagaaaaggaacaaagaacaaatgaaacaaaaacaaaaaaaagcaatatgtatatttaaacccaataatattaataattatattaaatgtaaatggtttaaaaacaccaatgaaaaggaagcaattgctagattgaatttaaaagcaagacctaactgtattctgcctacaagaaacccacatcaactataaaggcgcatacaggttaaaatttacatggaaaaagataaaatatgtgaacactaatcaaaagacaactgcgatagctaatgagtatcaaacagtggatttcagaacagagaatattgctaggaatgaaaaggatcattacatcggaataaaggaatcagtttatcaagaagatgtaacaattctaaatactaagcagaaactgacacaatttcatggggaaatatataaatccacaatgatagagatttcaacacctattcctcaagaacagatggaacaagtagatagaaacttagtaaggatgtaggcaattattataacaaacattttttattacaaaagatgtgaaatatttttggaattgaacaattttatctgagttacattttatttaaatgagacataaataaggccacattgtagagagcaaaatttaagagtgtgaattagtcagctattagtttaggaaattcaaattttagatgattttttctttttaaaacatagcactttctctagaagtcaatttttaaacatcaaatgctttattacaaagttaaaataattatagaaatgattaatttaactgtcactctttacatacttctctggtttatttacattatttggttggggaactttgctgagttacctaaaggagatttcagagaaaatttgttatggaaaaatggaccatattaacttaattcagagtttcctatcccaaagtttgcataaatcaagaaattacttagtcaaaagcttttatggaagcaaagttttaggaaaaatattttaaatattaactttaatggtaatactaagagattttaaatattctaacataattcttacaacttggtgagaataggattattatctcaattttatagttgaggaaactgaaactcgtatgttttaacaacctgtcagaagtcacacaaagcagcagaaaaagttcttctaaatctatgtccacttttttctccactaacttcatgataaaaataacacaaaacaaaaatcacttaaattaacatccagaaataaccgctcatcctttttttgtgattgatgaaatattgccttaatttgataacatgaaatgaatatgtagagggtaaaaggaaggaatgtgtattttgcttagaaactataggtaaatagatatttgcatatttttaatagaaaatatatttgtttaaagtaaaagtgaggacatttgagctaatctaattcacaattctaaaatagcaccatctcactacaataaaatacattcaagtgttagttaaccattgactgaaaaaatgaatgatatttttagactacacaaaaatgtactaaacattttttaagcattcttactcattctcttcctcctttctttctcctctccacatatgcatatatatgctactggcaaaatgaaattataactgctgtttttcatttatcattatgtattggcacctctttctctgctaataattagtttacattataattttttagtgatgttttgaaatctatatttaagggcataatttatttaaccaaatctctatgtggaaagcatttaatagttttcctctattttaaaatatgctatgataattattcttgtacttacatctctgcagactttctaattatctcattagtataaattcctggaagtataattgttggatcaaggggtattaacattataaattttgagacctattgttaaacttccctctaaaagtattgtacttgatttggagtccctctaacagcatataagtgtatttcttttatattcttgtcaacagttgatattatcaatgcatttttgtcaactggttaacagaaaacttcatctccttgcttttgtgtatattgaacataaggatactatcttttcatataccttgttgccatttttaatacattttactcttatgaattggaaacaattggtcacatttctcaaatattttattagttttcttataatcatattgactttacagattaattaggagaaaattacaaatttagaatattgagtcttccctaagaacaagatgaaatcttgtggaaccagaaatttttatttcttcaagtaatcctttatgtccttcagtagagctttattattttctttgtttaacaatgtgacaggaacttaccaaacctcttttctttttgaatagttttctatcttcccctgtagttaattaagcatggccatttaactaagtcctagctagtgaacaccagtttcagtccttgttctaatacccccagcccatggtcatcttatcttaatttctcgatctcccttgtctgcgtggaaaggactgtgaggacctagaggaagatagagctgcaagatggaaagatgacattcaaggctatgcagcaagaaagaacatcagtgtgggactttgtgtgatccaaaaataagcttgtactattttcagacactgaaggttttttttgtttgttgtttgtttgttttattgttgtttgtcatagcaaattctgtttttctaagacagaaatgcaggagttggttctaagagtggtgtgatataaaaatctgaagcaactggtcagtagggctatgagaaaacagatacagaagactgagaagctgaaaaatattgatattctatgaaataaacatttttaaatgtcaactgtgacaattcggaaggcagactcagtgctcactgagactgtggctctagagcaatacttgaaaaggctcagaatgatagtgtatgtttgctactcttggtgctttcagcaagacattacaagaaagaggtgagatcggataagaattggttagttttcaagcacagaaaaatgggaatggagatgtttcagtgatcaaaatccttacaggtttggaaaatccaactgcttctgaactcaaatagcattagtaacaagtaaatgtgcttgagaaagttcttagctacaaaggcccaatgaaacttctcattgggaaaacagactcatccctgcagcctaaagcagattttatatatatggctttcccagctaattttttttcagttagctttagggtaggcacaattacattgacaaagaaagagagaatgagggaggcagagagagagagagagagagagagagagagagagggagagaaaggcaggtgcatgagggcaaggaagcaatgaaacaaaccaatttgagaaggaaatcaatttaggtgtggttattaggacataaaactgcacagaaagaaatagataagtctgcaatattttggggttatcatattgccaaagaaaccatgagttaagactaaaaaagccttcccttaatttcctatacaaacccttggatctttaaacttgcaaagcaagaagcgaactgtgaaaatggtacaactcccaagggcctgcacacccagttctgatggaatacacccaagatcagtggtctgcaacctatttggtgccggggactggtttcatggaagacagtttttgcacagacggccagggggtgaaggggtgcgggggttgggggaggatggcttcaggatgaaaccgttctacctttgatcatcaggcattagttagattctcataagagcatgcaagctagatcccttgcatgtgcagtttacaatgggctgtgcgttcctaagagaatctaatgctaccactgatctaacaggaggcggagctcaggcggtaatgctggcttgcccactgctcacctgctatgcggcccagttcctagcaggccacggaccactagcggtgagcagcccagggattggggacccctaccatgtaggataacaaacaagtaagagactgcttgagggcagggccaggacccgtggaggacagtgcacaaggctgccccctccagagagctgcattaggtcctaagcaaggaatttctcccatcacaacagagtaattgcgcaaggtcttcctggcagggcctgccatatctctagtttttcctttcctaaagggaagtgtttgttgtggttaccttgtcctgttccaccatagtgtgttgacacacagaggggcagataaggtgcccactgaattcctgtgtcaccagagcatatctgaactaatgaagaggattgattacagatggctcagagagagcctcagctttgaggtataaacagtgcctgggtgggattgtgggtcttctgtgaagactgactataatctacatgtaaaaagaggagtaaaatggagatttggttaagagattggtggactctagcagagactaattactcttaacgaaacccgttttctcctattcctgaatacacagctagactacatttcccagcctcccttacagttagatatatctattttattcagttgtagccaatagaacatgtgtggaattaatgtatgctattcgtggtgtggttcataaaagccttatatgggcaaccatctattatctcattcccataagttaacttcatggagagaacgcctaggacctagagaagggtagagccatagtgtagaggaggctggttcccagaatgcccaagtagaaggcagaaaggtctgctttggacttcaatcagaagaaacacaatcttaacgagtttagcctaatgaaagttgactggggcttttgattgtttgaatagcaagtggtttttttttttacagtaatacaatttttattatgttgttaaatctcttcctctcactttttaatgttttgaaggttgttattgtgaattgttcaagaatccaggatgaatagagtcataaattttttcagttgtattggatcacttaggctgaacttagacttcatttacaaaatcaaatgcactgttaatgcaaagtaaatctaatatagcgcacgataaactatatattgatcaaaatttccaaataacattttaaattatacgaaagagtagcagttttgccagtagaaatactgaaatttctgccatgagtaatagtttatactaggaagaaaaataaatatgtgatctgccctcagcttttgcatgatagcagagaagtgattgatattaggttattcatttatgggtagctcctctgtgctttatttctcaccctgtcagactgagaagagctaccaattttattaggactgctgatgtactctgtacttatagttttattacctattggagaagctacaaaatattggcactctttaacaatgagccttttatgcttccttgtgtcagcaagtattttagattaataccctatgtttgattgatggaattgtactgagctcttttttaaggttctaatttctccaaacatgtaaaaaaactagcagggggtctcacatatatgtgtaggcatatatatatacacacacatatacacacatgataactctattatgtatatagttatatatgtatatggtatatatatgtatatggctattgtgtgtgtatatgtgtgtgtgtgtgtttgtgtatatatatatggttattgtgtgtgtgtgtgtgtgtgtgtgtatatatatatatatatatatatatatatatatatatatggttgtcctctctcttttgctaggcagacatatgtctgaagctgatattatatatttgtctattattataaataaccaacataatggtatccatgttattaggtttgcaaaatattttttgaacagaaaacaccaatttagaaggaatacaaacttatattctgaagttcaagtggggagacataagaatgcctgtcctctaatttttttttgaaaaattattaaagctagtccaatgccagtgttggactagtaacctggattttttaaattaatagactttattttttagagcagtttcaggttcacagcaaaattgggcaacaaaaggtacagggagttcccgtgtgctccctgcaccagtgtggtacgtttgttacaactgatgaacctgcactgacacatcattgtccaccatgttcatagtttacattgggtcattcttgaatagtctgagttttgacagataaataacgacattttccaccattacgtatcatacagagttttttgagtgccataaaatacttccgtgaccccctatttatttctccctcctctgaatccccagcaaccactatctttttactgtatccatagttttttcttttccagaatgtcatgcagttggaatcatacagtttgtagcctttgaagatgagcatctttcagctagtcatatgcatttaagatctctccatgtcttttcatggcttgatagctcatttgttttttagtgctgaataatattccattatttggatataccacagtttatttatccattcacccactgaaggacatcttggttccttccaagttttgggaattatgaatgaagatgtaaacatctgtgtgcagattttcatgtggacataagtttttaattcatttgggcaaattccaaggagtgtgattgctggatgatagggaacagtatgtttagttttgtaagaaacttgcaaactgtcttccaaagtgatggcaccatttgtcattcttaccagcagtgtatgagagttcctgttgctccatatcttctccagcatttgtggttgttagtgttctgaattttggctattttaatagatgtgtcatgatacctcattttttaaattggcatttctttatggcatataatgcggagcatctttttgtatgtttacctgccatctttatatctttgggaggtctcttttcaggtcttttgaccatttcaaaataaggttgttcattttcttattttgagtttgaagagttgtttttatattagaataacaggcttttattatgtgtatcatttgtaaatattttcttccagtccgtggcttgtcttctcattctcttgaagaagaaaagcttccctgattggaaattgaactcaggccacagccatgaaaataataaatcctaaccactagaccagggagtgcatgctctagatttttaaaatcttgtaataagaatattaaaggattaattaaagtaaatatttggtcttttattttgttgtaaaactaaagatatgtcaattatctccaagagatctaaaagaatggaaaatatgtttcttccctgttttgatcattgagtgaggaggcaactaactgactcttaaaagcttggaacaattttcagaataattgaaccttggcagagctttgctataatcatttttaataatatttctatcaaacagttgtgagtccctataatgctaggtaacaaagttttgttgaaatatataaatttcttttatttagtttttgtagcataaccatattggtacatcaagtatttgaacatgcttacttttatagggaactaacaactcatcttctaaggcaaaaatcaaagaaggttactataaaaatccacaatcatgttaactttcaaagtcttagtttcactaaggatcattttttctttacagagatgaaaaggagtgcttactatttcaattaactcttggtttcttcatattatatttagctatttgagattaaatagattcatttaggtatcatggattaatttacatatatgactttaattatctttcaatatattatcaggtattgatttagactgttttcataagtcttttggtcttcctcaatagaaactgatttcctgtggatttacatgattgccctctaaataaccagggtgagataactgtgccaaaatgattggctggagagagtataagttcatttagaccacttttaaaaatatcaaagtattgtagtagatctctgttgtactttagcatgatttgaatcatgtcgtccaggtctgcatatctacctgcatatggagtaacacctgatcataaaatcacatttagcactattggtttaccatttccaagtactgattttagaactagatctcaaatagtaggcaatttttgtgttgtatctgtggggagagagagtctgctttcacatgactttctaaaagtagcaaattatatctaaatgatgtttaagtgttttaaaatgtaaacacttagattttaaatctaaaaacacttattggaaaaaaatctttatttcccttgcataatgttggcatgaatgcagcgtggctggattggcagttctgttactgcaggaagtggatttaaaaatgtataatttcaaagccaaataattcaggcaggcatgctcataggatggataggttcagtggatacatttgctctccccgcactcaccccactcaccccaccaaccctgactcctcctttgttttgtgctttgtctttcttttctgtagattgggatccaggttcaaaaatcttagcatagtttacccttctgtagtccaattttaaatactctaatggagtgttctattgttttgtagcaagtcaaatagttttctccatatatatatatatattgcttagccattccatacatagttaattcttttaatcttacctcataaatcaatatttctaggtcattaatcacccgtactgccctttacacatcttactgtatatatcccttttcccaatcccttgtaaacctgattttccctctgcacaaaatttattatataatcctaagtaggctgaagatataaatttctttttggaagaagagtgctttaacattaaaacgtctctaagactggtcttatctagatctgcgttgatcccgctatgtatcaaaggacaacctaaagccggaagataactgaataagtcttttaacttacttgccacttctaaaatattgagttacatttgaccagatagctccaataaagggacaagatttattgcttaggaaacttcaaccctgtattattgtgctttgtttagcagatttttctaaaggagaaacatatgtatttaaagaggtagaattttttattattgtaaatgaacaaaagatatttctagccagttgtgtctcctagaatgtactgtagttaggtagaattaggatgttgctttcaatttatgtatgtgatgcttatagtttcacacaactcaaggtatgtcttaaagtgagtgtgacatatagagagagaagcagcctccctattacatagatacttaacttagattgtatatgtgcttgcaaggattggaagccaagctgaaaatgggggtttttgtgggtatatttgctctcttttccccactctgactcctagtttgtttgtttgttttttttttttttgctttgcgctaactttcctttttctgtagattgggttccaggttcaaaatcttagtgtcacctttgattctcctttccttctctaccccataggtaattttaaaatatgtcagaacaatggcttcttttatctgctattttcttgttatttcaaacaatgtatttatagattgcctgatccttctaaagtgaaaactgcaggagagtaggattcctatttgccttgttcactcctaaatgcctggaacttagaacagcaagtgctcggtaaatatgtgtgtaatgaattaatgaatgtcacttgtcttagtcttccctttccatttgtactagctccacgtgggcgcttttgcttcatatctagattatttaaaatatatagcatcccatcaatttgaatttcaccattcagtacttactgcattctagaaggaggatggggaatgcagaaggtaatgtgtagttttaaacagggcagtcatggaacgctttagaagggacaagttctaatgacacctgggggtcaatcccagcaggacacagaagcaagcgtacatcctctcctgcaggaggctcctgtgtgatgtttcacatgctgacgggtgtgtagatgtggtggtagcagccttccgaagtcccctttatgttatttctattcaatgactaggagcaagaacattagctgtgaatgaggctggagaagaggtgttggaggtttgaggagagaatgaaatatataaaatagccatctgtgtgcatggccaattgaatggagtagagaagtgtggtgaaatcgcttgttctgcaccagctacattgggctgctgaggcctcagcatacggttgacagagagcttgatctaggcagcatctgcaaagcacagcaaactaagggtgggttaagggagttcagggtgagtgcaagggagagattgtaccgactgaccatgactttaaactgggtcaggcaggagggcagaaataggagtaaggggcagggaagagaagggaaataattggattttcaggattttatagcgaaagtttcagggttagggttgcagagggattgagctagaaagataagaaatggtagtcttagagtgggatatatgaagtctggaattttggagtggctgcaattatttgtcagaaacctggctggccaggatgcaggtcaagaccgtgatagaacaggccaaggaactagagaggctgaagcactggtccaactatctacacaggccctgaaatgggatagaacagtctgaaagaggaggcagacacttcgtctctagtcccagtgttataaaatggattttagagagaaaacaaccaacactgctggggagacagcatccttagggaaaagtcaggcttctgttagagcaagaagaggtgaaaaaggcaatctgagacagggaagggtatgcaaaagaggttttcctgatgaccgactgtgagcagcaggggcacagtgcaatggttttagcagttgatgaggtggcagagatgatttcagaaaaggagatgtgtagagccattcaggagccagaatgcaaaatgagaggtgacctagtgtttacactttattgggactaaagggcatggtgagtttggtctggagagtgctgaggtattggttggccatgagtataggaggaacagtaggctggggctcagctggaccttgagtcctgcaatagagggagggcagtccaagggcaggtgattttcctcctggcacgagagctcccttaagacacttttccactggtaaatttgtagtttattcatttcaccaccattttacagtccattttcaaaaaatgctgtgagtattcactcattctacttattcaggattgttgtgttgttgttcttttttgttgtcttttacaaatactgctgccatgaacattctcataaacataagtatagtttcttattgagaaagacaataatcatggataagggattctctagggaacatgcctaggaatgcaatcgcttggccacagaatatgtacatttttattttatttttatttttcagaagtaaagagtaaaaacattgaatgatctcatataacaaagtatctggaggaaacagctccttgatttcttcagggacccatatcttttgcatctttctgctgtagcatccttggaatattgtcttgttgcttcatggttggaacatggtgcccattgttctaggcatcctttcaccatctatctggacaagaagaaggaagaaaggaattgacatgtgcatctgcatttagcaggcatcattagtataaagctgtttgacaaatattaattgaaccatcatttgggtggcaatgtgtcaggctatggaatttaataattagtcaaaaatgtacaatttggactctttagcaaatcttacaggtccaaatacaagacttcttcctagaaatttattttacatgtctgattacgcagagaagggtcattccccaactccagcacactcttaacaattcttgtgttctgactctgaggagggaaaggatcaggaaaaataactaatggatactgggcttaatacctgggtgatgaaagaatctatacaacagactcccatgacacaagtttacctatgtaacaaacctgcacatgtacccttgaacttaaaataaaagttaaatttaaaaagtatgcatttttatatatgcagctttactaggcaatggtaaatggtttccaaagtgtatccatttacactcaaactagcaggaatgagacttcccatccctccatatcctcaccaacacttcacagtaccagaatttttttgtcatctagtaacataaagatgttttattagtgttctatttgcacccctgtgattattaatgaaattgagcatttttaatttgttttattggctattcagttatactcttctgttgttactatatatttcctgcttttctgtggggttgtgtttctttttcttgttgatctgttggagtactaatatgttttgaatactaatttttattgattatgcttgtatatatctatttggagtttatggcttaccttttaattttttaaatggcatctcttgatgagcaatcattgttaatgtggacaaatttatcaatttttatactttatggtgtgtccttttagctatctttcttaagaaatcgttgtctatcccaaaataataaagatttttttctgcatttttgttaattttcatatggtttggcctccaatatttcttttaatcacacagaattgaatttcatatatggtgtgagacagagatacagtttttctttttgcatgaatatgcagttgtcccgcaccatatatcgaaaactaccttccccattcatcagcaatgtcacctttcccatatgatcaagtttatgcaatcactcaagaaatatttattgaacacctgttctgtaccatgtactattaatctaacaaggaacaaaacaaacaatgattcctcatggagcttataattcagctcaggtaggaaggtaataaacaataagcattacagatgcattctatggtacattagaaaggaatgaatactatggaaaaaagagaaagtgaatgaatactatgaatattgtggaaaaaaagatctggataagggggtttggagttcttggtggggagaccgttattttaaatggggtggttgtggtaggtcgcattaagaaagggagaccgagacacttaaaagagatgaggtaatgaaacagacatctggaagaacactccaggcagacacaacacctagagcaagttccctccactgggaatttgcctgatatgttcaagggaagccagtgtggttagtgcagagtaaactgtggtgaaaatagatgaggagatcagagaagaggggtggggggcagagtaggtaaggctgtgctggccgctgtatgactctttttaggacacttattctttcttttttcttttcattgactatatgcgcctgttggaactaattctgttgtaaattgaaagacattgatccaattttattctacctggatggctaaccagatgtcccaacaccagttaatgaatcgtccatgtttccccactgatttgaggtctaactttgtgatttattgaatatgcaaaattatttgaactataactagatccctgctccagtgaccttatgttatacctgtacacactgattttttttttggagatttcctgactaattttttaaaataattcagtgtaaactacagaatcatcttctcaatttctaaaaagaaaaacctagttgtatttttattgcgatagtattatgtttataaattaattttgcaaaattaaccattttgtgatgtgtaatgatgtgcaatccttctatcacaaaatagtgtgttttctaatttttaagtcttgtttatactttaaatcatatttcaaaacttcttcaaatagatcttgtacatttattacatttttcccatgtactttattttttgttactataattgagtctcttatcaatatctcctaattgatcagcacttttgtatatgaaaactatagatttttgcatgttaattttgcatgctagtaccttactaagtttctatgttacttaccaattttcaggtggttttctctgagtaaatgatcatgtaatcttcaaagacttactgttttatctcatcattccccaatgttttaacctcattttttttctcttacctaattgtactggctagtgcctccaataagaatatttttaaaatgttaaatagtacagcaatagaggacatccatatcttcttcttgcctttagtagaagtgtgttgtattttcccgcatggttctgagattggagctttacatttgactttcttggtagatttttctttatttcttcattttcaatctctctgggtcactttgtttttagcacagacgtgtttttctttatgatcaaaactgaaagtttatttagtctttttatatttattaatagctgagatgttggtccaggttctgtgaaattattttgtaatgttttctatttttatctttctctgtgtgctcagttttctttgttcatgtgtatttgaaagagtatgtacactgtttattttgtttttatggttatctttataacggtatatcacctatagcccttattttttatgatagctattaattccctaatatgactaatgaacataattaatatactttctcttcttccctttctacagtaccacctgattttagtcaataatatcatatttcatagtgcttacctttgtctggttaaatatagttccatgctctaaatcctgtcctttgcctcccaatgataatagatgaagcaaaaaaaaaaaggatacctcacatgtttttctcatctctctctcgatttgtgttagttgtgtcatctgcatatgatatgtgttattgacattctgtactatcatcctgaagccaatgctaaatgatgagttgtgtagttatttatgtgaatgcttgacacagtcctttcaaagacattgccccagtcctttcctgagagtctcaagcttgtctccaaagagtttcctcaagagtggttcatagcaacaattatctttgaacttttgaatttcaaaaactatttatctggctgggcacagtggctcacgcctgtaatcccagcactttgggaagccaaggcaggcagatcaactgaggtcaggagttcgagaccagactggccaacatggcgaccccccgtctctactaaaaatacaaaaattaaccaggtgtggcacatgcctgtaatcccagctactggggaggctgaggcaggaggatcacttgaaccctaagaggcagaggttacagtgagccgagatcattccactgcactgggtgacagagcaagactccatctcaaaaaccaaaccaaacaaaaaaaacaacaacaacagaaaaaaacctatttatctgtagattttatacctaaagggcacttttcctggaaatatataccttggcaaaccttttcttatgaatcttgcaggtgcttatctattgtcttctgggatgagacattgaactggaaacacgaagtcaacctgactcttacaagtgacttgatagttttaaataactacacaaaagacttttaaataaatttttgataagttcactaatatatgtcattgggcaatgtttgctttaatttttcctggcccacaggtaataatttcttcagcaataaataagtagctcttgtatttcaaaacatttttataaccacatttaaaaatatttgtttttttctcattgttttgaatttttttgggggggacttcaattatgataaggtagcactcccttgccagactttacgtctctttcacattattcatttttctcatttctgtcctttctctcctctttgtatttttgcaatgctatttttcccttttacttcttccagtttcatttttatatattgagtttcttatttctacttgctttccgaattctggtgccttatgcttcatcttctcctattacatcaccatttcttccctgtcataattcttggtctcctttcatgtaagtgagggattcaccaagttttaaaaattcctggcaagctatttggtcatagtgtttaactctgtatggtatttttcatcaattagtaagttttgctgctcttttaaatattgtttttcttatagtaactttgatattgtgctaggtcccactttaatacttactgctgaattgaattgatttttcctaaatgcttatttaaagtgggcttctgggtctaggcttcttgatccaaccttttccctctctattctgtcggaaagaatgatggttgcaagtgtcatttgtttatgtatttatttgtgtttgtgggtccctcttctgcctctttgatccacaaatggatgtgaagggacttttactgggagccttatttatactcatttttgcaaacaagaaacaaatgttgtccctcatgagttctccctcaccagaaatacatttttttctggtgttttctagaatccctcaatgatctccatcactcaccatatttcctctctctccttcctcccacatagcttgtgccttatgttagctgcttttggtggtcagtttttctcctaattttacagcaagtgaggcttatggttcctttttatttttattcatcttatttcattcatatgatttccaaaataagaagaagaaaggagaaatgttcacactagaaattatattaacttttgagatttagtacttgttaggtaccaaggcactaaaggaggctgtgaagtggggcatttgctcaacacctcctctatttccttttgaaagtgaaagcttcttgtctgtggttactcatatgtcatcgtatatttaaaaatcaaaaatacagtaacatatttcaaaggaaagatgtattaggaaacccctcactgagtcagattgtgtgtgtgtgttgtgtgaattacttatacaagtatatggaatgcctatataaaattttagtatctaacatatttcaaattctgcttaccaattctattcaaatcatgtaatcgtatgcatgcatcaaagtaaataacgctatgcaaaaaagaataacttctgaatgtaaagaaagctattaacaaagcttctggattggtgaattgcgagtgtctggctgttactgggtagataaatggccaagtcagacttgttgatggagagtggtcaggagttcaatctgcatgtggattagttggctttattttggaaacaagctgaccaaacttcagccagctttcacaaatgaagattttggctcagggaaaaaaatgcatatttactaaaaaataataaaatgtaaatgaaaataaaaatactttgcatctgaatagtgaaagatgcattactatctttatttagggcagacaacatgctgtttaggtacatgttcatcttttctccttttatattcttaatatttctttcatggtcgaatagactgtggtggaaactgtggtggaaaaaacctaggttgataggactccaatctagtgtttcttattaaattatcttccagttaagttgtagtaagtgtgctttatgtgtgtgatatatatttcgtacatttcttgctttctttattattggagtttctaaatcataatcagagtatttcatagctctgtaaattgtgttaacttcctaagtattttattttagagggagccagtgcgatgatgggaaagtgggacccttttttttttcttactactataaatatcttttattgtagacagttctaagaattgttttctattaaatagctatagttttttcttctggagaatttcagtttgcatcattagacacaaggattttcaaattttctattaaaatattcatgatatgtaagatgtgaatggtaatagtctcttaatagatacaaaaataacattttttactctaattattcagtaagaaataactcttgcaagacacagaagatatatgtttagatataaactgtttaccacctttcaacattaaaggtattaggagagtagaatatattttacactcttgcccatttatattctcctttcacatttggctcactcattcctttggccttagagttaggtgtgacagtgtattagctaagctgtctcagtcattcaggccttttatcagttctacaagacagatgctaaatagcatagtctaaattgaagtctctgatgactctcggagacaagttgaaggcaagaactgcacttgggcacttaaatatgtggcctttttctatatttaactgcaagaagaaggcagcttttaagtaaactttttagcctttaactgtcaagaatttttttaatcatttgattgttgcatctcattttgttaagaaaggctattaaccttttctttttctcctacaatggagaattttaaagatcactgctgcctattattttaaacaaaaataatttaaaacaaattttgttgtttaaccattgctttcaggacaattgtagactatagagacatttttgaaatgaaatattgcttccaaatgtgccacagtttatctataaattttgaatgacatactcacaatttacttagcaatctttgggacctccttatgtcatacagttattacagaagcatttttaaaatcaagtggacctgaaagaatctggtatctatgaaatggagatagatgttaagtaatagagctgaagaaaatatgctttgaaatgtcgactgggatatgtttccatagcctgtttgaatttcagttcaccaagaggaaaacaaggagttgatgtgttctttgcagttcctcttagctccaaaagtgtgtgaatgctctgataatattgtatgtcctcagtatgtgttgaattaatacattgaagttttccctgccagcccttgttgcctgtagtgccttatttttaaagactccgtaggatgctcactcaacatgttaagttagaaaggtgtagaaggaatcgtagaggtcagccaggaacattttacaggaggctgaggctgcaagggtccaatccccacacctggcagttcctccacgtgcgctgagccgtcttctgaactgcctgcgtcttcgtggacctccttaaatctttctggaaacaaggccgcttacaatgtgtggtcaagctgaaaaaccagctgtagtaccaaactgtgctaaatcttttagctgaaatatttgtcaattttctttttttttgaggcagagtctcgctctgttgcccaggctgggggatatcttgcctcactgcaactccacttcctgagttcaagcaattctcctgcctcagcctcccgagtagctgggattacatgtgtgtaccaccatgcccggctaatttttgtatttttagtagacatggggtttcaccatgttggccaggctggtctcaaactcctgacctcaggtgatccgccccccttggcctcccaaaatgctgggattataggcgtaagccaccatgcctggctaattttctacatattactatcttatactgatagcattgcatctttctcatagcaccgattagaaaaaaaaatgcatcataagttatttgtttttctgtgatcatcaaaaggcaatggtaatttaaatgtaatttattataatatgcacatgttaattttggtttttatttatgttcatcatatttaaactagtctctgcaagtactttagactaatttagattatttcctttaagtctaacagaaaccttagattttcaaccagatttttcatttggacaaatgaatttcaaaacaggaaatatgaattttattgcaagagatttcacctagaaagtgtattgatctcatcaatagtgaatttttggttataagattgtagtaataattaataactacttaaatttataaaatttatagaaaattcagacaaattaattctgatttaactgttaactacaaaagttgtaaatggacaaatacagggaatagcaaacataattttctaataattatttctaattaaaattgtacagaattcaggttcataggaaattataatacgtttttgtctggatccactgaaacctgtaggtactctgtaaaggctaagtaacattttctaatgaaaaggaacaatgccttcagatcgaagaggtttatcttctgagtttgcagaattctatatattttttgtgacatttctcatattcttatttcaagtgcagattgtgggtggtatttttatctcttctcctaataatatatatcttggagctaatgtatttgagttgtatttttccccgctcgtactaaacctagtaacttgtgaaaattaagtagtcaatatatttttaatgaataaatgatataggtaaaagtctaatttagagctattttcttaactctgtttctagtaaataatttagtttatgtgaccatagatccccaaattcatatttatgagctcctaacattgaaaaacttactctgcactttacatgtttctctggccattttatgtaagtgcattggttatacatatagcttgttttctaaaatccactgcggttccataagtggttatataatttatgaattccagtgtaatagtccattaatttacctctcttttcctatttccagttaccattggttttgacctccttcagcaatcacaccttgctaacatctcagatcttgacatcccacagggtagaaaggctcctatagaatacagatccttcttcatatttctcacccattcctcagtgcactacagtctggcttccacctcatcatgtcactactgcttttagattttcagatggatactttcagtcctcctcttaatgatctccctttattattaaaaaacaaaaacaaaaaaaatggtctctctcacttgttgaattttatggtatcatcccttttccattttcttgctactattctgactattctttctattctcctatagaatcctcttgttgttaaatattcaggtactgtcttggggcctcagcctttttctcactatacactctctctttgggaaaagttgcccgtttccatagattgaacctaccacttggtcacagccaaacataaccaacagcttagacctctctaataaggactcttcagatgtccagttgttcagtgaccccccaagttgtttaccccacaggtattgcaagcttaatgtgaagaaggatcaaaccccacttcacagtagggatgtggtttgttaggaaaggtttgtgctgagtcttgaaggtgattaatggttattcaggagaaaaggaaggagaaaagaaaagagtgagggcacgagggagaattacaggctgatggaaaatcatggagaccaaggaggagcaggatatatttgagactgccagcattttggtgtgactaatgcttgaagggcctgtgcaggaacaacctgagagactgacagtcagcttgcaaatgtctttgtgtagtgtgtcaatgggaaatcattgatggattttaagtagatgagagatatgatttaattagtctattagaatattcattgtgcagcacacagaggaatcaactagaaaaagcaaagctggaggcaaaaagagcaaataaagaaaagacagagactttcttacacaaaatttaaaacttttaaatgctaaataaataaaatgggaaacaaagatgataagatattttcagtcaatacaaccagtatttaatatattccagtataaagatctcatacaaattaacattaatgaggaaaagacatgaacacgcattcacaatgcatgcatattgtatttatacaaaatgagaaaatgctcatcctcctttgttaaatgtagtaatctaaattgaacaggaagactcatctattttttaattagaaaataatattatcaagatcataaaatatacaaaaaatttacctcattatctcactttggagactctgtctgaaggaaataatataaaacatcatatgcctggaatatttatacaatgtaattacaataggcaaaaaattgaaataatataaattccaaatataatggcaaatagtaggtggaatattacttagctattaaatacaaaattttgatagaaatggcaacatcgaaacatattaaactaagtttaaaagtacactaaatggaaaggacataaaaatgtaaaaatatggtatctgcagtgctatgtttttgaaaagtttaaagggaaaagcacaaagttattaataggtggtaggattacaagtgatttaataagattttcttgcaagctttctacagtttcttattatttatatgatttaaacaaatagacaatttgtaactttgtagtcttgaaatctaaattccatctctgcctgtagctctcctcatccaatcggtcaggtgccccgaataatcctttagatttttgcttgaatttaataatctaggacagtgactgagggacatgtcctgtagagacaaagagattgggggttaaagtctttttctgactgtgtgctgacatggtgatttccagccggttattttctctcttcaatttccttgtctgtgaaataattttcatacggttttgttgcaaattgataccagtaatgttcataaagcaatgaacacagtatgaggggttttgttcttattcttgatgccaccttaatttaaggcttttgccatcccatgcttggaccactgcattgaaatgcagaccattcaccttgactctatattctcctgacctcaggccattctgttagaccttgactgaaaacccttcgggaagttgatggctcaaatcacttgaagttttccctgccagccattgttgcctatagtgccttatttttaaagactctataggatgcttaccaatatattgaatatttattgaaatacagtcatgtattccttaaatgtggggatccattcatgcgttgttaggcaatttcatcattgcatgaacatcatacagtgtacttacacaaacttagatggtattgcctactacacacctagactatgtgttgtagcctattgctcctgggcttcagacctgtacaagatgttactgtattgaatgctgtaggtaaatgtaagaagatggtaagtacttgtgtatcttaaacatatctaaagatagaaaaggtatggtaaaaatatggtgttataatcttctgggactacaatggtatatgtggtccgttgtttactgaaacattgttctgcaacacatgactatatataaagggcgaccttggagatatcacagattcagtttcagaccactgcaatgaagcaaatatctcagttcagagagtcacgtggtttttttgtttcccagtgcatataaattatatttatactatattatagtctaataaggtacaatagcattatgtctaaaaacaatgagcctaccataattaaaaatactgctaaaatatgctaacaatcatctgagccttcagtgagtcttagtctttttgctggtggagggtcttgctttgaggctgatggctgctgactgatcagtgtggtggttgctgaaagctggtgtggctgtgatgatttcttaaaataagacaacaatgaaatttgctgcattgattgatttttcttttcatgaaagatttctctgtagcatgtgatgctgtttaataccatttgatgcacagtaaaacttctttcaaaattggagtcaatcttctcaaattgtgcccatgctttatcaattaagtttatgtttgctgtcattgtccttttttatcattttgataatgttcaaagtatcttcaccaggagtagattctgcctcaagaaactactttctttgctcatccataagaagcagctcctcattaaagttttttatgaggttgcagcaatttggtcacatcttcacttctaattctagactttttgctatttctgctacatctccagttactccactgcagtcttgaacccttcaaagttattcatgaggattggaatcatccttccttttaatgttgatattttgacctcttcctatgaatcagaaaggttcttaatggcatttagaatggtaaatcctgaatcttttgcagaatatttaaatttacattgcccagatacatcagaggaatcaccatctatggcagctagagccttacaaaaatgtatttctttctttcctttttttttttttagatcgagtttcactcttgttgcccaggctggagtgcaatagcacaatctcagcttactgcaacctctgcctcccgggttcaagcgattctcctgcctcagtctcccaagtatctgggatcacaggcatgcaccaccacgcccagctaattttgtatttttagtagagccagggtttcaccatgttggtcaggctggtcttgaactcctgacctcaggtgatccacccccacctcaggcttccaaagtgctgggattacaggtgtgagccaccacacctggcctaaaatgtatttcttaagtaaaaaaaaaaaaaaagctgaaagtcaaaattaccccttgatgcatgggctgcagaatgggtgttgtgtaagcagggatgaaaacaacattcatctccttgtacatctccatcagagctctagggataccaagagctttgtcaatgaggagaatactttgaaagaaatctttttttctgagcagtagatctcaacagtgggctgaaaatattcaataaaccatgctatatacagatgtgttgtcatccaggctttgttgttccatttacagagtacaggaagcatagattttgcctcattattaagggctctagaactttttaagtgctcagtgaccactggcttcaacttagagtcaccagctgcgttagcccctaacaagagagtcagcctgtcttttgaaacttcaaagccaagcattgaattatcctcagtagctttagcagcccagtgtcctcttccaatagaaggctgtttattctacattaaaaatctgttgtttactgtagccactttcatcatttatcttaggtagatcttctggaaaatttgctgcagcttctccatcagcacttgctgcctcaccttgcactttaatttatggagatggtttctttccatacatctcacaaatcaacctctactagcttcacacttttcttctgaagcttcctcacctctctcagccttcacagaattgaagacagttagggccttcctctggattaggctttggcttgagagaatgttgtggctggtttgatcttctatccagaccactcaaactttttccgtatcagcaataagcctgtttcactttctcattattcatgtgttcactgggatagcactttttatttccttcaagaacttttcctttgcattcacaacttggctaactatttggtacaagaggtcttccagcctgtcctggtgtccaatatgccttcttcactgagcttaattatttctagcttttgattcagaggaagagatgtgtgactcttcccttcattcgaacacttaggagccatgtagagttattaattggactcatttcaatattgttctgtctcgggaaatagggaggcctgaggaagggagagagataggggaatggccaattggtggagcagttagaacacaaacatttatggattaaatttgttgccttatatgagagttgtttgtggtactcccccaaaatcacaatagtaacattgaagattactgatcacaggtcaccataacagatataataatgatgaaaaattgaaatagtaccaggattaccaaaacatgatgcagagacatgaagtgagccgatgctgttggaaaaatggcactgatagtcttacacaatgctaggttgccacagaccttcaatttactaaataaacacaatatctgtgaagcacaataaaccaaagtgcaataaaatgaatgtctctacgtatccgtaacaaataagactcatatcttttctgactatcatgatcataatatattgttaaattcttaaattgttatattgttataacttattataatcattttacttggtattatgagctcatttttgctatcattgagacacctatcttctattacaatacaattttcttattgtaataattttgtaagcattgtcctggtcatttggtgaccttgagtattgtaaaatttctgatgtagtgaagcaattacagttggcaaatgaggcagatactgaattacagaacttctcactcaggagcctacgctgaaggtaaccgatttaccattcctgagactaacagtccagtcctgacagaactcaagtcaacaggtcttgcccacccgtttataacaatggcgttttcatgaatcagaatttcagattgaacctgatgaaaacaagtaatcaatatctttgcatcctattgtttcagtgttctagtgggttggctaaatgggccaattagaataacacaatgcaaatttcctgcttgatataaaagtcttttttaaacagcttcagtttatgctaaataataaaaatagtgaaaaggaaattttcaaactatatgatgaagacttcaagagccttacattccttccttattattattagttttgtgaccatatgatggacactgtgatctaagtcctaaatccattatgccacattccgtaaatgtaggcatataaagtattctgtcatctgtagttatttcaaactgcattcaatatcttggttcccaagtgcattggattttattaaaagcattctgctgtaacatccattcttcccaattggtttacagattgcccctaccattcaggcaaaccctaattgcattttcccacaaatctcgtttgatttatggtctcttgtttgctttatattatttataataaattgaggtaaaattcttaaaacatgaaataaaatttataatattttctcttctacaaatatggaacttacctaaggattttcagagtcgttttgcttgttttaaaagttgtttagacaagctacaaccatctgcatggtttccaataataagttctttattaccatcccagaattaattatatttcgcttgattttttttatgtacagatgtttaggattatatggaataaattatgtatagaatataaaaatggtatgtccttctataaagcttaggtggttacacatgtcatatgtacctggaacagaaaaaaatattatttcagcagtagtgacaaagcatctgcataaaattcagtgccactgatgcaccgagacagctaattgagaacattcttgcttctgttacaagttccggcttttgagatgccaagagttagtttagaatggatctatagcagatcccaaaaagtataaagtgtttaaaaataagtaaatagcagaaatataaagacagaggataccagagacttaagaagagaatttctcactgtcaagtgattacatatcaccatggattattttgtaaagttctcttctaaataaaggctttccatggaagtgcaggcatggaatcatttctgtagggtacatgaaaatttattgaaaggaagaagtataagttatctatatcgatttatgaatagccttctaagctttgttagaaatgtgtctattcagtcaaaagtttgaacattaagaattttgagctgagaatcagaaagattggagtatattcagtataagagacaaaaagaaaagagaaattgattttttgagaagtgcaaagacaaaagggggaaagatggatgatctcaacaaattttagaccaactcagtaagtgggaggcttattatcaacagtaaaaataactatgtgacttctagaaaaactcagaaagggtggttagtggatgattagcaaacaaaatatctaaataatggttgtagttgagtttcttaaatggggctttgggactttcctcttcactagaatagtaaagaggccccaacatctgcagtgccagtggagacctcacgaggagcttgggcttgttccccacttagtgacgaaagagttgtctccttcccattggagttaagtcagaggactgcctagagagtcaggaatttcaccactgcccagggtaatgaggccacactgtttatgatgtcagtgtggacaatgggggagcagtaatgagtcactcctgccccttccagccaggagggcatcagtggaggcctagtgggttctggaatctccatccccacccagtattaataaggcactccctcctctggggtcacccagtattaatgaagcattctctcctctggggtcagcagacgccaagtagagtaatgagacctctaccccaacttggcagtaataaggtagcacccttcccccaacctttgccagagaaatgtcagaataagcaagctaaaacggaagctttaagatctcataatataatgtatcaaacatactggtttcacaagaaaatcagtaatgacaccaagaatcaggaagatctcagagtgaatgtaaaaatataatcaacaggtgccaacaacaagataacagaaatgttagaaatgtctagggaagaattttaaattagttacttccaaaaatgcttttatgaatattatgacacccttgagacaatgaaagagtggaaagtctcagaaaagaaatagacgatataaagatgaaccaaatagaaattgtagaactgaaaatacaactcaaattaaataaaagcatatttgggctcaacagcagaatgcagtaggcagaaggaagaatccacaaacttgaagatagagcagtagaagttacccaatatgaacgacagagaaaacaggctggaaaaagaaaaagtttcagggatctgtggcactgtaacaaaagatctaacattaatgtcattggagtctacaaggaaaggaaaaagaagccaggccaaagaagtactcaaagaaataatgactgaaaactttctaaatttggcaagagacatgaacctacagattcacaaagttgaacaaacttcaaacaggataaaaagcaaagaaatgcatgcaaaggcacatcgtaattaaacttctgaaaattaaagacagagaaaaatcgtggcataactaaaaaaaagtggcaccttataaataagggaaagcaatgtgaatgagagtggatttatcatccaaagccttgaagggtagatggaagtggcacactatttttcaagtgctaaaagatagaaccatgaaccttaaatcctacatccagttaaaatgtagttttggaaatgcagaagaaatcaataaaattggccaacttctagtaagacagacaaaggagaaaccgaagacacaaattaccaaatatcagaaatgaagaatggatatcttgagagaccctccagacatcagaaggataatacagaaaaaacacaagcaattctacacttgtaagtttaactacttaaataaaacgggccaattcctcagaaaatacatgttactgcaagtcatccaataggaagcagattctttgagtagctctataactttaaaggctattacatttgtaatagaaaactccatatcaaaaggtgacagaataaaaatcacagaagcatattgactgacgcagaaaaaaattgaaaaaattgaacatttagttataatgaaaaactatcagaaaaataagaatagagggggaaaggtcatcaacttgttaaagagcatctacaaaaaattttgcaactttattcataatagccaaacccaggaagtaatccatatgacctttaaaggtggatgggtagacaaactgatgtatccatgccatggaataccattcaccattaaacagcaatgaactgttgatataggttgacaaccccttatctgaaatgcttgggattcaaagtgttttggatttttgattttttcagctccaataagcatttcctgtgaacaaccatgtcagcgctcaaaaagtttcagattttggagcttttcagattttgatactcaatctgtacacacaacaacttatatgattctacagagatttatgtggagtgaaaaaggccaattccaaagggttacatgttgtatgattcttgaaataacaaaattatagaaatgaagaggacatagttgttgctaggggacgaaggttaaggggaagaaagagtgtggctgtataagggcaaattgagggaactttgtggtggtagaaatgttcttgtctgtatcaatgtcaataacctattgtgatatagtatcacagtttgtaggatattcccattcgggaaagcaactaaaggctatgtgtgttctctgtgtgttatttcttacaactgcatatggatctatgattatcttaacaaaaagttaaacaagaaaaataaaataaaataaatgaggcttttgctgaccagtaatcagtgttctacaataacaatacacacacacatgcacatacatatttgcactatacactggcactattgcacataatttactataaatatttgttcacacatttatgctcatttaacttggtcaaattttctttctttagattgtattatatcacttttttgagggtgttaaaatggtgccatattggtagatgttaccatctaccttttctaaaaaaaaataactttttggcaacataaaaatttgtcaatcatttatcatttccaaaaaatgtgattcaagatttactcctccatgaatttcagaagtccaggaatcacagttctacagtttccatgatagtaatatagctaaaactgttctttttatgtagcctccagcttaaagagctgaacaaaatagttgttaaatacatgtggttatttgataattgaatgaatttgactgaaaatggtggctattaattctaattccagaacaaattcctaatcttcaataagtaaaaggaaatcttccttcctactggtaatacccaatgctgcctcaattactcatataatcatatactgggagtaatgtgctatgtagtggagtaaattctaaactctaataaatgtgtgttacctcactcttcaactccacttcagcatttaatcattgtaataaggtatttcttaataccacacttaatttcaaatataatccttttatatatgtattagatacaatgtatttttcatatctaatatgtgtattgtatgtttatttattgtatgttatttagatatgttaatatattcattaaaattggagtttttaacaaaaatattacaaattaacatataaaataactaaaaatattaggttatattattttgtctatagttagtattagcaaagtaataatgaatttattaagctaatatataaaatgactagtatttaccttttttcagtaagcagggaaaaataatcgtgtttagactatatgtaaggaacagaatagtacatttattttctaaatagtttacttactactttcaattttgtaatctaatgaattagttccaatgtaaatacagatttaaaagatgtattcattgtaaataactctatagggaatatttcttcttcaatgaaaatttcagttttggagatggaagtttctcatcagttctaatttctcacctattctaatgttactttcttgtgaattcatgttaccaaatgtatgctgtacacacacatagtaggccacctttttctctttctacactaatttattattagttttatatcattttagtagttttattgttaatattcataatgtgagaacatattccactattttccatatatatagaaagattgaaatgttttaaattacttcagtattccataaagtatatcagacccaagattagaatttataagtatttgaaattgtaaaagttttaacattctaagcgtaagacacctctattaaaatgtttttcacaaacataatatcagttttctcttccctctaaagtgatattttaagagacattttctaggaatgctttctaaagtagcttgaaataaagtagacttttaatagtgattataaaataattttctttcccaggtgtttgtattaacagatttctgttgtcccttatttgataatgtgtttttatcttccaacatatttatacaaactgaaatctttaaaaacagaaagttcttttattatgaatttttttagtatgtcttaaaacctgatccctatttttttttttccaattaaggtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtaagtcagggcacagctgtgccggccagctgcacccgctgaagtgacatctcccaatgccaaacacacttggctgcttaagtaaataaactggagtcatttctcagcacatggaagatggtgggaaagctcttagagaaagcccccctgtgtcagccatccaccttgactaacaattaaattatagcctgcaaagaagaaaatgacagagttgctttgccttagagagttgtctgctgcccaattcatctctatttttatgagaacctggcagcccggcctgtttcaggcagtccatcaaatgatggaactggtggctggatacggagagcaacagccatttatctcccccagatttcaccttcctgcaggacacttccaaatggaagctttaattacctaaatggataggtcaagattgtctgctccctggaaatgcagagtagaatacaaaagcaggccgatcccaatcctggctctcctctccgtccccgcctgtgtcagcaagcgcgatggctgtcacacgtgccctgttagaggctgacctccaccgccaaagccattacagcacggacatttttctgacaaaaggttaattggcttcaaaataaatgtattgcctaatgactccattctaatgtggttgtgttcctttgtaaaaggctcactgatgttatttgtaaaaacttgccaatctcttaaccggagaaggcttttacatttaatctgagaaaaataaatgctggtctctaaccagcttctgctatttaattattgttgttatcaaagactttgcttttggtgatatttatcaactaaaagggcttctctgcctacagacagcaaagcagttgtgcacacttatgagtatcacatcaggttaaggacaagaaaaggttttggccaactattagttaaattaagcaattgacacatttaactgggaagtccagcagtcgtgaccaaaagcaaatcaggaattgtttttaattagtaacaaataaatttatgttaaaaataaaagtacaaatcagagaaatcaaagtaaatagcttaaaaaggtgcattaaaattaaatttttccttcctgtatagacacattgaaaggattattgcattatatctagtatgtcttttgaaatattttcatattgttatcaaacatttctaattcttgagcagtcatccaatatcagttattgaacttagaattattccaacttatattacaagaggaacttggtagtatccttattaggaaaccttactataaaattttgggggggtgggaaagaggtgagtaacattattatctcctttataatagtgtctgttagaatgtgaacttgttatgtgaaaatgtacgtatgatgagaaaaaatttatagcgtgtataactaactttcatactttagtcttaatataagcatatatttccaaagttttgtttggatttttggattcatatatttgattggttgcatggattttgtgtttgcctgtctatgtactggctcatagatatgtactggctccaagataatacaatggagtttcttcaaaacctgattcctgttgagtaaaataatatgtcataattctttataaaaagggagtggcttttggtgttttaggtaattataacctacacataaattgtattaatgaaaataaattatatagatttactatgattcaaataattttatgagcaacctttagaagtgtagagactagaaaaaatcattttgaaaataaattattaataaaaatatgagatgaatcattttctttatctttgataatccaacagtcagcagggatataaaatgcttttcttttttatggatatattaattctcttaagctactattgattatagtactgattcagcaagctaaaaagtaataaaaagaagaaacaatttctttgctgtcactggtagtataatagcataaatttaggaaaacatcttattccggaagctgtggacttcttttagacagtagctactacattttaattgcattactgtaacactgaagataagacattaagattattttttattttatttatttattttttgagacggagtctcgctctgtcccccaggctagagcgcagtgacacgatcttggctcactgcaacctccgcctcctgggttcacgccattctcctgcctcagcctcccgagtagctgggactacaggctcccgccaccacgcccggctaattttttgtatttttagtagagacggggtttcactgtgttagccaggatggtctcgatctcctgacctcgtgatccgcctgtctcagcttcccaaagtgctgggattacaggcgtgagccaccgcgcccagccaagacattaagattgttaaacataggcttgggaaccatctgtccatagtttcatatttatttcgtggcacatttgatgaaaggacaatctggtgctaagtaggaggagggacttgttttaggatgccattcttaaggaagaactcttgagtgttgaaggaagcagggcgatccgtcccccacaaaaaactaaaagcaagaggccaagaccctgcactcttctcttgtgtgtgggcagagcaccggtttctggtcatgcaaacctctggtctcaatgtcatagctcatccctcactgaggactgctgaggagcagtgcttccctccgaggataccggccctctctcaactctcctcagacaccctagagactccaagtggacttgtgagcacctgaaatgatgcacataactaagtgagaagcaggtctgttgcttttatcagtgtttccagagcctgtggctccgaaggacttaggatgcactggctgtaaaccccggcacaggctgccccagcctctcacggtcattccagtctgtgaatgtgctggtctggggatccctccccaggtcctcagactcctcttctatttgttctggattagctgacctgatcttcaccaggttaggaaccattgtgtgttcttgaaataacaaaggcactctatggtaacatcagaaagtagaagcaagagttagagacagacagatgtctttgcatgcttaggtttctcagcccacgccctgctctcagtaccagtttcatgcacatggaagtggtcattagttccagatgccaaaacaacgtggcaggctgcgtgtcatcgtctctgcagcttcgtctctttcttgtggcatctctgaagattgcagcagtgtctgatccaacagtctgcagtggtggaaatgttctacatctgcaccgtctaatatggtacaattggccatatgtggtgattaagcacttgaaatgtgcctacggagactgaggaactcaatttttaattttatttaattttaattaattttaatttaaatagccacgtggttaccatattagaccatgcagctacagattaagataatggcagtcaaaaataaatgcctgaatctgctacccagatagatagaaggctatcactgtgttagaatttttattattaaagtgaaaaaacgggactcatctgtggattttttgtcatggttttctatgcatatcataaatttattagtaaatgtgagaaacgttttgcaaaatgtttgtagtgaaaatttctatatacttatcaatggcaagttcatgagctatgaaagttgaataaatctcatctcgaatatgaaatctaccggcaagcccaggaatagctttttttttaatttttaaatatgcattttctaaatatcactaaagaattcttgattatcaatggttgtagttataaaaaagcataaggaatacttaaacaaaaaaaatgttaatctgtttcttttgctacattttccttgacccctctaacatttgggaaatacgactgttgattcttttgctgtcttcaatatccacattattggcaacaagtgagaaaagagctaagctgtctggataagttacaaagcagataatcagatgaacgatggaattttaaaaattgtgtttgagttttctcatcttaaattgccatcctttaattttctgtccttctgtaatataaatcgcacacttctaatgatggtgatcggggtggggacggggctctttgtaaaggttttccatatgggcacctggggagggaagaaatgctatatgaattggtaaaatacatggcccattgtctctacctctgctgtgtaaataaagagcgaagagaagcatacaagtggttttgaaacggtctcttcaatagagacctcgagagaaagagatgaagataaatacctgaggcactgttaatttttagaaataactatatcatattataaaccattcatttattttgaagatggaaacagctacacctacataaaggtgtctctaaaatctttcactttctaggcattttgatgtagtagatattgatacaggtcatctttctccatgataacgtgctacgtgacagaatatgacatgcactaagacggtcttgttttccactaaatttctaataaccaggcgtaagaatgtcccaggtatcagagatatttgaataggacgtagataaacctgtaatcctctaggaaaatcaggatagaataccacccttttatgcatgcaacaaaatcacaaacctctcaaatttgaaagggagaaactcaaaatggacttgtattttgtccaaaatccttccccactgcccgcacagcacccgatcaacccacacccggcaatgtcatgatggtccttgtccagagtagcagacatgccagaggcctttctgcgttcttgttttttcttctttgacacgtaaatgatattccatagccacctatattgaaatgaataaaaccagaactgatacatatgagcaggtatatgtgagaatggacttaggtggcctctactcactgccaaaaatgtatcttcctcactgccctattagagaatatgaaatctcaccatggaggcaaatttccccttaggttaatatagtaattttacctgttgattaaaatttagatctccagactttgttttgtattaaaaaatgacttattaatcaggtaactatacacatttaatactttttataaataaatgttgacatacatatgtcatttatatatttataccccacattatttcaaaacggatttaaattgtcttacaaaaaaactataaagtcagcaaaaataagagatgagagaaatgaaaaccatagggacccaaaatggatccagtaacaatgttagtaaaaacaggcatatcctgaaatcctataaggcgagatctttgtctgtatttctggtttattcactcactttcctggtacctagaacagtactgtcacagggcaggtgcccagggatatttgttgaatgcaagtaaagcatacaggagctgattgtttttaagttttatttctcttgcttcgtaggcctcactttccttatctgtaagtgacaacaatataccaggtgatttctatggcccttttaaattatgagcattcaaataagttttgtttcataattattaaaataattgtattttgatatgttggtggaatacttcaaagaacaaatattgagtacaaatttgccacagagatcaattcttctggtagcaaaatggaaatattagcagcagcacatttaatttgaatccatagcactttaggttccagaatgatatgcaacggtcttgagggggttgaacttttaccaggaggatgctctttaggttatacacgaatgctttccaatgactactcatcccttaaagtttgctttcaaaatgacaaattcgcttccctttctaaaggactgaaaatatatgttgcacttgaacacccaagtaaaggaaatgctgtgaataaattaattagatgcataaatcagcctttataatttccactgatggtgtctcagacaacacctttaattatgtgttgactgacaattccattcagtatttcttctctggcattttctcctttttttctagttctttttatttctcagcagcattggtattcaggaactataaaaatctctgtcaatgtgactgttttcattgacataactgataatttcctagtaggaaaaacagttattgcatataattattataaaaatatgcacacattttcttacaattaaaatcagcccaactgaggatagctcattatctgtaaatattactgcattttaaagtaaatcacactgtgatgtgatactcgatccatttgctatcagaatattcacaagattccgtaattttgagttataatttagtcccttggtaccttcaatttcttaatgtttcaatttcttaaggattttaaaaaaataatgctatatctgttgcccctaaggtaaaactgatattgacttttgaaatcttgtaggcaaatttatttgagctgaataatttgtttcacatcaaggagaatgaatgttctcttggaattgtcctgggtttctatttcttttgataactgccaaagcttgagtttggataataggacttagtagaatttgcaaggcaaattttacaagagaagtgacaatttacctgatttttgtacaagagatctgccacgttcccacaattatttcctttgtgattaattaatagacagagcttattccagaagttttgaaaaaaaaaatcctctggcaatgagtgtactattcttaatgccattcttttatttgatgtaaattgttacatcttaaaagtgtatagcatgaaaatacagccatgtattagaaataacttttatttaaattggttagatgacctctgaaaaccagatgaaagattttctgctgaatgggctggtgctccctgctgcctatataatttatgtgagaaattagtgcaaatggttcacttttatgtagcagagctgcttgtagcaagcctgcagaaacaattttcccccaagcctccatctgttcttcaaactagggcatacgccatctcatcgagcttgaaagtcaactgatttataactcctggaaagtgtatagattgaaaagaaaggtcgactgctgctctgtgacagtgatttgtttggcattggctaaagacaattcacattaccagggacccaagggaaacaagaaatgttgtaagtttcagatctcagtagactgacaactagaagaaaaacaaatcactcctgctttttaagtcagacgaccaccagggttgaaaagtaggtcttggtagtgttaagggtgccaaagctaagctgccacccatattgtcacttagcacctcatgaagaaatgtgtcactgcccaccctctcagtggtaaatgttgacgttgtagaagtatcaatactctaatttttaaacacaaaatatgtgtcactgcttgtcagaatgttctgtttggagacacaaattggtctttgatgaattttctgtatctacccaaggataatctccagttgtattccaattagtaatttaatgaacagttcgctcctgtcttatcactcgtcacacgtctcttctctttactgaagcactattgagatcaaaagtcctttgacagatgacaaatggaatcagattggcagtatgcttgtaaacaacaacaagaaaatcattctttgtttgatgttttcctttgagtagtcaaagtatcatcctcccagataacaacttttagtctattgaagtttttgttgtcttttttctacatgtatgtatgttttttattttgtcgaaactgtgtttcacatgataatttttaaggaactcaaaggaacattcatggtcctaattaagacaggagattgatagtggacatactgccacaggaattctaatagttttttccagtttaatgacaacgaaaaagacaatcatcttttaatgtgcaggtttaagttttcagcggtcattactaagacctttggaaaggagatacccaaacatgtttctatgcaaagctccatgttagcagggatgcacatacatggcttttcctgtagtaattctcatggtatggtgcccaaccacgtaagcaggcttgcctttgtgagcatgtcattaccatgtttttgaagagcagagtaactactattttcacaaagttcattatgtatgaagcacatttcttgctattgggaaaagtatagaaatggacagagttgacagaatcattttaaagccaacctctgcccctactctaagagactgtctttacaacaaatactcctacagaatttccaagattgggttctaatctgagtaaaagaaaacccatcaacctttgtagccataaattctcaaattttgagttcttatttagattgatctctctctgttcattcatagttttaagcacttaaaaaaaacaggtatatggtttgaatatttctgaattcttgaatatcttgaaaatataaaatttcaactttcatgtacataaaacacaatttaattgaaattagcattcttaaattacaattgcttcccttcatatctctttagaagataacatctttgtattctattaatgacatatgttatgttaggtatattataacacatgtattataacatgtattataacatatatgtatatgtataacatataacatatgttattatgttatgtatatccaattccattgatctcattttctgtagaaattccctttattttctgcctgcacatttgttattatactgatttgccgttgcatgttacattttcctttttctgtatcttcacagataattttgtggtatgtggagagatactgtgtcagagatttgtgtcaagatgctatgtatatatgctgaaaaattaagactagcctgattttattcctttaatgtcaatgtattgtttgtttgtttgttttgtttaacagccttggtaaatgcactatttttgtgtaattaaaaattgcttccatgtatttttcttttccttttgtgtattcttccattagtacagtaagcttattgtctacttacttgaaactttctcaactgaggaaagttttcttttgtaatattacttattgttactctgtcccaattttctgttttctttcttagaacaaatattacatgtagattatacatttatattctgttctattatttctatcattatctccctcaatatttttatctctttatccttgttttaacttctggcagagctttcttttctcttctttttttttttttgagacagagtcttgctctgttgcccaggctggagtgcagtggtgcaatctcggctcactgcaagctccacctcctgggttcaagcgattctcctgcctcagcctcccgagtagctgggactacaggcgcccgccaccacacccggctaattttttctatttttttagtagagatgggatttcaccgtgttagccaagatggtctcgatctcctgacctcgtgatccgcctgcctaggcctcccaaagtgctgggattacaggcctgaaccaccgcgcctggccagagctttcttatgttttctatttttgttggtatggatctatccattactgccaccagttcaaattttagctgtgcttaggtaaactgccctgcacctggccaatacccagtgtctagcatgagcatgtttcacctggtcttattctgttggcctaaaaggggactttgtaacttctgacactgagatagctggagtacacaaacacctataatccctaaaaggcacaggtacccagctctgtctttgcctgcctttacctatagcattttgcttgtgggacacactgctttctaggacagaatgcaatgtggtaccagaaatctctgtccctacagagatttgttgttgtttcttgagttgactgtgaatggatgtaggaagggtgaatggaagtggatagtgctttgtcttgaaaggcaactacttcaaggtagcaggctggtggcctagtccctcccgcccccaccatcacccttttattctagaccttatgtttctgaccgggccaggaagggggatcagaaagtgtgggagagatgaaaaagctgactacctacctttggattggtgcctctggttgcaaaacataagttgactatgaattgtggttttccaatccaattccattgatctcattttctgtagaaattccttttattttctgcctgcacatttgttattatacagatttgccgttgcattttcctctttttctgtatcttcatagataattttgtggtatgttgggagatactgtgtcagagattcgtgtcaagatgctatttaaaaacactgagtccaattcatttttgtgcattaatggactatattcctttgcagagaagtaatgtgatctcattaacaggctacagtgacttgtctattcataaaggaattgagtacttataatgggaaagacatggtgctgagctctgtaacctgcataatatgagttctggtcttaagaagcttattgactagaatagatcactattcaaggaagaaaccgaaagtcctttcaaagagtatatatcaagtcttaagacagattgcttccgcttgcatagatcataattcttaatcctttatgcagtatgtgttaaacatttgctgcttcagtgatctggttcaaataatttctgtagacaaacttttcaaattgagagtctctataaaacttttgccagttcataaatggttatctatttcagggagtgcagcttgctgacacttttgtttttcttgtatttcagtttttttaattgccatattaagaaataataaattttacctttaaaatgacctttaggtagtcaatccacatacctatgtatctacatattgtggcaatcccaagtatcaataagatattactgacttcagtgttctactctgtactttgaaataaacactttgaaaaaaattatgtttttacctatttgtgaattttaaaggtttatcgtgcttgggattcagtctgatttaagtctgaagacttctggagtcatgattaaatacgagctgggctttctcattccagctttcacatctctgcatctccgttctcttattttctatctttttaaatcaccgtgtttcattcactttttaattcactgtgtgttgtaggtgatttcctcaactctgtcttccaacttaataatttactagtttaatctactgtataatttgttgaaattttttcaaatttactttcagtgaatatcaattctggaatttatatttgtttcttaaaaagatctgcctactcttatatttttctcactttatggtttctcttactatctttattagattgtatttttaagtcactcatttgaggttctttttcacactcatctattatcttgagctcctggggtgtgacttggaatctgccttctgtgggaggccctcgcggcctgggttgtgaaggcacccgtgtgctgtgctttcaggttcgtctctgcaggacacacattctgaacctcttttgatgtgaatcagccttcacgtttcctcactgggctcctgctcactgctctagatttgagtttccctttcatttctggggacttagtatttgcctatcttacttttgagaatggctatgcatttatttattttattttattttattttatttttcttcccgtatttatagttttggccatattgaccagaggtctattaattctgtaaaattgttttctcaattaactgaatatcttcgcttacatgcagattaaagtaccatcttgagatgtaatctttcctcaatgtcagaccaattctaatacttcctcaagtacaaaaaaaatcaatagaataaaatatgttttgtatttcccatggaagtccctttatgtaagcaagttacctttatgtaagctaatgtgtattgcatgattgtgtatgtgtgtgtgtaatcaaacacacataaattaaaactctgttgaacatagcaaaacttgggtttggaaaaatcacaaggaaaagacataaaaattttgtgccaacccacaactctcatttttgtatgtatatagtacgtgcatgtgtatgtgtgtatttacatgtatatgcaaatatgtgtagacattttgttcctatttcagtactggagtaaagatttttcttttttcttttttcttttttttttttttgagatggagtttcactcttgttgcccaggctggagtgcaatggtgcaatctcggctcatcgcaacctctatcacctgggttcaagctattctcctgcctcagcctcccaagtagctggaattacaggcatgcgccaccacacccagctaattttgtatttttagtagagacggggtttctccacgttggtcaggctggtctcgaactcctgacctcaggtgatctgcctgcctcagcctcccaaagtgctgggattagcgacgtgagccaccgcacccagccaagattttaattgtcatactgtaaaattaaggtgggtggggttatcctaaggagacctttatcttctcaatattcatatctattactatgaatctcttgagaagcattaacccttccaatggaaaacatctttcaaatgctttccatttgcagtaagttgcataacattttactaaacatcattcaatactttttaaaaatcaacaaattatagcattggattggaggtaatttagtgtttagaaatcatcttcatagaaataatcactgtagacttgttattaatttttatttttgaagagttgcttgggtaatgattaagtaatttatatatgcacaaaaagacttcatttacataaatttttatttatatattttaaatgcattatgagaagtgctagtgtattagattggtaatattaaaaccacaagtcaaaaaatacaaaagttaagatttttataattctatttgggaatctctagctttttctgttggtgtgggctataatttcaacactgcattattctaacttattacatttaataaactaacaattgggactagcttcaaatctcaagcagcaatttagtagatggttcatttcatgagaaagaaatatggactatggtgactatgactgtactattgcagaaatggaagaaagtgaaagtaaaatgtattggttagttgcaatattaccagtaatattttgtctggccaataatattagaatgtagatcaatttgcacaaataatgagctccacgaccaaatgaataatcctctatggaatatactagtattgcagaaaacctttttggtaagaaattttgcatgctattactgtaaagcatcattatttggcttcttaaataatcactttgttcttctcatcacttgatgtcttgtactttatacatcagacatctctgtgcatgtagattaccaaccatgctgcctccctttttgtctctgaacctgtaccatgctggcctctcttgaatgcctccattgcctccatatccacctcctctgctcagcctctaactgctcatctgcttgcacctggctcagctcttacagtctcctaaaagtctttcctgactttcccaggccagattgagtacccttcttggggaaaccagcatatgctattactggtctcatcactgagtaagatagtgatctgttttcacatctcccctcaagatgggggactgcagaagaactggagcagggttatttaactttgacctgccttagcccctgatacaacatgagtaaatattttaaggctgatgtttcaaatgattcattaaaatacatttttatacttttcatatatttttgtttgttgaatacagtagcaatttgaattttcatctacttgcaaaccaagaatgagggtggttatctgtgacttttaaattttctttacaggtcccatagatcttttggtagctctatttatttttgttttcttatagaatgtagtttgcagtacttttaaaacctgtatagtatcagctcactgaatattgctgattgctgaagaaaagtgtttgttcatttaaaccccagtgatctgatcatatttaaattgcattcttatctatgtgttgtctttaaatatgtgctgtccaattggtgctcatgtaacttgtaagaagcatcattcatttgctaggcattacctgagtacttactgggtgtcagaccctgctctgctctggaaatacagcagtgaatgaagcagcgaaattctcagggctcatggagcttccactacagtaggaaaactgaaacaaccaaacaaataaatatagagactgataaatggtaatagtatgaagcaaaataaagcagggtgaaagagagagttgtgagaggatatagcacccttttgtggggtggtcagaggaaattttccaaataaggtgacattaatgtgtaggctatttggtaatattgtctaaattatttttaaaaataagagtcctaacttaataatttgccctgtttaaaatgcagtgatatcaaaaagaataaagtgttaaagagaatgcaatgaaaataatctagtaaattgtgcaatttcaggacctagtactaaaaatcagtgtaagagttataacccgacactaatgaattaacaaattatattttaattaaatttttattccactaaaaccctaattgaggaatcatgaatgactgtgttttgtacatttcaacataaatattttgtgagtttatgcaaatatatatttcctttgtgaaaagtacttttcacatttcaaaaataagaaaaacctaaatagccaagcaaatccattttttgtgtcccctttctctcttcttttgaaagtaaaatcgttactagtgagcagatttagaaaaacaaacaggaaatgatgagacacatgtgagcagataaagtgtcatatctagattgtctttagagagggcacacgaaagcaagccccaaatgcaggcaaggcctggcctgcagggaagacacattcagatggagtcacagctcatgaacttttttgggatacaaatatataaaagtttctgctatggcagttgtataacaggatgtatctgagaaattaatggaattaaatgaaaagagatgaaactgagtattaaagacgtgcactattcatttgtttgttctgagcattctttcatccatcacacatttcagaaggttgcaatttattaagtgcagtgaaaatcactggtgatataggcctttgtgcagtgtatacaattagtcataagtacagtcatgagctgcataatgtggttttggtgaacgatgaactgcatattcgatggtgggaccgtaagattataacagatctgaaaaattcatattacctagcaatgacatagccattggaacgttcagcaacatatgttgccttttctcttcagagataaggatgttctttttctccgggtataggaagggcacccctcacatatgagggtcttatgaccggctttaggaaaacaaggtgggagaatgtgtgagagaacttcctgcttcttccatttttaaagatgtggcatatttggggatcgctgtcctgaccctgtcatcactcaatccctactttggactttagattatcttgcaatgccttctcattattatttattcaaatgggaccctaacacaaaaccaatgtggtatagaaagttaacagcaagaagggctagtgtctctgaggctgcagtaaacaggaggaagggcgtggtccactctcagaatgctgtcatggttcagagctgagggatttaatattgtttgggtatttttttctcttctctcaccctcttgccccattcctcactttatagcaacaccgatgtatttaccaacctcaagtgtactaacttgagcagtttggggaatcggggattaagatcttgtgcttcttggggccctggggacaatggttgaactgtgtcaggcagccagactggaatcaggtggagtcactggcaggttagaagcccttaattttgtcatgcctctcacttcctgtgaccctgacctgcccctacccactcacccacatggctccagccatactggcttccttgattttccaagaaaacaaaactcccaggtctcccgctggccttcatcaggaatgagtttctccaactcttggccaacttcccctcttcagggctgtgctccgatatatcaaacagccatccttggcacccattctcatccccctctccccagggacacagtgatgtttctccagagctcaataccatgcctgtcccaggcaaaacactgggataagaaagacattttgtctgtggctctcgctaccatccagtaatagctccaaatgattttagacagcaaggattaaaggatggtgatctagttgaaagtgtgcaggcatggtggggggtagacgtcttacattaaaacgatgtttacttatcaagcatttagttatttgggcggctttggtggagggctcagttgaaggagacgaagttggggagagaggactgagacatcctgagacatcccttctagctgctgctggaaccttcttacttttcttactttcaacaaacacgttctcagctctcctttatttagtcatgaatttactcatttattcaagaaacatgcgttgagcatctttgttactgccattagttccaataatatcttctatttctaatctgcttcattttgtcctattctgcctgctattaaaacccacctcttctgtgagaatcccatagattattgttattcttctaacataccgttcattctttaaacccagaagagtgcaactttcatgatggtatttggagcacggaggcaggcaggtagggtttagagggtaagagggagacaagcagagctgaagggttttgaaactgccttcaaagccaacgcatacaccaccacttattcattctaagataggtctttgtgattaaaatttagtgatgttcaatttatatttattgcttttcattgttttattaaatatttcattcgacaagtacttattgagcatttatgataagccagacattgattagatgctgtacatacagcatctaaattcttgccctggtagtgcttgagatcttgaataaggtgaaatcataagaatgccatattatttcttggcattagtgaaacttgatacatttattttgtttctttgattaaacttccttttgtaagttccaggatacatggcaggatgtgcagatttgttacataggtaaatgtgtgccatggtggtttgcggcacctatcaacccagcacctaggaattcagcccagcaagcattagttatttatcctgatgctctccctccccatgcacctccaccccacaagaggccccagtgtgtgttgtttccctccctgtgtccacgtgttctcattgttcagctccaacttgtaagtgagaatatacggtgtttaggttttctgttcctgagttagttttccaaggttaatggcttccagctccatccatgttcctgcaaaggacgtaatcttgctcctttttatggctgcatagtattccttggtatatatgtaccacattttctttatcaagtttatcattgatgggcatttgggttgattccatgtctttgctatcatgaatagcactgaagtgaatgtacacatgcatgtatctttataatagaatgatttatattcctttgtgtatatacccaggaatgggattgctgggtcaaatgtatgtctggctctaggtctttgaggaatcaccacactgtcttccacaatggttgaactaaattacattcccataaacagtgtaaaagcgttcctatttctccatagcctctccagaatctattgcttcttgacttttcaatactcgtcattctgacttgtgtgagatgatatctcattgtggttttgatttgcatttctctaatgatcgtgatgatgatgatgttgagcttttttcatgtttcttggccacataaatgtcttcttttgagaaatgtctgttcatgtcttttgcccacttcttaatggggttgtttgtttttttaagaaaagacattttttaatcaattatttttcatgaaatctaaatatgccttatcagtgctccaatctgtgtgggctggttgtttctaaattttatttttaataattgagtgatattaaataaaattcttgctatatttggtttaaaatggttttgatgtttagcttttgttagtggcatttacaaattctaaacaacttgtaccacatctattatattctttagcttctgctgggatttgctgtgtaaaagagagtgggaacaatgtagctcacattattctgataattaacatctgtgaaggacaagcttctgcataaatttttcccataatgggaggaagtgaatagaaacagaatgagcattgtgagctatggttttaatatttaaaatatttttctcttaggaactgaacctctagcttctgcacataaaagcagtctttttttttttttcatttttttgcccaaataaagatgattccaaataaactattatattttgtttgatgtcttcctttctactcaacaaaaccaatgatttgcaatttgaataacttttcaagcaatttctctttgttttttaaaaatcttttttatataatttatgaaatgaagatttaatcaacatttgaaaggagtgatgccatctcgatatttttacttaaatttcttttactagacctttcacagtggattcaggcataagtgcagggttttaaactttttcccctatcaactaataatgaggtgagttatgaaaaataataatttgtcataatttccaaaagaaattattacagccttcctattactagtgtcaaaagatgaattaactttcttttgttacctaaccatagccatgttgctaacttgatctcagctctcttggaaaaatgagaatacttccatatttaggcaatattccttctagctgttaagatgacttcagtttaatttggttgtctttcttctagtaactgcctcattcagagaagatattaccaacactttttgtcacttttgattcccctctggagctcttttattccccttgccttgataacttgtttgtgcagacttttctggaattggagcattgtttgtatcttttaaaaaacaatatgctaattattttgaaaaaacaatatgttgtttcttgactttttagtaattgccattctgactggcatgagatggtatttcattgtggttttcatttgcatttctgtaatcatcagtgatgttgaaccttttttcatatgtttgttggctgcataagtgtcttcttttgagaattgtttgttcatgtcttttgcccactttttaatgggactgcaattaaaaaaatatgtacttaaaaaaaccaatatgttaattaatttgaatttttaggacttttttcagtataacagttttacttttactgatgatatttttataagtattgatgcaatcttatttcttttctttcctaaaattgtggtaaaggcccatgatgtaaagtttaacatcataaccatttgtaactgtacagttcaagttgtggtaagtggtaagtgcattaacgttgtgcaaccaattttccaaacgttttttcatcttgcaagactgaaactctatgcccattaaacagctcctcactccctgctccccacatcccctgctaaccaccgctttactttctgtctctctgaaatggacataatgaatttcataagagatttttcatgtacgttaggtgcacagtgaagtgtatttgtttttgtatagattattggcaatatggcctccaaatgttaaaaaagagaagaaagttaagtcagttatgttttctacttggaatgtttagcagccacagagagttaagtaagaaaactgtacctgtactaaaaaattatcacaacatatgaaatacatataatttaattagacattaaaatatcagggtaaaaaggtgtttttaaaccctgtctaaaacattatatacattgtataacattgcatacattgtataatgaatgcatacataaaaggttataaaacctttaaaaatgatataagttgttttaggccagttgaattagctacatgccatttcccaaatatgctgtttaatatcccttaaaccaatgggcacatgtacgtgtgtatttttgtattcaattcacttttacctgcaaagaccctgattctgacatccttattaaaacttggaattgtttgatttttttaaaagatttgataattgcaaagggtatctagttatgcctcaagatcactggcctctctctatagcattttgccaaaaatactccttaaagcaactgtcctgtatctgaatgtagattctattatatttccatccaagcatttttgctaatatcatttgtatgttactttgatgtaatgaaacccagaaggtgcaatttcatgttaaagagcataatcagggcttatcatgtcctaatgccaaaccaaaatttggttctaatgtaaaacttgataataaaatttgaaaccaaaggggttttcctgatttacgtaaactattaaatcccctttattttggcatattaagttaaaataaactataagagtaacttaaacgaatatgcttacttacatttttattattctacttggcctcattgagccctgtttcaaggacttaactcaatgctcatttggttactctttttcattttcccatttccttccattgtttgaagcttggaataaattatacaagctaaactatattattttttcattatcttagtctttcttttctgatgatgaatatgctttagaaatggcttcttcagtaaaacattgtttcatcagtcattgctatctgatttaatatgcaaagtatacatgaagtattacaaaggagaatctttacattaaattttattctgtttgccatttgtcatcctttgagaattatttataaagcaaattccatttctaaaaagaagatataatatgatctggtccttctccctactctttttattgctatttgtaattaatagtgagggaagcactgtcttgagtcattggaacatgctaggaaatcattctgtgatgcacaccttcaagtataagaagataaatcacaaacagtaaattggatatcatgttaaaatatctgcaaacaattttttagccataaatgcattttataaatatgtatttaattatacatcttaaaatataggtttgatcatgcatctcgacaatgaaaaaccgaagggtttgtgaaattctatcctaagcagagaaaatctgtggttttttttgttgtgtggtgttatatattacacaagtagcatgtgctttttaattacctgccgtcatctatatgaacttgttgaggaaatgaaaattagcttaggtcttacaatctaccattggacacatttcaacaaaaagtaataactcactccaacttttcaactcttttaaggtcttctgttacaaattgtaatgaaaagaatcatacgatttgtgtgaaattcataagtaaaattgttctttccagtaggaaaaaagtggttaaaaataccctacttttttcttcctctcttttcctttgttttggtcagttttccgtcccacatcctgttctgtcttcttttgctttattgttattaaatactttcctgtcctaaatcttgaattctgacatatttttgcatggctttaaggttatatttgactttaacatgatttttatatattttttacttatttttggtaatacttcatacattcattgtgcagcattttgaatgggaaaaagagataatcactttttctcttctttattccttcgaattttcattatttccctcaatttataaatctttataacttaggctttctcccctttctttttcgcaattgggttatgttttcacatcctgggtctagcttggtacaggggtagtcagagggctgtgacttcagggaagcagaagcctcctcctcttcgcattctcctcaatatccataactgttgcttggcgcgttggcccagaggggtgaggtaggaacacctatctgaacacttccctttctttcctcttctgccttccatgatcgctcaagctgagggattcagctttcaggtttccaccacttttacatcataccgtcctttctgctactcaaaagtaccaaagagtggaggtggagggaagagccctatgtcatttagaaagaagttccattatcttttgcttctctctgcttcatttccctcgatttgattattttttataccttcaatcttgctcttttagtcacatcccttcttgttttttgtatttttcatttgatttaaaagagtgttttcttagcatattcttacaacttgtgctgtaaaattttattcaaagattatcatgaatattaggaagaaaaccagataaattctaaaccatttttctgtcttcaagtataaaactaatattcagatattagtttggggatttttcacaatgttacaaagctagtgagtagccctaatggagctagaacctaggtctgctatatccagtcctttctttctattatagcactaaaactcttgcagctgaatgttagagaagactcatatgcttctttacagaaaatttaagtatttttttttaacaatggttgacctgattcagagatggaaatgtaaataattggatgtaataagtagggaataatgtgggataagattaagtggaaaggcggaagctggattgtgaggggccctgaatgacaatctgaggtagcgcattgtcctgcgtagatagtgggggagatgataaagaaggaaattagtgttattaaagtctatgtttcaggcactaactattgtgaatcaagtattttattaaagaacaccgagtatatatgtaacacgcggtgctgataaagagtatttgggttgtcaccagcatgcatgttgaattggactctagcagctgtttcaacagtccacacattaaatgataaggagttggagtggaaagatggtggaagaggagatagaattggcaaataatagaatactagtgatcaagaggagggagacataaagggtgaattcacaatgttagcagcagaggatgagatgcaagtaatctatttcttttaagcaagagcaaaataaaaatctcataatttttagttggatttgacagaataatcctcacaacttatctggaaaaattaacaagcaaggaaatcaaatgacattttccaataagttaataaaaggtagacttatctcaattaagtttcaacaaattttagaaaggaaatagaactgagacaaccttaaattatctctgaaggagtacatacacaccgaccagtcatacacctcagcacatgttttaaaaactagaggggcctcacacaacagcaaggaaaggtaaacagtcatcaaaggcatctggaaacaggattaatgacttggaaggaaacaagaaattgttagcattcctgttgccatatatttaaataaattataggtgattttgaaaataaatacaaagaatcaaggtagagaaaataaagagcatttccttattgaaatgatacatcatatttattttagaaaaattagataatatagaaaaatgtaggcaaggaggaaaaaaagtttctaccagaaggaaccagtgttaatgttttggcagattttcttccatattattctttcctatcttagttgacttattattacatatcattttatattcaacgtaagtattttttcaggtataggagtttatgccaactgccgtagaaaataatcctctgaatctccgtggcttgacatagtaaggccatctgtcactcatctgtcagtccagtgggtcatggacaggcctctgctccaggcagtcactcagggacctaagttactttgattcttttcctgaatcctctcctgtatccttttcccatacatgtgggaggagaacatgtaggctaatcattatgagggacgtttatggtcccagactagaggttccattcttcactttcatctactttttgttgatcggaaatcagccaatcacatagccatgaataacttcaaagaaggctgggaaatacagtccagctgtgtacctcaaaggaaaagggaaatggtctgaacagtgagtctttcccacactagttattagaacccccttattaacatcatttttttttattattatactttaagttttagggtacatgtgcacattgtgcaggttagttacatatgtatacatatgccatgctggtgtgctgcacccactaactggtcatctagcattacgtatatctcccaatgctatccctcccccctccccccaccccaccacagtccccagagtgtgatattccccttcctgtgtccatgtgatctcattgttcaattcccacctatgagtgagaatatgtggtgtttggttttttgttcttgcgatagtttactgagaatgatgatttgcaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttgggtatatacccagtaatgcgatggctgggtcaaatggtatttctagttctagatccctgaggaatcgccacactgacttccacaatggttgaactagtttacaatcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcttgttcactctgatggtagtttcttttgctgtgcagaagctcttgagttgaattagatcccatttgtcaattttgtcttttgttgccattgcttttggtgttttagacatgaagtccttgcccatgcctatgtcctgaatggtattgcctaggttttcttctagggtttttatggtttgaggtctagcatttaagtctttaatccatcttgaattgatttttgtataaggtataaggaagggatccagtttcagctttctacatatggctagccagctttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtatggccattttcatgatattgattcttcctacctatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctagcctcataaaatgagttagggaggattccctctttttctgttgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattatctagtttatttgcatagaggtgtttgtagtattctctgatggtagtttgtatttctgtgggatcggtggtgatatcccctttatcatattttattgcatctattagatttttctctctttttttctttattagtcttgctagcagtctatcaattttgttgaacctttcaaaaaaccagctcctggattcattaattttttgaaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtatctttgttctcgttggtttcaaagaacatctttatttctgccttcatttcgttatgtatccagtagtcattcaggagcaggttgttcagtttccatgtagttgagcggttttgagtgagattcttaattctgagttctagtttgattgcactgtggtctgagagatagtttgttataatctctgttcttttacatttgctgaggagagctttacttccaagtatgtggtcaattttagaataggtgtggtgtggtgctgaaaaaaatgtatattctgttgatttggggtggagagttctgtagatgtctattaggtccgcttggtgcagagctgagttcaattcctgggtatccttgttgactttctatctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcagcccctgcctttttttgttttccatttgcttggtagatcttcctccatccttttattttgagcctgtgtgtgtctctggacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccagttgttcctttccatgtttagtgcttccttcaggagctcttttagggcagtcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttggctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttctagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggtgctctgcgttttagagtttcccgtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgctgccgccttgcagtttgatctcagactgctgtgctagcaaccagcgagactccgtgggcgtaggaccctccgagccaggtgcgggatataatctcatggtgcgccgttttttaagccggtccgaaaagcgcaatattcgggtgggagtgaccccattttccaggtgagtccgtcacccctctctgactccgaaggggaactccctgaccccttgcgcttcccaagtgaggcaatgcctcgccctgcttcggctcgcgcatggtgcgcgcacccactgacctgtgcccactttctggcactccctagtgagatgaacccggtacctccgatggaaatgcagaaatcacccgtcttctgcgtcgctcacgctgggagctgtagaccggagctgttcctattgcgccatcttggctcctcccttaacatcatttttgaggctacataacattcagtgacctgggtgaatcttcaattacataagcattcccttttgttgaatgtaatatttttataagctgtcaccattacaaattagtggttttcatttcttattgatcacaatccttcattgtctgctgttaaacatcttaaaatggttatttcttatattttctccagtattatagttatttatataacatgaaggctagttctgtaccagttactccatcatggctagaagcagaagtccactatgcttttattattattttttagggtactgttttacctcatccttgtgtaagtagttttgtttattaatccaatgtgagtctgcctagtattagagagtcataaagctgatgtgctttttgtcaaataatctcgtatcttaggttctagaggaaatgatgtaaataaaggtaaactatgtgaaaagtttcatttttataatgaaatgtcgaaagcagcccaaatagccacaataggtaatagttaattaaataataataaattcacttgatgagatataattttgcagactagcaatgcagtaaaaatacttcagacaaaatactaggttaaaaaacaaacaaacaaaaccccactgaccccattgtatatgcaacggtacgttccaaaattaaacctaaataaaacatactcacatgtccaaaccgtgagcaagaatcccccaggcttgcaaaattcattgcagtgtggcaacaagtatcatcaatttttttttcttttttttttttggtgggaaggattttcataccttttggtaaagtttgttgtatatataattaaaactcgtgtttactggacagataaaatatttgctaaaaaatttcaagtatacacagttttagacatttcttgtatatattggtcattagaacctcctgtgatcaatgtccatttagctaaactttgacttttcttcattgtctcaagaaaatgttgcttgctgtcacctttaatatttctaacaccacatcactgcagacgtcatgccagttctcctgctcagaagcttaggactttagcctatatgatctgcttagcttcattaaaagtattttcttgaatcacatgtttacagtttcatagaaatgttttaatttacctccagctgttaaaattaattgccagtttgcatcattcaatctctgaattttcatttgtatgttatcatacactacctaatgttttgtatcctgtgttttactaaatatcaccttatgatcatttcccagcatcattagagagttgctgtgtttaacattagtgttctcagggtagcaaatgccaagacaagattaaacatgcaggaaaagtaggagggtaaggcggagaggaggaagggagccagtgacagggtgggggagccggcagacctaggtgcgggtctgaccccagcgaaggggagggaaggaaggaagctggacggaaacactgtggcctgcactgcgtctctaaggggagctgggcagggctgtcaggggcccttagagccacagtggcctgtcagaggatcctgcatctccaggagggggcctgctttcctagccctgccagactcagtcaccgctgggagcagccccagggagcacaacttcacaggaacacggtagattttacagtgcagagcttggtccagggtcagttacattccctgcagtcagagatacgggaagtgcattctcatagcccccacactttgtaaaaatctttagtgcacctatgcacctaccattctatcttaaagctataccatattacaagtaattcttctgagtaagccagaaactcagaatcttccttgacaacattctgtctctcttacctccatagccaaaccatcaccaggccaaatgaatttggtctctcccatctctcttagctctgacactttatattcatctttagtaggagactctaataatcacccatccccacatcgtatcctgcctttttagatcacccgtgccaccctccagtggctgttttatcatattgccagagtaatttaggacagaaggcaccaccatatttatccctacccctttcatccacttttggctttttgtagccttttgggtggtgtgaaataatcttggcaattcctgtagtgcttcagttcacattatgctccccactgttgtctgtgctccgcacactgtccactgtgctccccacactgtgatgctccccatgctgaccgctgctctccacactgaccactgtgctccccacactgtccactgtgctccccacattgctgtgctccccacactgactgccgtgctcctcatgctgactgccatgctccccacactgcccactgtgctccccacactgtgatgccccccacactgccgtgctcctcacgctgactgccgtgctcctcatgctgactgccatgctccccacactgcccactgtgctccccacactgtccactgtgctccccacactgtgatgctccccacactgactccagagcttcacacactgaccaccttacgggtccacactagccagctatatcctcccacttcagccatactttcaacacacttccttcttcctagactggtccttcacaccctcttcatcaaagtcatttacacacagctttaaggccacagcttgagagaactttattcaaggatccttccttgacactctgttgaagtcatattccttgcatgtgacctcttgcaggcccacatttctcatcttttagtgtttattgtaacttcagtttccccttttttgggatttttatgttactatagtttgtaatactcgatactttgctatgaggacagtgccttctgtttatttttgctcagcaataacatctagtatgtgtgtattgttgaatggataaggggcctcagtataaaggtgtaagctgagatacaggtatgggaacagttacagttggaggtatacgaatggacgtggtccccaaggtaaaaagggcaggaaggaagcatcacccgaggtgaacacatgtgtcctgcattcacttagggaagatagagcatgtttgaaggcacaaaggggccaacagcagcatgcattgcaagattcacagtagttctgaataacctgaacaaggagctactaggggcagggctcaggaggaggatagaagtggaaagaaacctgaccatcaagtattttatatacatgttgagtgatctggactttatatcaaaggctagtgagaagccctgaaaggttttaaggaggaagaggcctgagcagatttgcctttcagaaagatcattccatcaggaatagggaagagaaattggagggggcagaccagagccaagaagcccccaagttgctccttagtgaccccggcaggagtgaggacagcgggagctacagtgtcgggaaagggaagctctagagggtgcagcggcagagttatcaccgagctggaggctgcggcccaggagaggacagaacgcaggaggcacagctccaagggatggagcccaagaggggcctctggatttggcaagcattcaaatctcaactttctctgtgagcaacagacaaacttcaccttcttcaaaatagcaccagcaaggaaacacaatgacttctttaccttttaccgaaatgtgtccttcagctttaggagcagcagtcaggaaaggaaaagagaacatctatctgactagctggccaggaaaacacagcctctgatcagtgcaccatggtgggcacagacaatagactcatgttcaaaatatcacacgaggtcttgcacactccttctagatgaacagatgaaatcggatccagaaatctactatgggcttagaataagcactttgccctgtgacaagatatcaagtaaagctttatcaaactacatagaattctttccagttttgaaattaaggtagctacctttattctttcaaagacttccttaagcccatttttatgaagaagagggaacttttgaaacaccttatttccattctttgtgattttacttaggattcatggatggtagttctgttgccttagtataatttaaggcttatttcatgtgaaatcaattggataataatcacttactgagtgatctgaatatacactatatgccaggcactggcctagatgacagaaatgcagatacttcatacaaaattgtctttgccttctgaatttcagtgatttggggaaaagaatgcacatgtgaggtctgtgtatataaaatacacaatcagagcagatctagaaatccaagtgctatggaaacacaaaggagagagcaactttaggggaaagcgagagatttgcaacagagatgttgaaaactgaattgatgccaaatggtaactaaaggtttaccagagaaacacaagagaagggctgggggcagaggaagcagggtttcaggcaagagaaacagtgtttaccgtaacacgaaaagaccaaagaagttgacattattggggaacaagtgagcaatttagtacattggcgtgcaaaaagagtgaagggatggttaaaaagaaaaaaggaccctttaagacagtcgttaagctttaattaatcacacacatgtaaaggagtggggaatatcacacaagcagacaagtccgtgtgcaataagacgagcacggagacaggggagagagaaaagaacaggaaaggtgaaagcatcttgagcttctgcagctatagtcagctccctgtttgctccactgatgtgaagaatgcatgccccattcccagtgcctgctgctgagaaagtcacgtgcagtgcagtgagcaggctgaccaattgccaaacagtgcaccccccaggggaatgctgcagagccctaaatgataaccagctgatatgggtgatctgctcaggctttttgtgcttgtctgagattggaggacttataacagaatagttcctgtctgtatccattttgaggcttactcttcttgaattgctgtatttactttttatatctttctaaaagtacagagattattgaaaactacaatttagtatttgcaattattaaaatcatagtggcaaattagactataacttgtaagttttcgatttttgaaatatctaaatattaagatagatttaaaatatctcaaagagaaaaggcatgctgtttgccatttgacagtaaatagtcgctaatcaatattctcacattttaatgctcagcagattctgacaacttgactagtaatgagttaatatattgttttttataacttcattaataagaagtttgtagggtagcatatttctatctcaactatccccaaaatgctgtttctaaggtcatgctcagttctaagaatccataaatgtgcatgtgaatagaatcacaaagcagcagcatgaaaacttatatttaggggaaatgtttgctgattccaactttcaatgagttttatttgggaattttacagataatatctttaatcaagtgcatggtctatgatctgtcaatctcatgtgtgtaagtaaaatcaaagttcatcagatctgtattaaacaacttatttgtgttcataaaatatgtgtagctttatagtgagtcttgttggctttctaatgtgatagagtaggcatgcatagattaaaactatgatatagtgaaatatataattggtcttcagcccatttcctggcatagggctcctaaaatccttagaatctccaaaatgatatccttttttatgcaaataaatcaacagatggcagaggtagcttcagaaaggagctggtcactagaaagaccaaagcatgactagagtgttggaactttcagccctacccctgaacccagggaggggagaggggctgagggttaagttgatggccaatgcacaatggtttaatcaatcatgactatgtaatgaagccttcataaacccacaaaaggacagggctcagggagctcggaatagctcagcatgtgtaggttcctggagggtggatcacctggagagggcggggaagctccacaccctttcccccatatcttgccctatccatctcttcatctgtattttgtgtaatatccttgataataaaccagtaaacttaagtgtttcccttagtgctgtgagctactctagcaaattaaccaaactaaagagggagttgaggaaactccagcttgaagctggttggtcagaaattctggaggccgagacttgcaaatggtgtctgggggagggaggagacagtcttgcgggcctgagcccccagcccaagggatcggatgccatctccaggtgaacagtgtcaggactgaatcctaggacacccagctggcatttactacagaattgattgttgcctattggtggggaaatcccccacacatttggccacagcattttctgtgttgactgcggcggcagtggggtgagagcggaggaaaatgctttgatttttccctaacaaggaccaatctgatagatccccacctgccactgaacctcctggtgagcacgtgtccagctgcggctggtagattgtgattcacagggaggtccacttaataaatgcccagctctctctcctgtcctctcctgtctccttgcctcccttctgcaccctggccacagcttccccagctcggctcctgctgtctcttcacccacactatgatctccttcattcccacacacgttctcttctctagaggactgaccttcaaaataactcattcacatttatcccaaaagaattctgaaaaatggtagtctcttagagatctttattctggcatctaaaatgcatgtttatcatagttgcaagcaatgtaatttctagtgaaatacaaatattgacatttaaaaataaaattatttttttcactctgttaattgtatccagccagttcttagtaccattagggatctgattctcaccatcagtcattttaaaaatacatgaatttgcttttctttaattgccagatttttatgttgttcttttatcccccttgaaactgtattttcatttcactctcctctcagaatgttttcctaatgtaactttttattctgaaaattattattgattattatatgatatgtaaattaatttaaacattaaaaaatttcccataaccatgtgtccaagaatttaaatatatttaaaatgtgtatttatacatagacaccactttgaaatggtgtccatctacctatcttatgtaagagagtgaaaagtatagaaggaaaaagaaagaaaagagaaaagaaaagaaaggaagggagaaaggaagggaggaaggaaggaagggaaaagagaaaagaaaagggagggagggagggagggaggaaggaaggaaggaaggaaggaaggaaggaaagatggaaagctccatcctggataaattttgtcattagaagtattactaatgcataactttcagaacacctgttgttaaccagcaggcttgtccacaagtaaatctgaaccatgatgactctagaacccagggcttgatccttctccgtctcagaggggctacaattcaatccagtttttttgtgatcagcttcccccagaactggtgattgcctccatctgactagagtagggtggggtttaagtattcctatgcgtccagggtcctcaattctgggcatctttctcagacaactcccagaaggaactggcaccagcactactgacccccgggggccagggtgctgccagcagcagaacccccagcgcaggctgagaggctaagacgcgcttctgtgggatggggagcctccttctcctgcgggactgtggaatttgtcctgaaccctggcaggtagagaccacaaagggacctaccttgcatgaaaaacatagatgtattacaaattgtgataggtgatttttaagcataaaagtaacattttgtatgaaattcatctcttgatagtccaggcttttgttttcaattggtccatacatgtggctgaatactaatttattgttagataaaatgaggcccagcattaatttcgagcctatgttttattttatagaaggaagcacaagaaagccctgttataataaagcagatgtgaatgaaaggaattttaacaatgtgactcaattctttgaacttatcctgagaattatatgccaacaatcacatagcaattcattaatcaataattctttttagtgatctcatcactgataaactgtcgggtctgccttcaattttcttgaaagccaaaaactagaaactgcctgacttacaacaggatttgctgcccagccgtcaaagccattccccttctcaacaccgtcaccaacatgatttcaaacggagcctgtggcctggtgacctggggccttgcagccagagacagtgaactgtcaggtttgggatggatgagagatttccttcttttgtaaagcggcagaactattgtgaaaggggagtagagaaaagagaacaccaggggctttcctgagcagatcatcactttcagaaaagagtacactgaacgtttaaaatctggaaattgaactccttaaaattatttgcatttgggtgctccttggaaagcctttgtatgccaaagctttgtgtacccagtataaaaatctctgctccagaatggcttgatctccttggagatcaggcagaaaattctgtcttttgcttttctttgcaatacctggttgaaccactgacttaccgtacgttttaactttcctgatatcctaccattatgtgttactatcagcctcgaatcatcctttcttattattttattcacagaactgtggtgttctcagtccttgtagccaatcttcttgtttttatcacagccttaataagacagaaagaaatatgcatacaaagctatactaccagataacacaggaacagaaaaccaaataccacatgttctcccttataagtgggagctaaatgataagaacttatgatcacaaaggcggaaacaacacacactgaacttagcatctgggggatgtaacagtatgtacaacaaacgcccatgatgcgtgtttgtctatgtaacaaaccttcacatgtacccctaaacctaaaataaacattttttaaaaagctatactaccagatatgaaaccttgggcaaagtacttaacctctttctaagtcttggtttccttgtttgtatctatgtatctacctcatagggttgtcatttattataaagatgaaataagaccatatattcttgaacttagaatattgttgggtccatgctaggtataaatattaactattattattaatatcattagtatcattatacatttaaaatctctaacatattctatggtcaacagttgaaggaaatatattactaatctatgtccataaattttacttcccacatattttgacttaaactatagtttttattttgtatttgccttatatatttagttctcattaacctgctagttctgggagaaggagaccattttctttctgttttttttttttttaattgaatgattttgttttattcatctttattttcttgactatatatagtatcctgcgcatagtaagcattcagtaatgtttgtggaattaaattttgtcaaagcacacattttttatttgtgaaagtccatgagtagctaatgatctattaaactgggaacagaaacttctacctgcatagttccacaaaagaaaaccatctgtgtgtttgtttaaccagtagaattgaaagatgttttgactttgctccaggaattagagttccatgtgacctccagataatgctgtctgacacataatcaggcctcatagagaaggaattaaaaagcaagcattacagatcctacattattattattattttttggtttgagactgactttatttctctccaaaaagaaattaaagcaaatatttgtgtatgcagttttaaaacctatatttgttttgatagatggtgtaactgacattcattggtatgtacgcatgagagtatgactaaaaaggcctctgtacggctagttataaacctttcagtttagtctgtggctgtaccagctaggcctactatgaattgtgtttgattctgacttcacctaaatgagcctgatgacacgtgtgaaaagccccacttcgctggttttagcacagctgtcccttcagcagaccgtgacttgccattgaatttcacatgggtagtccctttggaggtgcacagagtccgaaaagcgtttcttccgcccttcctcttatcaccgtatccttgcgctcttcctagagcagccgctgcagcagcatcgcttctacgctgtgccctgcgagcgcgcctggcttggtcgctgctgaagtggctgaatcttaggagcagaggactccccacgcagtctcatgtgaaccatgattccttcgttcactcccagccctgctgttaactagctgtgtgatcttgagcaagctgttgctgccttctcagactcggcgtaagctggagataatgcccagcgctgacacctggtagagctgttgtaaggattaggtggaggagtgcctgtaaaacacttagcaccctatctggcacacaaaaagaacacagtacatgatgatcgtgttataattgtgatttatgacactgatgaaattagtaggaaaagtggtctctgtcagcccttcaggacttcagtttagactaattcctaatcttatagacactcttcttttttgcgtatcagagatgtaagtattgtaaatgtgtcttaaattatatcttattatctgatgaaggaattattatagccatctgtcttaaactgttattctaagaaaaaaaaatggagaaagaagaaatacagagtgagggacttaaaaatattgaaatggctttcaaaataaaataatcccaaaatatggtacgagacaacagagagatcagagaagcaaatagccaggaagaagctctcctgtcaatttgaatgtaacttatgacaagggacatgggaatagatacccccaatcgtcccagcggtgtgtgttcccaccccagcttcccagcgccccaactccctgcttctgggacgtttagtcatgttttctccactggagatgcctccatagggcgtagcagttcctggagcacagtggacactgggtgggagacaggtgatttaactggccttccttgggcaccagtgaacagatgttgttgctagtcagttatggccccttctcacggagtccgggttcaggttctgcccctcatttctcagacagcgtcccaggccacctccacccatgccggactttatgccttccttgaccgggagggccacttatccttgttcaggtccaaagctgcgagttttggttttgttgttgttgttgttattgttgtgtttagagacttggtctggctctgtcacccaggctggagtgcagtggtgtgattacagctcaatgcggcctcgaacttctaggatcaaaagagatcctcccacctcagcctcccgagtagctgggactacagtagtgtgccaccatgcctggtaattttttaaattttttgtagagatagggtctcactcttttgtccagtctggtcttgaactcctggcctcaagctatcttcccacttcggcctcccaaagtgctgggattataggcatgagccaccgcacctggcctaaaactgcattgtgcatatagccgtggaagtgctgaattgtattgttatcgggtactttaatagtgatacattcaaccggctgtgtggccttgggagagtcatttcaacatgatgaaggtccaagcccaggagatgatcagagaatcatcccgagtctcctgcagccctggagcatcttctggtagcaaataatctaaacaggtatcttaataggtgagcggcacgtctcgaagaaaaaaatctctccacacaaatggtaaaggtcttgaaggagcaccagatctgtagcgtgtgcagcaccacacttttcatatatgatgtgattagtgtaaataagtagttgattttgcttcataagtcaaatgatgattcttttacaaatagccgtttgaataattctttacacctgctacttagccatagttttgctggaaggattgagttttcttctgaagacacagcactactctgaagcttatttccccctgaattttgtttttcccatttttggctgagaaggcatctggagtgactccagcgggtttacctaggttttccctgaagaggtttaggtgattagacaataacagaaggaaaagtagagttgccagtaggtggctcactatgaatgtgcttgggacgggatcagacatgtcacccctcctccacttagcctttgttttcaatccctgctgctttgagcctttttctataatgtctgagtcatttgcagcggggtgggtaaagaggggagaaagaagaaagcaagcaagcaacagcctttgagctccggaatagcaaaggcccccatcttgctccgagagttcacagagtatagcccagtccgagttctcttttccacgcacacttgcttgttcttttgttccttgtgtccttggcaaagactgaaagaactaagcctggaatacttgggccctcccgtgtcacttaagaaataataagccattgtcctcattaagccacccttgttttagcaaatagaatccagataccggagagggaacattttgaagggaggcagaattagagtagagatgctttacaaaattccctagagaaactgctttgtttctcctattttattgctccttactgagaagattcatattcaaatgggttggggttgtgaatagcggcttgcacattctcatgcacccaggaaggctatgattatggctaattacaatgaagaatgaagctctaacaagagtgttccatcagattgtcattcatgcatgaagtaacttaggctggccaatggaggtgtgattttggtaattacaaacaatgtggctatttgaaaaatgcttagtaaatctgttcaagacaaaataaggtctaattaatcactttagctctgaattctccagatgatccatttgctctgtttttttttttttaatttaaggtctctttaataaactagatctaagatataaaatatgttctcgttgcccacacttaaatgcaactgtgttacctgtttcaaaggcttcttaattctgccaatcatgttgcaacctgcttttaatgcaacttgacagaaggcttttaaaaataaatgtgtgtatattcttgttgttacctgacaagaaaatggtttatgaaaagttactgtaaaacattaactattaatttagaagccatattggtatcatcattgtgctgacatatattaactcttgaatattcggtgaatgttgtgtttagcacttaagtaatgtctaactatatgtattagtttgttttcacactgctataaagaactacctgagactgcataatttctaaacaaaagagttttaatttactcacagttccacatggcgggggaggcctcaggaaacttaacaatcacggtggaaggcaaaggggaagcaaggcatatcttacatggcagcaggagagagatagagaaggcggaagtgccacacttttaaaccatcagatctcatgagaactcactcgctattatgagaacagcatgggggagctgcccccatgatccagtcatctcccaccaagtccctcctttgacccatgggtataacaattcaagatgagatttgggtggggacacagagccaaaccaatcactatattataggggagaaaaagtaatatattttccttacctatcacaaggttcgtggctgagaaccttagagcaaaggacagagtaacaagagaaaaacatcacatttatttaatagaggttatgtgacatgggagccttcagaaatggagacccaaagaaacagagatgtgtgtacttttatggacaggcatgcagaagtaagactggaggatgaaatggcatgctccaatcggtacaaactgggggcaactcagggagacctgattgcccagtttcttctccgtgttcctgagtgacattccttccctcctggtatagggcagtactcctgtcacatgaggtcttcagggaagaagtgaggccgcaggtcaaagagtggccttccctgcggtcatggcctgtttcagggaagaaggggtggagggaattctagtttccatgcctacttcaggagacagaggacaggaaaagtcacagagaccctcctgcttctgcggcgttttccattttcttgagcttaaaacagtacacaaaggtgctatattttggagtatcatgttctgaaccccaaaaatattctaccttaaataattggaggcctccatgaaggcacaatgatgacataggaacttatgcctctctatcattttttttttcagtagatgattgaagcgaagctgttttatgcttgtctcttttcccgtttgccatttttgtacctttgttctctcacctaaaaatagactaataaatggccagagttgttgcaagaaatgtacaatgataaaaacatctaattattggttttaaatgcatcaatcttcaatttcttttaaatgtctactagaatgaaatctgcccaactatctgaggagctttgttatttttaacttatttggtttctatacatgaacccaaaggaactaccttttcctaattgaattagcagggctagaaattcaactcagcacacgtttaactgaggagtatcagggttcagaacacgctaccccaaaatgtgacacctcggaggtcactctctcaccttctccctccctcctttccttcatcttcctttctcccctgaggaggttcatagaaaccaaaatttctctttgccaaagcaaaccataaaacctagaaaggccactttctgaccttctcctttctcccctgaagaccctcaagtgataggtgtcttgccctgaacagaaaggccaagaagaagctaaacaaataagccttgcagagtcccctcagtttagtacattaggtcgtaccccctttttgtccagtcacatttctatacaactgtacatttttcctggaacctatgcaaaaaaattacatagtttttcctgggtctttgggtcttaatttcagaaggcaccttcctgtgtcacagaaaacttttgttacataaatttttttatgcttttctcttgttaatccgccttctgttatagtagtctccgccatgactcttgtagctggtgaggaaaaggtattattttttctcccctacaagagtaatggattttacaactttgactgttatactttctaaaaaatgggtttagcagggaggtgggggtgggggagagagaaggaagacacaaaaaaagactagtttttatacagatattttcttattttaactaatttatatcatctataaagggaagcaaatattaacgttattagtttcctcaagaggataactaaagaaaacattcttgtaacaggggaagaagtaattccatacctattgtatctatagagctgtgcatttcatgtctctaaaatggagtaatttaaagttaaaaggcctcttctagtagttttcaccaaatgaattttatatatactgaagacagataaaataaaaatggtacagaaaaacgggagttttagagtcttgtttcaattctttagaaagtaagttgtctagcagaacatgccaacttggttgcctaagagcaatgtaaacttgagtcccactcgccatgttgaattattcttgtttctatttagcaagtggtctggagtctttgatctgcaatgtgtgtagttaaaatcattgtggctattattttatctgcccaaaatacagattttctaggatttgacagtataaagcatttgctttaataagttgagatttaatatttaatggtttctctcaaattcctgattggtcaatgtattgttgccaatttgtaaatttttatcaaaggtacaaatttgaaatgttttgctgtatatcatggaagagaagccatgattatgttccctaagcaagttacggaggcttagagtggataattattctctccttgtcctggtactgcctttgaagaatttccatgttgagggtaagagaagatggtttaaaaacctgatgaatttaggtagttgcttgagagaatgagtaaagtccattttttccctgattaaaattaagtctgttagttgcttttttgctcaccaaacacatcaatacagatgcagataaggtgaggcctcttcctgtaaatcagctgtcaaggcctatcggggagaaaaacaatggacaaggaggcaaactgcttctcatgaaggctgtgcgcttcttgtttgcaagaagaatatttatgggcttcacagctggcagcaaagaacatttaaatatataacttcatacacatgcaaagcattttgtagattaaatcagctcgaagtgtagaacctgagagggttaatagaatttcttggtaaccatttaataaaattaatgtgctattagtctgatgtcttaattcaattggctgatatatattcccagttttcactcataggtgagccttagaaaaagttagtaaagattgttttaagattgccaattttctaagaatgggaatacaataaaatgtaggtaatcaaaatattgaatctttgatctaggatctgttaggatagcaataataggtgcatatataatgtcttgtatattcctcaaatttttattatttcctttaacttccaaaattaagaaactgccagaaaagtatggcaggtgttcttagctacctatcaaagcgaaagcaactgagaccctgagtgaagtcgtcaacacaaggagcaccacagagggaacgtggaagctctaagcaaaacccacctccctctgcctcaccacccacctctcattatacacatctatttccatcgcatcgtggagatgcagaggtgctggcagaaagtcttgggtacttaactgttggataaatcttttactgaatctcttaaagttatgctcactataattgttggtgaaatcactttagatctctgttgtaaagctctctaaatttcctcttccattggtgttcatagtttatgacctgtcccactgagatgctactaagggagtctgcacagagtgggatttctgtatctgctacggtctgggtatttctgtatccactagggtctgggtatttctgtgtctgctaaggtctcagcatttttgtatccactaaggtcttggcatttctgtgtcagctgagatctttggttttaggcgacagaactcctctctgtctggcttgaccacacgttggtcagaaagaggctgtactgtgctccctctaggacagtccacgggaactcagaggactgaggaggtgactcaaaagtttggaaggtgtttcaagatttagaaggcaggattcaggtagccccagagagtcttgggaatgaattccaattcccccttgtaccacctttcacgagactccggattataggggcgaaggagaaagacgggcaaagcttctgtcatgtcattacactgggaagtgagagggaagtgctggctgaacctcttgggaccccctgtatactctgtggtgggggagaggggaagcgtctttgtttaccccctcaatactttatacagcagaagaaaggagatgcctgaaaaggcaacggggatgcatttaggaagaagcaattgatgctaggcacacaagaaatgctgcaacatctaagttgtacctgaagcagaatttcaatttaatgtgccatgtcaaggtggccacagagccatctttataaactgggagtatccacatattccagactcagagagcaaagatccaggactagtacagaaagtcactccgtataactggaaaagcttgcttgtctgctttcagatacgtttctcaaccctcatccataacacgatgctgtaaaccctagagtaagacagagataaagcatgtgctgggatgaagagagccactttggggaagtgccaccacatcccaggctgcaaggcatctctctctgctgcttgtgcagactggctggggtgagctttggagctggtctcatctcgaaggcaggcgctgctgaggcctctgtgcccttttgcctgggttagatttggcttcaaaattaatttgaaatcatttaatcttgctactctcagcaggtcagtgattaacaggaaattcagtgcccatgttggtcctgtttatgagcccaagtctatgtcataagtaaaaacaggcttaaacacatcaggaaactactcagtatagagtggaaaaagcctgggctgggcttccactcaagggccctgcacacactgcatccacaggccctgagggcagcccctgggcttcagccgtctgcgtgcactcttgtctagtaccgtgcctgatgtgggctatgtgctctactggtatttgttgagcacatcatcaagttactacgtgaataaacatcacttatctgggtcttggtttcccccatttgtaaaaccagagagttgggctaggaaacttttgagtccctccagcgcagtgattgatgtataacataatcagcaatgttgaactttgaagagaatacaagccttatgttgtcactgatatatttcagaacaccttgttactatttgtaaggatgtttgagaacatgtgggcaaatgcatctattttttcttccctaaaaggtaaacttgtctcctttacaaccaaacaaaagaggatggcactgcatagcagaggctaagctacaggctgggtaccactgagcagtggagtaacccaagtttaaacttgaaaccacatttgtgcaataagcaaaagcttcacatttatagaacatcgatgctgcggcacagcaggctactttcatatgtgttatttcattaaatccttaaaacttcaatgtcgtatgtatgtattatttaataaataaggaaccacagactcagagagtttacttaatttgcctaaggtcacagaggtaataaatggataaaaccaagatttgaatataggtctgaataaattattcatgctctcatacctacctatttaatgttatggagttgtctacctttctgcttcatttttctttatatttttactctacatgatccttattttgaggccttccattgcttgttctccttctcttgattcctgcattatttcctttccaacatgtgctttgatgcatctgttttctctatggagccaaggaattttccatcctctcagttttatgggaagatacagaaattctctactcattgagtcccaatgacaatctaattatttctaaatctcaccgtccaataattatctttttaagctcttcctctccctctgaattgtgtggtgtgttccctgttgacatttgattaaggctttgcccatgctgcttgaataaaaatatttatatttcaaaatttctgactgccaattatccatattttgatgcttaatgtccataatatcacaatttgacatgaaagatattcttaaaaatcattttattatagccacagagtagagttggaaaaataactctaggataaacaaatacatacttattcattccatacctgcttgatgacctactatgtgccaggccttattctaggtgctcacacatagcacctagaattctgttgatcctgggagtttaacgataggcaaatagaagtacaatgagacagatgacagatgttctttcttcctgcctgtctacctacttgtccatccatcaatcttcatgagaaaatggactcaagattttgaaaacctcaaaatgcttccttttgttctagcccttgctttcacgtttaaatgaactctcagtgttgtatatatattttagaaagtttaattttcactaaaataaactttcagtctctacaagtgttgacatttaactccaagaatactttagttggttggaaaatcatttctggtaaagacttcattgtagagaggagacttctccacctctgattactcctacaccttgactgagtactgactacatgtactagacgtttgttgtgagcaagtttcatatactattttattgtgttcccactactgacctataaagtatgtgctattatattttgtttcatttcctgtccaaagaatatttttttaaccaaagaatccagtagaaatgcctttagacttacatagtgattgttaggagaatgatctatagctgttcggagtttgcagaacctcgagtgaatctttcaccaattactaaatgttaaccgaacatttgtgaacatgtgtaatatactccctctaggacgggataaaacctcaagaaacctaggaaaatggccaaattcttgctctggactgcggctctcaatgataattggcatatactggttatttaagacctcacagctgctctggtctgaatgctatttgagatataaaattgtgggctatgtatgcaatctgccttggctcccataaaattaagaagtttaattattaatgtatatgagtatgttgagaaaatgatatagttccactgactatgatagtcttgctgtattacctgctgttttaggatatagggatacagcatcttaatataattgacagtaagccttctcattgtaaattaatctgagtgcttcacattgaaacatgattcttttttaatgtatatattaagtttcgactacatggatgccttttaaactttctaaagaagattttaaaaagcttagactgtagctattcagatttataattccactcaactctgctatatgatcctgaaaatgtttaagtacattacatataacttaaattatttaaaagtttattttacacttcttgaagactaagaactccttgaatttatttcacaaaaggcttatcttctccagaataaatttaacttgcctcatgtaattagcattcagaaaggctcgaattaactggaacatagctaaatagaacctttaatttactagattttttttttctttttgctctacttttagagcttgaaatcattggaaaacaaacaaaatagcaaagatttgttttaaaaatcagcctccaaggttagtgctagggtcagtaaatagctagccaagttttcatattacaaacctatatagttatgatttatttaaaatgatgaaccagagatacccatgttttctaatgcatgaaagaaatattacagaaatattaaatatgttatttgctggggtgaaaaaataagctaatagatgttgagaatattttcagcaatgaaagattgaagcagaattgatttcctagttatcactctgaaaaccaagaaattaaatgaacccaaactcatttttaccagagcattctaattaatcaaatggattaacaaatgcatgagtgagggatgaaaaatacttgtgggagaaaaacagaggtgatacttttggtgagagaaattgctcatgtaaaataattttaaaggaagttacacatttattgaatgcagcatatagagtcctgtgcttccggtctttaccaactaatctcccctaggccctaccgtcacccatcccttttccagaaatcttctaaaaacatctccttcttctccaattactctttattataatatttatgattaaagtctggcaacatttatgtgccaggtactatccttactgacatagaaaccctatgagccatagagctcgctcttttgctataacttcttagagttttctgcacttcagatttcgccacttcagatatttcattattccatgtttatttcaagagaggtttaccaaatacacagaagaaaaaaaaaaatctctaaactagaatgctgatttccaattcccctgtttcaactagttactgactttcctacttccaaaacagtttgagggaacttaaaagacacagttacaataaaagcctaaacagaaaagaaagcaggatggagaaagagaattctatcagagtaatcatgctaagaaaagcaaagtgcacccaaccgaaccaaaagataccagagatactcatgacaggaaacttgacaagctccactgtgcatgtttgattaaaggaagtaaatcagtgcatcaggaaagccaaacattttctcttgactaaacttcaagaggtgtttcctctgtggttctttgtctcagagtttgtccatgataggcatggagaaatatttgttgcatggtaaataataaatataagtgatacttagctgataaccagggtccacagcgggaaagactgggcaataggtctccactccttgtcctgcttccactgtgaagttacctttgccagcggctcagtaccaaatgctcaattgcccctgagaagtgtcacctgaatgctccccagtcttctagcccactgaccttggcacccaattaaaacagcttgatccctcctctcacatactatcagaagcctcaggaccctaccttgtgttttgttattttgggttttgttttattctatttttgtttttattccaaactcttgctgtgggaccttcttggatatctctccatccctgttgccatttctccctccacatctctggtaacagatgtgagacttcttggacatcactgtgggaaacacagtggccttcatcccctgcaccctggcttcctgaagggctgtgctggcttctcctccagggtccctaccttgaagccgcttcaggttcctctgtattatgcagagcaaggggactctcctctctccgctcccagactattcaaaaggcccgccatctttgccttattaaaatgtgcattgagatattttccaaacgaaaagaactatccgcaagaaaaatgtatttctcctccagcaactggcccgaactgaaatgagattttaaaatattttctccctgtgacacagacacaccttgatgaaccaggtggctaccctctagggtcctgggaacatctcccagtcagaacaggcccggttttctccagcaagagaagatggttctctaaggagccctcgtcctagaaggcagcgtcgtagagggaaagaaccaggcctggagccaggccgacgttggtttaattcttttctctataacccattactttgctgctggctcttggacgattctcagaacttttcagagcctcacttttctcatcaataaaagggagagaagaaagcttagctttgtattgcaggcgccatttacccttcagggtgacttctcttatgacttttcttattccagacccttttgcattttaagctggatctctcactgaataaggagagggttgcttcaaaggattttcagacacctttgaacaggcagcagagatgcctttgcacatggccttggtgactaggataggatacacggtgttcctagatccagcctggaactagaggcgataggccgccctgaaaggccaatgggctttcaaggtggacagccgtggttttaaatcctggccttttccccgctattactagagcgaccatcagacttttttgacctcagttttgtctctttaaaatggaacaagaattatctaacagacagaattacatcttttagattgtcgtgaggaaagcgcttcccatagtgctgggtagactgggagcgctgggagctgtggcaggccagccgccgcagcacagtggtgagatgcgcggtccacagtcgttcccccttgggagttgttctcccctgaggaacagaggatagggactctgtctgagtgcctggagaggaccccttgctctggcattgagtttcttccagccccgccccatgcaggtgagatccctactcacagcctagggcgcacccgagccgccagagcacagcctcctttccggctcatcacctgcttcctgcgggaggagaatacgcaactccttcgccatgcacatgcgcacagggtctgccgcgggatgccctgtctttcctgtagatggggaattgtttgggattgttacacaatcacaaaccaacactgaatcctactgaaaaaggacacaggctctttgaactctgcactagaacctaaaaccaaattccttttagacctgttctaggaggactacgttaacctgatagctgctgacacagggcagcatgcctaaagctcctaagttagactggtaggtaccgttaattattcctcgttacatcacgcaggtacacagagggacgatgacatgtgcatcctctgctcagaattgcttctgtgctgctggtgacgatggcttcatgggtctttacagaatgtagaggaagagaacagcaaagatttgctggggtttgccactgaatagcagcaaaggcaaatcccaaataacagtggatgtatttcattatcagtaaaatgaaggggctgggctagggcggctccaagatccctctggctcagaacgttccttgatactttgattccatctatgtaacatagcctgaaagtcttagcatgttttctgagattatcccagtagaataccttgtctgcaaaaggctgaaatttattatttgggaataataaatcagaacaaaaaaagatgtagagtccacggtatattattagttttgagtgtactaatccttattttatgagatttaatttttgaaatgtttacctttccattcagactattgtcaggaaaaaaagcgtgatttttgtgttcagggaagaggtaggcaagggactaatgaatatgtgctttgcccttgctctgataaatgctgtagttataaaaagtcgtggcaggttatgggggcccttttgtttaccatgataaaattaataccttacaagttttcaaaggagtttgtaagacgttacagatttatttttaatataatttcagagttggaaagctagacagttggaagtagtgcttggaaagcctgattcttgataaattcattatcaataataccatgtgcagaataaaattacaatttcagcaaagaatattcttccataacattttattattactgtgaaactaattaaacattgtaatctgcaagtaattaaaaatttacctgaaaatatactatgagccctgttgacagtacatggagcattttgtgcgattatttaatgtctgctattttttcttggttgctctattaggaaattgtagtctatatggttttataaaaaggaggcaaattatagactaatggagctagaagactcattaaaagatgatctgcccctgggagattgggtgtcctctttgaaaggcttctgagatggaatggagacattcctgggagcccctcctgggtttggtaccgtggaaatccaggtgactgtcactctattcactattatgtgtccctgcgttccttaagcacattttcacagatgtatttttcacatgcagggaatgcatacaaagcaactagcacactgcttaatgattaccaagcgttcaatgaagagaatcattctactagtattattctttgtgcatggattattacaatactctaacttttttaacttttcactcagagggatattccaatgagactttttattataactcctcattcacttaccagtgtgatttcttgctaccacacgtacatttcttcttttttaaaattcttatttccataggtttttggggaacaggtggtgtttggctacatgagtaaggtctttagtggtgatttgtgagattttggtgcacccatcacccaagcagtacacactgaacccagttcgtagtctgttattcctgacccccttcccatgctttcctcctgagtccccaaagtccactgtggcattcttatgcctttgcgtcctcatagcttagctcccacttatgaatgagaacatatacatttcttctaaatgtgctctggtttatccatatattattggaaataaagccaccacaactgatatcttactttatgagtgtttcttatggggtagaaatttctgatataataaaggccaaagttgtaacatatttattacctttacttcagccagactcacaaaaatagctgcgttgatagctctctcctgatctctaatctcttccttcctccctccttctcttgtttcttttctttcatgcattgaaaattgactggggcaccattttcaatgctggaatatgactgtgaacaaaagtaaaggcctgtggtatcatagaatgttaagttttgggagtgggaaatgacaattagttatttaatcaaggaaaggcataattccaaaaaatgtcaattgctatgagaaaattaaaacgaggtgatgtgggggtggtaacatactctagatgggttagtcagaaaaggctttgtaaacattgtaactgtgctccttttaggaatttcttaatatttatcaataaaagtatgcaatcatacttttgtattttatttttattaagtttgataaataggtgatgtttatataaggcacatatattttatgaagttatagtttgaatgtgattaccattttaaatagcaaagatctgttagttctggtacaaggtatttccccaaggtcttacagaaatgtaaagggttgatactattctgagtgcatataaaacttttaaaactgaagaacattgtttagcactatacaaactatagcaataatttaagatctgccatagtggccttcttctgtgcctcagagaacttggaaatcatcagtagcttatgctaacataaaaatacattaaccatgagttacacattctcatatatatgttttcaaataccagcaatcatttcattaaaaataaaacaagcacttccacttatcttaaagactacttctcggctgggcgcggtggctcacgcctgtaatcccagcactttgggaggccgaggcgggcggatcacgaggtcaggaaatcgagaccatcctggctaacatggtgaaaccctgtctctactaaaaatacaaaaaattagctgggcgtggtagcaggcgcctgtagtcccagctactcgggaggctgaggcaggagaatggcgtgaacctgggaggcggagcttgcagtgagctgagatgtgccactgcactccagcctgggtgacagagccagactccgtctcaaaaaaaaacaaaaacaaaaacaaaacaaaacaaaaaaaaacaaaagactactttctcaatagaatattttaaattcttccaaacactgtaagatatgttttaagattaactaccattttttagctgaattaattttgattctaacaataactacaaaatgtgacattatgttttccatcttatagataaggaggctcaagaacagagagggaagttcagagcttgccaaaaccacagtcatgagagattttaaggaggtggactcatagccagggcttctaactccagatgccctaagttctctatgagagctcagtgctcagtgtcattggaagacagtagacagcggtattgttaggttgactaaaatctggaggaaattggtcacttgataaatgtaattttaaaatatcttcattctgtaaatagattaatacttctaaataaatcttatctctagcagttgagtattagaatgctgtattataaacttacgccaacaaaaattaatgatgttgaattgagaaacaagaaagaagatatttaaatgtatcattaccccacttacttttgtctataagaaattgctcatttccagatttttctttcctactcaagccagccttttggctttctaaaaaataaatacataattagaaaattagaaattagaaacttccctaaaaattgtaataaaacttgtacagattatagaaaacgttcacaggaaagaagagggagggagggaggtaatttctataattggattatttttgtaaaaccttttcaagaaaaattgcaggtccagacacccacattgtcctagcaactaccttggttcccaccatcccaccgctgctcaaggcacccccacctttattctgaactgagtgatttccaagcacagtttgcataaagagacatgaatagagtttcagggaatgagcgctcataggtagtgcaatactttattatctcttataattatactgattttagcttcaaggcctgactgatatcactaggtatcagaatctcaattttattagtacattaaaaaaattactcagttaagaagtaaaagttacaaaaaccagtttaatgtgtaatacagccatttacagtgcacatgtaagcctaacccagatgccagagatgaacgcttagcttgggctttctgcctaatatgtttttccctggaactacaggtattatttatacgtatgagatgtggttatcaagaaataaataagaatactaaattccaagagtagtttggtttttctgtttgtgtgtgtgtgtgtgtgtgtttaggtaactggggtacgtttctggcttgccacatcttcctcagtacctacaatagtgccctgtccatcatagattcctaataaaatacagattgactcattaatggtaggtcacatgtcattattttctcaattttagtggtaggagttatttctttctaaacctttactttcatttactcaacacatatgtgtctgtcttagcactgaatctattgctgtaggtcagcaagacattttaaaattgttcttgaaagaatgctatgaaattatgtaatctggtcaaagtaggaaagcataaaattggcaaaatgtccaaagcaaagcccatactgtaaaaatcatgtcctgatgtcactggaagttgttttgggcatgaaaccagcaatgaagcaaaccaggatgaccctcttagagcccaactagatcctaaatgtcattaaagtcactaaagcactttaccactaaatgtggtaaagattcctttggaaactagctagcttgaaaaaccaattcggcaccaaaactttcagtgactcacatcttatcatcaggccagcttaaaattaatttgatatgctaccctgacactaggcatgaaaagaaaataagattagccagtacatttttgcctaccattcagcaacaaatggaagagccaaataactgcgcattcactcttagattccttgtaactcaagttatcttcttttcaataaacgaaaccaagctacaaacagattttattgcttacaagtgagcagcgcttctgattgtgcacttccatgtcagacctcacattaacaatagtgattatttcagaaatgtgcataaactcaatattggaatgaattgttttacaattgttttgtattccaaaccagacagatcaggcaaaaacatgagggagttaaaaaaaaaaaaatatatatatatatatgtatatatatgctcagatgaaggctagggtatcaaatagttgagtttttttgtaactttacttcctcccctccaaattctgagatggcttaaagaacttttattaataagacaaactattttaatctttcccttcaaactttagctgccgatttgcctaccagtttgtgacttggaatgtccttattttttttatatcatttagggttttgggctagggcttaggtgcctggatccacactcatccatcttccttcttagagtgatagccaggggtctgttcacaggagggcaagaaaccagtggcaaacagaatgccagccaattcaccagactgggaaatgcctagtcagcttcaaagccagatctcctgggaggtcgcagatggaagcacgtgacctgcaccacaaggctgtttgcctctttccctcaaatctctgcctgatggacaccccccaatgtggcgattagattttatcacatcagtgtggggggaggccagtcagaatcatccacaagtaccagggcacagagagaggaaatgaggcatggctcctacatgcatagacacacatgcattcacacacttacatatacattcacacactcgcacacacttattcccacatcacacacaaagtcacattcatacgactcgcacacattcacactcacattcacatcattcacacagattctcacactcacacacccattaacacacttacataaacattcacacagttacacattcatatacacacacacatacactcacacagtcacatgcctccggtcacacacatttacacacattcatacgcccacatacattcatacacatgtatgtattcacacatatgtatattcacacatgctttcacactcacacatgcattcacaccctcacacattcattcatgtgctcacacacatttgcacactcacacatacatagtcatgcacattcacacgcagacattcacacacagatgcacacacagacattcatacacattcacacacacatccacgcacattcacacacacacatgcacacacagacatgcacagacattcacacacagacatgcacacacagtcatccacacacattcacacacacacatgcacacacagacatgcacagacattcacacacagacatgcacacacagtcatgcacacacattcacacacattcatacacagacattcacacacagaaattcacacacagacattcccacacagtcatgcacacacattcacacacaggcattcatacacagacattcacacacacatgcttccttcacctgcaccatctgtgtagtatggtgtttagacatcctccatcttttctcgttaaacattttaaaaactcttagccaaaagtggctgaaagaaatatcatctttattattctgtaagtttttgtttcacataggttgtacattaaccacttgtccttttcctctaagtaacatacagtctatgtccaaggctggttttcccccaaaaattctgctgcaataattgtgtccttgacttggggtcacattacaacattaaatgcatggagttatcaacctggcattccactaatgctccaagttttatgtttaaatagtcttcattagttgtatttccagggaggtcttcttcctccagtatgatcttctaaatgcttactgaccattcagtcttggaaataatttttctttctatttccctggagcttgaactcatgtgtctatctccagttgttctacatcatgcttgtctgaagtgaacagagatgagaaggaaaatgtttatacatttccttccctagatagagccgaagattacaaaaggcctcccagctctgttccttcaccaccccctcctccatgctaaaaccatgcatgcttcccgggtatcactgttctcatgtgggtgcagccatctggagggtagcgtttcaatattcatggtcaccatcatagggggttcctctccaaagaaagcaatgacaagtggaacctcattgtaggtggatttgagggagactttacactactgtgaagctttcttctgacaaggaggaggtcaagagtgggaagggaggccaaggccacaagattccactggaaaccatcactctcttcctgctgtcctctaataatacaggagagaatatggcatcagcaactgccagcaggatccctgggagatcttttctctctttattgtttacatgatatcactttaatattcaggaggctttgatttgcatttctctaattaccagtgatgatgagcttttcttcatgtttgatggccgcataaatgccttcttttgagaagtgtctgttcatatcttttgcccactttttgttggggttgtttgtttcttcttgtaaatttgtttaagtaccttgtagattctggatattagtcctttgtcagatggatagattgcaaaaattttctcccattctgtaggttgcctgttcactctgatgatagtttcttttgctgtgcagaagctctttagtttaattaaatcccatttgtcaactttggcttttgttgccattgcttttggtgttttagtcatgaagtctttgcccacacctttgtcctgaatggtattgcctaggttttcctctagggattttatggttttaagtcttacatttaagtctttaatccatcttgagttaatttttgtataaggtgtaaggaaggggtccacgccagttagaataaagtcaggaaacaacagaggctggagaggatgtggagaaataggaacacttttacactgttggtgggagtgtaaattagttcaactgtggtgaaagacagtgtggcgattcctcaaggatctagaaccagaaataccatttgacccagcaatcccattactggatatatacacaagaattataaatcattctactataaagacacatgcacacgtaagtttattgcagcactatttacaatagcaaagacttggaaccaacccaactgcccatcagcgatagactagataaagaaaatgtggcacatatacactgtggaatactatgcagccataaaaaagaatgagttcatgtcctttgcagggacatggatgaagccagaaaccatcattctcagcaaactaacacaggaacagaaaaccaagcaccacatgttctcactcagaagtgggagttgaacaatgagaacaaatggatacagggagaagaacatcacacaccagggcctgttgggaggttgggggctaggggagggatagcattgggagaaatacctaatgtagatgatgggttgatgggtgcagcaaaccaccatgacacatgtatacctatgtaacaaacctgcacgttctgcacatgtatcccagaacttaaaatataataataaaaaaaagaaaaaaaaaaggaaaatattttccaaaataaaaaaatgtttaagaagaggaaaaaaaattcaggaggcttcagtcagatgtggacttactgggaccaaatatataagacatgttttatatctgatagaaatgttttagggaagacatagtgcaacgttccttggttcagaaatggcatccctcttcttgtcctgcccagaagagtcaatatgcctataacatatcagaagggattttgctttccattaaaaaagtagattcatggtctttccctttatagaattatagttaccaatgaacaagttcctatccccaaactattagatagcaacggtcaccatggtaactaagttgagtgctatgaattatttcttacaacattatttttggagctttacctaaggttatagatagtttcacttaactgggtaaatactaaatttagaatatacctgtgaattataaatagtatgagcaaaaagcataataatattagtagattaaaattctgagacttttttatattaggggaattggaataataactttaaatgtttgtaagatgcaagtgtaagtgtgagatgcaagtgtaaagtgtaagatgcaatatcacaattcacatttttacaacataattaaaaattgacattatgacacagaaatgagatattaaattataacaacagtttttaaaagtcatgtatgtgaataagaaaattattttaaacttaatttttaatgtttcttcactaagtaaaaaaacacaccaatgtagctgtcttgataatgaattcttttttgaataaagtaataatgagaaacattttaacaaataaaatctattttacttttttagagtgtttgatgctgttacaaatattgaatagactgaatctttttctcatctgtgcctgcctatctctgtgtataatgagattgttacttggattcaaagagtgacatcagcaagatggccaactagagccacctgatgctcattcccccaacaaaaggagaccaaaacaacagatggttacccatgttatacattaagcttttaaaaaatagtactagggaaatttgagattgttctaggcctttgagtttggaaatagagctgacacataagggacaaatttaaaaatcctctgatttccccaatatgttgtttctagcggtagtttaccgtgatttgtagtatgttaagatgaatgtatatgcataagccccatgttattctaaatctgaatggagtgaataactatggtgacaagtttaaagatgtcttgcttttcttagtttatcttctagaaatattattgctattatagaatggctctttgtatgtaataatacaatttcagtactacttaaatttttattcactaaatattaccttttctgtaatatgtattgtaattgcatacaaaggaggaatctcatggtgtttcaatacagtctaaatgccttccttgcctttaaaaagcttctcagtttatatgatggtcctcaaaaattaaccccccatgtaattctctatcaaatcacaagaacaatatcaagcttcatgtaaaatatattataaaatccatactttattgccaattgtgcacgaagagacatagcccactttaaccttcattaacagtctatagttctctgttctatagaaatcgtcctttaatgaagggaaaaaatagcacaaaaggtaacacagtaaaactatccatgtaactccccttcttgctcaagaaattcagttttaaaagttaattatctattgggcaaaaagtaacattgccaccatgtgatttttggcccagttggcctggtattcatgactctgtctagacacccagactcttatgtttaggaatcattgaggggggcaggggacagttggtgctaaaactgatctattctgttcatctacactgatatagatgtaccatatacagatttttaaatcaatccaatgtaggacataagaagttaatctagcaaaggttttactcagtggttagggtaaataggaggcttcattcattaattcattccttcaacaagtatttattgaacacctgctgtgggccaggccccgagctggccgtgcagataggacagtgagtaagacagagagcaggtttcagtcttccaggagatgaggctgactgtgggtgcccaagcagccttccagggctgtccagtgaattcaagagggcagggaacgtgagggagttactccttcttcaaggagaagtagctggtatatctataaggatttcctgatatatctacaaaacacctctctcaaaaagcatctgtgagaatgtgtgaggggatatattttttaggtacttagcagagcacctggcatgtggtaagtaccgggcagtctccttttacttctgtgtcgaggtcaaaccacaccttggaaccagagagaggctgagcacaggggagaaaacagacatgtaaatgggggtcctccaacacccccttctgtggaaatgaatttcagccagcaggcctgtactggaaagaggaaaggtctgatcttctgccctttagttgcagctcggtttgttgtccctgtataaaatgtagcaacggtaagaaatgtcggatttcaatacagtatggcaaacatttatttaacatctgtcacataaaagactgttgcttacttgggaatttgtggatgatgttgccaggcccctcactggaatctacatgagagaatgatcacttacgtggcattggtttttgatagattcacttaggacctttgttagatgtattgcaactctagcatgtatttctgcttattatagaaagagcaaaggaacaacaacaacaaaacagggcctatcacaaaatatactgcagaagaatgagttccttgtagtgttttgaatatctgaggtagatggtggcatgcagtcaaggttctgtgtatttgtgaacaaaaatagaaaaatataacgcttcatatctttcaggcaacactaagttatatatagtaagatcagccatgactattaaacaagaatgctttagaaaagataaaatgaaaatttatattccttttagaataaaacatatcttaaatttctataaactgttgtgcctcatacgtattacaaaaataagcagtaaaaaataaattgcacctacctgaaatcatcttccgagataccctaaaactacacatcgctttcatctgactgtggctgcacgtgggcaaggctacattgcacaccagccagatccaccttgtgtagcaaagcatgcgccaggggtgcatcgttcagggcgtggcagctgcactgcattagatgtgctggatgtgtgcacagagccacgctctgtctgtacatttacatctacagaaagacacagatcgtcacgatcttctgtagatgtgcatgtcattgtcctggtcttggtagttgctaacagtgatgctggcaatggtatcagggaataaaactggactgaatgagcctgtgtatggaccacaggctcagccagcctcagtgcatatacttcattctttggattttgcctattggaagtgtttataaactttaaacgacctggcagttttggctgagagccttactccaggggctgcctgatggttgtcttcaaaatgagcaaactttcaatgatgactgctccttaatgaacctgttttcctttggggctgtaaatgaggcctagctttcatgtctaagtcctacatgcacccacgcaaaaggtagatgtttatttttttaaaactgtattaatgtccccaatccggtgggaaatttaaattagaagggcagagagatgagtgtcaatgctccagcaactacatgtgaataaggtattaaagtgtgtttccaatcatcatgttcaagagatttgcaaagaggtgcacttgtggatgttcacatggctgaagaaacacagggagcactcttcaccaaactggagacccgggggcactctccaccaagaccagagacccaggggtgctctccaccaagaccagagacctgggggaattcttcaccaagaccagagacccagggacactctccaacaataccagagactgggggtgggggggtgcactctccaccaagaccagagacagtggggtgctctccacaaagaacagagatccgggaggctctccccaccaaggttagagaccctggggtgctttccaccaagaccagagactggggcagggtgcgctctccaccaagaccagagaccagggggcgctctccaccaagaacagagatctgaggcctctctccaccaagatcggagaccacagggtcctctccaccaagaccagagatgggtgggggggggcactcttccactaaggacagagaccctggggcactctccaccaagaacagagaccaaggggtgatctctaccaagaccagagacccgggggcgctctccaccaagaccagagactcggggtgggggggcgcactctccaccaagaacagagaccaaggggtgatctctaccaagaccagagacccgggggcgctctccaccaagaccagagactgggggtgggggggcgcactctccaccaagaccagagacagtggggtgctttccaccaagaatacagatccagggggctctctccaccaaggttggagaccctggggtgctctccaccaagaccagagacccgggggccctctccaccatgaccagagacccggaggcactgtccaccaataccagagacctggggcaccgtccaccaagatcagtgacccaagggtgctctccaccaagaacagagacccaggggctctctctaccaagactatagatggatggagtcagtggcaagtctgtggtaaattcttggatgtaagaattacaaaatgccttggacatgtgggaaaattataagaggaagagtgtgtagacctcaggggctctttacatttgtcaccttgagtgaacaaagctcacctcctgggtatggaccctgaggagtaggcaagctgggttctgatgagactcgactctgaacatcacacctggagaaaaccattctctgcatccagggccttgtccaggtcatttctatgcatcccccaactccatcccaccaacatgtctttggatttcaaactaacccgactgtccaggaagccttttctgaccttcgtgaattatttccattgtgctcactcgcgtcttccccactttagcaggcttaccctgaagtgttatttcccaaaccttcagaaaccctgactagatcattttgaagatggggcattagcatttgtgtgaatgcttagcaaacaatggaaaccctcagccaggcttgagctgtgctctctgcgctctgaccctcactggcaggggcacctcgagttccactccctgttgcatcatcagccttggagcagtgtctgacaatatgtattcagttattatttactaaatgaaactaatttttaaatgattaaaaatcagaattaaagtctatgtttcattctgtcactaccaggtttttttttttagctgactaccaatttgttagatttttttaaaaatgtgatttcacataattataaaggcatatttactgatgttacgtaaactgtctggcacatgaaatatccaggaaagagttttcctttcagctctcatgacacagcttgttggggcccgctgcctatttagctggcctctaattaatttattagatttttaaagtgtgatttcacataattacaaagacatatttgctgatgacgtaccaaatatctggtacattacaaatgtccaataaatgtaagttcccctttcattcctctcatggcatggatcattcagtctgcttatttacatagtgttcacaatgttaacaagtttagacagtggttttatatttattaccctctttttaatcacatctttaattttatcggtttttaaaatattttccagtctcagggcaagtccagtacatatgatttatattcagcaggagcaaacatcaagtggttcagaaggcatcaaacgatttttcaaaaactgtgtgtgtgtgtgtgtgtgtgtgtgtgtgtatgtatgtatatatctgcatacacacatacagttgactcttgaacaatgcaggggttaggggcacacagtcagaaatccacattccacatagaacttttgagtcccccaaaatttaactactaataccctactgttgcctgaaagtttcaccaataacataggcaggtgattgacacatagactgctctctacatatatgcattcataacatatttaacttttgttttgtttcgttattttgagacagggtctcactctgtcacccaagctggagtgtaatgtgcaatcgtagcttaccgaagccttgacctcctgggctcaagcgatcctcccacctcaacctcccgcctaagtcccccaagtagctgagactacgggcctgccaccacacctggctaatttttgtagagatggtgtttcaccacgttgcccagactgtccttgaaatcctgggctcaagtgatctgcctgccttggcctcccaaagtgctgggatgacaggagtgagccattgcaccctgcactttttgttatttttttccccaatatttctaggctagaaggttcatctataagttttttcaaactgtaacaaatcaccaagaaattttccagtatgtttattgaaaaaaatccttgtataagtggaccagggcagttcaaatttgtgttgttcaagggtccactgtctgcataaaaatacatatatacatgcacacaagtgtaaatgatagatatagacagtaaattacaaagcaaattgggtaaaatgttaacagtaggtaaatctgggtaaagggtgaatgggatatggatattatctcaactatttttgtaaatatgaaattatttcctaacaaatttttttaaaaaaattaagcaacttatgactacttcatgaattttagttacaagcagtatgtggagtaaatgctttgtactaaatttgaacacaatggtgtttatggtgaacctgaaatataaaataacagtgttaacatgtcaccgtctcttctgtggagtgatacatgtatgcctgtgtatggtggttggcatttatgtgtattttcccagctccccaatgataaacctaaaaacctctaaacctaaaagtctcagcgctaaaaatccagcaaggtcaaacaaagatttcaggggcccaagctcatctattagcataatatgaacccagcccgtgtaacgtactgaaattgtgccatgccacttacacttaaacagacagaagttctctgctctgggtctctcaatatacattttttcagcaccctgcttcactttagaggtgaagttgtgggctcaatgttacccacatcacttgcccattaaaaaagccaccatcgtcataataccataattttctgcatgaaattttggtctccttacccttgtagaggttcctctatgtacaagtttgcacaaaacactgcagggattataaaccatgaagaaaacatggtttcctttcaatgctctgcagagtttggccttttgagtaacctttttttttttttctgggagctttctttctcttttttttttaattattttttgagatggagtcttgctctgttgcccaggctggagtgcagtggcacgaccttagctcactgcaaactctgccacctgggttcaagcgattctcctgcctcagcctcccaagtagctgggattataggagcgtgccacaacacctggatagtttttgtattttttggtagagataaggttttaccatgttggccatgttgatctcgaactcctgacctcaagccatctgccttcctcggcctcccaaagtgctgggattacaggtgtgagccaccgtgcctggcctaaataaggtgtctttgaacagaaacatgtataaaactgaattatgtattgatcgttgatgaaaatgtgatcagaggtttttgggaaccaaccctgtatttccttgaggagcagtattggctaattcagtgttcctggtgactttaccacaaataatgagagttgacttgcatgtgtgtgtgtgtgcgtgcacacgtgcatgtgtgtgtgtgtgtgtgtatatatataaaataattattactgtttgctgaatcatttgagagcaacttgcagacattatgatccttcatccctgtcttagagtgcatttcctaaaaccaaggacattcttttacataaagttactttatcaaattctgaaaatttaatattgttacaatattgttatttggtggtcattctaaattcaaatttttccaatttttcattagttgtaagttctttctgatgcagaatctagtccagatcacacattacatttatttgcctcctgagtagctgggattatcatgcccaactaatttttgtatttttagtaaagatggggtttcgccattttgtgcaggctgatcttgaactcctgacctcatgatctacccgccttggcctcccaaaatgctgtgattacaggcatgagccattgcccccgggcttgcaagctcttttttaacttctcttcctggacaagtctctgttgtggctctccttcagtgtctctggccagtcattctcagactgggaaagccaggtccttctcctccttggccttctcatcatccatctccttcctcctgggccactcttctgtcctcatttattccgggtttttccttttcaaaaacctgtttcattcttatgtatcctgtggacttgatgaaatcttacatgacttcatacaatcacatggcacgcgtctcctggaaagttcagagatctgtctgttcattaaccccctccagtgggactctcattgatgtggcagcagcaacatgaggaatagaatcagaaaacatttcctgtagccatttggctcattggagtgaaggaattttttttacagttttcaagttatgctgttttctaaagttttgaccatttatttttatgtcacagagatgaaattgattttgaggtcttatttttgttacacaaatctagaggagagtgtgtcagtatctcttctaagtattagacacattcatttgctttttcctggaggaaaacatgcaggaacaagaacccaaaattctagatatcattaattttttaaatttaaataatttctaagagaaaagagacgttatccatacaataattatgcaactccagttattattattattagtattatttttgagacagagtctcaccctgttgcccaggctggagtacagtggtgtgatctcagctcactgcaacctctgcctctcaggttcaagcgattctcctgcctcagcctcccgagtagctgggattacaggcacatgctaccacacctggctaattttttgtatattcagtagagacggggtttcaccatgtctgtcttgaccatgaggcctcaccaccatgtgctcaccatcataaggccaggctggtcttgaactccctacctcaggtgatctgtccaccttggcctcccaaagtgctgcaattataggtgtgagccactgcgcatggcccccagttatgtttgaatggttgctttccatcttgtgggtgtgttctttagcaatgaccaggctgaagcaagttcctcccagatagttccatctttgcaaattaagagaaagacagctagtgtggataatggaagggtgacttccaatgtattctctggaattttagtgaaaaaattaatagtgggtacagctctgcacagatgggctcccttggttcatgtgaccacagatgttttggtatcgtattgcatgtgatttctgtagctgttaaggtattcccatagtaatacttatgtggacacgttcttgtaaaacttcccaccaaaattcagagtgaaaaaactaacatatcagggtgaaattatctcaggatgcaatatgaagtcttaagaagtataactattcatttcttgtctaaattgaacttgaatcttgagataatcccagaaagttttgacctcgccctgcctccgtccttaaatacattcccttgagttaggttgagccatcagactggtttgcagagtgcccagtcccaaaggctgggcaagagaccggtctttggtcttcatgactcagcatccagtctctgagggtgggtgaggctcagtcctcagtcttggtgactgtctttgtctgcttgtgctgctataacaaaatactgggtaatttataaacaatgaacatttatttctcccggttctgggggtggtaagtccaagatcaagttcccagcaggttcagtgtgtggtgagggctactctccgcttccaaagatggtgccttgttgcagcagcctcaggaggagatgaacgtcgtgtcctcatatgctggtgagcatgggctgcggggtctcgtcctcatctggggtgtccgtactggtgagggtgggctggggtggtctcatcctcatctagggggtttctgtagcagtgagggtgggctgcggggtgtcatcctcatctgtgggatgtccgtgctggccatcaccgagttgagcacttcccatcctggagtcttggccacaaccctcacatacagacaaaagtcgatttgggtccagcggctctttcagcacgtggtgccaacctaagacatgaggcctcctgctggagctccaggaaactctagtctctgccctcctcttgcatccgtaggatcgctgggctgctgctggggcttggcaatcctcagagaccttggacttgtctgcttggagataaggcacagtcatttcatctccaactgctgccaagccctgctggctggcaggacatttggactctctctccctgggttttcccaggacagaggttacagatccttcagctcttaggctgatgtcacttccactccttgatctcagcttacaggaaaggtggagagaaaaggcgatcagagcagagtccctttctgaagacacacttggtcctcccctgcctgggtctgcaggggtcagaagcatttccatagcagtcattttcatacaggccctggctcccattaggcaaccttcctctttggaaaacccaatagccaggaatttaaaaggcaggactcttttctcttaattttctcctgaaaaacccttccctgaggcaaccagacccagctgctgcccaaataggaaggaaggtcagaattgacaggaattcacaaggaaagagagcataggtttatatttcagggtatcagtcatgcggccatgggatcagatttggaactctgtgattaagctaatttctggcattaggctcaatccctctgtgacagagaagtgtaaaattgtcaaaaaatgagcattattttagcaacacaatcctgacactatgagagggagaaaactgggttggatcaagtattcatcttacccagtaagccattataactcaggcttttgatgcatattttgggctgttattcatcaaggtggtcaaagtcatgaagaactgtatgttattctataatatactttctatattaagtctgttcagatgataccacattttctacatcactgatccattaaaaaaaaatctttctttgaatgcctcttgccactaatcaggctatgatattcagtttttgagataggttaacaaattgaaaacccagctttaaatgttatggtagtttaaaaatagaagtgttttacttcaaactattctgagttgctgcttagagcaataaaaatgtactttatagcttgttaacctagatctcagggatatccgttctacaataatggaagtagatttgtttactgtctaaatcagccttgtcagaacaatgctctccagtgactttttaaagtcagagtaaaccaatacattctgtcttctgtgattatacagcatggcatggtgttctcttgtatacttgtgttttgaatatgagtaacagtctttagctgactttagcattttggagaaatctgtatatgtggcttctacttatataagcatctaccaaatatattaactgagttttatagtccggttattttccatttcagttacttccaagactcttcgatatgcacttacatacttcatactcattaaatgaagatattggaagctaccttattttgaggtacagcataaagcaccagcagagcttagttactacacattttagcacaatctcctgtaagttactgcatgctgcaaaagagctgaatgagtcaacagacattgtaatggtgatgtgtaactcataacctgaaataaactatgtcaaatcgattagaaaggtctgagcacatctggaaaattggcaggtaatttagaaagaaatgactagttattaagaactcaggccagttaaactgggagattaaaatgtattacattgagagactattgccatcaattgccatttgttattgaacataaaatgcagcctagttttgagactcaagtgatgaacccttcccatgggttctttctacctttctactggtcctcaaaaacaagttaaagcaaaaaagatttaagtgataaaatgtgtttatgcctcttggatgtatacttttttttaatctaaggaagaaaccttatgatatgatatgatgaaaccatcctctctggattctaatcctaagtaaatactgaccagctgcattaagaaattttctgtttttttctccagatcttcaaatgctccattaaaaaaagaaagtttgttctagtgttttcccatcagcatttacctactcttatgtaccttcaccacaatcaaaactgttttccagcccaaacttggcctccaggccctcactgctctagagccagcccctcctaatggtttcgctcacactcagcgccttagcttcccctcctcagggtcacttagagaaggaaatacttctgcctctttgtaccacctcctgccagaaaggagaccccgcactgtacctgattctttgggtcataggaacagcatgtgccccacgtgggcattctcctcagtctttatatcacataccctgtgaatcagcatgctggggtaggaccccagggtggaaactgttgaaagccgtccagcaggcaatgaggtatgctctaccctggaggcctggtaaccttcacgacccccttgagcttcaagtctctgtggctgatggttttaatgataggagcccagaaagggaggcagcttccacccagctgcacccctcgaggtcttgtgctccctgaccgggccatcagctacatccttttgcaaagcagccatcagcttatgatggggtcttgctaagctgagtgcctgctccaggaaagccttgtgatgctcatacgtggtccgatacttgtatttggggtgagccagcttaggtttaacgactaaaggacaggaagagcccggcaagccttgcttgtgaaatggacacggtatatccaggaacacacccagtctgaccccagcagcactgcactttacatggaaagttagcagctatccattattcatttcaactgcaatgctattgcagtcaggcagtgcagagagacagcagttttcccttatccaagtgatcttgagaaggggaagttgaggcactaagtagaaggaaaacccttagggaaggttggctctaaagagcaggaaatttatccctccctcatgcacctgaagcaagctggtgctcagtgggacccacaattcatagaagttccctaaatgcctgggcctggttcagtgatgatttggctgagctgagacctgggagtgctctctggcttgctgcagccattccatctcagctccaatgagacagggccaaagatggacctgattctccacccagtgggcagaactcaaggccattctcagctataactgctacttcccttggtaatccctgttacattcttcccaactcttaggctgttgccaatggcctagctatttggtttgccacctgaaaaaaccagacaagcagataaaaggcacctctttggggggctgtagaccatggaaacaaatcatgcatggaaccatgtgggtcactcaggtacaagcccacagtgtggacctgtttcgatgagaccaactggaatgagctgctgatccagatggcactggccacataaccaccaggctgcctgagtttaccttcatactgggcattgcagcacatcccccatcacaacatgagcacaaaggaaacccagtttctgacacagagctgccactcactgcatgcaggtgttttatagtccggttatcttctgtttcagttggtgtctcaggaggccacacttccctgggcaaggccccccctgctcctggaagactgactacgttggacccctgacctccactcagggctgacactgttccaggctatgttgttactgtcccagtctggtcagccaacttcagccacaccaccagtccgcttggttcttactttctgtttgcagtctgacaatggaacaccttttgtcaaggaaaccactcaggagtggacagatgaccttccatgccattgccatccacaggcaccaggcattgttgagcactggatcagtctcttcaaaaactgactcaaagacatctgactttggtctcctcctggtcacacgcttgactaagacacgttgttcactgaatgtagctgttccagaaagggaccatcttctcttggctgcttcttgagtaatgaccagaatgaaggggcaaggaatcatctagatctattttgaaaatttgataacctttcctgatcattcctggacatgaggcttctctctttaccctaacaactcccccaggcccacgtggttagtgcacccccgtgagcccagcgcgttctagtctaattctgatgcgaccacctggatgctcatgccgcattgccatggactgagataggtgggacagggaccactggctgagagctccgccccctgacccccctacagtggttcacacaggccaaaatggtggccgtgacaggcctctgtagactttattaaaatcctctgtgcctcttgcacctgactgtccagatggaaagtcgggagtgagcaggggcatggggagcaaagtaaagctccagccactgacatagggcacactaattttattccagtggagggagaagaaccacctcagcctcaggagcctcggcccacaccccagagaaccacctcagcctcaggagcctcggcccacaccccagagaagaaccacctcagcctcaagagcctcggcccacaccccggagaagaaccacctcagcctcaggagcctcggcccacatcccggagaaccacgtcagcctcaggagcctcggcccacacccctctacctccactaagaggtaagcggggtgagggctatgaatgacctttttcctttactgtcatccctggtgtctgtcttccttgtgaaggaaaataacttggtgccgctcacccaaactattacaagcaccttaactgactgctggctctcacatcgtcaccaggcagctctgaacacagctggactgccattgcccttaacttaccgagaaatttttggaaacagcaggggagggcctcggctcgactggcagtgtggacagacagggcagggtaaatggatggctctcaaacagtctctccaaagccgagaaggacttcacccagttgctcaaactgaactggaaacggtgcgttttaccagcagatcaggaggctacattgtagtgattgtcaaagtgcacttctcagttcacactggtcccaacagtcaaggaagcccaacttgggggtgccagcaattgtaacccacactctgttttcagaggcaccacgcgtgccccagatctacactccttgtatgggagggagtcaggtactaagttgcttttcttccccaaaacgtgctttcctttccccttacaccttatggattctcttgagaatggaagtcgacaccatcgatagaccgtgcagcactccgacggctatgcagatcgaaaacagagccgccgtgcttaccctcaccctgtgggcagtcagatatgatgggaatcacccagttagaaagatggcatggaatctgtccctgacttcaaatgaagtaatcaatggtattgccctggaaggcaagcaagtcagcctccactcaccagcgagagttgtcagggatggtagcattgccccagactcactcttagtggcacaatcaatcacgaactcagtcattcataccttgggacgtaaagaaatgacagtgaatggcagtaacaaaggcacaccacagcaagggacccaagctcggcgcaccattgtcctttttcattctggttttgctgagctgctgttgcttggccttgcacaaatgctgactgggagtagtctgagacctggagtgggacacacgtccttcccatgactaaaactgctgatgaatatgataatatttctacactagcctccctcaagcccagaaccatgatctggaacagcatttgcatggagcaccaaattacaggccttaatccaacaagtatttcttgattatacgacttgattccaggttagacagatggaaaaatgctgataaatataaaacatgtcttgctctctaaaaaattatagtttggttgcaaaagtaagaccaagttgactaagatataatggtcttttgtatcattatgtgatcatttgatcattgtatcattatttgatcaccaaattatatggggccaaaaataacacaaaattgggaaagagattgtaatcactgagggatgaaaaaaggcagtcaggttttgaaaaagagctctatttgggtgcacgccgagcctgcctgactgtctacaaatgaaaatcaggccaatgcctgtggcctgcaaggcttctcgatattctaaggtgacatggattgcatgttattatgcaatttttaaaaaaatggtagagcctctggatgaacgtgttataattaggtttccttttgttgatttggaactctttctgttcattgctgtgtgaaacacgcttgtggaaggaattatgccagctttgcatagtgtgcatttttagagagaacattttcattgaaacagaatcagaaatgtaacaacgagttgggtagaaatttgtcatgattcttgttggcatatattattgttgctaaaggcatttattaaacttaatgaaagtgttcattaagaacactgaagattataatgctgacaaaaacaccaaaaaaagtcattctactacattgaagattaaaaataaataagctaccccatcaaaccaaataaactataacttttaggtaattataaaatacaacttcacctgcctgggcaacatggtgagatccccgtctctacccccccgcccccaaaaaaaaatttagccatgtgtggtggcatgcgactgtgatctcagctactctggaggctgagaagggaagatggcttgagcccaggaggtcagggctgcagtgagcagtgttcgtgccaccgcactccagtctgggtgacagagtgagaccctctctctcaaaaaaaaaaaaaaaaaaaatacaacttcaaatgaatgaatactatatttcaggtgataattcctaataataaaagcaaaatattacaactacccagcataactgtctatctgtgatctttcacccaaagctcatggcctttgtaccattctgtgaatttcaaggttatcaaaatatagggaatgttaactaatggtctaacatttcttaatctttactttgtatcaaatggggctattacttaaattctttgtatgttttaacggtttcttatgaaagcataccttcttcacccagcccgatcttgacagtaatgcctaacactaaacaagtcagtgttgagttgtttgtttaatctctccaaatatgttggtttaagacctgtacaatttgaaaataaaacctgcaatactttttacatatgaatagcaatttacttatgtctgaaaccttagcaataactgcacagagagcatccaacagtcttaattggagttatctgattattactcacaggataccacaagctctaagaacatttactttacactgctggtgttctggtcacctcctcggtgaattcactgctccctttgcccaagtcgaacagtttctattatttgtaactttttctttgtagtgtttactgtgaagatagctgaatgtttcagccaggcttttttcttcttttacagaataatattgttcatgatcaacacagattctacagagtgtattaaaaaaatagtcatcaaaagcttgattgctcccagcagccttagatcaggcctgtgtagagaaggattgaccatgaagccgaaaggatcactgattgccaccacaccttcctcagccctgagaggggcctaggcagggtggtcacatggccatgtgttcttgtaaaattcacaaacgtgagatcgtttggccacagtcctttgttactgctgcctctttctaccctgacttcactccagcacattctcctgctgtttagaggaattggagtggggcttggcagcttcgggatctagctgggggaacattgatttggaaagacattgagtatgagtttagaatgacacattttgtggttcacgcttactgcggactgtgctgacttaccaggagttattatgtgaaggtccagggataatttctccgtaagaacgcatcccacggtgctggcagcagacccacgagggtggtagaggagaaacaagattggaaatgtctggagtcacaggcaaatccgtggtaaaatcttggatgtgtaagaattataaaatgtataggctacctgggaaaactatgataggaaggttgtgttctcatcaataatgcagggtatattataaacgtatccatgtgttcatttattttttcatgtgaattatatgaaacatgtatcagaattttttcctttgtatgacacaatctgtagcaatttagtaagcaagcggtctgtgtgtgaaggtgaatgtcttatgccttttaatatattggaacaggtcttagtatatttgattattttgtttcaaagccatctggcaggtccaaacagcacatgtgtcattccaaaaccaataatttattatgagaaggaaatacattttaaatagaagtaatgaataggctctcaggttattagacaacttaattaatgaagagaagtggtgcatacgaacccattgggaaaatacttgaatttcttgcttccttgacaaaagttctgacatcaatgaatataatctgatctaatctgccaatgagcccctacaacaaggaactaacgataaacttgttaatgagtgtcagcaattcaaagagagtttaagattagttcctgggcaacaaaacttgaaaaacctagtattcttattgcttgcatgtgagagaaatttggaattccccaaaaaatgtgcatgatataaccaacaacaagtcatgaagctgaaagtaactttttcaaacttcagtactaaaagagaaatttagatcaactatgctgctggaaagactggattatctttctgcttttttctttataaaatgatagtcatagtttcgtattcttttttcaaagagcacccccaattgtgcaagcctcaagcctgaggaatttgcactcatcaagtacctgtgcctgatgcgttctttccagaactgaagtctcattgataggtgaggtaatgcgatcccagctggtatagagatttattcctccagggagtagacagtgaatttatccagaaatgaatgtgtatacgtaagaaaagctgttcataccaagatttacacacctatgttccattaaatgcaaaggatgtggtttcatttgataatcgcttctggttgccatcttggtaacgttacactgaggtgctggagaggtctgtagccatttagggtcttaccttcaactattctgtgtatctgttatcagggaatttcttcatttcacgctgagcaccagtgctgtattagtgagtggggtgtatagtttgttggcatgcacggacttctggtcctataagcttcaggctgcagaaagggtttagccctggaccattctgggatgcgtcgtcaaggctggtgcttctgcgggaggcagggcactcagggctttcatgctgcaatgggggagtcccatggaagccagaacgaggtggtcaccctgatgtgaaggaatctgcagaggcaggaagagccctgaagctagctccacgttcccctgtccatgtctacattcacagacactttcccaactctccaggagaagcagtgcagaacgttctggaaagagagtgaagttttgccctcctaagactaggtttctgatgaaagtaggaccactgaactgtaggcagctacaggatagggcctgtctgttcttcaccagtgtagcctcagccgcgagcacagtgtggagctgctcacagataatgaagacagatggtgctaagcggaatctcctctctgctgagtgggttgctgtagtggaagaagcactgaagagtcccaagcgtaggttgaactccttgagtatgtcctgagagactggggcagcctgagtctctgcgcgcaccagcctttacactgaagtgagattctatgtaagaatataccttgtctaccggaatgcaccacaggactggatattgttatggtaaaatattttagtaaaggaaaaataatgcctaaatacatatagcctttcagaaattttcacacaatggaagtgctgtggtgattatgaacacaggctctggagcgatattccctgagttcaatcctggatctatctgttatcagctgtgtgaccttgggcaagttgcttaatctctctgtgtctattttttcatctgcaagtgaggataatcatagaacctacctcacagggatattgtaagaattaaatgagttcacacaaatacaggacttaaagagtgtctgtcacttaggaagcacacaataaatattagctattatcgttatggtcttcgttttactttattgatgcctaaagtaattttgaactaaaaattgtgattaaaattttgttttgtttcagagatttggaattactgtctaaatccaccaaatcttgataaaatattacagggaaaatagaagtttgggtaatgtccctatttcattatttagtatctagacacattatttaactgatgtctaatatgaacacttataaaccaaagaaagtgagtttaaatttcaccaggtgttaaatataaatacctgtttaattccgagggtggttatatcctaggacaaagagctatcaaggttatattgtagtacaccaactctgggagatgagggcttgagtaagtctctagatacttctttttgtgtgctgaggggttttgcaattctttggctgtcacagccctgtgtaaatttttgaaaattaatgacaatttgctggtagtggccaggtggtgtgccaggggagaaagaggaggttagagggagatgcagtacactctcaccaggcagtgtgaagacaggagagctggcatagatgaggcttggtaacaaccagaaaccacggggggaaagcagcctcccaggaatgagtcagggcccagaggacgtctcacctttctaggatctgtgtggctaccgcttcggcaccacctaggagctgtcaaaattgcaagatctccaagcccgtgccggaccttctgagtgagtttgtgttttattcacccccactgaggactgtgtgcaggtaggcattcgggaagcaccgggcaggaagctgtccttccatcctctcttcacctctgccctggctcctgccgtcctctctgtaaggaaggtcttcctcccagccagggtgaggctgagagctttagagccctaaacactgagaagacaatatgcagatgaaatgtaatgagggcctgagctacaggagtcacttggcatggcaagaaatcactggatacgagtaatattaagatattcacattgtgaaaccttgttgccccggggaggataagaaaaagcagcttacgtttattgaggtatttactttcattagccccatcttacaggagaggaaactgaagctggaaatgaaataacctgttccaggtctgagcgcaaggaagagggaaggccaggactcctggctttgggtctgcacccgtcaccgtcaccgctgtgcatgcagaggatgaggggaaggtcagggagctgcagggagcaaaagggtctggctgtggggaagggcgggggagagagagccagttccttatggtcagaccggaacatcgtaatgctccctcgagaactgatgctctggtatcagagcatggtcaggccggaacatcgtaatgcaccctcgagaactgatgcgctggtatccagggaggatcggtaaaggaaccaacacgcacatatgcactcacaatgctcacggatgtcacgcagcaggacctggcagggctggcctctgcttacagaggccgacgttccctcgccctgagacatcaattttactccatctcttcttgcctcaaactttccatatccgtccccattctaccctcacttcttcaacctgtgattcctaggtgattcctacaaggagacgtgatagcgtgcaagactcaactcccgtcttcaatgaacttacgtttcaatgagaatgtatgggtctatggatacttcagatagtctcatgtgaacaatcttaccacctgcaggaagagcatttggaaccatggcccattctttcttcaaacttcttttggcttccacggcatctctttctctgcatttcctctttcctcactccttggctggtgtgagggcccccgagctgccactctaagctcatctcttgccgtctttcttattcctcaggctccaaacacaccggcttccccgccatcccccaagcgtgccaagcgctctgctgcctccgggacttgctgtttgcttttctttctgccccagcgcctttcctgtggctggctccttctcagccatcggatttggctcaaatgttgcatctcctgagagcctgtttttaaacccttgattttcctcagttctattaccttgtttattttattcaaaagacttatcatgagctgaaagtatctttttgtttgctcatactctatctccctgactagaattcttcaactacgcatcccgtctatcttatttgcttcagcatctctcatgattagaacatagccttggtgagtattatagtctcattaatttttaatcaaatgaatgaatatataatatacagatacataatacaaacaatttaacctggcacataaaagaccaggagagataagacatccattttctggtatttagaggactgtcataaagaagagggatttaccctgggctacatcggctctaggagatggaaccgactaagagtgggagccgaagcaggtatatattggtgcaatttaaggaagaacttcctaccaggtagagtgttcaaagatgtaatagcctttttgggaaggtgatgagcctcttactacagtttttcccaaatagacaggtagcttctgggaagagatgatgtaaaggagattcatagctgcttgtaataagtggcttttaaggtttctttcaatcctgattgtctcttagaagttgggtgcagtgactttctctaaggcatgtactgttccaggatgatacatagataaaggtgaggttactaggaaaatggactcgattgtttagctgtatcctaatacttgttttcaaagagtaagctaaacacttacagtttttaaatttaaaaatgagatagagatcaacaacctcaaaaacaacgtattcaaatcctgtggcaccgcctttgctcagggagtctttaaagtgcttattctagaatttcctggagagtcatgtaacaggaagttgtgcaaatttgttaaacactttatttgttagatttcagtttaaaaaacttctgctttaaatccattcctagcgggtaaagatgtacctccactaatttgaaagaacaagttaaaagctctgaaaataattataaaagagtgcaccaaaaaaatatttgccacaatggcaggatcgctaaggtaattacagttccttccaaggtcattacttggtgacaaatgcctattggatatattggctgtgttgggcatagtaaagaacaatgcccaggcgtattgcctgatgggaatgtggcctgtgtgtgtccatgcgtacatgcagattacaataccaaatctcttcttcttaatcgttttttgtttgttttgacaagaagattcttactctatggtttcacacgttgcatgctaaatatttcagcctttgcaaatgtgataagtatgggttctgacattttgaagatcttttcagaatattttagaaatgtattatgtttattctacatatgcatgatcagtgttttacatgtgattatagctttgcatttacaaagaaaataactgttaagtaggaagcaatccatttggatgctctaaagagtaatttgagtggcttgtaaaccttttactgttttgtcttaaatatatggctgatgatatacctttaagtagccttaaaatactatagtttactttctatgaatgactgcagaaatttcaagcatacacacagtgcataacattctacattatatttttacttttaagaaacaaaatgtttttcctgtctagttctaatttatcactttgtagttatgcccagtgaactgataggccattatcccatcttattaaaacactcagggcttgctatcccgacaatatatcaaaagaaaagcaaaacaagaagatgtatacagaatacttaagtcaattttatcttcagagtgcggttttcaggtagagacgttgtaattgttaacaataaaggtaaaatgtagtctggttttgcttgagttttcagatcaattttttagacaaaaatcatcctatagtttagtatttggccaaattattttcttctgaatctcccaaaaaggaaataaagtattcctcttatcaatttgaccccataacaaatgctgccctttgggctttttttcttcaattccaaaagcattttaacaaccataatccaagacaagaagataatatatttatcatctgatcatttttacaacttctgtttttctgctataataatataccttactgttaatccttcccagctgttggagtaaagcacttagattgaactatgtctgggttttaaagatccaaagctggaatgttttattgttgctaccttttaattaaaggaaaactaaaggttagctaggtcctgataaaattggaatcagattaaggtgaatttttctcccatactacagtttgttgtcaggttttaggtagtaatactagaatcagacccacccccgaccatctgactgtgcaggtgagaactgtcactttgtcttcaagaagcttcaggaaaggaggatgggagatatttgggaatatatttttctctaggggaaaaataataatatgttaataatttaaatacccaagtttttaatattggggaatgtattagtctgttttcacgctgctgatatatacatacccaagactgggtaatttataaagaaaaagaggtttaatggactcacagttccatgtggctggggaggcctcacaatcatggcagaaggtgaaagacacatcttacatggcggcaggcaagagagaatgagaaccaagtgaaaggggtttccccttataaaaccatcagatctcatgagactgattcactaccacaagaacagtatgggggaaactgcccccatgagtcagttatctcccactgggtccctccctcaacatgtggaaattatgggagcaattgaagatgagattcgggtggagacacagccaaaccgtatcagggaatatatacttatgactgtctcttacttttttgtctgcctacttctcttaatttgggaaactgcccccaaatacccctttatgtgatcgtgaggggtttgtcaaccaaagactacattcaccctgcctcagggtgggcccctgtatcagttgggacattccagagaaacagaaccaataggttaacacataatagggagatttatcttagggaattgacttgtgtgattgcaggggctggcgagtctgaaatccacagggcaggccagcagcctggaaataagtgttgatgctgcactcttgagtccgaaatccgcagggcagactgataggcaggaaactcaggcaagggttctatgttacagccttgaagctagattccttcctcctccttcagaacctcagcttttcctctgaaggttttcacccagccagatgaggctatatagggagggtaatttcctttacataaagtcaactgattttaagtgttaatgacatctacagaataccttcacagaaacatctacatgaatgacgcaacagctgggcaacatggcgcagccacagcaacaaataaaagtaaccattgcagccagtgagtcccacagggcccttctgtgaaactcacacagactcaggaaaaccactgggcattttctctcaagtcggggaacagcccctgctggttgaagggcctgctagagaatgcagctgacctgggagcacgtggagtgagggagcgagggaggccatcctggtggcagtgtccgattcctggatacagccgtgctgccgcccaactcaaccctggaattccctctcttgcttgagcaactaagactcttgatgaatgaagaagacttttagaaacctattaatacttaaggttaggatgcagcttacatgttaaatgacgttcagaaatccattcagtcattttttcaccagtgttttagtgcctgcattttacctttatggaaatgttaggcattgagattaaagtagtgagcaagagaaacccagtgcctgacctgtttagtggaataagcaacattgaatgataaatgacaaggaaaaaagcttacaaaagagtaaggagatgatatggcatgagaataatgcaggagtggccgactatctttgggtgaagattaggcttctttgaggaaatgcatttgtgatgcaacccccgaaggtgaggatgagttagctgggaggggaagagtgatctagtccaagggaagtatgggaatgaaagagcaaggactatacatggagttgaaagggcacaatgcctgggacagagacagagatgagaagagagacagggggaattcatgaattgggcatcaggaaaagcctcctggtcccctgtaagccttgcctacattggagcaacaaggtggtggtggcctcgttgcctgacgcaggaggactggagaaggaaatgtctgcaagaggtaagatagtcattcagttgaggatgcattaggcttgggaggagatgtttaagaagcaccatgagcatttagggctcaggagagctgcctgtactatcacctgtcatctgtgtgaatggagtgggaagggaactgaagatggaaaggatgctttctgaaggtaataataattatgagacagtgctttagcttattgccagtaaaataagcttaccaattttaaaagggagaaaccgtttctgtttgctgaccagactggcagcatttacagtcactaagtgggagctggaaagaatcccgcagctcgtctaattccaccctttaatttcaaaaataaagagattgaagccgagagagacagtcaggaggaccaaaacccaaaccttctgacgtctgctactttgctgtttctactacagttttgtggaaagggagagagggagacagggaaaaagaacactttaatgtaataaacatttccatcttttcactttccctttaattttatttatatagccatgcacctaatttagcttccaattaatgttgagctgtggtggattggtgggagctgcccgaagcactctatctgaagccactttggttttcagtgtttagtatgagtaaggcatgtatctaatgtccaaaccagtccaatggagagtgaaatggtggttattcctcatgcagagacagcaggcatgaaccagaactgtccccagcaaactagaacccgtggtctccctaaccacgaggactataggaagaaaatgcagcatgggagccattttgcaattcctggtttatatggttttcctatcgaagttagaatttgttaagattttgatacagaaaaaaagggggggaaagctgaggaaaaattgattccaactgcggcaaggttttcaaattttttactattgtcttcttcatggagatgtattaattattcatcttgaattttaataatgattttttgtgtgtgttccaaaaaaaggaattaaaataattactttgtataagtctaccttgatccaaaataagtatttcaaaataggaaacatgtaaatgtcaatttaatgcaaagctctttctcctttaagtcaatcctcttcctctgaaataaaatcttctgtaaaggtaatagtatttgtctctccttgtgatgagcatttttagagttttagaaatttctttgacactggaaggaaattttcttttcttggtaaaaactaaataatcagtagagaatagtgcttccaaaacaattttaaatgccagaccgtatttcaaacaaccgtctaatttgagttaagtacatttgggaaatatagttatcaccaatgttgacagaaaacttaatattggtgatcacgacaggcatagatcaagcactgatgaatatgcctttgatggagttttctcacgatcttcttcatgtgcaggtgatgacagctctttcttccgtggtgtttacctgtacatcaatactacaggcatctcaaaagacgttacaagtattgaagatctttatgcctctgcctgtgggatttctttagggaactgacatattgctaaagaatagactcaacatccattactagctttcattcaaatctctgtacctcacagaaaatttcactgaaaacaatgatcgtataccttgtatatcagagagatgttcatgttatgggaaatgtggaataagttctggaatatagtgcatatgaaaaccagtgagttttaggaaaatatttaaatgtggagaaatgcaaattatactcaaatgtgggcttcatcagtgtgaggagctaaggttgctagggtattgaaagttaatactctatgaaatgcatcttaagcagaagccttaaattaaaaatctacacaaatcaaactaagtgtcattattgaaaagcattttgttcatataccatgagttctttatatgaatgatttgcatgtatcagatcttttttttattccagacattttgtcctggaaaatatgaacttgtttatggaaattttgccctttaaatgttgcagctttaaaatacggctgctccctgttctatagtttaaaaatggcttagattcagtagtttatttgtaaatattatcaatacatgcctattttatgtatttagtaggtggatatctgaactcattcataaggaaaaattgaaattaaacaatttttctttcaattgggcatttctaatattttttacatgatctgaaaattaattcctaggatcatttgaaaagacttctgggtaaggggaagggaagagagtagaaaaatgcttcctacacatttagccattagattttagtcctcagcaggcaggtttttctggtgtgacttcatcaagcataacttaatagagaaaaggatgatttcatttattttaatctacaacctcaaataacataaagacctatgaagtatgcgtgactctttcttaagactcttaagaaagattcacacataaaaagagctacattattttatatatattatttcttaaaaaatgcgtttacacttgaaatagactcataaatactatggaagctataaaacatattttgaaagcaagtcctaaagtcttcagggtacgtctgtcctcatagcaaactagtgatttgagagttccctctatctttcagaatttatgtagctgaatcttaaggaccagacttatgacacttatgacactgccatcttcaaggtatttgccatataatttcagtgactgaaatctcatatgccttgaaaacctaagagctgtgatattgcaacaaaaggacaaccaagtgacatttcctgcaaattttgagagttatacatacgcctctcaaataaattgaaactgcaatttgggtatgtaaccaccagatgtcactgtcttgtgatttttaagtcataggcatatattaatacttacataaagtcatataccaattttacacttttcctattgaataaattataactctttatacagaaacaataaaaagactacattaatgtttggttttgaaactcaaacttcagccaagttgtcttaattcacatacatacctgctaagtagtggatatctctcatttcaaaagcatgcatttctgcaaaactggattatcataatcgtgtttaggactctttaggttgcatcttaaagaagcccaacctagcctaagcacaaaacaggaaatccattggcacacatacagaagcccagtggtgtactgccttcaggcatggcctattccagaggctataatccattttatcacaatgcatcactcagtaggctctccaccaaatagcacatgatatggccctgcagctgaagacccacattctacaacctcagtagagacaggccattccgagacattccatgtctctgctcttttcaggttctgtaaccacagtagagataggccattttccccaatagctggcagaaatgagctgaaataagttttgattagccagtcttgggtttcataaaccttcaggatccagtcattatggacaggggcatggcatacttggattagccagaatcaggggcccactgcttggctgtggcagtggctaggccatcagcctgacttaacaatatgggatggatctccacaggaagcatggcaccattagtacagcacagggagatggaagctgggtgggcatatcaaattattggactgtcattccatgtctctgctcttctcaggagcaagcagtcatgtccatggctgccagagtgacccctctagaacaaaatctcgaaatgctactcttctctcaagagggcaagatgcagtacaaactgtgtagtatacacgactcctcttgacctaacttcttccttttcctgctttagtctcatctcccatcactgctgaatccaaccacatgaactctttgcaattctaacaaatgatcatactctttcaggtactactttccacttcacaagccttactctttctcataacaaaggcttttcccaagttatttccgtctggaagtccttccataccgttgtctttatgcatcatttaaaaatcatccttggccaggcgcgggggctcatgcctgtaatcccagcactttgggaggccgacgtgggcgaatcaagaggtcaggagatcgagaccatcctggctaacacggtgaaacctcatctctactaaaaatacaaaaaattagccaggcgtggtggagggcacctgtagtcccagctacttgggaggctgaggcaggagaatggcgtgaacccaggaggcggagcttgcagtgagccaagatcgcgccactgcactccagcctgggtgacagagcgagactccatctcaaaaaaaaaaaaaaaaaaaaaatcatccttaagcatttctttcttgaaatttccttgtccccacttcctaccccttcccagacagatttagatatgtattttctacatgtccacagtatctggcacacgagtatcattagcatttgtcacactgcattataatatttgatggtggggttattggccattaaacagaacttcttaagagtaagggccatgaattatctgaattatcctccatgaattatcccccaatacctggtacagtgattggcacatgatggggattgaatgaatggttgatgaatgaaggaaggaatgcatgaacaaattagtagatttgaatcggttttacactagaataatttcctctttgctctctgcaaacacgtatatgaagaagcacttgagtgtcagtatgtatagtgttaaaatcagtgtaagctttagagctagaatgcctgggctcagattcttgcgtcttcacttaccagttgtgtaactgtgggcaaagcacctaaccttctgtgcctctgttttctcatatgtaaaaagatagtggtaatagtttccactttgctaagtgtttacttctttaatcttcaccaactctgtcataaacataattattcttatttcttaggtaagtgaactgagactcagaatgcttaaataacttcctcaaggtcacacgggttctaaaatggggagctactattctaattaaagattatctgatgctaaagccctcacagtttcagctgcactgagatttcacaattggttcttactggctggaagaaggatacagggaaatattttccttcccttagctaatttttgtcctaatgattactttctgtataagattgtaacatgaaccatgtagctttgagatattgctataattgtgctcactactgctaagctgtattgtttataccttcagatagttgaacatagatagttgagaaataaatgccaacattttcatttgaattgaaaaaaaaccacaaaaaccattatattaaacctttctatttgtgtagatattagcaattttccccaaaacaaaacaagatacattcaaattgtaaatagctcaaaatggcagaagtttattcaggatgaatttgttcaggatgtagttaaatggattctcttctccattcttgtgtgtcagattacctaaatagaggcagtggggtctccaaaactctaagagggcaacatggaagcagtagcagttcattgcccataattttctctgcagattagttcagagagcccacttagaaaggaggaaaaatgaatcaaaccaaaagttaaagcaactttctcaccttccggctctccacagatgctgctggctacagtgattctgaggattatatataactcatttaccatcccaaagtcatgaaagtagactttgtattaaaggacaattgaacaaactctggtatactaagaagcattaggagaatattagacaattgttgagtaggatatttgatatatgttctaagtcatgatgcgcatctgcatcgatatcaatttgttttcattaacttagacaattaaaatcaagaactaagttattttaagcaaacagcttcattttacattcatttatttctgctttgcatgaagcacagctgcattataatgtgatcaagcacaataaattgtgctctgttgtttatagatggaagattgtaccactcaggtacatgtacaattttaccacaagtgttttgaaagtacaagtgtgtgagattttcttctcttctgaaaataattcttactcagactttagaaactatggattttctacctcctattaccaaaaataaatgcaatgttctgggccaatggcctgaagttacttaactgaagttatttaattggtagtatcttttccaatgtttttgaaaaatatattgagtgaaatagctactgcatttaggatacttacagaatatagatatggatatatagatagatatgcagtgaacaactttgtaggtctcccctggggcacatgcatgacaattctctaggtttataaccagaagtagagggtctgtgttatagtaaatgcccatctttagatttacttgttactggcaaattgctctctacccaaattcaggataattcattcaaagagggtttatttacaaagattttcaaaggtgtagggagagggtaaaccaagtgataatgctgtgacctagggctagtggcagctgagctttggacactgctaggcccaaaaggatgataggagggaaagattccttaactctgaaagtcctgtagaaaaagttgccttcagaagagaagtaacctataattgagaaaacctggcagagagggagcctgggaaacaaattcctctttccagtctctcctctctacttccgctcttctgccaaagtccctcactggccaaacaaaatggtggccagaagacactggggtccattggtgttgaccatacaggttactttctcatagcagagagcacagaggatctggaaaggaaaactgagtatgtccagccacaaggtcaatccaagttgttagaagtatattttgtctgttgctaatgcctgctatagagtagtactccctagtatatttccatcatttaaaaaaatctatcctgtttccttgtgatcaacttccaggttgcctccaattcccttctgccactaatagtgctgtaaggcactttttttgtatatgctctcttatgaacttgaagtcttcttaggggtctaaatccagtagcagaatcaactggtcttcgggtgcatgtgtatgcttaacttgaatgagggtcctctaccctcccagaagcagtgcacaagtattgcggtatcaccacatccttgccagcatgtagcagctttgtaacttctgccactgtagtaagtgtaagtgaagtttcctgtatacactatgatacattcatgtaaatgttaaacacataagtcacatattatattctttttttttttttttttgagatggagtcttactctatcacccaggctggagtgcagtggcgcaatctcagctcagtgcaacctctgacttcctggttcaagcaattctcctgcctcagcctcccaagtagctgggattacaggcacgtgccaccacattcatctaatttttgtctttttagtagagatggggtttcacaatgttggccgggatgctcttgatctcctgacctcatgatctgcctgcctcggcttcccaaagtgctgggattacaggcatgagccactgcacccggcccacacattatattcttataaatacatgtgtagtaaaatccaaaacaaacaaacaaaaaaaaaaaaaacaaaattggattggaaagctaccattggggataagctcaaaggatatttcgacttcatataaaattttatgtatataaaatgtttaaagaagtatggcaaaatatcaacatttatgcctattgttccaatgtaagcctttaggcttatttgtgtgttcacattatgatttttacaacttcactgaagtataaatgaaatacggtaaatcacactaattcaaggtgtacaatctgctaaatgttggcctctgtatacacccatgaaccatctcaggaagcacgataatcaacatcccatggtcccaagcctttcctctgtccccaggtaaccactgacctagctttctacatagaggtaatcatacaacatgtactgtgtttgtgggggacgtatgtggctgctgttactaagcgtatgcctttgatgttcattcttgttgcctgtatcaatagttcattcttttttattgctgagtagtgttttattgtatagaaatagcatgatttctctattcacttgtcagtaggcatttgagctgtttccagtttcagggatcttaaacataaagctactaaaagcattcatgtacaattttttgttgggacacatgttttcatttctcttggggaaatacttaggagtataacggctgagttgcgtggaaagtgctatttatttacctttctaagacattgtcaagtaaatttccaagcctgttatatcactttatatttccactagcagcgtttgagagtctcagtttctctacatcctcaccaaccacttggtatagtcaatccttttaatttcagccagtctaatggatacacagtgactgagcatgtccttgatgactaacaatattgagcatattttgtgtactttttaatgtgcttctatatcttctttttatgtactttttagtgtgcttatatatcttcttttgtgaagtgtctgctcaaatattttgtccatttttattaggttaattgttttattgttaagttgtaagcattctttatatattttataaacatgctttgtctatgtgtttcaaataatttttctcagtcagtggttagcttttccattttcttaaggctctgcaaaagagaaaatgtatttaattttgatgaaatccagcttatcatttttttcttttatggttttacttttggtatgctaatctaataaatgtttgcctcctccaagatctcctatgctttgtttgtcacaggttttatattttagggtttacatctagtcctatgatcaatttttagttagtttgtgtatgtgttatgaggtataaattgtctatttttttccatacagatataagttgattcagtatcatttgttagaaagattattctttccccatcaattgctttgataatttgtcaaaaataaattgaccgtatacatatggaatagaatagacggtccagaagtagactgaacagtctgagctgtacttctttatcttttgccaacctcaaactgcaactttatagccagtcctgaaatcaggtagcgtacataaggtctcaaagttttgtacttttttgttttttttttttttttttttttagttgtttgggctttcctaagccctttgcattgactataaatttaaaaaatcaacttgcccatttttaccaaaaaaaaaaaaacctgctggaattttgtttaggattgcattgaatctatagatcaacctggggagaattaccagttccaatccatgattctggcatatctttcaattacttaggtccttagtttctctcagcaatgttttgtaattttttagtgcagagtcataaataccttttattagatttcttcctattttataacttgacattaatgtaaatgaaatgttttaagaattctatttttcaatattttcagctagtatataagaatataaataattttgtaaaaatcttgcatcttgcagattatatattatttctagttgtaattctatagattccttgagatttttgtataaacaataaaatatctgagataggaacagttttacttcatcctttctgatccttttgccttatatttaactttttttaactttagtaaaatgtttaatagacttgatgaaagagtgaatcttcttcaccttgtcctccatctcaagggaaagtaattcagtttttcaccattaagtatgatattggctatgagtttttcataaataaccattatctacttgaggaatttcttactattcctaatttgctagctttttaaaaattatgaatgagcattaattttgtcaaattatttttctgccaatattaaaataatctttttttttttagaccaggggtaggcaaactttttttaaaggccagaataaatatgttcaggtttgcaacctaggaggcaaattcaaggatattatgtaggtatttatataaccatttaaaatgtaaccatttagaaatacaaaattattcctagcttgtaagcataataaaaaacaccaggagcctggccatttttggtctatagactacagcttgacagtgtctgttttgtactattaatacctattgtgatatttttatatagttggatttagatctgtcattttattatgcgttttctctttgtaccatgtttttgttgctctgttcctctctctgtctctctttcctgcctttttaggattatttgaatatgtttgtattgcatgtgaatgtatctcttagctatcagctattcttttgtattgtttttgtggttgctttatgtattacaatatatatacctaacctttcacagtctacttggagttattattgtaccacttgacatctaatgtagaaaccttggaaccatagaggtctctttgccacctcctacctttattttatagttgtgatatgggctatatctgtattcattgaaaacttcacagacactggtataattttagtgctaatgagctatacatatttaaagaacttaagaggaaagcacagtttttacattacccagataggaatcatttctattgcttatccttcatcttgaagttacaggtttcctcttgtatcatttttcttccatctgcagaacttccttcagcatttctggtagagcaggtataagataatgaattttcttaattttttttaaatctggaaatgtcattttgacttcattcttgaaggatattttcattgaacatagaattctaagttgacagttcttatccttgagcactctaaagatgctattctactgtcttatgaccttcatagtttctggtgagaaatttgtgataatttgaatcattgtttctatggatgtaaggtattttttcctagctgttttaagtatttcttctttattattggctttcaacagttggactatgatgtgtttggtcatggtttctttgaagttatcctctgtgtgatatgttgagattctagaatctatgacttctactaaatttggaaagtttttgtcccttatttcttcaaatatattttctgttttaatctttttctccttcccttctggaacctaaagctcacatttcttatgttatgcagtaccttctgcattttgttctgtttcctttttttccttaaccatctttcttatgacattatcctattttatacaagccatgttctattgtgatgcattaaagagttgagtttcatgaaattttgtgctgcaacatacaagtacacaaatttcataaatctgtgctgtctctgagtctactccagatgctatcttctccttgtttgtagttcttttttattggctccaggtggcatttttaattgtttcttatcctcaaacaaagcaagatctcacaagagtcagtgtcagtcaagagacgcaatgatgaatggagctggcccagtgtcctgtgcacagatctagtggccacattctttctcagatcagcagtggttaatgtgtggcactcccagccaaacttacggtttctagtggtggatactttcttctccccagactgtccggtcttctaattttcccaaaagttggaacatccggatcacatttctttttgtctcttccctagagtatgttaattttggagtctgggccttgcaagttgtgctgtagctttgcttcgagtctcacatatgcctgagttcaaggctggcctccaattatccatgttattttgagaaactcgcttaatctgtcttagagtcttctttggtaaattcaggccaataatgtctccattatacagtgaggtaatatgaagaaattctgaaataatgcaagtggagcatttatcctggagcagtgaagttcacggtaactcaaactgtggctgctgtggtctccagcctcagcaatatggccatccttagtgcattttgccaccaccaatctctaactctgtctaaaattttgggagatttacattcttaggaagtggtcctgcttctgggctggaaaatacaacaccttctgcaggaagtagggctctcagggttcagtagggtcagcactctggacttctgccttgtagtcaggggacagctgtctccatatccattttagagaaaaattagaagagatagatttgggttcaggtagccagatataattttaaatcagaatgcataccccatagccacatttttgagcagagaaagcattatgtacatctatcttctttagctatctttggtctttttgttttaaaatccaggttgacatctggcttttgttaagtgtggcactgccggagttctgattattcatatcctgtccacccactcctgcacatctcctctgtttggcctaacctctctctctcactatgatatttgttgagcaaaagagctttgagagaataaaattttctgaaaaataaggaaaaactgaaatatgtttatatttataggctttcactcatgtctatgtcatcattcttgtcatttttagactgatgtaccattctgtgaacagcaaatgtgtttacaaggtgcaaactgtgtgctcatctaacttagttaaattatctaaaatgaccaacctcttcagacatagacaaattattacttttccttgtcattttgttagtagattctatatagcatttttagaccactgcagtgttcaagataataatattcaataaattataaatcaattttctcctcgttgtagaaggaagctaattgtcagaggtaatatctattaagcttcctggattaaattcatttaaaatgtgttctgttagaaaatgtgataacactttatttttagtgaccattagctaatactaaattacagcataacgcctctggaagtgcatgtgacgtccatatgaataccaaatgaactcataattatctatactataataatgaatatcaaaccaatttataatgatatactgaaaatcaaatacttctgaaattttatgttctcatcaattttaaggacgagacatgaatctagcttgttagagcaattgctggcagtcaggaagctgcgctgtgcccagtctgcaattttgttttctggtatttctggcaccagcacaatgattccaaaaactgaaaaatgtaacaacagtatgctggggaggagcataggtattcaagaaagggggtgcgtgtttctaggtatgataatgagagatttttaaaggatagaatgaaatgactatcatgtttcaaaagaagttacaacacatatgtattagttcattactaagcaactgaagaatataatacaaaatgttcagttgattaatttggaaaagtatgccaccccaaagcaggcttggccaatgacttaggaagtaaagtcttctttttttatttcaaatataaagtcattttctaagttcccctcttgtattataaaagagtaattttattgggttcataggttgtctaacttgatgtaataattaatagttatttaatattaactgattgatatttaataaaaatattgtagtgattggggtgtaaggctgccattgcaaagatgagagagactagggagtgattaggacaagtaactgggtcagcttgacctagaggggatgaagccctacagaagctcaaaaggcagaaaggagttagaggtagaccactcccactaccaaaagaaataccatttgggatgagctttctagaatataaagttgtaacaagtagcagtttacgaggcatattttagacgaagaacatagcatgaacaaattcatggagacaaaatagtactgtatgcttctagaaaaacaatatctttttgattaagaaaatattttgtgggtttgtagagttcatgcctgtgatttatgggaaggaactacaaagagacagtatgggattcccaatgtccagggtccagatacgaagttgggtgttaatttccctggtactgagcaaaggagggagtgagtgccccaaaagagaaaaggatcaaaagttcttgttacgaatgatttgagccatgctccagaaaaacgtttctcgtagcaccatgcaaaatggaatagatctagttatagaaactagtagagttcccagctaagaggccagtacaattattagaggcaagtagcaacccatggtggcactgggaagaggaagaaaagatacagatgtaacagacaagggtctgtgatattgtcaggctgcgggttcaaaatgagagtccttccacaaagtactgttgtagttgaatgaatcaatattaattgaatgaaagcattgtgctgaattttactaaattaggtttgtatagaaaaatgtaacctcatgtatatgtattaccctagtgaatatgactcattaaaattcatttaaaatgataaacatttaaaatgtaaaatgtgttacatgatgtaagtagtacaaatagctgtataacagggtcaatatattaaatatatataagatttaaacatataactattttattaaaataatctgtgaatatctagatcttctaaaaagatgatctctctgccatgcccagagcacagtaggtccactgacccccatgtagtcttggccagagcggactcttccagtctcagctcttgatacttttccctcttcactcacaatctcatcattccgcttgccaagcattgatcttggcgcatagaaggtgttcactgttatttacagaatgaagagctaatgggaggaggaaagggaaaaagcaacaaaggaggaagggaggaaagaaaggaggaagtgagggaggaagggaatgagagaggaagagaggtgctctgtatctactatctttaggaccttgcacaattaattaaactccccgaagcctgaatgcttttgtctgacaaaagaaacaataggattgctatgaaaatttaaaaaatactgtattatggcatctgcactctattgggctgatagcagcagctggaagattgctccccatcgaatcacgccacagtttaccatagacacagcacctcccctcttcctctggtctattatgagaactctgtgatggcagagatttccatgggacttgagaagttatggatggatgagtgtaagggatgaaatcactactttttagttttttatttctagcattttccagtggatttttattaatccatctgcattcccttacctgatgactgggtatgcaatgtggaaaagaataatctaacacttcactgtataaaaattgtagcttggcctcctaagtacagttctctgagcaatcagctacataccaggtcactatcacatactagtaaataaggcactctgtcactttcagtagagtactactaatttggctatcaaaattgtgtttttaggcagctgaacagaaggtagagttcattagttcatgtttaaattagagcttgttttcattctagataatagggagaacaaatgctattatttttaaattctatggaaatgtgaaaataaatgctgttcatattatatctgcctaaggctttcataaaaacagttaatttccaaaataatgtatctattatattttatgtttatgaggataatttgaaatatatatttctactcagggacttttgaactaagcagtggaacaaactgcaataattagctgaactacaaaccaaacttgaatgttaatgtgtttttacataaacaaactcttgttacaaaatattgcttgagaaacttagaaaatttttttaactttgcagctaaatcagccagccttgtcacgtagacccaggagagacagagtggggagggaagaggcggccggatcctgcacaatctcatctcctgctagaagaccggggggagcagtgagggccgccaggtggtggggcagggcagtagggaaaatcctcttcatgattccctccaatatctgtggtcagtgtaagaaggaagtcagtactgaaagcctcactatatccttatccatcttggtttcctccggaggctgtctgatttgttttctggcttcctccatttctctgacctctgggggtgttttgcttcctcttcttgacacttttgttcatcaaaattatccagggaactttgaaacatggagatgcttgggctacaccgccagagaggctgactcttgctgtggggtaagacccaggcattggtgtctttgaaaagctccatgtgaaaagtaagcaaattcttccccctacccccatttacttttagttgacatgtaataattgtatacacttattggatacagagttatatttccacacgtgtatacaatgtgtaattattactgagacatgtgggaatcctgtttcttagtcttatttgggagaaagaagtctgccaagtgactgatttagccaaaaaagagaattaattgaaggaaaacagaaagcagagagtttatttagagacacagtacactttgaaagatgaggcagagcggactgctgaaagccagaggcccccctcaccccaagagttctgcattgggttttgatgacgttgaactgtttcctgaagttcgccgctgtcttaagtctctgccatttttccttgtctagttttctggctcctgccttaagtccccgctttttccacgtctagtccccactccaggcttgtgggaccctcccttactatgagttggtgcacatgtgtgggccggtgttggatatgaattgcacccggggtctcttaggaatttccgccttatcagcatgtaggttaactgcagagggagcagtgcctggggggtcttaaggattgctccttcctgcctatgttatttcccctccgccttgctcatatctagcatgcctgtttctggtggtccctggattgtgggatcctccagacctccctttcctcaggggctccccctcctgctcatgtctagctgtctgtctactctaacacagtgatcaaaccagagtaattagcatctccatcatctcagacatttatcattgccacgtgtaaggaacattcaaattcttttaccttttgtaaatataaaataaattattgtgaattcaccctgcagtgcagtggaacatattcctcctatgtagctataatttggtatcccttaagcagcccctccttatttccccccatccccaccagccttcccagcctctagtcaccacaattccactctctacttctatgagctcatttttttaactcctatgtatgaatgagaacatgtgatatttatctttctgtgcatgacttatttcccttagcataatgtcctccaggctcatccatgttgctgtgaataataggattttattctttttttatggctgaatagtatccagctgtgtatgtacaccacattttattcatctgctgatggacattcaggttgatttcatatcttggctactgtgaatatgctgcaataaatacagagatgcagatatcttttcagtatactgatttcctttcctttggttaaatacttagtagtggaatgccggatcatgtggtgattctatttttagtttttgagaagcctccataatggttttcataatggctgtactaatttgcatttcccacatccttgccagcatttgttatttttttacttattgatgatagacattctaaccagagggagatatctcactgtggtcttgatttgcatttccctgatgattagtgatgctgagcatttaaaaaatatacttgctggccatttgtatgcctttttcttcaggaatgtttattcagatcctttgcccattctaaaagtcagatgagtttattttcctattgatttgtttgagctccttgcatattctggtgttcgtcccttgtcagatgaatagtttgtaaatattttctcctattctgcagattgtctcttcactctattgactgcctctttagtttgataaagtcccatttgtctatttttatttttgtaatctgtacttttaaggttttaggcataaaatctttgctatgccaatttcttagagcattttccctatgttttcttctagtagttttatagtttcagtttttacatttaagtctttaatccactttgaattggcttttgtatgtggtgagagataggggtctagtttctttcttctgcatatggatatccagttttcccagcacagtttagtgaagagtgtgtcatttccccaatgtatgttcttggcatctttgttgaaaattagttgattgtaaatacatgggtttatttctgggctctctattatgatgttccatttgtttatgtgtctgttttcacaccaataccatgctgttttggtaaccataggcttataatatattttgaagtcaggtagtgtgatgtctccagctttatggttttgtttttattttcttttgttttgctcaggattacttttggctcttaggggacttttttggttccatataaattttatgattgattttgctagttctgtgaagaatgccattggtattttgatagagattacattgaatatgcagattactttgatttgtatgatcatttttacaacatgaattcatcccattcataagcatgagatatcttttctttttttgggggagtggggtcttcttcaatttcttccgccagtattttgtagttttcatcatagagatcattcaccttcctggttaaatttattcctaattatgttatttttgtataactattgtaaataggattactttcttggtttctttttcagttagtttgtttttaagtgtatagaaatactactgttgtttgtatgtggatttgcatcctgtgcctttactgatttcccttatcagttctatgaattttttggtagagttttaatgtttttctatatataagatcatgctctctgtaaagaggaacattttgatttcctcttttccaatttgaatgtcctttatttctttatcttgcgtaattgctctggctaggacttccagtactctattgaatagagtggtgaaagtgggcatccttgtcttgttccagcacttaatggaaaagatttctcttttttcctttcagaatgatgctaattgtggatctgacacatatagcctttattgtgctaaggtatattcctactataccccatttgttgagagtttttattgtgaagagatgtagaattttattaaatgcttttttttctgttgtccattgggatgataatacagtttttgtccttcattctgttgatttaatatatcacatttattgacttatggtattgaaacattcttgcaaatcgataccctaacatcacaactaaaagaactagagaagcaagagcaaacaaatccaaaagctagcagaagacaagaaataactaagatcacagtggaactgaaggagatagagatacgaaaagtccttcaaaaaaatcaatcaatccaggagctgggtttttgaaaataattaataaaatagatagactgctagctagactaataaagaggaaaagagagaagaatgaaatagacacaataaaaaataataaaggagatatcaccactgaccccacagaaatacccacaatcagagaacactataaacatctctatgcaaatacactagaaaatctagaagaaatggataaattcctggacacacataccctcccaagactaaaccaggaagaagtaggatccttgaatagaccaataacaagttctgaaattgaggcagtaataaatagcctaccaaccattaaaagtccaggaccagatggattcacagccaaattctgctagaggtacaaagaggagctggtaccattccttctgaaaatattccaaacaactgaaaaggagggacttctccctaactcattttatgaggccagtatcatcctgacataaaaccctggcagagacacaacaaaaaaagaaaacttcaggccaatatccctgatgaacgttactacaaaaatcttcaataaaatactggcaaactgaatccagcagtgcatcagaaagcttatctaccacgatcaagtgagcttcatgcctggaatgcaaggctggttcaacatagcaaatcagtaaacataatctatcacataaacagaaccagtgacaaaaactacagttatctcaatagatgcaaagtccttcaataaaattcaacatcctttcatgttaaaaactctcaataaactaggtgttgatagaacgtatctcaaaataataagagctatttatgacaaactcacagccaatgtcatactgaatggacaaaagctggaagcattccctttgaaaactggaacaagacaaggatgccttctctcaccactcctattcaatatagtattggaagttctggccagggaaagcaagagaaagaaatcaaggtattcaaataggaagagaggaaataaattgtctcttttagcagacgacatgatcctcctatatctagaaaaccccaccatctcagcccaaaagtgctaagctgatatgcaacttcagcaaagtctcaggatacaaaattaatgtgcaaaaatcacaagaatttctatacaccaacagtagacaagcagagagccaaatcatgaatgaactcccattcacaactgctatgaagagaataaaatacctaggaatacagctagcaagggatgtgaaggacctcttcaaggaggactacaagccactgctcaagaaaataagagaggacacaaacaaatgcaaatatattccatcctcatggataggaagaatcaatatcatgaaaatggccatactgcccaaagtaatttatagattcaatgctattctcataaaactaccattgacattcttcaaagtattagaaaaaaaactactttaaaattcatatggaaacaagagcccatatatccaagacaatcctaagcaaaaagaacaaagctggaggcatcacactacctgacttcaaactatactgcaaggctacattaaccaaaacaacatggcactggtaccaaagcagatgcatagaccactgaaacagaatagagatctcagaaataagaccacacatctacaaccatctgatgttcaacaaacctggcaaaaacaagccatggggaaaggattccctatttaacaagtgatgctgtgagagaactggctaaccatatgcggaaaactgaaactgggtcccttccttacacattatataaaaattaactcaagatggattaaagacctaaatgtaaaacccaaaaccacagaaaccctagaagaaaacctaggcaataccattcaggacataggcatgatcaaaggttttatgatgaaatcaccaaaagcaattgcaacaaaagcaaaaattagcaaatggaatctaattaaactaaagagcttctgcacagcaaaggaaactgtcatcagagcaaacaggcaacctgcagaatgggagaaaatttttgcaatctacccatctgacaaaggtctaatatgcggaatttacaaggaacttaaacaaatttacaagaaaaaacaaacaactccatcaaaaagtagacaaaggacatgaacagatgcttctcaaaagaagatgtttatgcagccaacaaacatgcaaaaaagctcaacatcactgatcattagagaaatgcaaatcaaaaccatgatgagataccatctccaccggtcaggatggcaattattaaaaagtcaggaaacaacagatgctggcgaggctgtggagaaatagaaacacttttatactgttggtgggaatgtaaattagttcaactattgtggaagacagtgtggcttttcctcaaggacctagaaccagaagtatcatttgacccagcaatcccattgctgggtatatacccaaaggaatataaataattatattataaagatacatgcaaatgtatgtttattgcagtactattcacaatagcaaagacatggaatcaacccaaatgcgcatcaatattagactggatcaagaaaatgtggtacatatacaccatggaatactatgcagccataaaaaagaatgagattacttcctctgcagggacatggatggagctggaagccatcatcctcagtaaactaacacagcaacagaaaaccaaacaccagatattctcactcatgagtcggagctgaacaatgagaacacatggaaatggggaggggaacaaaacacaccagggtcagaggagggagagcatcagggtaaatagctaatgcatgtggggcttaatacataggtattgggttgatacgtgcagcaaaccaccatggagcatgtttacccatgtaacaaacctgcacattctgcacatgtatcctagaacttaaaattaaaaaaagcaaagcaaacaaacaaacaaacaaacaaaaaaatgaaacattcttggatccctgggatgaatgaaactggatcgtggtgtactatctttttcatgtgctgttgaatttgatttgccagtattttgttgatgaatttattgatgaatttccctatgttcattgctaatattggcttgtagtttcctttatttgttgtctttgtctggttttggtatgagggtaatgctggcctcatagaatgtgtttgggagaattctctcctcttcagtttttcagaattgagaaaaatctgtgtttggtcttttttaaaagttcggtagaatttgtcagtaaatccatttgggctttttttgaggggagactttttattatggcttcaacctctttgttcatcattggtctgttaaggttttctagctcttcttggctcaattttggtaggttatatgtgccgagaaattcatccattttctctaggtgttccaatttgttggcatatagttgttcataatagtccctaatgatcctttgtatttctgtggtctcagttgttatgtctcctttttcatttctgatttaaatgtatgtgggtcttctctatttttttctagtctagctaatggtttttttcataattttaaaatattctccaaagaaactatttttaaattttttgtattgatacataatagatttgcatattttctgggtacatgtgataattcaatacattcatgtaatttgtaaagatctaatcagtgtgactgtgatatccatcaccttaaagatttgtcttttctttatgctagaaagatttgaattattctcttcttagctattttgaaatatgcaatagatcgttgtatgctatagtcaccctacagatctatcaaactccaggccttattcttctatcatattgtatatggctatatgtatgtatgtttttattttctccccctactccccactctttccaacctctggtaacaaccaatttgttttcttcttaataaggtccacttttttttttagctcctacatataagtgagaatgtatggtatttgtctttctgtgcatggcatatattacttaacataatgaccatgagttccatccatgttgctgcaaatgacaggatttcatccttttttatgctgaataatactccattgtgtatatatgctacattttctttatccagtcatccactgatggtcacttacgttgattccattgtttgcctattgtgaatagtgctccaataaacatgacaatacagatatctctttaatatattgattccctttcttctggataaatacccagcagaggaattgctggatcatacgggagttctatttttagtattttgaggaaccttcatacagtttttcttactggctgtactaatttacattccccccaacagtgtaaagagttccccgttcttgacattcccaccggcatccttaatttcctttttggtaaaaggcatttaactggggtaagatgtttcattgtggtttgaatttgcatttctctgattatacacccattggctatttgtaagtcttctttggagaaatgtctattggatcttctgcccatttttaaattgtattatttactttttgttattgagttgagtcccttataattctggttattaatcacttgtcagatagatagtttgtgaatattttctcccattctgtgggttatctcttcacttggttgattgtttccttgctgtgcaaaagctttctagcttgatataatcccatttgtccatttttgctttgatcgtctttgcttctgaggtcttacacaaaagatgcttacctagactcatgtcctggagcattttccccaatgatctctccgggtagtttcacagtttggggtcttaaatttaagcctctaatccatttttatttgatttttgtagatggtgagaggtaggggtctaatttcattcttctgcacacacatgtccagttttcctagtaccatgtattaaagagagtgttcttttcccattgtatgttcttggcaactttttcaaaaatgagttggctgtaaatgcatggatttatatctgggttctctattctgtttcattggtctatgtgtccatttttatgccagtaccatgctcatttggttgctatagcttcgtaatatatattgaatctagtagtgtgatgtctccagctttgttttgttttggggtattttctctgctcaagatttctttgggtattttgggtctttcatgattccatataatcttcaggatttaaaaaaatatatatttctgttaagaatgtcattggtattttgataaagattgcattgaatttgtatgttgctttgggtggtaactttaacaaaattagttattccaatccatgagcatggagtatctttttatttttttctggtctctccaagtccttttatcagtgttttatagtttcccttgtatagatctttcactccttggttaaattgattcctagatattttatattctttgtaacttttgtagatgggattactttcttgatttctttttcagattgattgcttttgacatatataattatgactgatttttgtatgttgattttgtatcctgcaactctactgaatttgtttattagttctaatggtttttttgcagtaaatctttaggcttttctatatataatatgatatctttgaacaagactaatttgacttcttcctttccaatttggatgccctttgtttatttctcttacctaattgctgtagccaggacttccattattacattgaataaaagtagtaaaagtgggcatccttttcttgttccatatcgtagaggaaaggctttcaattttccctgttcagtattatattagctgtgagtctttcatatgtggcctttgttatttttaagtttatttttctataccagtgtgttgaaagtttttatcataaaggaatcttgaattttgtcaaatgctttttcagtatctacatggtttttttcttggtactgttaatatgatgtatcacatttattgagttgtatatgtggaaacctccttgcatccctgggatgcatgccacttgatcatggtgtattatctttttgaagtgcttttggattcagtttgctagtattttgttgataattttttcatatacgttcttcagtgatatgggcctatagttttctttttttgttgtgtccttgtctgattttggtatcagagtaatgctagccttacagagtttgcaagtattctttcttctacaaaaaatttttgaagagtttctgtttaattgttttaaccaatttttgattgaattgttttcttattgatttatgagagttctttttatatatctggattcaacttctttatcagatgtatgctttgcaaatattttcttccagcacacaagttgtctttttgttctcttaacagtgcctttcaaagaaaagatatttttaaaatgtttacgaggtccagttttatcaatttattctttcatggatcatgcttttgatgtcatatataaaaaaaaatttgcctaacccaaggtcacaaaattttttcctaggttttcttctagaagttttatagttttatgttttacatttaggtccatgatagtttgagttaaattttgtttatgccatgagatatggatcaatttttgcagttgatatgatatgcagttgtttcagcaccatttgttgaaaagattatccttcttccattggattgcctttgtacttttgtgaaaaatcagttgtctccaaggatatacagaaagcaaataaacatatgccaaataccacatgattagttcattaggaatgaaaattaaaataacagtgataccactacacacctattagagtggctacaatgaaaaagacttattatgtcatgtgttggtgaggatgtagaggaattggagcattcatccactgttgatgggaatgtaaaatggtacaaccaatttagagaacagtttgccagtttctcaaaaagtcaaagatacaaatgccatatgtagagccatttcacttctaggcatttatccagaaggaaagaaaatgtatgttcatacaatgacttcgacatgaatgttgataagggctttatatgtaaataccctaaactggaaataacccaaatgttcacctacagttcttgggtaagcaaatgatgatgtacgcatactacagactactactactcagcaataaaaagaaatgaattactgacacacttaacagcatggatgcatctaaaaaaagtaatgttgaataaaagaaaccaaacaaaaaggagtacgtactttatgtttccatttatataaaactctagaaaatatacgtttattacatttatagtgacagaaagcatggggtgggagaggtaagagaggaatcgtaaagaagcatgagaaaacttttggggttgatgggtatgttcttcactgaagtgatagtgtttcatgggtgtacacatctgtcaaaacttatcaaattgtatactttaatagtacatttttcaatattaattttacttcaataaagcttctaaaaacacacaatttttttttgaagagtttgagtataattggttttagttctttaaacatttggtagaatttagcagtgaagcaactgggtcctgggcttttccttgataggagacttttcattatagcttcaattttgttacttactattggtttcttgaaattttccatttcttcatggtttaatcttagtagattttatgtgtccagaagcttatcatttttttctaggtttctaatttgtagttgtatagttgtttataataatctctaattatttgtatgtctctgatcatatttgttaagtgtccttttcatttctaattttacttatttggctcttctctctttttttctttgtctagctaaaggtttgccaattttgcttatctttaaaaaacagccttttacatcttcagatttctaaaatatttttgtctttgtttatttctgctctcatctttataaacgttctaaaaattttgggtttagctttttttttcttgcttttctaattctctgagatacatcattaggttgtttatttgaattctacttttgatttaggtgtttattgctgtaaactttcctctgtgtacagagtttcctgtatctcatatgatttggtatatgtttagtgtttttattttcactagtttcaagactttttaatatttacttcttaatttcttcatagacccatttgtcattcagaagcatgttgtttactctccgtacatttgtattttcaaagttcttattatttctggttttattacattgtgatgtgagaaaacaataggactttcatttcttgaaatgtgttgagacttgttttgtggcctaatatatggtttatcctggagaatgtttcatgtgctgatgagaagaatgtgtatattacagttgatgaaatgtcttgtctcttaggtacatttgctctgtagtgcagtttaagtccagtgtttcttggtgaattttctgtctagatgatttttccaaacctaaaagtggggtattgaagtccccagcttttattgtactgaggtttatctgtctctctttagctaatatttgcattacatttgtgggtgttttggtgttgtgagcataaatatttacaattgttagattatcttgctaaatttatcattttatcagtatataatgactttctgtatctttttttttttttttttttttttacttaaagtctgttttgtttgatataattacactactcctgcacactcttggtttccatttgtgtggaatattttcttccatttgtcttagtccatttagagttgctttaaagaaatatccaaggctgggtaattttggggaaaaaaaaggttcgtttagttcatggttctactagaaagttcaggattggatttctggcaagggcctcaggctactttcatcatggtggaaggcaaaggtgaacatgtgtgtgcagagattacatagtgagaggggaaacaagagagagggaagggaggtgctaagctgtttttaacaaccagccttcacataaacgaataagaatgagaactcacaactgggcgcggtggctcacgcctgtaatcccagcagtttgggaggctgaggtgggcagattacctgatgtcaggagttcaagaccagcctggctaacatggtgaaacccagtctctactaaaaatacaaaagatagccaggcatggtggcacactcctgtaatcgcagctactcggggggctgaggcaggagaattgcttgagctgggaggcggaggttgcagtgagccgagatcatgccactgcactccagcctggccaacacagcgagactgtctcaaaaaaaaaaaataaataaatgaaaaaaagagaatgagaactcacttccctggttgggagggcgggcgttaaactcttcatgagggatctgcacccatggctcaaacaccttccattaggccccacctttaaaattggggatcaaatttatacttgaggttcagggtgacaaatatccaaactatagcaccagcccttctctttcagaaagtctgtttccttgtaggtgaaatttcttttcagcaggatatagttgtttcactgtgtttgttttgttttatttatcatgtagccagtctatatcttttaggtggggaatttaaaccctttacattcaaagttgttattgtattcattttgctaattgttttctgattattttgtatatcctttgtttctttcttcctcttttattgtttatcttttcagtcttgtggttttctgtagtgttaatgtttggctcctatctctttctcatttgtgtattgtggcagaatatgaaactctgccaatgagttttatattttcatgtgttttcatgatggtagatatcatcctttcactcacacatgcagggttcccttaaacatttcttgtagcactagtctagtggtgatgaatttccctcagtttttgcttgtctgggaaagattttatttttcatttatttatgaaggatagctttgctgggtataacattcttggctgatagttgttgttttttctttcagtactttgaagatatcatcctgttctctccaggcctgtatggtttctgttgagaaatctgctattagtctgatggggattctcttgtatgtgattggatgcttttctcttgctgttttcataattttctcattgtctttgacttttgatagtttaactataacttgccttagagaggaccgttttgggttgaatctatttggggatttgaacttcctgtatctatatgtctaaatatctttctagacttgggaaattttcagctattatttcgttaaataaattatctaggactttttctatttattgttcttctggaactcccaaaatgcaaaacttttttcacttcgtggtgtagtgatgtcccatgtgtcggataggctctcttcattctgttttattctttttttttttttttttgactacgtaattttaaagacctgtctttgagttgagaaattctttttattcctgcttgatgtagtctgttgttgaagttctcaattgtatttttttttatttccctcattatatgtttcagttacaagatttttgtttggttcttttatatgctatttcttttttaaaatttctcatttggataatgaattattttcctgatttatttcttctgtaacctgttgagttttcttaagatcattattttggatttcttttcaggcatttcatagattttcttttcttttcactgttactggagaattattgtgttcctttggaagtgtcatgttttcttgtttttcatgtttcttgtgaacaggaacatttctttctgagaaattagagatcattgaaaattgcaagatagtataacttaatgtttgttatcatatattgaatattaccaaatttaaacttcaagttcaaagactactgggagcaaaatgaaacatacttcaacattactgttcttcaaaatcaagccatcaccagtgctgtattagtctattttcatgctgctgatgaagacatacccaagactgggcaatttacaaaagaaagaggtttaatggacttacagctccacatgcctaggaaagcctcacaatcatggcagaaggcaaaaggcacttcttacatgacagctgcaagagagagaatgagagtcaagctaaaggggtttccccttataaaaccatcagatcttgtgagacttattcactaccatgaaaacagtatgagggaaaccacccccatgattcaattgtctcccatcaggtccctcccacaacacatgggaatcatgggagctacaattcaagatgagatctgggtggggacacagcgaaactctatcgagtgctcacacatgcagaagaattgcatagacttgccataagtagaatctcaagctcaattttgtttataaatgtattaacttaaacaatctttgctattcactcaacatgatatgtttttggtaaggcttagtgtgtctcaaagctattaatatagtgatatagccaattccattgagcaagcattgccttgcagtgcctaaaaatatactcagaattggtagtgagaggacattctgatactgaatcttgccaaacacactatattgcagaaaatgttactatattatccaaaaggtaaatgatcccttgccaatttattgtttccattataattttatattttaattacttaatattatatattgctttgttaagcatgcattctaaatattgcttctgttgttaatagactgctttaacaattatcatggtattaaataaaaagcaaataattcatttgaaaagtatatatctgtaattgttcagaatttttttttttttagtttggcttatagagagacccatttactttcatggtcttactaagatgtgcatttctaaaatattttagaaatcatgcatctatacaactgggttaagcattcaatagagagaggtcaaggccatcttttcagtttctgacttaaataagagaagcatttgaaaaaggatacttttctcatgagaacgagataaatgagttgaatttgaaatacactgagtttgaaagtgccagagtagaaaaggaataagttgatttgaagttcaaaagaaaggtctagactgatgtcatttgtcagaataactgaaaaggcatgggtggagcttagacaatcctgatgaaccttgaagagcagcactgttcaatagaaatataatatgaatcacgtattattttatattcttctagtagccacattttaaaaagtaaaataaaattggtaaaattaactttaatgaattaacctgatatattttaaatatcatcttaacatgtggtatcagccacatttcaaacacaaccacaggtagctgctggctgctgtgctagacagtgcaggtgtagagagagaagggagtgctaagaacaaaacctgtgggatcccaacactgaaagaatgcgggaggatgcagaagaccctcacatggaggccaagagacacctatctagatctcagcttgtccacaggcggtgagcagcatcttcacatctatgtctcgggtgttactttctagatgggtgacacttgcagggtgaattaggagatctctcattctgtcagtgacgtagacctccctccccaaaccagtttccattgtaagtatggtcgtatttgccctaggttacaaattagccagagcccttgtaatgtaaggcttgtgggtatatttaccaaccacatcttaatcaaaatagtgtaatgtggtagcatccctgtaacaatattaaccatttagtaacatattctgttgtctcggttggaccaaaacttcaaatctaggaagtgaaaatttgagaaaagtataaaacaacaataccactcccttgcttagtgctttggggtttatttgcagtcattttttaatttttttttttattttcataggttattggggcaaaggtggtatttggtcacaagagtaagttctttagtggtgatttgtgagattttggtgcacccattacccaagtagtatacattgcacacagtttatagacttttatccctcacccccttcccatccttttcccctgtgtccccaaggtccattgtgtcattcttatgcatttgcatcctcatagcttagctcctacttatgaatgagaacacacaatgtttggttttccattcctgagttacttcacatagaataatagtctccaatctcatctaggttgctgtgaatgccattaattcattccttttttatggatgaatagtattccattgtaaatatataccacagtttctttatccactcgttgattgatgggcatttgggttggttccatgtttttgcaattgggaattgtgctgctataaacatgcatgtgcaagtatctttttcgtataatgacttcttttcctctgggtagatacccagtagtgggattgctggatcaaatggtagttctacttttagctctttaaggaactgccacactgttttccagagtggctgtactagtttacactcccaccagtagtgggattgctggatcaaatggtagttctacttttagctctttaaggaactgccacactgttttccagagtggctgtactagtttacactcccaccagcagtgtagaagtgttccctgttcactgcatccatcccaacatctattattttttaatttttttgattatggccattcttgcaggagtaaggtggcattgcattgtggttttgatttgcatttccctgatcattagtgatgctgagcattttttcatatgtttgtttgccatttgtatgtctttttttgagaattgtctattcatgtacttagctcactttttattggaattgtttggttttttcttgctaattcatttgagttctttgtagattctgtatattagtcttttgtcagatgtatagattgtgaggattttctcccactctgtgggttgtctatttactctgctgactgttccttttgccgtgcaaaagctctttagtttaattaagtaccagttaggcaatagtcaccaagcagcatggtactggtataaaaatgggcacatagaccaatggaacagaatagagaacccagaaataaatctgaatacttacagccaactgatcttcaaaaaagcaaacaaaagcataaagtggggaaaggactccctattcaacaaatgataattgcccagccacatgtagtagaatgaaactggattcttacctctcaccttatgcaaaaatcaactcaagatggatcaaggacttaaatctaagacctgaaactataaaaaacctagaagataacattggaaaaacccttctgacattgacctaagcaaggatttcatgaccaagagcccaaaagcaaatgcaataaaaacaaagataaatagctgagacttaattaaactaaagagctattgcagccatttacatccagtatctcatttgggcccagagccaacctgatgaggactcaaagattatttcaagggagggaaaagcacaggtaatgaggctttcttctttttggtgtttttctttattccttactcttcttgctcttctctacttctttcatctcatctctcctatcttttttcctcctttctcctattctttgttctccttattccttttccattaattttacatctcctgtatttgacgtgtgtgtgtgtgtgtgtgtgtgtgtcacttagctgattctagcatgttctggtaatgaatgttttctatctgttatattgttgaacactgcctttggtgctgggcttttattttacttcgatttaagcaatattttaaattcataatttcatttaagttgctaatttgcaaaatttatttagcgcctgctgtcagtctttttcttaaattaagaaccatacagtaaattagttcatactggtaattatattttctaaaattattgaagcaaatcaaacccagaatgtcaaagtattttctcaaatgaagctaagccaaacccattatttaagtttgttgctaattctaactgcaaataaacactcagtataatagatttctatactttttctggatcatggatcaggagccatggactattatagtcataaagaaacatcaagagcaactttttcaaatatctcattttatagatattcatgctaacgctcagaggggtgccctgatatgctcaagatcaggcaacaaatgagaagtagaggcaggtttagaagaaaaacttaagagagaactcaaacttactgccctacactctgttctaggcaaggcagagattgaggcccctcttctccttggctctctgacttctattttgtttcctgctctttatatctgactgtcattagtgggtggttctctatgttctctctctccctctctctctctctcctgcccatttctcctatctctctctgtctgtctgtctgtatgtgtcttctttctcttcttcctttctgtgtgtgatgttttatctctgtgtgtctcttttatctctctctgtcctctctatttgagtccagaataaagcaaaaggagtaagtggaatgtttccctatgaatcagatggcagcagaaagggatttgtttttcacaagacttgaaagtcccacgtgaagctctcccgctctgctccgtgcctggaccggctgctgctgtcagcaggccttgtttctcaccagcagcaggggcaagtgacagttgctttttctgcttcgggtttgattttgtgggcattttatcattggaggggtgaaatgttatgaaggaagatgacaacaacagttttttgtcatattggcaaacagggtcattactgtacattcgtaaccttagagaaatgagtttttactggactatcagaaactacagcacaggatataatgaatgtatcagagctcagaatttgtttttaaatgaaattacgtggaaaaatgtaccaatccttaatgaatgtaatcactgtgtttttcttcctggcatgtgtgtttgtgtgtgtgcgcgtgtgtgtttgtatatgtgtgtgtttgtgcatgtgtgtgtgtgtgtgtgtttgtgtgtgtgatcatgcatacacacaatccagtatcttccaccgggtgtccccacggcttctagcctttggggttaccctcttctctaatattaaagagaaactcaagccctcatcccacggactgtgagagattgggtggcttgttttcctccttcttctctccagtagtcccaaggatttttaggaggttatttcatttcttctggctcccgccctgtgactccctgttctgttggattctcagtccttcctttgcgtcttgtatccagcacatgacgttcccttccacgtgtgccacatgctgccctggattctttcatgtcccaaagtactgcgagtgcaaggtcctgcacgccacaaaatttcactggaggtttggggacaggcctggcgagttaagcacatcacagtgaaaggaaatcagatcagagtaaaatgaaatcttagacagcaatgccttcacaattcacctgcattttcctggcaggaggagtttctgggtgattttactgtcattgttgctgttggttttgcctgctatgcctcctttaagcctcgctgattattccacactctccccatgcactttctttttttatgttaattagctttatttaatcatgctacattgtatgcatatttcaagacattgtaccccataaatacatacaattataatttgttaattaaaaacttaaaaagaaatttaaaatgtagtggctgaaaagaataaacagaaatcaaataaccatgttagagattattgttaaactccataaaagttatcagtttgaactttaaaagaaaaaaagccagttgctttcattactagtttgagctttgctctacccagctgtaaaaattcctccctttctataataaatgtccactcaccctctcactagctgccagattcaaatcccaagctgctattcttttccatgtcaagcacttgagctattcaacccttacctcagagtagaatctaagccacctttgcagaaccaaaattgaagctttgctaaataaacagtctaaaactccctgtctaacctttcgcaccaaaagaaacctctatggaattttgaaatcatagtttctttaacatgatcaaaatcttaggcaagtttctttaatcagggttagagtagagctattctctccacatactgaataagacctaggggagggaggattatttttcagtttgtgaaaattatcactggtattgctttcaatatgacttcctgtccccctctcttcttcagggactcaaataacaaagtttattagacctttctttctgtttcatgcatctcctactatgtttacttttcattctatttttttttctctgcatttacctgggtattttgtactgacacttcatccagttctttattcccctattcagtgtggataaccagctcccaaacctatatattaaatccctaatttcaaaatattatagtgtttttccattctagaatttctatttgattctttctgtatgttccagttctttggaactggacggaaactcttcacattttcctctttttgaacatatttgtcataattaaagcccatatgttataatgatacctcattcacctgttgattactctgaattatttttttcttgggtttcagtcatttggttttggcttctggcatgacttgtaatatttgattgattcagtgccagaaatcgtatatggagggggcttcaagatagctaactggaggtatctggtacttgcctcctccacaaagaagaaccaaaatagtgagtagataatcaaactttgaatagattatctaagaaagacactggaattcaacaaagaagtgacaggaaacacctaaggcaaaaaaggagagagaagcaaggcagccagctcagctgggattggccaggagcccagagaggctcccagtgcagggaaagggtaagtgagagacccccagctgaccacattcccaccatggacttctgcaatcctagtgactcaacccctgcaggctctgagactaacatggggagctgcctggaaactctgtgaccgcattgctcgagagaagctcatgctggctcccacacacacccttatgtcttaagtggctacaacaaagtgccactttgagagcccagcccccagcagaatgcatcctgttctggggacccatggccccacatctttacatccctgaggcccattgatatcccccatccatagctgccatcgctgctggctgctgttaccagggccaaagcaccagcccttggcagcactctcaccaccagcagcagtgggctgttgtgcatttataagtgccctgaggacaaggtaccctgcctgccaccaccaccaggctgaagtgcacactccccagctgcctgcgtatggctgctgccactgaaaaagcaaccctgctctcctcagtagcagggccgcagtgcagccgctggttccccaacccaggcatttcactgggggcctggggatcaccctgtcactgcctaccacagccagtgcctgcaggcaccacttggggagcctgaggacagactcacttagcctggctccaccacctccagtgcctgagctcgccgtctgggtacctgaggattctcctgccctgtgcaccataggcacctgagcatctctcccagggacctaaggacaggcttacccaacctgccactaccaccacagctggcacccacctacatgtgctaccacctgtgggcctgaggactggcccacccagctcattgcagccgccacagaccccagcatggaccacttggaaaccagaggattgtcatgctgctactactgccattgctcacaccacacctgccatccaggtgcctgaggacccacccacctgcccagcccacagctggcaccggagaaagccacctggaggcccaagaatatgcctgcctggtcctgctagcgctagtaccagcatagcctaccctgaggctgaaggatgggtattcttggcccgtcactgccaccactggggcctgtggactggcctacctgtcctccttatctcagcaaaacttcaccatagcttctagtaataactaccgtaagccactgaggaaattacagataccactgatgctgtttacagccaaataaatcatagagaaactatactactgcatatatccagaatcaaagccaaagtgcactaccaaaccaacatcataggtacatcttgaggaaaaaatccttccttagcaagaaaattcaaacaactggagaagtgactgttgtgtcagatgtgcacatatcaatgtaaggacacaagaaacataaaaaagtggggaactatgacacctcaaaagaaatacaataattttctagcaacacattccaaagaaaacaaaatttatgaaatcctgggaaaagaatttaaaatagttatttgaaaggaattctgtgagatgtgaaagaaaacagataaataatacatataaatcagaaaagcaattcaggatatgaataagatgtttaccaaagagatagatattataaaaagcatcaaacagaaattctggaactgaacaatttattgaatgaaattttaaaatatgtttgaaagctttaacagtagactagatcaaacagaagaaacaatttcaaaatcgggagacaggtcttttgagataacccagtcagacaaaaaaaaggaaaaaggattaaaaaaatgaacaaggactttctgacatataagacaccataaagtgtccaaatatttgaaattttggtgtaccagaaggtgaagaaaaaaacaaacaaaaaaagggatagaaaacttatttagccaaataatagctgaaaacctcccaagtttagaaagatatttagacatacagatgaaggacatttactgatccccaaatagaaagtgtaaaacctatgggtaaaaataaatagaagactgaaatgttaccactacagaaagccaccaaacaacaatgctaaacattaacagagaaaaaaaaagatatagaaaacaagcagaaatcaattaataaagtgacagcaataagccttcacatatcaatgataaccttgaatgtaaactgattaaacttttcacttaaaagttatagactgactgaatggataaaatacataacccaactgtatgttgcctacaagaaactaatctcacctgtaaagacacatatagactgccagtaagtgatggaaaaaaatattccatgcaaatggaaaccaaaaacgggcagaagtagctatacttatatcagataaaataagctttaaataaaaaacagcaaaaaatgaaggttattatataataataaagggatcaattcaacaagaggggtaacaattttaaacatatgtgcacccaccaacagaacactcagatatgtaaagcaagtattagttttaaagggagagttagagtccagtacaataatagttgagggtttcaacaccccagtctcagcattagacaaattgtatagacagaaaatcaacagagaaacattgaatttaaactgcagtttagaccaaaaggacctttggtatttatagaatatttgaactgacagctgcagaatacacattcttctcatcagcacatggaacattctccaggatagttcatatgttaaacctcaaaacaagtctcaacaaattttttaaaaattgaaatcatgtcaagtattttcttagaccacaatgaaatcaaactagaaatcagtaatgatgaactagaaatcaataacaatggaaactcttcaaacacatggaaattaaacaacatgttcctgaatgaccactgggtcatggaagaagttaaggaggaaattaaaaaatatcttgaaacaaatgaaagtcaaaatgcaacataccaaaagctatgggatacagcaaaagcactgttcaaaggaaagtttatagtgataaatgcctgtgtcaaaaaaatagatttcaagtaaacaatctaatgatgtatctcaaggaaatagaaagtcaagaacaagccaaaccccaaactagtagaaggaaagaaataataaaggccagagcagaactaaataaaatagagacaaaaaaaggatcatcaaaacattgttttaaagatcaacaaaatcaataaaccactagctagagtaaccaaggaaaaaaaaatgaaaagaaaacctcaaataaaatcagaaatgaaaatggagacattacaactgataaccaccaaaatgcaaaagatcatcagaaactattatgaacaattatacacttacaaactggaaaacctagaggaaatagaaaaattcctggacacatacaggctacaaaaattgaatcagaaagaaatacaaaacctgaacagactggtaataagattagattgaaacagtaaaaaaaagtctcccaacaaagcaaagttctgcacctgaggctttactgccaaattctacaaaatttacaaagaagaactaacaccaattctcaaactattccaaaaaatcaaagaggagagaattctcattaactcattctaagaagccagcattacgtttattccaaaaccagtcaaagatggaacaaaaaagaaaactacagaccggatgaacatagacacaaaaatccccaacaaaatactagcaaaccaaattcaactgcatatcaaaaagataatataccatatcaagtgggatttatcccggggatgaaaggatggttcaacatatgcaaatcaataaacatgatacatcaaatcaacagagtgaaggacaaaaaccatatgatcatctcaatagatgtagaagaagcattggataaaattcaacaactttttatgttaaaaatttctgggaaagtaggcatagaaggaacataccttaaaataataaaggccatatatgacaaacacacagctaacatcatactaaatgggcaaaagctggaagcattccccttgagaacaggacaaggataccactctcaccactcctattcaacatgctactgaaagtcgtagccagatcgtcaggcaagagaaagaaataaaagacatccaaatgggagaagaagccaaatcatccctctttccagatgacatgtatgtgtgtgggtgtgtatgtatatctatatataatatagatatataaacatatatcatatataatctatatataaccatatataatcatacatataatcatataatatatataatcatatataatacatataatcatatatataatgattacatatatataatgtaatcatatataatcatatatataatcatatataatatataatcatatataatcatacataaaatcatatatataaaatatatataatcatatatataatcatatataatatatatataatcatatatatactcatatatatataatctatatatataatcatatatatactcatatataatcatatatatataatcatatatatatactcatatataatcatatatataatcatatatatatataatcatatatatatatatatatatatatatatatatatatacacccaaagattccaccaaaaatctcctagatctgataataaattcagtaaagttgcaggatacaaaatcaacatgcaaacatcagcagtgtttccattcaccaataataaactaactgagaaagaaatcaagaaggtaatccatttacaatagctacaaaaataaataaataaaatctagagataaatttaaccaaggaggtgaaacacctctacaaagaaaactacataacactgatttaaaaaattaaagaggacacaaacaaaggtcacccatgctcatggattggaataattaatattgttaaaatgaccttattacccaaagcaatctacaaattgaatgaaatccctatcaaaataccaatgtcatttttcacagaaagaaaatataattataaaatgtgtatggaactgaaaaagagcctgaatagccgaagcaatcctgagcaaaaagaaccaagctggaggcatcacactacctgacttcaaaataaactacaaagctttagtaaccagaacaggatggtattgatataaacacagactcatagaccagtggaacagaatagagaatgcagaaataaatctatgtgtttacaaccagatgatttttgacataggtgccaacaacatacatagggggaaaacacactcctcatcaaattgtgctgggaaaactggatccgtgttcagaagaacgaaactagacccttatttctcaccatatataaaaaccaatccagaatgaattgaacacttaaatgtaagacctgaaactaaaaactagaagaaaacagaaggggcaatgcttcaggagattggtctaggaaacgattttatggctaagaccttaaaaccataggcaaaaaaccaaaaatagacaaattggactatatcaaactaaaaccttctacacagcaaaggacacaatcaacagaatgaagagacagccttaaaaatgagagaaaatatttgcaaactattcatctgacaaagaactaatatttagaacatgcaagaaactcacaagtcaacagcaaaaaaccctaataatccaattttaaaatgggcaaaaaatccaaatgaacattcctcaaaaaaggacaaacaaatggccaagaagtatataaaaatgctcaacgtcactaagtattggggaaatgcaaatcaaaaccacaataaaaatatcatcttactccagtgaaaaagaccattatcaaaatgtcaaaaaataaatgccggtgagcatgtgggaatgtaaattattatagccagtatggaaaacagtatggaaatgactcaaaattttaaaaacagaactgccatatgatatggcaattttactactcggtgtttatccaaaaaaaaggaaatcagtatatcaaaaagatatctgcaccccatctttattgcagcactactcacaacagctatgaatcagcctaattattcctcagtatatgaatgcattttaaaaatgtagtacatatacatggaatacagtggaatactattcagccttaaaaaaattgaaatcatgtcatttgcagcaacatggaggactaggaggtcattatgttaagtgaaataagccagtcacagaaaaattaatagtgcatgttctccctcatatgtgggagcttaaaaaatgttggttttatggaggtaaagagtagaattatagataccagagactgggaaggatgtgcaggtagttgggcaggaatgaaggggttgtttaatgggtctgtacaattacacaggaagaatacagtgtaatgttcaatagcagagtagggtgactatagttaataacggtgtattgtatatctcaaaggagctagaagggagcagttgaaatactctcaactcatagaaatgatgtatctctgaggtgctagatactataaataccctagcttgatcacaagtgcctgataaataggtacacatattatgtgtcaagttttaaaaagaaaataaataaactgtgtatgaaaaaatttaatgacattttatttccccagtgatacatacttttgagtgaaaaatagagtgagggcagaaactaagtcagattcttggaggctgtgatttaagttttgtgagggtttgttgtatttccaatttctcttactcctagggcccagctctgaagagggctgaactggcaggtgtttaccaggtactaaaatgtcttaatttctgcttagatttttagccttttaacagatgctgtctgcatggtttctgggcctctctcctaggatgtggaactgaaagactggcaaatgtctctaagggaaattgcattagatgaaacataaaaactctgagcaactttgatcctgaaagaagttttgattttgcaatggtacatattttacacctgtttttaaataatttttagtgttttttaaaaaattaagaaatcacattatgaatccttgtgaaaaaaattatctttttctaagtttttgtttccattttttctttgaacattttgatttttatgtattaacttttactgatatgatgcagtaattattaaaagtagtcgaacaggctgggcacggtggctcacgcctataatcccagcactttgggaggccgagacgggtggatcgtgaggtcaggagatcgagaccatcctgactaacacggtgaaaccccgtctctactaaaaatacaaaaaagaaaaaaaaaattagccgggcgtggtggcgagcgcctgtattcccagctacttgggaggctgaggcaggagaatggcatgaacccgggaggcggagcttgcagtgagccaagatcatgccactgcactccagcctgggctacagagcaagactccatctcaataaataaataaataaattaattaataataaaagtagttgaacagatcatattttgtacagtgaatttcatgccttctcatctccaaattaaaatatggttttggatatacgttcatgattcaaaatttgtttcagtatttaaagcatattaatcctttcaagtctatttttcttggtaaatgaattaaaggaaaaaatactacaaatatctaattgttcctgaattcaatacaaactgatattttaaacttgtaaaatgtatatgggaaaaattcaatataaacattgaaaaagctctttcagtgtagaaagggctaatagttaaaaagaaaagcctagacagagtggacaagataaaccagttgatgaaaataagcttgttctagcacttagtgaaacaagtgaacaaagattggggactgcagtacagcttttaattaatataaaaaatttaaaacagacggagtgtttaatttgtctctgaatatgagatgaaggattttaccctcttcaggtgaaattgaatcttgtatgtaacacagatggtttgtgggtgtgtattttccctgtaagttgggtattatttgtttcatgaatgaaagttccctgaaaaggaagtaggaggaaagcaactttgttccagtgaacagtttgcaaactggggagacacagcttttgttgtaatgcaatgatgttctacagaataaagaaagggtttgggctttatagcaaaagttccctcccaggttttctatcaagtctatttatgcaaatgaaagattgaaactcgcttagttcttattggtcagcacagctgagctatgactgatcaatatagctgagccctgattggttgatacagctgagcccagattgacacaggcaggaaggctctgattgattggcctccaagccccaaaccagaattctctgtcagatatttctttcaaacagcagttggcggggagggattctcagccacagtctgttttatcaccaaacataggaactggtttggcttcattgtagaaagggaggtcctgtgatacgtccacaacatctttctgagaacagagtacctgaccactccctctcacagctattgctgcctgtttctgtatttactttgagcacctcagttggccatgcagagtctgttttgtctttcagctgggggcatactttaacggtttatgttttaatttctttttattttaaagatttcatcagttacagggtgcaaacattccagggatggcaattcagtatttctttcagctgatggttttttaaaagggccagtctgttcagttttttgctctcgttgtagtcttactggggaggggagcactagcaagagagctgggagcttcctctagcagccaacatagctttcctggtcttaacccatcagctttgcttgtgcctccaagaattcccttctgctttccaggtttctgctgctgaatcttaggagagaaatgctctgtgcatttctcaagcacagaaatgagatttgtccttaaacaaaaatgtcaatagttcctacgtagctgaaactgaaatgacaggggtaatgatcctttatctctacctctccgtcatgaaagagagagactcatcttctagtaaattagctcttccctccgtttattgtaagaaattatttatttagttgctaacccagtctcttcttataagacagtgctaaaggaaaaatggaactttaaaaacattacacagcacactattgtaggtcatgaaatagtctgaacctatttacatctagtttttttgcctttcagcagctaggtattaaaacttaggaaccccttgttgtatatagattactaaattttcatattataaccctttcctctttaatgtaaaatagcctaaaagaatcttccatcagaaaccacttcaacaaaacctaaggaattgggtggttcaatagataaatagtactgttccacagggagtgaggttcacgtccagcctcaagtctaaattaaatgagcttgatcgtatctcttcagtctcttgtgagcagcagtccagaatactgaactgtatgaataattccacagtttggcgtgattgatagtcttggctcaggagagtcccagaattgaactaacaaccacactaaattgtatcacatctttaaaggagatagccctgtttagtgagggctcagttacacgaaagggccatgggaagtagcatgcatcatccttagtctgggaagaggtagagaatggcttccagctctgctcctgggctcataattgaatcaggttttgcagctcaaatggcaccaaatgatttattttcttctcttgggctacctctagcttcgacgtttttgcatgtgatatggttttatatctactgataaatatgtgaatttttcttgctaaataatttgtctctagcagtgataagaaatatctgtatttcaaatatataaaaaaatctccatggctgtagtctgtgtacattctttggcgtacaaaaattcattgcatttatctacctattatttagctattttttaaatattttgtgtggtgaaacctgggaattcaggggagtgtgttgctttaatttaaagaaccacaagtgtcataactgcattaaaattttactctccttataacctatatttaatcaatcatattcattgacttttaggctctgtagtcacggtagttaaggaggagttcaaacagaaatatataaaaggtatagctttagcaatctgtattatttaatattttaaaatttttattaagctttaactgaacgacagctacttgcaatgttcaagcttattaattcagttatttaaatgacatagaaaacttcttttaatgtatgtagatcagtctctggaagaaaacttagaagataatactgtaaactaatgattattaaataaaatcaacctttttttctgaaaggcaacatgaacaaagcaatacattttatctagtaaaagtagaaaatgtaagattaattgcttccaaaaatgttagggttcacatgaccttgagattattctctgactgactatcaagctaacatatgagatagcagagatttttccttggaactgtctagaactgccatagtacttgactgacagagcttgctgtcctcccgctctctctccctaacccccccacactttctcccacccccatttctctctcttattgttccactagcaaatgttaagcatccatgataacacaagaaagaacagtggcatattctgttcttaaatgtaaattcactttttctctaactctgtagacttcagagtgtacatttaggctgtggtttggttttgcaaaaaagcagaaatgaaaaatactatatgaacttatcaatactgccttttaaaaatctattaactatcaagatggaatattaatgtagaataccaattttttatttttacaaaattctaatatataatgaaatacctataacctcaatattttccacatagtttttatttgctaattgagtagtaaataaaacaatgtaaaataattgttttgcctgtggataggcttatttaaaagtaatatcatctttacaaagtgtgcattcttattgtatgttagagtatcatctaccacttcagagactgatgaaatgtttcagtttgtatgtgttgctactaagcagctcaaagcaattgtctagtttaatgtatttccaattaatttttagttgcattagaaaacagaatgatgctttggttatttagctgtgaaaataatgaagcaggtgttttgaaatccctgaccttcatgttcaacatgaaaaacatgggtaatgtatataagtttgtctttagcttccctcacttagacttacagactagaaaaacagttacaaaatttcctgagttgcttttttttttttaatggcctaaaggttctcaatttagaattggttgctctaaatatttaaacattatttttttactgcacaaccctttagcctaaaatattattatcattgtatcagtatttctggtgtccagagctgcaattacacttcccactaattaatttggagtgatttttttctccaccttattagcattcattcattaaccgaataagttttgaggcttactgtgtactagacatgtgctggttgaagaaactgtactgatgaatgaaaacctcatgtcaagtagcttttggtgagtatagggaaacaaaaagagtaagcaaataaatgcagtgttatagcaagtgtatttttttgtctcttcactctgtacattggttcatatagtactttttagagatcagtgttgattattcctgtcagctggttttacctttttataaattaagtattagcctgatattagtagctgagaatactagcaaaatgagcttaggatggtaattaatccatcgtgacaaaccagttgcagaccaacagcatctgctactgctgggtaactagacgtatatcagatattatgtagacataaccattactccctgtttcatgttaacgtacctgggtttgaaattaaattattttgacattgtctgtagttgctcacacttacaagaagggaacctgcaggcaagtgagatgaagagagaaagaaaaggaagaagaaaaagcaaaaggggagagcgggctgaccaggtgaggtgggtagggttcataagcaggagagaggggaagcatttcaaattcccctaatggttttgaaatctatttttgttgttgttgttgttgtttgtttttgtttttgtttttttgagacggagtctctctctgttgcccaagctggagtgcagtggtgtggtcttggctcactgcaagctctgcctcccgggttcaagcaattctcctgcctcagcctcccgagtagctgggattacaggcacctgccaccacacccggctaattttttgtatttttagtagataccgggtttgcccatgttggccaggctggtcttgaactcctgacctcgttatccacccaccttggcctcccaaagtgctgggattacaggtgtgagccaccacgcccagcccaaaatctgttttaatgttccatttgtgttttcaggggagacatagaaatagcgtatgatttattgatgatactgatcctgcctcaacgttttgatattctctttgtttggcagaaaggaggctgaaggcccttctgatcctagtcagcagcagctggggtgttacagtcttggtgtccaagggcccaggtctggcactggaaatggatgtgtggggcccagcctgaatcacaccccaggtcctttccgtactgcttccatttcctttttggacttctttctccggggctggcaacagccttgtacgtgtacacatgcctggggggacagctgggctccattggcaggtgggagcagcctggcgacatggtggtggtgggagaggagcctctggacatggtgggaagcacaggagcctggaggcttttctcctgctgttttctctttgctccccagggcaagcacataccctgttgcttgcactgagtctactctccaaagcaaccatgactcgtgttaaggtggaagatcaagtgcaaggcggtgccagttaaatagtcgggaatatttactggtgcaaaactgaggatcaaagagaacaagagcattcggttttagagaaagtcagaaaccccagagaccagccacagacttgcatcctgatgcatcaagagccccaaaaggtggagattattttcttttgtcagcaggttttgctgttagtctacggtgacagtttccttttaagtagtttaagttgtcaaattacccttaatcagcttcaccacgatcagcagctttgccccgctttacctggatattaataaatgttggtcaggtcaatgttatgttatttgtttcccagggctgctgtgacacagtaccacaagaaagggaggctcaaaacagcagaaattggctgtctcaaagctctggaggccagaagtctcagatgagagtgttggcagggccgtgctccctctgaactctgcggggcagaatccctcctcgcctcttccagcttctggtggtctcagtcagtccttggcttggggcagcattgctcctgcagccgcatggccttctccctgtgtctcctcacacagccctcccctggatgtgtctctgtttccaacctcctctgtttggaaggacatcagtcatactaggttaggacctgtctaaagacctccagtcaacttgactacatctgcaaacaagctcacatcacgaggccctgggggttaagagttcaacttggctttttctggaggggagggacacagtgtaacctattatcagttttctggggtgttcaagttggagtatatttctttgtatcattcatgacgtttactgcatttttaatgtaggtagtgggtaaatctcacctgatctttttagaaacacaaatacttacctttttgtcagtaaagcgtttaaaaaaaaaaaaccaagcaaacataagaactagtgatttagaggtaggcagtagagtgagacagacttgagctccagcctcatgtctgagactcactagaaaatgaatttgggcttagcctccctggtctcagggtcctcacctggagaatggatgtgtggggcccagcttatgccttcaacactttcacagcttcaacacttttgaagtgcttatgctgtcaacactttcacaatgattttctgctcctcgataaagaaagcacgcttgatcctgtcctgaacacatttagcactcatggaaccaccacaggccctgctgacatgtttttttgttttggacaatctcataagaactttaggtctcacagcacggacccctcaaagtctgcctgggcacacaccacatgcagagttttggtgttttccacaccttcttgggataaaggtagtcaattctattacaaggggctcgggacagcctagttttgctagagctgtattgtaggaagcctaaggcagtatgtctaagaccattctgagtgcatgtagacaacgacgtccatggaagaggctgtgcgtttcctagggcaaaggaacattttgtttgttttatttttatttcactgtttacttttttttttgtctcacatgcatataaaaaaggatcatttggaatggttttccttttaaaattaagaagcccagaactcgaatttaatctgagttaggaaatctaacttgaattttaaaactccataaaggacatatatctagccccaaccccagtacctagagacacaaatagaaataagctggacttagactctcagccatttgctggagagacaggccaggtatgttactttgggtgcaaagcaaggctagatgaaatttagttggaatttctatcgatgatacttgaatttcatgtttaaaggtattaacattttttcactaatgatataaaacatgcttatgctttagtgagaagggaaagccattgaaatcctgagaataataagatgtttgactacatgcatcacctagccatccttcagaactttaagcaaaagaaaataaattactaaaaacaaagagccattaattagaccagtgtggcttatgaaacgtttggagctttggaggtagtgctttgcaaatctagctggcaaaaggtttggaaaactatgccagccttaagattaactctattttatgaaaaataatgaatttcaaatattcatattctatattaatatttaaatattcatttaaaaacccatttttaaaatagctcagataaggattttttacagcctatctcgtttgtatgacagactgttgcacacaatggctcatatacaattcttgaaactgagattcccaagcataccagacatatttttatgtctttagacttctaaatcaatcatatttggtagctcctcttaattacctgacctatggtggtcattttagttgtagcatctgttccatttatccatgtgtaaaagtatgctttgcttttaacattaatttattcacttgacaaatatttatcaagtatttataatatgttggacattgacttgacactaaggataaagcagcaatcaaaacacttaggatcctttgtttatggagcttagattcaggtatgtggaggcagacaataaaaatgggtacacatatgcgtgtgtgtgtgtgtgtgtgtatatatatacacatacacataaatatacatatacacacacatatatatagcatatagagcatatatagagtgtatatatagagcatatatagagcatatatatatatatatatatatatatatatatatagagagagagagagagagagagagagagagagagagagagagagagagagagagatgaaatctcactccatcacccaggctggaatgtagtggtgtgatcatggctccctgaatcctagaactcctgactcaagcaatcctgcctcagcctccggagtagctgagactacaggtgcacgacaccatgcctggctaacttttttttttttttgtagtggagatggggttctcattatgttgacaaggctagtcttgaattcctatcctcaagcaatcctcctgccttagcctaccaaagctctgggattacaggtgttagccaccgtgcctggccaacacatggatattatagcgggtgtattggaagacaataattgttaaaagatggatctgggaagggggataaggagtagggccggggatgggaacttgtataactagaggggtcagggtgagcttgctgagaaggcgacatttaagtgaagacctgaaagagatgaaggtccaccacacgcactctgtggaggagacctgccgtgcatggaggggtgggtctggtattttctgcaaagaacaaggaggtcagtgtccccagcatggagtcactgctggggcaatggccagcatggttatggggccagaagctttaggctatacagaccatggtaaggactttggcttttactctgagtgataaggcgaggcagtctagggtttcagcattggaataacatgatctgacttacatttttgaaggatcccttgggctcctgagttgagaagaaattggagaggagcaagtgtaggaaaaaggaggccatttgggacataagtgcattcatccaggagagagatggttctggcttggaccaaggtgcagatggtacagatggtggaatgtggttggatcctggacatatgaatgtgccagcagtatgacagaaaaaagaattctgtatatatgcactcagtcataacaaaggtctaatacccagaatctataaggaacttaaacaattgaatgagcataaaacaaataaccccattaaaaagcgggcaaaggacataaacagaaacttctcaaaagaagacatacaagcagccaacaaacatatgaaaaatgctcatcatcactaatcatcagagaaatgcaaatcaaaccacaatgaggtaccatctcacacctgtcagaatgtctgttattaaaaactcaaaaaacaacggatgctggtgaagctgtggagaaaaaagaaagcttataacactgttggtgggaatgtaaattagttcattcactgtggaaagcagtttggagatttctcaaagaacttaaaacagagctaccatttgacccaacaatcccattactgggtatataccgaaaggaaaatagattattataacaaaaagacacatgtactcatctgtttattgctgcactattgacaataccaaagacacacatcaacctaggtgcccatcaacaatggattggataaagaaaatgtggtacatatacaccacggaatactacacagccttaaaaagaatgaaactatttcctttgcagcaacatggatgcagctggaggccattatcctaagcaaattaacgcaggaacagaaaaccaaatactgcacattctcttttataagtgagagctaaacattgagcacatatggacgtaaacatggggacaactgatactgcagactactagaggagggaggaagggagaagcgtgcgggttaaaaaactacctattgggtactatgttcactacctggatgcaatatattcacgtagcaaatctgcacatgtaccccctatatctaaaataaaagtagaattaaaataaaagagagggcattggctaacataatttaaaaggatattgcttcagacccagctagatccagagacacaaacaatgtcagaacattcagcctgtttttcattattcagatgtattttctttggtgttggcttcattctcagctagtttaacagcaccatcaggaaaacattttctctttcccaatagttaagagccaaagttaagactgtaatgcgttaacctggtttaggtcatgtgcccatgccagaatcaaatattgtggccatgagaggtagaataactttttggccagatgaggattgcatacttaccttgctgtttgaatttttgctgtcactcatagccctgtgaacctattcatgacacagcacatagatgtactcaaacgaggcaagaaggaagtcactgcaaggtttgcatcagtagcccatgtgaaagctgctcataaccttactgacatattgtgtcatccctgttactttcacagtttcaggggtttccatgaaaatgctgactgttaagattgttaaggaagctgtctagaggaagaataagattcccccaaatcctgattgtctcacttgcaactgcaaagtatccagcctcactccaagggtgtcacagcatgacagcaggtgaagttgaccttgttattaaacacagtctggagtttctactatcatgtgtctatctataactccaaccttgtatttctatcagagctgcagatccatctcctcctgcatcatgacttttgtaatccagtggttgaccaggcacctggattacaaacgcaactaatctagtaccaaagtcttcatcctctcctttttcttcaccacctctgagtctaccacactccactccacatctgatcttctcatttcctcattttgaatggtggcaccaccttctgcccagtcacttaggactggaatcgatgagtcagtcctagtgtccaccttctcctccaccatcttcatttctacccgcttccctagagtcctgcctttagtctagtgtccttctaatcagatccataccccaagccaggatgatgcatctaagctgtgagcagaggcatgtattcccatatgtaaaatgctttagtgattcttccttcttggagcacctgaggctgtctgtgagctggcccctacctacctctctgtctttgctcacactctttctccttagtaaacggttagtgctccaattatatatttcttgtggttccttaatcaaccatcatttgcatcactgctaaacttttgttcctccttgaatttccttttttctctagtgtgtgtgatgaaaaccagcctgctcttctgtctaggctcaggtcaagtgccccctcttctctgaacccttttctggccctacctcatttaacctctgacacttatgggcctccaccttaccttgggaaactcttctctctgcctctgtaccaggttagggatttttgtccatctctatgcctaatgccctttaccaggctctaagccccactggaggcagagactatgtcttactcatgcttgtactccagtgactaacagttattagcatgtaatacatgtttctgaagtgaatgagtgcatttgtttttctgagaaagttgttgactccactgtttcctctgaaggtgtagttgatgtgattgggccatgttatgggctgaattaaatgcccccagattcacaccttgaagccccaaaccccaatgtgatagcatttggaagtggtgtgttttggggtaattaggtttagctgaggtcatgaaagtggggcccccatgatgggatttgtgttcttatgggaagaagaagagagacctgagctctcttaccaccaggtgaggacacagggagaaggcagctgtcatcaagccaggaagagagccctcatcaggaaccacatctgccagcatcttgatcttggactttgcagcctccagaactgtaagaaataaatgcctgttgtttaagccactagtctatggaattttgttccagcagcctgagctaagacaggtcacatgctacaaatgtgtgctgggaggttggaagacaatggatagtgactgaagaacaaggtagatagcagcttctctgaactgtattcctgacgatgaacgtgcctctgttcaggttgttatgaaagcaaattgacttggatcttgtgttcttcatctcataattaggggactttgattagaagacctctagggtcactttgagggaccacattctacatttatagatctatattagttctaatgatacttgttttgctataataagatgaagatgtctaggaaagtataggataaaaatcagaataactaaaaacttagttatgaaaaggaaggcaaggttttccataattaattgcttataaaaactaccaaagatgcttgtttgggcaggtgaaggcaggtagagtaatttaaagtataaaagatttcctttgtttaaggaatgtagttattaatgactaactctacataacaaaagatttttccaagatgtgattatattagacattaaaagctgttcacatttcaagtaggcaaatatcaaagtttgggatttctaatctcttgttatgtgatgtatttataaggtgctgataaaactctcatgggtcacaaatttattatatgaaattttcagttcaaaatcatgtgtatataatgacatagaataaaacagaagtacccagaattaacattttaatatatagtatgtctatttgtgtctatataaatatctataaatacaaataatgtgtatttatttacacattattgtgtaatacaatgtgtaaatttgtaattatacatttatttaaatataaaatgtatttaaacataaaaagtataaatttataattataaatttattgcacattttatatatacattttacatatacttttataaatttataattttatacatataaaattattttatatgtataaaataattgttactgacctcccaattcaccagtatcaggaggttgttcagtatcaacagaactctatccaggcctgcatattttcaccatttttattttgctattctatttcattgcaattgcaatatatcagttagatcatgggttgaagctacagaaacaatcacctttctagcactattttaacctagattgttattcccttgggcagaagactcttgcctaatacatctttgtcagcccataaagactagtgagatgtcttgccaggaggagctggaaatcagtaaatacttatttaatgaattggtttgaaaatgaataaacaaataaccataacagaagttgagtagggtactagtaatgctggaatacaacaccgtgaaagcagaagcagataatggattacagtggctgaaatcctgaatgtagagtcagccctgatttcacatttcagctctgccatttacaaactagataacttagggcaaattacttaatatcattaaaacttactcttcttgtctataaaacaagtgagcttctctgaaggtaaaatgagataatgctcagtaaaattttcatcacagagtaaactctgatgactttttgaactatttttatggaaagtaacaattacaaaaatagtaagttaatgaaatcataaaggccttcttttatcttcattattggcattttcactaaagatgtgattttaggaactgctttagtaagaaagagaagattcgaagtcctgaggggcagcattccagaagtaggatatggcctatgaaggctggaaggaagggcttggaatgatcaacagatgttctggacatctgagaatctccagacaagttaactgcacacagcaatctagaagagaactttaacctggacatgaatgcgttaggaggctccaagtgagctcttggaagaaggaagccatgatcaatgccttatgcaggaaagtaacctggccgccagcataaggaatgagcaaagagaaggcagtttttgaaggaaaatcctgagctaagattaggaagtgactcactaagtcactgacccccaggatcagaattatgggtttagaaagataaacaacaggaactggtatttagggagggtggcatcttttcaaggaggcttcctctgggaaattctccaagagctttgaacatctgaatgtaacgacatcactttgtactgtagttatgtatctgctgctgtctcctctagagagtgtgatgtaggacattggaactcgctgagctgttatctggaagcatgcccagtggggctgtggctgtgaagatggaagtgccttaaggactcacagctggagttgggtagggtgcgagtagacacatggacgaagggttgcatcagtgattatactttatccctgtggggagccaagaaggattgttaaagcaggagtataatatgaacataattgcatttacaagtacctcttggccagagtcttgaaggatagatagtagaagactgatggcagagacaccagaaaataagtcattaaagtctcgggtcagaggtaaggcctgcctgttgtcttagtccatttggttgctataaaaaatactgtaaactagatatttataagcaatagaaatttatttctcatagctcaggatctgggaagtccaacgttaaggcactgtcagattcagtgtctagcaaagactgctttctggttcaagatggtgccttctatctgtcttcacatagtagaaatggtgagggatctgttttgggcctcttttgtaaggggactaatcccattcatgaagggcttaatcctcatgacctaatgacctcccaaaggcactgcttcctaacaccatcacataggggttaagatttaaacatgtgaagtttgaaggaacacaatcattcagaccactgggccttggctaagaaattggtgaggggaagaagagtaaggaatggattatagtgatgctttagaagatggaattcatggaaactcacagccaatgacaggcctggattcagataaagatgtaaatttggtagaaaaaatcaaagtgagttttcacccactgacctcttcttctcattgtattttgaagtaggaagcaaaagcagctgatgagaataaggaggctaaagctggactagagggcttgagattgtgcagaaggtttgggatgggagacgaaatgcatccaagtcaactgagaggaatatcgtgcagctccgatacaccaatgtggatggtttcaggagtgaagcaagttgaaggatgagttgatgtaggtttggagatttgtttctctacaggaaaagacagggcctggctaagcaggtgtttagtatttgttgaacgaataaatgcttgcctggacactgttgagaaggaatttattagggatatggtgcaagaaaataaagatctagaaacaagtaactaatcttatttcctaagacatctttatcagagaagcctcatgtgacccagagtaggttcagcgccaccttgtatgccccatggcacttggtgccttccgttcattggattttgcttctctttcaattagaagtaggttattcatgaccatttgcgtgatgtcatcatccccaggggtctgttatttctgttttgttgacatggtatcctaagtgctgacacacagtagtcactccatcaatctacagtgctggatacaaagatgttaatggagggaatgacatgtatttttttttttttttttgaggcggagtctcactctgttgcccaggctggagtgcagtggtgtgatctcggctcactgcaagctccgcctcccgggttcatgccattctcctgcctcagtctcatgagcagctgggactacaggcgccctccaccatgcccggctaattttttgtatttttagtagagacgaggtttcaccgtgttagccaggatggtctcgatctcctgacctcgtgatccacccacctccccctcccaaagtgctgggattacaggcgtgagcccccgcacccggccccgacatgtatttttatatattttgttacttgatggtctcttgtaaggttttgtgaattgctttaattagtaagaaaactggtaagctaaatgacaaatggtactttattggaatatagtctctttctggctcataaggaagagaaatttgtgtaattacatcaaaattatatggatattacacagtgattagataaataaatataaaaccgtacagcttcagggcaacttacacctagcctctgtaataattacacttaaccttgacattatttatggtttccttttcccccttattacacgttttatcatactaagtgttttaaactgataatgctcaaaagtagcacatgatgtgtattattatagaaattaatgcttgccttaataacagatgctttctatttggggtttgaaatgaagaagcagatattttcctagaatacatctggaagtgattttattactaaaactgaaaaaaaaaacctttcaggtatcaaatgtgtctggtctgtgatacgtcagatttctgaattcttacacttttatttcctatagaaatctgaaagtgtgttattaaaagttaaactgttctgtagattgtctacctaatttcataaggtttagtgtaatagatatgaaatctatgtcacatctactgtgtggtcttcatatcttagttatatttagaattttgatcaatagattttggtagaacattattgaactttctcttttttttttttttgaagatggagtctcactcagtggcccaggctggagtgcagtgttgcgatctcggctcactgcaagctccgcctcccggtttcacgccattctcctgcctcagcctcccaagtagctgggactacaggcgcctgccaccacgcccggctaatttttttgtattttttgtagagacggggtttcaccatgttagccgggatggtctcaatctcctgacctcatgatccgcccatcttggcctcccaacgtgctaggattgaactttctcttttttaatgatattattttacatcataaaatgtgattttacttaacagcacaaatatgttcttcaaaaatgagtctatcaaacaaaacgttcataaattaaaatcagaatgaaatataaatgcaaattttgaaagctaaatcattgtttatattttaaaatattctatatttcctcaccttaaaaattggatgctattcacaaatattcctaaagaatatttttgttcagctaacatcaaactgtggattacttacatagtgagttacacactacctatcttttcctctgccaagctgtattccagactgccataattaattaagtaggtgaatgaatctctgatgggttgtatgtctgtttctatactcctcagagagtttctctcttccactgtgttagaacaccaaataaattgggtctctatcactactccaggttattatgaaagtaaacatctggttttaccttcagaaaatagcattggttgttcaaaattcaagatatgcgtgtgtacattagcctaaaatttattttttgaaattataatgggattgttatataactccttctgcaagaatattgtcaaacaaaaaaatctgtatctgtctttctcactgaaatattgtgagagttaatgagacatttgtggctagatcgtgcaatcctttcaggaatctcaaagcaagaacaaaacagcatttccttttgaaaggcatatgttttactgtcaaaccaaacttaaagcagtaggaatgatacacatttctgagttaacttcctgctttcttggacgtgtcaaaattactgatgttccagcgtgacagaagcctagtaatgaaggaaccatgtaggtggaaaaaaattattacccgacttgcaatcaaataatagaacataggtatataatattcaaagaaaagaaagtgagagtctgaagtcatgcataaagcaaaatcttcacagtaaattgataggctgggcgcggtgggtcacgcctgtaatcccagcactttgggaggctgaggtgggtggatcacaaggtcaggagtacgagatcagcctggccaacatggcgaaaccccgtctgtactaaaaatacaaaaattagctgggcgtggtggcgggcgcctgtaatcccagctactcaggaggctgaggcaggagaatcgcttgaacccaggaagcgaaggttgcagtgagccgagatcgcaccactgccctccagcctggggaacagagcgagactctatcacaaaaaaaaaaaaaaaaaaaagtaacagactggagtcttacctatgtcttactttttccctaattttaagttagacactaatagaggtccggtaactaattgtattcacttatgtagtacttggtatagattttcatcttaggaatgtcagaataatggtacttactgctgactgctgtatattactgctcaggttcaagacagaaaaccgagagttacttctatttcctccatttcacctcatcctcccgtttcaagggattggtgagaacctttgatgttatcatctccaaacatacatcaaattcctgccctctctctctcctgtccactgctaccccatcatctcttctgtccattgctaccccatcatctcttgcctgaaatactacaaccaacccccttgtcgctccactgtctctcttgccacccatctccccccactattccatagccacaagaagcaaaagtgaccttcaaatgtcactcagattgtatcactccactgcaaggacttaccattgcacttattttaaaaccctaatctctcttcctggcccctgtctgccccttgctcccaagttctgtccattttgatattctttcctttccttaaaaccctgactgtttcctcctggagggcctcggcatggtgtggtttgctctttcccgtgacttaggtctcagcttaaatgtcactatcttcaagacgttctacttgactccttttgtaaagttggctgagaccatttccctccctgctttatcctctcagttgtaatttattatgatgagtgttattcatgtagcagaaagtatctcctttcatgcatttgccgccaattgccactgtttatctgcatgtttgttgcatgtgagctctctgagcacaggaagctggcttacacacagcaccttggagtaaatgaatgaatggtcgaatgaaaagtgctgataggccgggtgcagtagaggttcatgcctagcacatttctataaaatcagttggacgtgaagtttgacagtggctttttcactctgtctgctgccatgacatgcaaatagtgccttctcatgtgagttgcattgttggtgaaatgggcctcggtttcttcacctgaagcaaaagaaatgagagcagataatcaccaaaattccagctctaaaatcccccaggctgtgcagatgccacctatccccagaaatggcttgaaatgccacgtggagctaaggagtctcttcctgaaggaaagaatgagcacagtctgaggagggtgtctggggagcgcatcgatttcggagctgctgtgggaatatacttaggttctactggagagctcatcttgcagaagctgactgcattgaacgtgccggggaccacctggtccccctcttctcgtttggcaagaatcccggctatcgatgaagaaaccagctgctttcctatgtagtgaacaagcacaataatgtttatacagtttcccagcctctcttcccccacccactttcacccttcctcacccaagaataatcgtgccaaatagatatcagattaagaaaatgcttctcattagttgtctgctcaaaacaactttggaagcaatcctagaacatcccgttgtatcttcacagccctttatctcttgaaagttgttgagagagctaaattaaagttgcctaccattaatccttgctctcaacactgtaaatcaaaggaatgaaatacttctcatcacaattcagatcccaaacaggtaaaaattacaacataaagcaaaatctaatactggcattgcccctgtcacctgagccacgtatcctgactgaagtaatcagcaaggggcaggcttgtactgcaactcaacaattgtttcagtggccatgggttgtgtaaatacattccatttttaacgtccccatactaaaaacgagatgtggtcatcttcacttggttcttaaaacggataggttagatccagtctccacagctgttttgcaatttcacgttatagtgacagcttccataatacaaattcagattgtaaagactgacctctcttcactgtcacagagcattctgggtgaaggctttttatctgcaagttgcacttgacaagcgttttagagagggaaggtagcaaaataaagaatcagacaacgagtcaaaggagctaagctctgttccgagaggccctgatattgatttgtggagccttgtgtcattttctctatctgggctccagttcttccatttacaaaatatggatcatggaccatattgtcaacctgtgtaatccacgaagtcagtttttatagatatagagccagcactgatcaaatgtgtcagcctcttacaaccacagcggcattatgaagatctgtaagtgagcacttacggagcttcctaaacaccttgggaggaaaccagtcagtgtctgaacacaaagaatttatctacaacataaaacaaaaaccactgcagagtcagagatcccagtgccctcatcatcgcctcttctaggattacacagtcacggaacgtgtgcatccgcctccagaatcgctccccaaattccatggggtaaatattttactagaaaatgtgagtcaaaaggaaagcaacctgtctctaaagtaaatcttatggaataaggtttttaatattgtgaaaaacacaaactaaccattctttcctaacaaatacccctagggatgggggaagcacaaggatctctgcgatcaagccctgccgggccgcagctttcattaggttgcagaggcagctcttcctttccctgagtgttcctgcatccttgaggcccctataaagaggactcagcgtctgtttggcaccgcctgttctcctccttccttgtgtctcttcgtccactctgtcaccacggcgctcgcagttttctcaggagacacctggatctcaggctctaaggcctgtctcactctgtgacgcatgtggtcatgagcactctgacctccgcatgaggatggtcagatggcagagggcagaacactgggtcagagatctgaaacccagcatgcagccctacctctgcctgtcacaggttttaagactttggcgagtctcaaatcttcaagacctggcttcccttatctataagacaaagagatcggcttgagtgatgtttgagatgttttccaccctgcagtgattcattataaaataatagacatcctctgactcctatggaccagtcaaggattgaagcttcttaaggccagttattcctctgccatctgactcgcacatgtagcagtctctaaagattgcctacttcagtcatctgattgcgtctgtttcacagattcttctggaatttttcttctttcagttggcttttttttatcgtggtcaaaacccccatagtcgactatgatctaaataagcagtgccctctctattaagaacagtgttgaattacctattcttgcaaccacattgaccgagcttcatctctgttataaatcataacctgaacagacaatctcagtgcatcccggcacctgcagattggatatatcagtagaagttccctcatcccccagttccacatgcacagcactcattgaagtgaaagcatgagtctcccatattgaaagacgagaagatcccataacacatctgtgaatctggacatctcaagctgcctttcaatggattttagactgtgatcatacggagggctgaagaattgtctgctctacgtcttccacagtgtactggtcttgtatgtctaacaccctataagagtaaacaatgtgctctgatagatgagaattctaaaaaaatgatatcttctataatgattctttagatttaaatgttcattatggcatttaggaatccctgttataaagcaggttttaaaaatgttttatccaccatgtcatacttttgaagaagctatgatctcaggaataagagataggttacaagagttctctatcatggagaaacttacttttaaaactgtaacatcagtaaagaaaaaaatgtagaacatggacaactaagctttgttcctagtacggtaaagtgatgctgatgttggtgattgctatggattttgagtgggacttagttgaaacacagcataagtccaacatcagtcctcaacttggccccagcactgaccagtcatgaggcagcagaggagtcactgcccctctctggcctcagtcccttgtctgtaaaattagtaaaaggcggtttgccctaaccagttcacactgctgacttgaaagccagacgatgtgaaagtctgttgcaagtgtaatgcgatctttccatctaatgcgaggcctggctccatttcatgcatgatcaccttcagctgtgactgcagcccttgctggtaggacctctctcagggactcccactcacccctaacctttagcactgaatgtcaggttggtgactcccactcttgctctgtagcaagcaaggcaattcttttacttaaatgtcattttgtctttaaagttctaagtcttcttttttgagattcccttctaccagttttttctccccaaattagatattccacaattttcaaccttttttgagcttattcagcatatttatgttgtactaagtcattgtttcaataaagaagaactaaaaaagtgctagaaataaattgtcctgctttgcataaaaccttaagagtagtgtgtgtgtatgtgtgtgtgtgtgtatgcgtgcgcacgctattacagagatagatcttttgcagaataataaaaataactatgggggtcctattatttagacagaaggggttaaatgaaccctacaagcttcttactgtcaggagagaatagatttcagaaaaaataaagacaaggaaacaagccccaaagctataaatttacccacagtgtttaaacactcctttgtgattattttctaaattttctcaggtaccctttttcatttgaaatgttagtggaaagttctggagaagaatttattgcaagtaacgtaataattataaaatagaagaaaagggccctgctgacttgccagagcttgaagcaaaagagaaagttgcctgcattgacggggctcgctcaagtatttcagtttcaacacagctgtcctttctcattgcagatggagggcggctgccaccatatgccacctctgtaataaacaaaagtagtgcaacaatataattaatagcaagccattttcatttttaaaattccaaaaaggaatatgcttttcacgaaaattcaagatgtaatgcccaagtaaattgggcaaaatacagcaatgtatcaatgagattccactttaagaaagccaatatacaaaatattgtacttgaaagttaacattactgtcatcacaaattacttgcttatatttctttatagtactttaagaattgtagtctcacctacttcattcaaaatgactcatcctgtaaccagtcttttcctgggatctgttgtatctccattatataccactgaaaatatttactaaataggttccccaaataaaaatatgatttgttacatagaattttctgcctttttcctgtttcctattgacatgcattgtttccttaaataatgatgatgatattaataattgctaacacatatcatgcttagtgtattgttaagagctttatatttaatcatgaataatcttatccgggagatattattatctccacgttacagatgataaaactgaatcatagaaagattcgtcacttgcctttcttataactcgttagtgatgagtggggcttgaacctggcaatccttctccaaatccgtggtctgagtcactgtcctgtgaattagggctcagtagcaatggctcttttgccacggcttgctatgattgactcttacagcagtgagctctctctacagtactcaagatctgactgtggtactccatctgacttttctgacttttgctgagaactttatggaaaatatgtgaatgtggaggaatttcaagagaatccctgcaataatctgagcttgttttgttgtgttctctctgccttcttgtctggacaatgcctaccaaggtatccagacaggaagtccatgttggctgagaggctgaaaatacataagccaatagatggtaactcaagctgtgcaagggacccagccaccgtcatgtaaattgctaccatgatctaagcttaattatcatagacagtactaattaaaagacaatattgtaaatataaactggccctgatatatggcaaatgattagtatgtattacaacttgctaaatcaaaaacatgtcttaaaatacaagatagtattgcaataagtactagagaatgcgacaagaaaattaatcatctgctctttaccacaaattccttgtacaggatatctgctctttgtgttttgtttcacactttaatgcaataaagtgtttacaaagcataaagcactctgttcatttgtcatgttttactttagcttttccatttttttctctctacaacacttttcactgaagataagtttgctgacatatggcataatcattttttctcttagttacccaattctgcttcacaactttaatttttatatctattcgaaattagttttaattacctcaacactttaaattgatttagctctggttttagaaaaaaattcaaataaaatctttagcaggtccttcttctctccctcccttcttctctcccttttctccctttttccttcttgccttccttcctcccttcctccctctctccctccctcccttccttccacaaatactgctcaagtcctaccataccgagtactgcactgtaaatacaaagatgaaaagttacaaacctgccccctcggaatttgcacatccagtgaggcgattgacagaatgtgctggaaagggctgggtgtgagacgggatttgagacaagagcagaaattcatggaggtgggcagggcagggaaggcttagcaaaaacaaacaaacacgaagatgaacagaataaagtgtatgtttgagaaatcctgaaacccggaggccgtgagtagtgagaaatggaagcaagagacaccagacaaggcgagaagggatgtttggctccagaataacagaggcactgagtagcgtgttttaaaacttaaattgtaagtttgagatttaaatagagaaggaaaacgattttgagttttgacaaaataactttggaaaccattcaaagagtggactgcagctgaatgatgctggcaggtgtggaacagtctagccattatgagggccgaacgaagtgaccctatcatggatggaaaggtgggagggagatagaaatctttaactaacaggactggataaaggactggagttgaggggggaagaaaggtagttgctgataccctccaggttcttataatgaatgagttggaggcagtgctgtcaagagacacaggaggaacagcaggctgtacagaaagataataagataactctggtgtatagatgtagagatggaacagcagtgtggtatccagattaagtattcaagtcatagccactgaaatttggaacgaggtacatatgcctggtttcatttttatcgtttaacttcttttagagaatctaactaatgtaataaatatctataaaacaatattttcttatagaaatatactatcacacacacaatggatgacaaatattgaaaagaagaaaaattattttgttatataattatgtcacacaacaacaaaatcaagatattctaaattctaaatactattattagaagtatcaaataaaaatgaaagtagggtgcatgaatataaaaaaatacgcaaaatgaaagtggttttctttatagtattgataaccaattggaaatgaaaacagggtaaaataccacaaaaataacaacactgtacaagtcctaagaaaaatatagcgagaaacttgcaggacttgagtaaatgagaaatatttgttaagtaagaacaaatataatggtattgcaggttaataaattgtttattatataaatatttaaaattttgtacagctaaaaatactttaaatatagatatgagttgaaggatagactcaaagaaaatatttgtaaacatttgataaataatatcactaacatacaaatagctcctttataatgacaataaaaagatccatagcgtaaatacaaatggaaaagtcttaacaggtaatagataaatgaatataaattgtcatgtaaaagtccttcttctgaactaaaagttaagaaagtgaaaattaaacatataaacaagataccattttcttttattaaaatttcaaattaaaaaaaaaaaccagcaataagtcctagcaacggctgtattgatatttacctggtaagctaagtatcaccaataaaatactaatgttccacttcataaatattcgccaccctgagccccttttttttctcctcgaaccccatcccacccttctccgactgaccaaacccttccaacttcaagagcaataattagaggattaatttgtggcacttgaatgttcctgcctagcttattattaaatatttagaatagtatttctgggtatgagtacagcacaatggggatactcagttatactgcagttgggaatatgaagtgttaaaactttttaaaagagttacattactatgtttattaaaactcagtatctgcttatttttaaacaccccaaaactaccttattttttaatcttataaaaataaaagcactgacatatgtataaagatgtttatggccaggcacagtggctcacgtctgtaatcccagcactttgggaggccgagggaggcagatcatctaaggtcaggagttcaagaccagcctggccaacatggggaaaccccatctctactaaaaatacaaaaattagccaggcatgttggcaggcgcctgtaatcccagctacttgggaggctgaggcaggagaatcacttgaacccgggagccggaggttgcagtgaaccaagattgcaccactgtactccagcctgggtgacagagtgagactccatctcaaaaaaaaaaaaaatgtttataacagcataaatagcccccaaactataaacagcatgaatgctcattacttagaatatggctgaagaaattatagtatatttctataagaaaatattgtgttttatagatatttaaaagaacagattaaatttgtgtttactgacttagaaagatgcccataatgcactgtttacaagaaaaaacacaatgtgtagggtaacatgtacttttgtttagaataccagttttattttagaaaaagaaatacatctctctctggctctatctctgtctctctatctctgtctgcctgtctgtctgtctctctcacacacacatacacacacacacacattgtagacataattctatatggtgtgaggattaaaatgtatgaacaaatacactcccagttgttggggatgggtgaaggggatatgcacaggatattaactttttcttcatataactctgtattgttagacttattttattcagcattttattcttgcccttctaaaaaaaactgtagaaactccagacaaagagaagtctagaaatgacattctccagagttgaaggaaaatagtgattataatagagcatgacaaattaaacacagactatattatttaataagaaaagaaaaataataaaaatttaaacccaccaaataatgaaatgctttgttgaactaagcaatttcctctagaacattgatttttaacatttttaagggtgactcatccttagaagaattggatgaaacacttttcccggataaaggtagctgagttctcaaatccataaattgcatagaattgtataggtttgctgaatccctgttctccagtctcctagttaattatttaattaaaagcaattgtaaataagtgcaaaacatatattcgttatataggtcctcttctcattgttttgataataacctgtctttataatgacctgctttcttaggacgaatatgtttatttcagaattaaagctttaaagctaattcaaccccactttgccagtccaagatgcctttactcttctgttaagcttgccactcccttcctcctggggtgaggtgacatctcactgtggttttgacttgcatttccctgattattagacatgttgaggattttgtcatctacctgatggccatttgtatgtcttcttctctgaagaagtctatttggatcttttgcccatttctttattggattatttttcttgcactgcgttgagttcatttatattctggatattaactccttgtcagatgcatcatttgtacatattttctctcattctgtaggttgtctcttcactttgttgagtgtcttcttggctgtgcagaagaagcttttcagttcaatgtaatctcatttgtctactttcgcttttgttgtgtgtatcttggagatcttatccaaaaaatccttgtccagactatgttgtgaagcccccttttgagtggtgctaataaattacaattatgtttaaattatttgataaaattgtatctcttacacacttgaaatgttggtataattttataatttatctgatttttttagctttactttgagctaaaatcaccttttgacttattttcctgtcagaataaataatatatgcagcaaagaatactaaagatagactaatgaaagtttaatgtgctttctatttaatagtaattcggaagtttacttaaataaaataaattcacaggtattaaaaattctccctcagagcttttagggcctaaagttggtaaataatattcagtccagaaaaaaaatgaaacttagaaattaacagaaatgaatactaaactgcaaaaatttatatttagaaagaagaaaggcctgcgagttttagaaagatatgtagtttaatggtggaatttaataaatggtcgatatgttagcttctttgttcagctaattcatactctttagaaggttcaaggttttcccagtactagttctcatcacaattatgtgaaacacacacatacacacacacacacacacgcacacacacacattttcagtgtaataattactagcataagtttttaattacactgcatacagatctcatgtcattaggcccaggtcataaatgtatgcctaatactcttcagtcagttcaccattgttttacctagtctcttaaaaataaatgtgaaaatgtttattcctctggcttttcagtaggggcagttgagatctcatgtctttcttgccatatattaagaaaaaatgttaattaggtgctaccatgatgtttttctaccaggattaagtaaggttcagaagcagataaatatggcagaattggagaattacaataatactcttgtttttggcatttgttggcttttttgcttagaatttccaagtatgtttttacattaatattctccatttaagaaacatcctatggagtagcaacagggaaatactgttttatctactcaacctacagagacaaagctaaatgcagaaggataatttgctcatttaggatctgatgttctcgaccttccatcacttatgtggaagatatttcatatttgcctgatataaatattggcaatgtatggccccgcctttaagaatctcattaaatttatctgtaataaactatactacaggaaactatggtaattactacaatacaagttaagtgtcatcgtaacaggaagcaggaatgggagccattactttctttttttttatttcaataatttttggggaacaggtggtgtttggttgcatggaaaagttctttagaggtgatttctgagatttgggtgcacccatcacccgagcagtgtctactgtacccaatgtgtagtcctttatccctcaccccctcccaaacctcccactgagtccccagtgtccattatatcattctcatgcctttgtgtcctcatagcttgactcccacttatgagtgataacatacgatgtttggttttccattcctgaattacttcacttggaataatactctccaattctatccaggttgctgcaaatgccgttatttcattccttttgatggctgagtagtattccatggtgtatatctataatatatttatatatttttatgtataaaacatatatatatatatatttacaatggcaaaaatatagaaccagcctaaattcccatcaaccaatgattggataaagaaaatgtgatatatatatgtatatatacacacacacgcacacacatatacatgctgttttcatgactatggccttataatatagtttgaagtcaggtaacgtgatgcctccagatttgtgctttttgcttagtcttgcttgctttggctatgtgggctcttttttggttccatatgaattttaggattttttttctagttctgtaaagaaagatggtggtattttgatgggaatttcattgaatttgtaagttgcttttggcagtatggtcattttcacaatattgattctatccatccatgaacatgggatgtgtttccatttgtttgtgtcatctatgatttctttcagcagtgttttgtagttttcttttagaagtctttcatgtccttgattagatatattcctaagtattttattttatttattttggagctgttgtgaaaggggttgagttcttaagctgattctcagcttggtccagtaagattggtaccaattcttttttgaatgtcagctgtgaatccatctggtcctggattttttttttttttttttggttgacaaattttttctgttagtgtttcaatattgttactattgttacttgttattggtctgttcacggtttctatttcttcttgatttaatctaggagggttgtatatttccaggaatttatctatctcctccagattttctaatttgtgtgcataaaggtgtctacagtagctttaaacaatcttttgtatttctctggtatcggttacaatatctcccattttgtttccaattgagcttatctggatcttctgtcttcttttcttcttggttaaccttgtgaattgtctatcagttttgttcatctttacaaagaaccagctttttgtttcatttatcttttatattgttttctttttgtttcaatttcatgtagttctgctgtgatctttgtcatttcttttcttctgctgggtttgggtttggtttttgtgtttgtttctctagttccttgaggtgtgatgttaaattgtctatttgtgctcttttagactttgcgacgtaggcatttcatgctatgaattttcctcttggcaacacttttgctgtatctcagtggttttcataagttgtgtcactattatcattcagttcaaagaatttttaaattttaatcttgatttcattgttgacccaaagatcattcaggagcagattatttaatttccatgtatttgtatggttttgagggttccttttggagttaatttccagttttattccactgtggcctgagagagtacttgatataaattttgattttcttaaatgtattgagacttgttttgtggcctatcatatggtctatcttggagaatgttccatgtgctgatgaatagaatgtatattctgcagttgttgggtagaatgttctataaatatctgttaagtccatttgttataagatatagtttaagtccattgtttctttgttgactgtctgtcttggtgacatgtctagtgcattcagtggagtattgaagtctcctactattatggtgttgccatatatctcatttcttaagtctagtaataattgtttagaaatttgggagttccagtgttaggtgtatatatattttggattgtgatattttcctgttgaacggatccttttatcattatatgatgtccctctttctcttttttaactgttgttgccttaaagtctgtcttgtctgacctaagaatagctcctcctgcttgcttttggtttacatttgcatggaatatcattttgcactcctttctctaggagtttatgtgagtgcttatgcattaggtgagtctcttgaagacagcagatacttggttagtggatttttatccattctgccattctgtatcttttaagtggagcatttaggccatttacattcactgttaatattgagatgtgaggtactgttttattcatcatgctaattgttgcctaaataccttatttttttttccattgtgttagtgttttataggccctgtgagatttatgcttcaggaggttctattttggggtatttcaaggttttgtttcaagatttagaactccttttaccatttcttataatgctggattggtagtggtgaattctctcagcatttgtttgtctgaaaaagactttatctctctttcatttaggaatcagttttgctggatacgatattcttggctgataattattttgtttgaggaggctaaagataggaccccaatcccttctggcttgtagggtttctgctaagaagtctgttgttagtctgatagtttttcccttagaggttacctatgctttcgcttcacagctcttaagattatttcctttgtcttgactttaggtaacctgatgactgtgtacctaggtgacaacttttttgtgacaaatttttcagctgttctttgaacttcttgtaattggatgtctagaactgaagtgaggccaaggaaggttttcttaattgttccctcaaatacgttttccaagcttttaaatttctcttcatcctcaggaataccaattattcttaggtttacctgtttaacataatcccaaatttattggaggttttgttcatttttaaaattcttttttctttaaaaattttttttatttcaataggtttttgggaaacgggtggtgtttggttacatgaataatttctttagtggtgacttatgagattttggtgcacccatcacctgagcagtgtacacagtgtccaatgtgtagtcttttattcttcaccacccccaccatttcccctgagtttccaaagtccaattatcattcttatgcctttgcatcctcatagcttacctcccacatttgaatgagaacatactatgcttggtcttccattcctgaattacttctcctagaataatagtctccaattccatccaggttgcagtgaatgccattatttcattcctgtttatggccaagtagtatttcatggtatatgcataccacattttctttatcaaccccttgatttaatgggcatatgggctggttccatatttttacaattgcaaattgtgctgctgtcaacatgcatgtgcaagtatcttttttgtataacttcttttcctttggatagatacctagtagtgggatttctggatcaaatggcagatctacttttagttctttgaggaatctccacactgtttttcatagtggttgtactagtttacattcccatcaacagtgtaatgtgttcccttttcaccacatccatgccaacatctagtatttttttattatggccattcttgcaggagtgaggtggtattgtattgtggttttgatttgcatttccacaatattagtgattttgagcaatttttcatatgcttggttttccatttgtatatcttcttttgagaattgtctattcatgtccttagcccactttttgatgcgattggttttttttttttcttgctgatttgtttgagttgtggattctggatattcatcctttgttggatgtatagattgtgaagatttcttcccactctgtgggttgtctgttaactgtgctgattacttgttttgctgtgcagaagcttaaggaaggaatagaatctctgaacaggccaataacaagcagtgagattgaaatggtcatttaaaaactgtcaccaaaaaaagttcacaaacagatggatttacagctgaattctatccgacatacaaagaagaattggtaccaatcatattgacactattccaaaagatagagaagagggaatcctcctttcagtcattctatgaagccagtaccaccctaataccaaaaccagggaaggacatttaaaaaaacgaaaactacagaccaatatccctgatgaacatagacacgaaaatcctcaacaaactactagtgaaatgaatccaacagcatatgaaaaagataatccaccatgatcaagtgggttccatatgagggatgcagggatggtttaacgtacataagtcagtaactgtgataaaccacataaacggaattaaaaacaaaaatcacatgatcatctcaatagatgcagaaaaagctttttgacaaaatccagcatccctctatgattaaaaccctcaccaaaatcagtatagaacagacatatcttaacataataaaagccatgtatgacaatcccacagccaacattatactgaatggggaaaatttgaaagcttcctcctgagaactggaacaagacaaggatgtccactttcaccactgctattcaacatagtgctggtattcctagccagagcaatcagacaagaaaaagaaatcaagggcattcaaaatggtaaagaggaagtcaaactgttgctgtttcctgataatatgattgtatacctagaaaaccctaaagactcatccataaagctcctagaactggtaaatgaattcagcaaagcttcaggatgcaaaattaatgtacacaagtcagtagctctgctatacaccaacagtgacaaatctgagaatcaaatcaagaactcaacccctttcacaatagctgcaaaaataaaataaaataaaatacttaggaatgtacctaaccaaggatataaaaaacctctacaaggaaaactacaaaacactgctgaaagaaatcatagttgacacaagcaaatggaaacacatcccatgctcatggatgggtagaatcaatgttgtgaaaatgaccatactgccaaaagtaatttacaaattcaatgcaattttcatcaaaataccaccatcattctttacagaactagaaaaaaatcccaaaattcatatagaaccaaaaaagatcccacatagccaaagcaggactaagcaaaaagaacaaatctgaaggcctcacattacttaacctcaaactatactataaggccatagtcaccaaaacagcattgtactggtataaaaaaggtacatagactgatggaacagaatagagaacccagaaataaagccaaatacttacagcctactgatcttagacaaagcaaacaaaaacataaagtggggaaaggacaccctgttcaacaaatggtgctgggaatattggcaagccacatgtagaaaaatgaagctggattcccatctctcaccttatacaaaaatcaactcaagatagatcaaagacttaaatctaagacctaaaaccataaaaattctagaagataatattggagaaacccttctagatattgggttaagcaaagacttcatgaccaagaaccttgaagcaaatgcaacaaaaatatgataattagataggactttattttttgtctttgtttttgtctgattggattaattcgaaagccttgtcttttaactctgaagttgttttttctgcttgttgtagtctattgtcgacaatttccagtgcatttcatatttctttaagtgtgtcttttatttccagaagttgtgattgttttttctttatgatatctgtttccctggataatttttcattcttatcctgtattttttttcaattttttaaagttggctttcaactttctctggtatctctttgagtagcttaataataaaccttctgaattttttatttggcaatccagatatttcttcttggtttgcattaattgctgaagagttagtctggccttttggtggtgttatagagcctgttttgtcatattaccagaatgtcttttctgatttcttcttctttgggtagactacttcagtggaaaaatctggaactcaagtctgctcttcagattcttttgtcccatgagttgatcccttgatgtgttgtgttcccacttcccctaaggttgaggctttctgagagccagattgcattgattgttattgctcttctgggtctagccactctgtggagctaccaggctccaggctggtgctgggaaatgtctgcaagcttcaggtctcccagccatggataccagcatgatatggtttggctatgtccccacccaaatctcatcttgaattgtagctcccataatctccacatgtcatgggagggaggtaattgaatcacgggggtgggtttttcccatgctgttctcatgacagtgaataagtcccacgagatctgatggttttctaaagggcaatttccctacatacactctcttgcctgctgccatgtaagacaagcctttgctcctccttcaccttccgccatgattatgaagcttcctcagccaggcggaactatgagtccattaaacctctttttctttataaattacccagtcttaggtgtgtctttattagcaacatgagaacagactaatacacaacacctgctctggtggaggtggcaggggattgaagtagatagactctgtgagagtccttgtttgtagatatgtttattgtgctgactttctcaaatgctgattatgctagcagtgaagttgtcccatggacagacccaggacctctggttatccaggatgctgcaggcagtggaattagctgttgttttctccttccttggagcagggttattatgtcatgagttgctgtaatgtcctgagttggttggcctccacccaggtggtggcacattcaagagaacaccagttttgcacccgtctcatggaatttgcagtggcatgccatttctttcaagggatctgtgaattcttttggttttcctggtacattcttgaggtggttcttggagcaaaagtccatggtatgagtctccacatgcttttctctccatccaagtgggagctgcatgttagccctgtcttctatctgccatcttcctctctgagtccaggagcaattacttttaaattgaggaagaatgttgtgaatttcactagggacacagagtgggattggagcagagatttaactgaataaagaggagaagggtcaatcgaggtagagagagcaatagatgcaggttcagcataggtgaaagctgggacgcttgagttgaggagacagtagcaatgaagccggacagatggatatgcatggggcaagccttagaagagcaagttgaggagttcagatttcatttattgggtatgaaaacagccacatagctgttttggaaagggaagttgttttggataggatcagctatgttctacagaaagctattatgtagccattctatgtagaatcgttggaaattggtaaattttaaaatgttcatagactttaatgaggtaatcctgtttctgagagtttatgctaaggaaacaactgaatctattgaaacagttttatgtgcagcatattcattaaaatgccaaacaagaaagggaatggttatataaactatggtgcaatctcttaatggaaaattaagaaaacactatgaatttaaaagtttacaaagagttcttaataatatgagaacaataacaggttatagtaaaagaaaaagcaaaactgaaaactatgagtatggtttgattacagtagttttacaaaattttgtgggggcaaataggcaggagctactgactggtgaaactattggttttctttctacattacaatgttcaatacatttctctaagcatgtattagttatgcgacgaaaaaattcaatatactttttaaatagcccaatcaagaatagacacgtccagtgctactactctggcaagacatgaaccaagcaatggcagtgagaatgtagagaagggggcagattaagatttcaggtggaacattgttctcatagacataagcataagaaagacctaaggcaaaaaggacactacagctctgacttctacagctggttagatactgatgctctaggtcacaacagcaactgcaggaggagaaacagggtcagaagaggaaacttcctaagtttgatattgaatgtgtttatttggaaggatcctgaggatacctgacagatgtatcataatggcagatggagataaaagtacggtcatgcctcagtagtggtggaaggtttgttccaggacccctttcagatgccaaaaaccatggatgctcaagtacctgacatgaaatgacatagtatttgcatataacctacacacatcctcctgtatactttaaaccatcttgagattacttataatacctaatacaatgtaaatgctatgcaaatatttgttacattgtgttgtttaggaaatcataaccaaaaaaatgtctgttcatattcagtacagacacaacaaatccatttttatgaatattttcaatccttggattgaatccacagattgaaaacccgcagatatggagggctgactgtgttcagtacttcctttttttttttttcttttctttttttttattatactttaagttttagggtacatgtgcacattgtgcaggttagttacatatgtatacatgtgccatgctggtgcgctgcacccactaactcgtcatctagccttaggtatatctcccaatgctatccctccccgctcccccgaccccaccacagtccccagagtgtgatgttccccttcatgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagcctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgagaatcgccacactgacttccacaatggttgaactagtttacaatcccaccaacagtgtaaaagtgttcctatttctccacatcctctccagcacctgttgtttcctgactttttaatgattgccattctaactggtgtgagatgatatctcagagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttccttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgctggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggcgtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagcctttcatcccagggatgaagcccacttgatcatggtggataagctttttgaggtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccccaatttcagctcctgttattggtctattcagagattcaacttcttcctggtttaatcttgggagagtgtatgtgtcgaggaatgtatccatttcttctagattttctagtttatttgcatagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcattcagtgctataaatttccctctacacactgctttgagtgcgtcccagagattctggtatgttgtgtctctgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttagaataggtgtggtgtggtgctgaaaagaatgtatattctgttgatttggggtggagagttctgtagatgtctattaggtccacttggtacagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctctggttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacacttaaagttaatattgttatgtgtgaatttgatcctgtcattatgatgttagctggtgattttgctcgttagttgatgcagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagtgtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattgggaaagttctcctggataatatcctgtagagtgttttccaacttggttccattctccgcatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcgcatcggctcttgaggcttctgcattcttcacgtagttctcgagccttggttttagctccatcagctcctttaagcacttctctgtattggttattctagttatacattcttctaaatttttttcaaagttttcaacttctttgcctttagtttgaatgtcctcccgtagctcagagtaatttgatcgtctgaagccttcttctctcagctcgtcaaagtcattctccatccagctttgttccgttgctggtaaggaactgcgttcctttggaggaggagaggcgctctgcgttttagagtttcccgtttttctgttctgttttttccccatctttgtggttttatctacttttggtctttgatgatggtgatgtacagatgggttttcggtgtggatgtcctttctgtttgttagttttccttctaacagacagcaccctcagctgcaggtctgttggaataccctgccgagtgaggtgtcagtgtgcccctgctggggggtgcctcccagttaggctgctcaggggtcaggggtcagggacccacttgaggaggcagtccgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagattccatgggcgtaggaccctcagagccaggtgtgggatatagtctcgtggtgcgccgttttttaagccggtctgaaaagcgcagtattcgggtgggagtgacccgattttccaggtgcgtccgtcacccctttctttgactcagaaagcgaactccctgaccccttgcgcttcccacgtgaggcaatgccttgccctgcttcggctcgcgcctggtgcgtgcacccactggcctgcgcccactgtctggcactccctagtgagatgaacccggtacctccgatggaaatgcagaaatcacccgtcttctgcgtcgctcacgctgggagctgtagaccggagctgttcctattcggccatcttggctcctagtacttccttatttttaagcctgagtaatatcctgttgtgtgtatatactacatattctttacccatccatttgttgaaagacatttaaattgtttccatatcttggctattgtgaataatgccacaatgaacatgggaggatagatatctcttcgtgatcctgatttcaattcctttgaatatatacccagaattgggattgattgctggatcatgtgatgttggtcaaagggtacaaagttttagctatgcaagaagaataatttctggagatctaatatacagtatggtgatggtagttacaatacttcatatttgtatacttgtaatttgctaagagaataaattaaatcttctcaccactcgtgtgtgtgcatgcacacacacaccacacacatgcacagagataattatgtgagataatggacatgtttattaggttgattgtggtgatcatttcacagtgtacacatatatcaagacattaagctgtataccctaaatatatacaatgtttatgtgtcaatgatatcttaaagctgttatttaaaaaggggtcattactggcaaaaatacaataaaatcatcactttcaagtcccataatggaggtgataaaagtaatttagtaatatgttcacatccttcaaatcaaatatagaaaattcgtttgtgctttgatccaaaatagacccccccaaaaccattatacacaaagatgctctaggttagagctagagaaaacagaaactgagaaaaatgaaacattccaccaaactaggggaatggctaattaaattatgatgaatccattcaatggaatattatataacaatttaaaataatatattaacaaaatgaagtactcatgccaaattttaaaaatagcatgtggaatttatacacacagtaagactttggccttatacaatattatataaataagtctagactaatcacatttcaaagtattaacagtaactgtctcaactcttgttagtaacattatgggcactctactctttcttctcttgtttttcaaattcttttctaccaagagcacacattactcttaaaactagagttttttagaaaaatagaaagaatatatgctaagtaatcagggttaaaatgtagactggagaatcctatagtggcataagtcatgggtagtcattaaactccagggagacattatgttgtctctcttaataactgtttagtactagattttataagataaactaaaacattttaatgattcagtcatttgtttaccaaaagtcaattagagccttaggcctttgtcattttgtgatgttcaatgaatgaacatagtgtttaaaattggtttgataaagataaaacttgacattaatgtacagtaatccattttcttacttttcttcagaaaatatgtcatgctcaattttaatttcaagaaaatatagagcaaatctacataaggcaaaaaccctaaagatttgtttgccctaagatatgttgtgctgactataattggattgtcggaatgcatctgacatatgctaatgaaaaagtaagaaagccaaagtatggtttatttgcttatattagtcctttttgtagtcaaaccagcaacacttatttacctccttcttagattctaggaatgaaaaattacaaaaccacatcaccttggcccttaagtaacagatgaaaactactgacagacggcagcgaatcatgtcttccaatgaatagcagaataatgctggaaattggaaaaattcaatgtcaaggtgggcccaaggattcataacagacttcataaaagaggtgacaatttgacataggtcttgaaagcaacgcagtggtaaagaagagagaccttcagataaactcactagattattcttcaaagtggtgatttcagtttccattctaatcagccaggaatgggagttcccatgttcctcctgctagccaatacttgacattgtcagacttttaatctgtgtttgtaacattggacatcttttgctatattaacttgacactatatgtcttctcttcagtgaaatgcctgaatattatgcccaatttctcttgagttgtttatctttttcttattgacttggaggagttctttttgtagtctggatgctaattccttgccaggagatacactccctcctttctcagagccagactgcctgaattgtacacgtcataacagtatgtccttaaacaagttacttagcctctctggctttagttttctcaggagttagattgggataataatagtacctaccgtaaagaattgtgaagatgaaatgggttaatatatggagcacatggaactctgttccgctggtagtgcgtcataataggggcaggctgtcaatgttgttactaacattattgcaacctcccacccaggtgaacgattttctaacccaccttttcctgaagggtgctgtcctctaggagtcctagctttaagcaggaatcttaactccaacttcgtacttgatgtggatctgaggacttgtctccagtcctcatgccgtatgcaactcaggatctccaggactgagaaagccttcaggaggcccatggtctccatcacctggcatgactttcctgcttcctcttcctttctggcccttactttttaaaggattaatgtgagcaggtatttgttattttgttctgcaatgtttctgcatctttaacaaaaattttaagagagaagttgcttgtaaactactcagtatgtcatgttgatgaacgtagaagtctttgtccattcttccctctagcatggtgttcttttctttatgagaattcattctttgttaagcatatgaaatgttttctctcatattgtgggtatatttttatatgcagtacaatttcatagtcaaatctgaccactttgactttattatttctgctctagaagcatgcttagaaagatccctcttaccccaagattacattaaaaatgtttttattatttgtatttccatcctatatgttatatgataccaaatgtcatttagaattgattctgacatgtgaagtcaattagggaatctaacccttttcttcaaaaatgtttagccagttatcacaacccctcttattgagtgatcactctttccttagtggacaaagccctagatgtgggaatttccatcgacctggctgccaactgtactttgtattccttctgcagggcatggccagcagtcacagcaccagtctgctgtttctcacacctgaataggaaagaacttgcactattccctactggacagacattcatattggcagaaagaatatgaaaaaaaagtgacattttaaattacttgtgcaatgagtccaaaaacattatgactagaaatacccaaataattatgggcagaaataaacataaataagaggatatcaagagattgctggaagccccattcttattggtaggaagcagtcagggcatcttcgttcctctcattagaactattacgtttcagaatgcaaatcctagctctggtcctcactgagtgtatagaatggtacaatttatttaacttacctttgctaattcagcagacatttttcagcacctgttatgtgcaagttgtttactggcctgtgagttttaggtaccttaatcatagcctgcattagacagatgtatgccagagccctgctcttagtagaagctcaatacaagattggatagttgctgcccacctaactcttcagaccctcaaccaatttaaattggattaaacacacacaaaaaattcagaaacaagactggcttggccttctatgtatttccttaacattttagtgacacatagaattcctttcttaaaggggattagcattctacatagtaaaacattttaattataaaaattatatttattacatgaagtctgttcttcccaggcaaggtctaatccactatacatgactcattttcttgtgagttttactttagcctcagcctttcaaaatttccgagtgaaatatcattaatcctggtgattcatggcctgcgcctggtattttgcagtctttagtgtgaaatccttcatttagaaaactgcaaatggaggtgagaacctaacatattactttggaacattaattatgaaacataattacaaacacaaatgcctacaatggtaataattttacagtttgtaattgtaccagaaacctccaactggatgtacttgtaacatcctatggttggattcgtttcaatggattgcaaaagagtgagccatcagcagggttctctgtagattagtctgatcattaagatccttgtcctgggttacacatccgaggtagcagtcaactgagtcattttagtctaggccatccaggccagattcacttttcctccctcttgaagacctggaggacagtctctaaatgcaatcaggcttcatctgtcagtgggcagtgcctagtccctgagatagtgccctcccgcaggttgtggtgcagggtactcggagggtcaaaaacttcttgctgcattttctgttttcgcgctggacagacttgcccagaagtcaccctctgagaacactgttggagatcacttcctgggctttcgagtgagggaacccccattgcactcccatcacactccccataccagtgggtcctgtgtggtccaaaggggtccctgtcgctccaaacagaagagagtgtggtggcatccttatagcatcatgttgggagcctttgcagagaaactgatctggatttaaactgtagctctggcattctctccctgtgtggccttgggcatgcatcttaacttgcttcatgtgtaaaatgggtacatcgcagggtgccatgaggactggggatgacacacatggcccagcaggaactcaacaaatggaaattcacgtgatcgtcatttcatatcacagtacacagcatttatctatctgaggcttgatattgaacactcctatgctgcaggctctgtgttagaaaaggaagacacaacaatgaaagatgcagtctctacccttggggagtttatggtttagagaggagagaattaggaaaatgtgaaattacctatgagccaaggcaggcctgaatagtaggggctcctgaaacacttagggagctcttagcccagcctcagatagctgctgaggcaaaaacctcctgagaagctgatggccatgattttgaaggagaggcaagagtctgccccgggaaggccgaaagagccctgtctgcagaggtggtggcacttgcgaggccttggggatgggttacaggtgtgcatggctcccaaggaccttggcacaaccacacagctgagtcctttgtatgctgcagtgtaagctgaagactctgaaatgggtgggttgtgaactgttcaataacctatttgatgcactgtccaaagagttaatgaaatctgaacaaggaggaaatgggtctccaggaggagaatagcagacaccacaattctccaaagagcttttgagtggtgctactggccacggggagatcagtgctctaggatccaataaacctgctctctccactgtacacacaactttcatatttatgtatctcccagtcctagctccagagaacgtcccataagaaccagggtgagccaagagttttttataatgaagtgggagtggcagccggtaaacagaaagcagaataggtttgaaagccttcaggccaaatcaaagagaacagagaaagagaaaaccacaggtctctgtgggtaacttctgatatgactcaagtctctatcttgtacactggaaatagcagcttttctaagaacatgatatcctttctcatttatacggtataattgttactttagggaattgtcttcactctatttggttcttggtggaatttgatttcattatatgatcttgtttgtgggttttggggcttaagctgtagacagcattcacttattcacacaataaaatatagaagttacgctgataagattttgctataatttttatacaaggtaattaaattccagcctaatgtgccaagacagaacattattatatacatttggcatttgtttagccccagaaaattcactcatccaagaagtccactgatagtgtacccatctaatataattaccctattatgcataaaataatgtgtttaaagagttagggaacctgctttcttcactgcagcaagttgtaaatgaaatgaaatcaccctggctataatattaaaagtattgagaacattttttactcagtctgctctaactgagtgaaggcaaatttttcagaacgacagaatattgtacacatttctttggaggtaagaatcttaagaacttctcattaaaatgttacttaggttgatctatataacacattctaggcctctctagttgacagcaaagtaatactggtgcctgtgtgttgcatgtaactgtggcagttcaggaatcagttccaatttgctgaccatcacagcattcgttcattgctagataaggtttctcgtagcacaatttcttgattgacggtcagtcagactcatctgtttatctttaaagccttccttccacttgaccttcaaaatgccttctaatgctatatatacaaatagaaggtgaagaaaaatcatttgaaccaaacaacagagtaatttcaaaactatctttttcaggttaaaaaaagagcagaaatgattaagaaaagagcaactataccttaattatcttggcattgcccacagtgccttgatcatgatatacacccaaaaagtagtcactgaataaatgaatgaatcagttaatcatttagttaatgaaagaaatgtcttcacgttttgcaaaacagtttggttaagtagttggtggaagttctgtttattgacaaatgactagaggaaaagattactgtagataatcaagagactagaaatggctactttctgtgtgtgaaagtgttttcttgcattcaaactctatttctgagataggtctacctattagtgactgccagacctcagagaaccttgactcctctgcagcaggaccataaccctgagtcctaaaggctggatgctgtcctcagatgtgtttgataaacctgtgcaattattttttgagactctcaaatattgagaattttcatgtccaaatttctggcttctttggcatactgcaatttctggcaacactagacccatattcttatgtgtcaatgaatgtctgtggttaagtaacacccaccccttctagatggcatgtcttgcctagttttcttcattctcaccagctgctgctaactccaacatggcagtctagtgccaatcgatgtttattatcttctttgcattattacttctcttaaagtaggtgaatacttctatggccccagattgcctggataagtacgtgttgtcagaaaaaatgaaagagagcaaattttcatttggaaatgggataatcatctcttgctgattaatatgcaaatgaaccatgtgtggggaaagaataccataaagcttgcttcaataattcactttacttgcataattcctgtaagcatttgaatgttaaacccttgctttacaaatatctgtgaggaagggaagaggaaattgagcctgtttgcaataccagaatcaagtcagaaaaaaaataaaatggaaaaatctgggaaagtatagacagcaggagataaaaggagaaaggaaacatttccaactcaaacttcccttttttctatatccacttcttgccaaatattgtttttaattattctctctcttttcattttcagttttaattattcttaaactcttcccatcttctccccaggaattttttggcttatcaacagctggaggtaggatgggcttataaggaaatgaagtccaacaccaacaatagtaatcatgataacaatatctgtcatttattgcccttcttctctctgcctgccaccaggttaggggatttaaatacattagccttaatcctctcgataattatttaagatagcattgcacccccattcttatagatgacatgaccaaagcttacaatgattaagtaatcttccccagctaaaaagagcagaacagagattcaaattagatccacttgatcgcactatgcatgctctttccacttggacttgcttaatagttggctaatcattccaactggatcattaactcatgcttaaaaagataatgaccatatcaatctctttcagagttcattgatcttgaattagaatttacaaaaaaaattctcttccaataatgtaaaccacagttagtctttactttcccaaacaaactcatgaaaagattttaaaatttcagagctttcattgcatagttttctaatatttgaacatatatattattatatatacagaatattagctataataaatatatatttcaaatatgtatatgaacatatatatcattatatataaagtatattagctataatattgtattagtttgttttcatactgctgtaaagaactgcctgagactgggtaatttataaaagaaagatgtttaattgactcatagttcaacatgctggggttggcctcaggaatcttacaatcatggtggaaggtgaaggggaagcaagacaccttcttcacaaggcagcaggaaggagaagtgccaagggaagggggaagagcgccttataaaaccatcagttctcatgagaactcactcactatcaggagaacagcatgggggaaaccacccccatgattcagttacccccacctgatctctcccttgacatgtggggattatggggactatgagcattacaattcaagatgagatttgggtggggacatgaagcctaaccatatcaaatgtatacaaagttctagtgtgtgtgtgtgtgtgtgtgtgtgtatatatatatacacacacacacacacacatatctgcaaatttaatctatgtatgggatttaaactattttctaatgaaaatacttatttgttcgttcattcattcagagcagcagtatagagatgaaaacggagaggcaaaatctgatcctaccatttactaactacaaggtcttgctcaaactacttgcctatctttatttcagtcttcttattttaaattaagatgaagaatgccagctttatatgaaaaataaatgagtatatagggatattcaggtcatctatttctttttgactatgcttgaatagcttgtttgtttcaagaaatttgtccatgtcatgtaagctgtattaattgtcataaagttcttaataacttctcttattatacttttaatgtggaatctgtagtggtatcacccctctcattcctctaagtggtaatttgtgtcttctctcttttttgtgatcatttttgccagaggtttattaatagtatttaccttctcaaagaaaaagttttaggtttcattgatttttccttattattcttctattttatattttactaatttccactcagatatttattattttctttgttctgattactttggtttgcatttgctattcttttactcatttcttaaggttgaacctgaggtcattgacttcagacctttcttcttcttttctaatagggattttagtgctgtttccttctaattattactttagtagtggcccacaaattttgatatgtttactcttcactcagttaaaatacttaaaaatttttcttcttatttgttctttgacacatgggttttgtttattttccatctatttagggattttcctgttactaatgctcatttaatttcatgtggtcagatagcttaccttgtgtaacttgaattatattaaatttatttgtttacaaatgtatttgtttatctctatttttaatttttatgggtacctagtatatatgttcaaatattagaaaactatgcaatgaaagctctgaaattttatatatatataaaacgtagttatacatgttatatatatacaacatagttatacgtgttatatatatacaacatagttatacgtgttatatatatacaacatagttatacgtgttatatatatacaacgtagttatacgtgttatatatataacatgtatatatataacatgtataacagttatacatgttatgtgtataacattgttcataacagttatacatgttctgtgtataacatttatatgttatatacattatatatgttatatataacatatataactatgtataacatatatataactatatatgggttttgtttatatatataatatataatatatagaaacaaaacccatatatattatatattattatatataatatattatatataatataaaacatacatatatataaacccatatatatatatatatcccatatatatatatatgtatatatatgggttacatgagatattttgatatgggcatacaatgtgtaataatcacatcagggtaaatggggtatccaaaattcttttacatttattgagtcttatgaacacgaatatgttctattttcgtaaatgttctgggtgtaaagaagatacatgtgtgatactgtgggttatagtgttctataaatgtcaatttaggtcaataagttgacaatatcatttagatcaattgatagataatgtccaatttttctatatgtttactgatttttttgtatacttgttctatcagttattgagagaatggcattgaaatatctgactatagttatagattttttaattctttttgcaattctattagtttttcttcatatattttggagctctgttattaggtgcataactctttagaattattatgtcctcttgataaattgacccccttatcaatataaaatgaccttttttattcgtggtaaatttctgtactctgaaaactactttgttgacattaatttagccattccagctttcttttcaataatgttagcattattttatcttttttcattttttaattttaacctatttgtgcctttatatttaaagtatgtttctcggaggcagcttataatgttggcttctcttttatacaatctggcaatgtctgccttttgattaattgcttctattatgattatgatgtggttgtttcataaatgtgttattttgtatttttatttgtcccatgtgtcctggttccatgtttttccttttgttaaaatcttctgttgggttaagtattttttatgattcccttgtatttcatgtatttgtttcaaatttttgttgtgtaattttagtggttgtcttaaagtttgcagcacatatttttaacttaccacactagaatgtcaaaagagattataccattttatatatagtataaaaacatggaacatttttccattttccctcttaacctttgtgctgtattatagcttttacttctatatattatagatcctacaatacattattacttttacttttaacaattatcttttggagacttaaacaataagaaaaaatttttctattttcccatatagttgacatttctgatgctcttcattcctttatgtagctccagactttcatctggtgtcattttccttctccttaaataacttcctttcatatttcttgaagtgcagattggctggttataaattcctttgtatgtatgaaatgtctttattttgtgctcccttttgaaagtgagacaccctactctgtctcctcagcttgggagaccactggactctgctgggatcccctttttgctatactgactgcagactttctccaggcagtgagctgggcagtgacacccttcccccatttgtgtcctgcttcttaggggtgactgcttccattgtcagatgtccagtgccttgagaaactattttatctcttttacctgttttttagttgtttcaggcataacaattaatcaggtcgctcttgctccattttggtcagaggtgggatctctgggctctagatggaactggattttcctgagagttcttcccagtccacccagctagaacagagcggccttctcactggacactgggcattttggtcccaggtcatagaagagcagcatcctcacagtgtgacctcagctgagccttccactgcgtacttggtttcattttaagtcccctctctcaagacttcctaaatgtcaattatctgacccacctgggcactacatagaatattcttattgttgttgtactggatttacaaactctagaagcacattagagaaaatgaagggactttgctaaattttaagctgttccttgagctgccctcaatgttattttatccttttagagtccaagtttttccatagttccccctaacgcaaatgcacactcatgctcactctctctcacgcacacactaagacacaagggagtattgctcaggccctcaaagacagatcgccacagggacttctgtgagacactttctcagcacatattttccagccataatgtcttccgaaatcaaagccaacctaacaacagaatttccccagtaaaatcacagctaattgactctgaatttgtaaacgaggcacacatccaaatccatgtgggatcttgttgtgaccagcgtgtgttttccagattctctaaactcacagagtgaaaagagggtcatctataacaaatcctctcagtaggagatcccttcctttctccaatttgagaggcccacagagtaatcattagacaaaggatcgtttgtgtcaagttttaagaaaatttggccaaagcgatttaatcaagcccaacggaaagctttctacgagagcctgggccaccaggaactttattctcgccatccgagatagcggctcagcacctcacatggtaagaggactatgtattcctttcccttcgtgaaggctctcaagttctgacctgggacctgagaaatgtttgaattgggtaacgtgaaaggagcttctaatctactaaacagaacatccatacatgtcatgtcctgaggataaatgttggcatctcctgtgattgaagcttagcactcctgacctcctgaggtgaaacttcaatgagctttagctctttcagccatgagttgtttaggcttgagctaagcacattacctgagctggtttctgtttctttatctgttggtacaaaagggaggtgacaatttgctttctaagatcctttccagatccaacagactttgattatttttgtttaggtactgggcaaaattactctgaatataatgctgtttagttcagtaaattctaagaaacagactaaaatgtgtatgaccaatatactgggtccatgtgacaacaacaacaaaatccagataactggcaaaatctaagccattgacttaattctttacaccttattgaggctaattcattaataaaacaggtcatccattgagatttcatgtgaccataaataatgagtggcagagttagaataaagtctaagatagctcaaagtttttcatcctgtgcaaagctttcactctatatattattccataaaataaaaatatgccatattaaaggaaagagagctcagaattgaaaatgtaaaacttcccatcacttcaatttatcctgttagcatctcaaattcaacgttacattaacatggttcattacacttaatgatttcaatagcaataaagacaatagttttcagaaatcacttagatcttcccatggtctttagaaaaagatttggtttactttcctgcatagatcctttccaggatttttaatctaaacatgatttctttggcaatccaaattatgaaaattattagcacagctagccactactgcatccttacagtgatgaacaataagctaattaggtgtgtagtggcatattctatcggtgattaaccagctgggatggagttatttacacctctggaagctgtgtaaatcttacacttctgaagctggcaatagaattttaaacttacacttaaaaggctgataaacactttaaatataagctttattgttgttataaaatttcattttttatgagatttgcattcctttcattgattaaatactcatatcttcatacatttatatgtttgtgtttatgtgtatatatctggtcctgtgtaggcagaaaacattaaaatgtgcagattcaaaggaaatgagaattgatgctaaactttgtggccttgttaatgttttggattcaaaatcattttgaagatctaaggtcccaatagtatttcatctagtaaaaataaaactgcgattcccttagcaacatgctacagtacagggcccataaagtacatttgaaaaccaaacgactgtaaagtgatccactataatcaaatctgtcttgctgtgctagatgatatgaactgttctttaattgttgttttgcagagataaataaagcaaaacgctagattctgatttatgtagcattttacaaaccaaaatccatttttaaaaaaattttgtatcgcattccctcagaagcaccagggagaattgaggacgtcatgctgatgacttttattagtgtgctgacatataaatgatgctacctgtgaggagtgggtaggagaatgggcctaaatgcaattatctcccacttcatgtccaatcctactcatccatcagtgcagcccctggctcctttatagacgggccctgcctgccccacctcatttagccctcctcctcctgtagtcctagcaactgttatcctacctttatttcatcatgtagccagagtctgccaaatgacaccttttcagtcattgttagacgagtcttgctatgttttatcttccaagtgtgggtctctgggagcttcataaatagcatccaccaggattctgaataaattgcaaattcggtcactcaacgagaaacactcaatgtatcaggcacggtgctgggcagaaggagaccccagggaatgacacggatataaaggtgtgttctcctggagcctgtattccaactggaggagacaaaagtaaacaataacccgagaggctgtgcagtgactgagcgcgggcccctccagagttactcagtggggcaggcactgcagggttgctgagccgggtccgggctcccttaggaggatctgctgcagtgagatgtgcggcccagaggagcagaggaaactcttttctgcacataggtgctctcaggtggaaaagggagaagctgtgccagatttatcaatcaggtgaattagctcacctcccctggaaagcagtgagtaaggggtagagaagaggaagaaaaggggctgggagggtgggcttcctgtcatggaagatttatcaggagtggagaccttcctcctgctgcagtcatgcgacacttaatgactgggataccctctaagaaatgtgttgttagatgattttgtcactgtgcaggtagtgcacttacacacacctggacgggacaaccccactacacacctaggccctgcggtgtagccgattgcccccaggaaataaacccctacagcaagtgatcgtcctgaatactgtagacaattgtaacacaatggtaagtatttgtgtatctaaacatagaaaaggtgcagtgaaaatgtagtataaaagataaaaaatggtacacctatatagggcatttgccataaggcttacaggactggaagtggctctgagtgagtcagtgagtggtaagtgattgtgagggcctagggtatcactgtacactaccagggacctcatagacactgtgcacttaggctacactccatttatacaaaatagttttcttcagtaaaaaattaaccttagctcactgtaagttttttactttataaactttccaattttttaacttttgactctttagtaaaaacagcttaaaacacaaacacattatacagctgtacaaaatattttttctttacatccttattctataagctctttatttttaaaatattttatttctttttactttttaaactttgttgctaaaaacaaagacacaaacatacacattagcctgagcccacacagggtcaggagcatccatgtcactgtcttctacccccacttcttgtcccactggaaggtcttcaggggcaatggcaggcatgaagctgtatctcctgtgatcacagtgcctttttctggatgcctcctgaaagaacaggtgtcacactaactgagctcctgtcacacggaaggaaacaccaggggtaggaaaaaagttccaccctaacatccacaaatagatgtgtttcatgaggacaaggagcaagttcttacacttcttgatatttacatgcctaagatttgttgtcctaattaacatattgtaccccttttattctaatcctaaggtccaaaagaaaataagttagatatgttttttcaatagccaaaacagaaatatgaatgcaattgttattatgacatttcacattcattcagggggaaactcagcatctgcaaagccagaagacaaagtcttgcttttcaccattcagtaagagccaatggatcttgaagtgaacagatttggaaaagtgacctgaacagccaagatcagcaaataacaaggaacacaaagaaaagctagtaagaaagtaggaaaatcaatatggaaattgaccactaatatatccataagtgtatatacgattttaaacaacagatctgaatctgctgcacaccagggctgctgtgacgcatagccctggcaggtgctttctcattgtcatctgtctgaccgactgggcagagcccagctccagtggctacattcaatgttcatgcaccctctggagctgtgccaggctgtgaacctatttacaccctataatgttctaactttactggagaaaggactgaaacagtatggttatcattctctagttatgggactacccattcatttccctgacagaagtgtaaatacttgagtgcaggcaccatctccgcttcacctttgcacccttttgaacgcacaacacactacaggtgtagagcgagtactcagtaagtgttcatttaatgatccaaagctttcacggtctgtgtaactctctatagctgaacttccaaaacagtagccaatatctatacatggttaataagcacttgaaatgaggttaacccaaattgtaaaatacaagattttgaagacttcagatgaaataatgcaaaacatctcattaataatatttatattgataatgttgaaatggtaacattttggatatattaagttaaataaaatatattattaatattatgttttcctgtttgtttttactttttactttggctttgagaaaatttaaaattatatgtgtggttggtgtttgtgatttacattagatttcttttggataaggacggccaccttagacaaaaacctggatggtaatttgacttaaagtttatttatttatttatttatttatttattttggtagccatactcataagttagcactacgccaatggagtgtaaaagttttgctgccattagaacttgcataataatttcactgtggcatataaagaatatttgtattgcaataataacatgattaagaatatcaatagtcagtattacctgtacgcctgatgaacttagaagtaaattatgctctgttcgacaatgtggattgtctttcccttctgaagttaccctcagatatagtcaaatcagttatgttttggatgtccttctaaaaatgatcactgaggtcatgcagtggaaggaattcagattttgaggagctgtgcacatctgaatgttagactctgaaagaaactcgtgggtgtggaaataagtgtttctggtgctgcattagtataaaaatccatcacatctaactttgcacactatttaaaaattataaatcaagataatgtattttacatattcacttttaaataattgctgataaaatgaaaaatattcattaagggtaaaagtaattttactttatggaattgacaaatataattgctttaaaattagtttttgaggtttttttttttttttacttgaccaaatcttggcttttggttaatttgaaaataacatgatagaagcatacctgatgaaaaattataagatgtgataaaattacttgaaccatttttgtcactgttagtcatagtcttagttaaattttgtaatatacgtcacataggaacatcttccttaaaatttttcaatattttgaaaaacatccctctcaaatatttttaacaagtgagaatatgcagtgtttagttttctgtttgtgcgtgaattcgcttaagatagtggtctccagctgcatagatgttgctgcaaaggacatgatttcattcttttttatggctgcaaagtagtctatggtgtatatgtaccacattttctttatccaattcaccactgatgggcaactaggttgattccatgtctttgctattgtgaaaagtgctgcaataagcatgtgactgtatgtgtcttgttggtaaaatgatttgttttcttttggatatgtgcccattaatgggattgcttggttgaatggtagttctgttttaaattcttggaaaaatctccaaactgttttccacagtggctgaactaatttacattctcaccaacagtgtataagtgttcccttttttctgcagtcttgccaacatgtatttttttttttttacttcttaataatagccattctgactggtatgagatggtatctcgtggttttgatttgcatttctctaataattactgacatgagcattttttcaggtttgttggctgcttgtgtatcttcttttgagaagtgtctgttcatgtattttacccattttaatgggtttacttgttttttgcttaattgtttaagttcgttataggttctaaatagtagacctttgtcagattcatagtttgcaaatatcttcttccattctgtaggctgtctgtttactctgctgatagtttcttttgctgtgcagaagctccttagtttaattagatccatttgtcagtttttgtttttgttgcaattgcttttgaggacttagtcataaattctttcccaaggcccatgtccaaaatgacatttcctacattttcttctaggattcttatagcttgaggtcttatatttaaattctcaattcatcttgagttaatttttttgtatagtgaaaagtaagggtccagttttattcttctgcatatgactagcaagctattccagcactatttattaaataggaagtcgtctatttgttgcttatttttgtcaacttcatcaaagattagatagctgtaggtgtgtggttttatttctgggttctctattgtgttccattggtctgtgtgtccagctttgtaccagtagcatgctgtttttgttactatagccttgcagtatagtttgaggtcagataatgggatgcctctgggtttgttctttttgtttaggattgctttggctattcggcctcatttctggttctatatgaattttagaatggttttgtttccaattctgtgaaaaacgacatttgtagtttgataagaatagtgttgaatctggggattgctttagacagtatggtcattttaatgataccaattctgcttctaatccatgagcacagaatgtttttcattcatttgtgtcatctatcatttttctagcagtattttgtagttctgcttgtagagatcttgcacctcctttgtcagatgtattcctaggtattttctgtatgtggctattgtaaatgggattgtgttcttcattttgctctgtttgaatgttattggtgtatagaaatgctactgatttttatacattgattttgtatcctgaaactctgctgaaatagtttatcagttccaggagctttttggtggtgtctttagggctttcaaggtatagaaaaccacaaagagcgaaagtttgacttccttccctatttggatgccttttatttctgtctgttgtgtaggcactattttaaaaggagtgttatcttcaatgtatttgagtgactagaaattacattttaattgttattaaaatcataataagtttttatgaacatttacttggctgaattagaagcaaagagagagggtatgacctgtgtaataccttgtgtttattttctttttctctgaatttctgtcttccccttttattaagtaaataagatacaaatgatgagcatcattttgttgcaggcattaggtgataatctaggaaggtctggagacaagacgaggtgttctcaaagccaccggcaggctgccctatcaccaggctagcatcgcatttcaaggggcacagtcgtctttctgaacagttaacttgtattgcctgtttcaaatgtgacagtgtgagttgggttctccctgcctgactagctttttaaaagatttttaaagagggatgggcaagatataattttttaaagagggatggacaagatataatctgatgggaaagatctactctgggaaaaatacaaaaattctgtgtgtttaattttagcagattaagaaatcactgaggaaaggaacaattccagagtcaagattttttttttttttattcctcaaatctgccactaggttcagcctgttaatttagaaaattgatgacagatctatttatagaactgcaagtatttttgtaatggtaatggttttgtataacccttgaaaaaatatttcgtctggcttcccattaattaatggttccaaagatgaatatggggtcgaaatgaatctaaatgagctagtaagtttttttatgatatgcaagcacaggaaagttacaggatgagagcattttcatctttcatatatttgacagggaaactagaatatcaaagcttttgtcattgaactctacagtagttattcagtttgatttcaacaaatgtaaaattaggagtccaatatattggaatttgatattattataaattgtaatatatttatatatactgggtaatgtgaactaattttacttatttaggtctgtctttttctcttctattatttggacagtgcttcataaaattagtaagataaggtcaaaatatatttcatattatttcatgtaaaatgtaatatacaaaattaaaatcagaaaatatatgtgatcctaaaatatatttaaaatttgtattgtctagaaatacactcatgaaggagagctgtgttctttctttgaatggctactttcagttaacttttccttagatagactcggtcaagtccatcacttgaataaactgtaaaataagatggaaaacattgtataaaagaataagctaatcacaagtcatgactgagctattttgtacataattgcatacatgaaaatgtgtacatagtgataaatataaacgtggggggagatacagctccaaggcaaggaaatattgacttcagagtatataatcggatttttactacacttacattacatgctaacaaagctattagcaacatcatttacaaaatctacaggttctaagggttgatgatgacataggtcatcgtgaagtacccttttacaaagtcacaaaaatattacgaatctcttttgcagccttcttcaattcatagttgttattaacaggagcttaaaagcaaattaaccaaaagagagagagaaactattaataattccacacttgtctcttgtaaggcatactctgggtccttttcacgtgagtataaaaagtgaatgcagagaaatagaaaaaaatgaaaatacattgtatccaggtggttgttgcagaaagttgatgtaatcttgattgagagagagagacagacagacagacggacagagatggacataaatgcagagatattcttctgaagcagaggacaatatgtaatttagagagttactactcttaaaaattcttacattttacatttttacattttatctttttctattcaacctaataaatattttattagtgagggtttttcttttttcacattcacttttaaaatctctatttgcctctccatttttatgtgacactgtatttagtgtatgagtaagactcaaattcaggcaccttcccatgatttgctatacatggcatccatttactccagtcaaatacattcttgagagggccagtgtgtttatgtcactgtgtgtgtatgtgtgtgtgtttatttttatccctttctcttagaaaaatgttagcattttctgcacacttttaggaatgctaaatgttcccccttccctccttccactacatctgatttggagtaatattcctttacttttatttagtaggcataatgcgatcagcaaacattctactttttacatgttttcctactctcctacccctcatttttactactgtagctacactaccaaagcattatagccatacttaccctccttgcttctttgtaactgtcacttcttcctagtttcataagtaaatatatacctaaccttcaccatcaatgcttaaggcaatgcctcaccagatagtttggttttctgaatcttttcctctagtagaatcctcaagaagttttcatgagaccagtattccctcatttgttaagttgtttcttaacaatttgtttgagacttcatattggaaagttattatggctgagtataaaatctttggctcaaattttttttcctcaagttgcccaatttcttctggtagaaagtattattgtcaaaaagcctgatgacaacctttatgagtgaattggtaatttcgcccagattttatttttattttcagtgaaggtcagtaactttactaaaatatgccccagtgttggtctttcaggattaaattctccagtaatacggcctatccttttagtaggtagtgtccagtcttttggggagggagttgtcttgagtttaatatgtcagcactattctgttccgttgctttgagcttcttgtttggggctatatgcatgttgagtctcttctgcctatcttcatctgtcattttctctaaaacacttcatcactcttttgattttcaatttttaaaaaatcctcttttttgtctcctgtgtttcttaaactgttgtctgttatgattactttgtcttttgttccttccaatttaggcatcatttcctgatatttattttgcattttaagttctttcattaagttctatgtttttaatgtcttctatcatttaaaaaatatgtgatcttgttttgaagcagtatcttgcaagttcttctattgaggggcatgtcttgctagcaggcttttattgtctgtagagacattatgatatttcttattctctcctttttaaaataataattttgtaagggatttgacaacactctttttctatctgcctactcttttagaagggaggattggtcaagataacttttctggttcacagctccagagcctcctcttctattgcctctacaaagtggtttttaaaatgacctcatatttctaggatctgccttctcttctgtctttccctccttttagctggattttctctttcttttactcctctggacctgggcagctccgctcgatttggattttatccctttgctttcctcagtggagagatttgtactagaagggaaatgggggattttaggcttaagatccttttcagacctcgtcaccacccgtgaactggagcgtgcacaacctctcccagcttcaaatatggcatctgttggtgacgttcccattctggaatcaggagatggctggctactctcctctgctgcctctagcaccgttgctgtggtcacatgggtcttagtggtcagaggtctgtccccattgccttatattttaaggaccatgagtgtaccttgcacacaatttcgatgtagttcttctgtatataggttttggttttgctatcctagttgctttacctgtctgtgttaatgaggggatttggagagattaaaaagcaatattgctttcttatttccttaattctccccctttcgcctatagaaacagactcccaggctaaaagcagcagataacaaatatcaagtcttaatttttccaagataaatgaaagctcagcctcttcaactaaagcaaagtgaagaccacagtcatttcccatgtctttggcgagatgtcttcgtattggcaaaaacaggaatccttagaagatcctaattacaggaaataattactcacagacaagttgcccttcatttaaactgtcagggtaacaatgtaaagaaaacataatactttcagtctctaccaatccaggaatggtgtgatcttaaggctgactgccaagagcacaggccagctgttacagaacttaattaaaacagttttgataattagcacaacttgtatatgaatgtgagagtatttctaatgtgaatacaccggtcaccttgtcagttacagggaacagaggaaaaaatcctatgacatatggagttgtgaaccagttattaaaaaacaagcaaacttagaattgctgttgaactatcctccattctttgccaccctcataaaaacaataaaaataaaaccaaacacgcagagacccctcccaatctgatttttgcaagtagtttaagaagcaaaagctgttatgctttgttaaaagtccttttggttgcaaacaaatagaaagggacccagaccggtttgagcggtgagtattccacagagcggctgcctgagtccagcagcagcgttcgcatcatggtgctgctatttccctgcgacgacacacagcaatctttcttaattttgtcatattttcacttttatttactaaggaatgacagatcaccgagaaaatcttttttttcctcctttctatgtgtttcattctgaaaggtccattgctctccactgatactttgcagtctgagcttagtgttataactgttctaaaaatgtctcatttggaaggaagagctgtagcctgctctttattgcccagtacctctaacagccctgccaccatcaatcagcaaaatgtctacaattaactcttgctgttgtctccaaagcctggttgctgcccccacggcctcagcaccctctgcctgcacctccctccatggcttcatgacacgatctcctccttatcttgctcttcagaggctgtgtccctgtgcctgcccgtcctgggcaggtggagcccagtggatgggccttggacctcttctttctccccaaaacactctccatggtgagccatcactttagcccagattctctcccaagttccaaagtcacacctccagacacctcccgggcaccagcactccacttctgtgtgcacagtagccactgcaaagctcagtgtgtccatgatgcaatcataacctcgcagctcccactctgcctgcccctcctagagctgccctctcccatgttggcccccatctgggttgatcgacagcactgtgcacacagtacccaagatagaagccaggagttgtccttggccgtggacacttcctcactctcatgtttaaatcctttatttcaaccatttccttctgtttcctaaatgtctcgtgaatgtctgtgccttcccatcctactgaccctgtaaggttaagccaccttcctaactgagcaatgctgggcaggagatgtttgtctcgctccaggcttgtctcttcccagctcatggctcccaccgcaacctgatcgttcattcttgaaacagatcccatttcttattctcacaattagcgtctttccatttcctttctgatgaactctaagctcctgacagcctccctcctgacctggctccttccctgaagtccagcctcatctctcgctgttgccccaccttcagacccagcttcagctgtcccgaattctgcagttccccaaggccaccattcaccatggtttccatcatggtcccctgcctttgcctgggatgcccttcctgcctcaagggaggcactgtcgtttcctcaggggagcctgctccctgttattccgagttaagcatcagaataatgtgtttacttttcataattttatgataacattctcttataaagatcaattttaatatcccaaaatatttgatttcttcttttgagaattctgacttttcaaaagtagtgatgcacagccgaccacggaccccctgctgggaggcagtctccgaagctgccagtggtcttcggccacacacattcacttggccagccagacacacacctgctgctgccacagtggggcaagtgcactcagaccatctgaaggaaggtggggctgaaacccactgactcatttctactttcaacagggatttattgagcacctactatgtgctcaataatatacagtacctgttgaattgggagtttcatgagaaataaggcagccttagtccctgcccttgctgtactctaaaaacagctaaacacatgatgtaataattgccgtgtaggaagagaacatcagtgtctctggctgagctctttgctacctcacagtcacactgtctgaaatgtgtgcttctcttactgctgaaggctgccgagataaaagcagtcacctcagggtgagagtccaaggattcaaccggaagagagcagcagctagggaccccttggtgggaatgtggttcgtgaggaactggagttctgacgaggagcagcttcgaggcatttgcttctcactaacaggagtgtcccaggaaacaccgaaatccatctaagcaggcgacatgccaattttaattacctgctccagtgagtcatcagttattacatgtaatgaaattaactgtagcactgaacccacagttatgtggattatttgccattttcctcacagtattcaacattttaaaaatctgtggcaagtctgagatttaggaatagtgaaatttccttcgatttgtcctggatcatgatttatttataatatgttaacattgaattggcttaaataatttcctgcttctctttctttgagatttccatcctattaagagcagaaaggagcaatttttgtgagtatcccagttctgatgggccaccatgctcagcaacatttcctaattttttttcatatttttactttgacttactggagaattgcaatgcatgtagaccttattttcacaaaatgcaaatgttaacatgcctatttagctctcccagccatgttccttttcttgggcaattgtcttcttttaaatctcaacttttatttagatacaggtggtacatacgcagatttggtacctgagaatattgcatgatgctggggctgggagtaggaatcccgtcaccctggccatgagcataatacccgatgggtagttttttaacccacccccctccttccaccctccagtagtcctcagtgtctcttgtttccttgttcatgtccacgtgtgctcagtgcttagctcccacttatcagtgagaacatgcagtatttggttttctgttcctgtgttaatttgcttaggataatgacctccagctctatttacgttgctgcaaaggacatgatttcattcttcattatagctgtgtagtatttcatagtgaatatgtaccacattttctttatccactccactgttgatgggcaccggggttgactccatgtctttgtcattgtgaatagtgcagtgatgagtatgcaagtgtatgtggtttttttggtagaacaatttattttcttttgggtatatacacaggaatgggattgttgggtcaaatgatcgctctgctttaagttctttgagaaatctccagactgcttttcacagtggctagactaatttacattcccaccaacagtgtataagtgttcgcttttctctgcagcctcaccaggatctgttgttttttgactttttaataattgtcattccaactgtgtaagattgtgtctcattgtggttttgatttgcatttctctgatgactagtgatgatgagcaattttttgtaagtttgttggctgcttatatgtcttcttttgagaagtgtctgttcatgttttttgcccatttttaaatggggctgtttcttttttgcttgttcaattgtttaagttccctagagattctgcattttgttgaatgcatggtttacaaatattctctcccattctatagtttgcttgtttaatctattggtagtttcttttgctgtgcaaaatctctttagtttaattaggtaccacttgtctatttttgtttttgttgcacttgcttttggggacttagccaaaaatgctttgccacagccagtgtcaagaagagtatttcctagattgccttccaggatttttatagtttaagatcttacatttaaatctttaatctattttgaattaatttttgtatatggtgaaagataggggtccagattcaatcttctagctagcatatgactagccggttatcccagcattatttattgaatagatagtcctttccccattgcttgttttcattggccttgttgaatatcagatggttgtagggtatgcagctttatttatgagttctctcttctgttccattgatctatgtgtatatttttgtaccagtaccatgctgttatggttactataggcttacagtatggtttaaagctgggcaatatggtgcctccacctatattctttttgcttagaagcgctttggctattcaggctctttcttggttccatatgaattttagattttttttctgattctgtgaagaatgacattaaagtttaataggaatatcattgaactgtaaattgatttggacagtatgaccatttttacaatattgattcctccaatccatgaacatgagatttttttttatttgtgccacctcagcagtgtcttatagttctccttgtagagatctttcacctcaagaaaacatcagacaaatatccctcatgaacatagacacaaaattcctcaacaaaatgctagtacattgaatccagcggcacatcaaaaagttaatacaccatgatcaagtaggctttatttctgggatgcagggctggttcaacatatacaaatcaataaatgtgattcagcacataaatagaatcaaaagcaaaaagcctttattgagatatggttatctcaatagatgcagaaaaagctttcaataaaatctgacatccctccatgataaaaaccttcaacagactaggcattgaaggaacattgctcaaaataataagagccatctatgacaaacccatagcccacatcatactgaatgggcaaaagctcaaaccattctccttgagaagtgaacaagacaagaatgcccactcttacaaatcctattcaacagagtattggaagtcctagccagagcaatcaggcaagacaaagaattaaaagccatccaaataggaaaagaagaagtcaaactatctctctttgctaacgatatgattctatacctacaaaaatcataaagactctgctaaaaggcccctagaattgataaacaactttagtaaagtttcaggatgcaaacccaatgtacaaaaatcagtagcatttctatacgccagcaacacgcaggctgagagtgatatcaagagcacaatctcacttccagtcaccgtgaagaaaatgaaatacctagaaatacagctaacaaacgaggtgggccattctttgatgtttcatacaaaccactgttttaagcaaaccaccttgttgtgcaattgtgagaggaaaatgcagaaggagattggctgcaaatattaaacccagcatagttaggatttattttccttttgaatttcaagtttgaagccttgtctttgatttgcatggaaaagaaccagaaggtgctgaggggctgtggttcccaacaggattctggggcctgcagttctttccacgcagcctcagagctgagctggaagccagggggcaggcccaggaccatgtacagaggtgcacaagttaagagcacaaaggttggcaaatgcagatgagtgtccagtttaggcaattaatgaggctttggttaaagctgttctaaagctttagctgtaaatatacataaaataaagctattctataaaatttagctaaagctatagttaaactattctaaaatttatagggaaccaaaaaaagagcccgaatagccaaagcaaatctaagtaaaaggaacaaagttgggcacatcacattgccccagttcaacctatactataagactatagtaaccattaaactaaagtctcattaaactaaccattaaactacagccttttataagaaatcaatttgataaaagggaacaacataaaagtttatctcactgaaagccttgtgtaagaattcagaaattagaatcagagggaaaaattatatgcatttagctagtcaatgtcttttgattcagacaaatgtcaaggaaatctttcttcttccctgcatatttcacacttatttatgttttcccaaaaattattttggtgcagtttaactatgactattgaatatatgtgacctttctaattattaaattgctttggtagaataattttatacactgatctatggcatttctaataataaaaagcaagaaaatgcataatagctagatgtatgctagattaggaaagaaatgtgagaaaatatgtttacaaaacactgttactatagtgctgtgtccttaaatacatgttggtaggagaagcatcaaggagtccgctaaggtcacctcccaggttcccccataagacctcactctcatgcaagaatctattaacttgtgttctccattttactgtcaggtccttgagggagggattatgcccatcctgtgccaagagcatctagtttgtggcacgtgggagcacttagcaaatattttgttgaatgactaaataaggcgtttcatagctggaaacttcagaaaagggccatgtgcccaggcacagagggactggttacagaagaggtgccgtagcaaattagggtgatccagaagcttcttcccaggaaaagtcttcttgtcagggtgtcttttgggattgtattcatattggaagccctggggcagccaggttattgttcatcagttctgagcaacgtggatatgctccatatgaacatggaaggataaaaatagcatcctcctgtgcttgctgcaaaaggagcactcaagacaaatgataggcccaccagggatggctgaaaggtgcctgcatcttttaaacatctactgtggatttgaatgaaaatgcacataattataggatgagaaatttacttttgatctgggctggaaatagagtgtgactctggttgcgtgtattttttcagacaaaccctgcttgcaggcattctgcatttatctggggtttgcagaacgtttttttcctcaaggttcgtctgactgctcttgattttttcatcttttaatactgagcagatctaatttctgtacaatattgcgttcattacactgaaaattatgctatatttaatgatgcaagtaaattgaaaagtattggctaaaatctggaaacatttctctcttaaaattgctgtttccaaatgtcaactgaatttctagaattcatttaatgtccctttgtctaggttatgggagcatttccaaggtgattctcaatgtacacttttagcctcacatgaatagaaaaaaatcttattatggtgttttagaacaccagccccttaattctcccctacactcagagctacaggatataataacccaaccccacagatacagaggggcctgcctggctttaaccccagaagacatcacgtcaggttcggcagagagcaatacagaagcacttctataaaggctcttttgcagctttcatggccagtcaagagatgataaaacagaatggggaggaagtggcacccaacagggtgcagctccttcatctgcatagaataagcagagcctatttctcattcatgcgcccatgaaaatgggtgtttctgattggagagcatctcttttccagtggtaataaggggccaggactctcccacactgtcccccaccaaccaccttcagcactggcttcccagatctctgtgcagcactgcacaagccagggaagggaaagggcacgccagccttgagagaagtcgtgagtcacttcctccctcccatggtgctctagatgccagccacatggtcatgcatactaaccccaaaagaggccggcagaggtggttcatttgggtgaaccccaagtgaaatggaagtaagttttataaacagctatctagtctctaacccattccaataagccaggaaattataagtataaaaaagttaaatcctacatgactgaaagaaatgtatcctataagatcatctgttataggctctgtgcctgtctttttttctgcttagaagctgctgtatcaaaattacagaaggtctccaggtacctagtgacactctttgggcattcaagagcataactcacaccttccaaagttagattttgatcattttgcacctccatggatgggtagtgtcaaattcaggttctaacacaatcaacctttaagatcatgcagccctgtaggacagagatagccatccacaagggcttgcttctggatctcaggtggcaccactgctttctgttctgctaatgagtaaaactggctccatacaaatacatattaaatatgattcactgaaatatgaaaaatatatttcaaaaaacaaatatttaaatattcgttttttcatatataaagtttaaatgatcaaaaatgacatcaataatataaagacattggtagtgctttacttaatacgaaactctaaatcttatcaggactgtgtgcaggctaatctcaatgatctcaattatttttcttgtgcctagttttgtcactctaattccaagtcttgcttttgaagtaatataacaattttcttataaatttgttggaagtatcattttacaacccccaactggggagggcaggaaaatgccccccaaacacattcacatcctaatcctggagcctgtgaacatgccgtcctacacagcaaaagggacatggcagatgcgattacgttaacaggtcttgagatggggtgattagcctggattagccaggtgggctcaacaggagcacaatctctagtccttacaaagaggaggcaaggaggtctcagttagagagaggagatgtaacggtggaggcagaggttgagtggtgtgctttgtagatggagcaaggggacatgccccaaggaatgcaggcagctcctggaggccgaaaagataaggagacacattctcccctaaacctccagaaccagaaccagcctgaaccaatgcagctctgctaccaccttgatgtcagcctgcgagacccatctcagacttgtgacttcagaattatcagatacacttgtgttgttttaatatactaagtttggtgtaagttgttacagcagccataggagatgaaccccaacagcttcaagccagcctctctgagcacctcatggcctggctacctttttaattactctaggttaccatctgtggcagacattttcagtggccttacccagcacacttctccctttcctccaggggataaagatagtgttgtgctaaacaaatctgcgttgccagccatgtggattgcatcaatttggaaggaactttcaactcagtggtggaaaggagagggattgtttctgagaagcttttctacctcttgagacaaaaggaaagtttcgtccctttttttgcttctggatgttgtcatgtctagctgtgattcctggagcccctgcaaccattctgtgattggaaggggagctgcagaccctctgcagactacatggggaatgtctcggagcagagggtacttgatgccattgctgaaccactcagtcatccaaccagctgtagagctgctctagggacttcctgattcttgctgctgaacaagctgattaatacaactgcataggtacttgttgggcatagctttcaggccttccaggagtaaatgaggagcaggagaaaagtaattgtgaacaagagagggtgaaaggaaaaaaggttcatataaatcatagataccagaaacttcatacaatgaggaggaaaattacttccagtaacatcaatgaaataaacctttttatctatttcatggtttgtatttttatatttccttttatattctgttctttttactccactgagtgaaggagataaagtcttgttctgatgtgaaatgtaccatcagagtcacaagggcatcactggcatatgaaactatacctgtgccttacctgggcaggaaggagactgtttcactcaccttgtggatgagcatggccagtccacttctatgatacatacatatgcatacctttttatatgagaaatagatttctctagatatatagaattagccaaaattctatcgagatacagtaagttccaacataaagtttcttccagcttatgagagctgattgacacatctcttcctagtgatttcaagttggaggcttgaaatttataccacaaaaatcagcagctaccgctcatcagagctccccttcccagagccagttgttatgtcacaggaaaggggtccccttccagaccccaagagagggttcttggatctcacacaagaaagaattcagggtgagtccacagtgcaaaacaaaagtaagtttattaagaaagtacaggaataaaagaatggctactccatagacagagtagccctgagggctgcttgttgcccatttttatggttatttcttgatgatatggtatacaaggggtggactattcatgcctccccctttcagaccatatagggtaactcctgatgttgccatggcatttgtaaactgtcgtggcactggtgggaatgtagcagtgaggacgaccagaggtcactttcatcgccatcttggttttggtaggttttagccagcttctttactgcaacctgttttatcagcaaggtctttatgacttgtatcttgtgctgacctcctatctcatcctgtgacttagaatgcctgaaccatctaggaatgcagcccagtagcttcttcaagctgaataggcgcaatgatattcctgcctaacttctagggtctcttgtgttcagggtagagaggagctcagtcagaaagcatcagtatggcaagggccattcatgactcttgagttccaataagaggtgatatctggaagattaataagtactcagtttaagaaaatgttgagtaagcttattctgcattcttactcaaagagtacagcagcaatatattctacaacaataaagccaaataagtaaaattatcccaagtaaactaaattagaaggctttccatgaactaggcaactgttggaaccaagctggtagggggttgctagatcattccagtacatgcccagaattagaacactgatttagatttttacattacccatccctcttgtttcttctgagcagcagtcagagatcactggttggtttgcaggaataagcacggttagcctaaattgcaaaaacaaacttaaaaacaactgatgagactagaatctaataagaagtgtaccatagttcttacaacataacttttttgtttgcagtttcccatttttactaaagacaaatcagcaagacaaatttgctttattatacttggcctgattatttgtataaagtacaacaaggaaaattattttttacataagctctttttaaattggctttgatggaactctattccatagaagaaatcttagataagacttttttaaagctgagcccagccatgggtttctaccctcaaatacctctgagttgggtaaattcctttttctgagatcccaagataacttggggctcctggacctgttagaaagtgacattctttacttaccacaggtcagaaaccttatacagggactgtataataggcaaggtatgaggccagttttccaaacagcttttattggctctacaagtcaagtttgactccttaaacgaatgcaaactattccagtcaaagccctggtaaaataaccagtttctccaattgtgtcatgttgcaaagaaaacagattcttattgcacttatgcaaataactgtattgccataaattaagaatattcacaaatagtttccaacttctggagaaatcagatagagagaaacaaatatgctccagattttgtttacaggagtatagtttacttaattgctaaaaagctgtaaatagctcaaaagttttcttgactctgaaaagcaaaacaaaggatcagcagcattttaagcaaaaagttaaaaaatattactttagactttcattagtttagttcatgcagttaacttctgtttgatattcatgaacatttcagctctctatgagagttctgaaagttttttcctctattctaatgtcataatttccaaagttagcagaaacttgcattcaagagcacctgtcaaagccctatagctgattacaaaccacctttggaagatgatcaaaataagacaattgtttgtggatgacaaaagatgttagaacagccacagtcaaaaacacgattaacaaagaaatttggttacctttgtggcatacaataattcaacacaattataattattactgataatgtacactaagtcatatcagaattataagagttttttataattttagaagacataccaataacatttatacaaatacagcccaaagaaaaccaatcattttatatttgacagtgcttcctgtgtgacttttataccaaataagccaaatgtcactgttgcattagtgcattattgatgtcagacccaattcttagtaaaccttatagataaatatatccaatcttattcagtttgaccataaggtaagattcttataaaccttttataaccctttacaaatttttgtgaaagagcagatcataagcaggtttttgctctaagaaaaacctattatgcttttattccaatgtttagtttatggaaaagctgaaaaatgccactttaattttagtcaatgcagactctcttacaattaatttttcacaaaccttccataacttgcttaagccttcagcttcatcctaacttaaaacaatccattaatcctttaatctaggccaaaaaaattacatttccatgcctttttataatcttttaccaaaaacacatttcacttttcttatacaccttgtgtatagaactgtgtcttcactagtctcaaatacatgttatcctgttaactcttagcagcttttacttttgatgaaaaacctggttagtaagcaattttatttatgtattagatgtggggcctaggacccagacagaagtgcagataaggtctgactctctccagcgtttaacttcacatgtctcaggccttacctagaatctaatgctccaaaataaatggaacagttttcaaaagtcaaagaaacagtgtataaccttaaagcatttagtaaacttaatatttgatctgcataatgtagaccaaatatttatagttctgaagatatttttattttatgaataatctttaaaactctatttcccaaagattacttaagtcacatgaactaaataaaaggcattacactttttacttttctgacaaaatatttgatttaagtgcttattattaaaccaattaattaaagctctttcatttataaacatcatacacagaatacatataaatacatagaaagataaaagatagaggactcattttccaagccaggaattgaatcctgaacccaggccaccattgtgaaaagagaaagcatggccacatggttacaaggtcaagcccccaaggacatagaagacaagagggaaacctcatccagtgttttttcagggacctgtagcaaagtttagaactgaccagtttgctgggtcaccttgaacagcagtcttacaggtgtcctaagcccatgttctatccctagggacccctcattgtgacagaacaataaagaaagacacataaagcacaccagattggctacagcttaagactagcctcacaaatccttttttccattaatcaaactttacagaggagataaacagtgatttttaccattcattcaaccagtttgcacagagagagaaacagcggaaaagcattgcctgcagcagggtgggaaggcaaggcgctcagggaggccagagaaagacccacccattgcagcaacattgaaaagttcaggcagctgcttgtcagtagcaaagggatcttttccagcagtctcatcagctctcaagtttccccttttagggaagaaaaagctccccatgtcccacaatcccgtacatgcctaattctgtcactcacagctattagcaaagagcaaggcagattattccaaagagaatagcagttaacatcctgtagtaccaaacccgttcttagctgagagggactttaatgagagggactttaccaagaggggcctctaaacccctgaatcttagaaggcactctaaccctcctaaattgggcttctaacccaaggttggtcaagcatccgtgccttttatgaagaggggcctctaacccactcattcttaagagagactctaactcccctaagttgggcctctaattcaatcccattctttacctggctatatgcaccccacttacctgaaggccgccaatcagtgccatagtctctttcctttgggttgggggatctcctcagcatcgtcccttccatgttcaccagaaagatgtcaccagacaccaccacttacctagttagcctttgggtccctttatggtagccagaaaaatgttacagggaaggggtcctaatccagaccccaagagagggttcttggacctcgcgcaagaaagaattcagagtgagtccacagtgcaaagcaaaagcaagtttattaagaaagtaaaggaataaagaatcgctactccattgacagagcagccgtgagggctgttggttgcccatttttgtggttatttcttgatgatatgctaacaaggcgtggattattcatgcctccccctttcaaaccatatagggtaacttcctgatgttgccatggtacttgtaaactgtcatggtgctggtgggagtgtagcagtgagtatgaccagaggtcactctcatcgccatcttggttttggtgggttttagccggcttctttactgcagtctgttttatcagcaaggtgtttatgacctgtatcttgtgttgaccttctatctcatcccatgacttagaatgccttaactgggccgggcacagtggctcatgcccataaactcagcactttgggcggctgtggcaggtagatcacctaaggtcaggagttccagaccagcctggccaacatggtggaaccctgtctctactagaaatacaaaaattaggctgggcacggtggctcatgcctataatctcagcactttgggaggccaaggcaggcagatcacgaggtcaggagatcgagatcagcctggccaacatggtgaaattccgtctctactaaaaatacaaaaattagccaggtacggtggcaggtgcctgtaatccagctacttgggaggctgaggcaggagaatcacttgaacttgggaggcggaagttgcagtgagcctagatcatgccactgcactccagcctgggcgacagagtaagactccatgtcaaaaaataataataatacaaaaatgagccaggcatggtggtgtgtgcctgtaatcctagctacttgggaggctgaggcaggagaatcacttgaactcgggaggtggaggtgagccgagatcatgccattgcactccagcctgggtgacaagagtgagactctgtctcaaaaaaaaaaaaaaaaaaaaaacaaagaatgccttaaccgcctgggaatgcagcccagtaggtctcagcctcattttacccagctcctattcaagatggagttgctctggttcaaacgcctctgacagttacacatttgccagtacaccactgggaacaatgaaaggaaatacttggtttctactctcatcgatgattttaactttaataacttttggtattgccttatttctaatcaaaatgtaatgacatgactaatattttaatttgctaagtcagtctgctcagatctgctgaattgatctgctcaaattaattgctaatgctaatagtatgttgcaagactgaaggtttaaccacttgaagcatgcaaacttattttgtggatttttaaaacttattttatctctctatatgttaaaactatatagactatcagaaattggcattagggaattatttagctctctcattttccatagttccaggccttataaagagccacactgtgagtacagacagtactgaatctgactcacagccgcattctggaaactgctaggctgcatattgtggatcataacacataaccctggaatgaggccagatctaataaaactaataagctgcgccttgtttgacacatttcatgaattgaaagtgcaggagcctaaatgaaatcaaaggcccctttcagttggcaaagaacaatgagcctaaataagttaggattgatgagtgggcaattcaatcacctcctgcctttgggcgagtcattttaccctaaatgggatgctggttctcacttgtgaatcaaaaggggattgaaatgagggatttaaagtcacacaaaatgacttgttatcccagatgactaaagccaggaggtctgaaaccaacacttgcttgatgtgttttgcagaaatttccacacactaaagtagaggacacttgatccagagagggtggagtgaattaactaaagagcaatttatttactcttttatttatccatccatccatccatccacctatccatccagctatccatccatccatccatccatccatccatccatccatccatccatccatccatccattcacccaggtctctgtgacagaccctgagccatgctaagttctgggccagatataaagcagaaataaagaaagatagacctaacgagagaggcgaattgtaaacaagtgtgtgtgtgcatgcatgtgtgtacatgtgcctatatgtggtgttgggaacaaatgcctcaatgtgcaaaacactgtaaccctctttgtcatccgtaactgttctcttcttgctttggagattgcatctccactcatgaaatctgggagtggcagaagagaaggaggcatctgaagcccgtccgagggtctcagggcttcacttcccttactcccttctctccccagttgacatcacctgggtgtcagcagacgcttagttggcttctgatgcagagcagagtgtctgcaatctgcctcacgttgtcctctcttctcactcctacaaatgttcggctgagctccaaggtcctcttcacctggcccttggctgtgggcctcctcattgtataccttcttgaggttgccatggttagaacctgtctttggtctgttctcttagcattcatagcacctgctgactgttgcaggtttgtgggtgctggctgactcccaaagctcagctcacaccagtgctcctgagctgcatctgccatcctttccctggctttgagctggtcactgtcaggctctgctgtgacctgaaacttcttcggcccatgccctgagaaacaaagtacagcagggaacaactatcctctcgcaacatactcgggcaccccaggatttccctcagtcgtctccggttacctacagcacagacgcatgtgcacatgcatgcacacacacacacagtttccaccctggaggggagggtctgggactgtactgctggccgcttgctctccactcaccctgtctctcctgcctctgctgccccttcctgtctgggaggcactccctctggcttccctactccaactaggaagacaaaggaagatttactgaataggtaaatatttgggtacccacttaatgattattcatgtaattataatatactacttctaatgcttttatagtaaagtggcaataataatgattagcaagtaccaggcagtgttctagatggtttacatgaattaactaatacattatttaccataggcagctgatgtatgtactgttatcatttccattttaatgaggagactgaggtgagttgcccaaggtcctatcactaatttgtggcagaggctggggcaggatttggacttaggctccaacatgtacaccttaaccactattatgtggaaaggatgcagtatgatttcataaagaataaaaagatgaacatcaaaatggaaaaactggagaagtactccaggcatacagaagagcaggacacatctagcaaatatttggtgtatttggaactgaagatgtgagggtgaaatgttagaatgtgaagctggaaagaaaatggggacagattctggaaaacggagtacaacacagtgaagcgttgaggatagaccctgcacacagccagtgaagggcctttggtagatgagtgacatggacaaagtatttttagaagggagtgtctggctgcaacctgaagaatgagccagagaggagagagactgctatccagaggtcatttgagaactggctcattggttaattaagtcaacaaatatgaggtggcctctgtctcatgaattggtatgaaatgttatagagcaaaaaagaatggatggaatatgccatccagggctcacaagttagtgagggtgacagaatataaacaaatacataagcataataaatgccctcatagatctctacgcaacaggcactgctgttacagagggtttaattctccctagagaggacaggaagggctctctgagctgggtgcaaaggcatatcctatgggaataggaaacacatagaacacagttacatgactttaggtttacaattccataaaattgtgtgtttcaggtgcctgttatactactagtcctgaatagaaatgaaatattttatgagtttgcatataaaatatcctagttaactgatatggtttagatctatgtccccactcaaatctcaactcaaactgttatccctgtgtgtcgagggagggacctggtggaagatgattggatcatgagggcagtttaccccgtgctattctcataatagagaaggagttctcacgagatttgatggtttattgagattttatggtttaaaagtggcagtttcccctgcactctctctctcctgctgccaagtaagatgtgccttgctcccccttcagcttccaccatgattgtaagtttcctgaggccttcccagtgatggagaactgtgagtcaattaaacctctttccttcataaattacccagcctcaagtagtatctttatagcagtgtgagaacaaactaatacagaaaattggtaccagcagagtggggtactgctataaagataacctgaaaatatggaagtgactttggaactggaaaacaggcagagattcaaacagtttggaggactcagaagaagagaggaaaatgtgggaaagtttggaacttcctagagacttgttgaatggttttgaccaaaatgctgatagtgatatggacaatgaagtccaggctgaggtggtcacagatggagatgaagaatttattgggaactgaagcaaaggtcactcttgctatgctttagcagagagactggcagcattttgcccctgcccttgagatctgtggaactttgaacttgagagagatgatttagggcatctggcagaagaaatttctaagcagcaaagcattcaagatgtggcctggctttttctgaaagcattcagttatatgtgttcacaaagagatggtttgatattggaacttatgtttaaaagggaaccagagcagaaaagtttggaaaatttgcagcctgaccatgtagtagaaaagaacaacccatcttctggtgaggaactcaagctggctgcagaaatgtgcataagtaatgagatgccaaatgttaatagcaaagacaatggagaaaatgtctccaggacatgtcagagatcttcatggcagcccttcccatcacaggccttgaggtctaggagggaaaatagtttcgtgggctgggcctagggccccactgctctgagcggccccaggatatggcatcctgcatcccagctacttcagctccggctgtggctaaaaggtgacaaggtacagatcaggccattgcctcaaagtgtgtgagccccaagcattggcagtttccacaaggttttgggcccgcaggtgcacagaagacaagagttgaggtttgggagcctctgcctagatttcagaggctgtatggaaacatctggatatccaggcagatgtctgctgcaagggcagagccctcatggagaatttctgctaaggcagtgcagaagggaaatgtggcattggagcccccatacagagtccccactggggcactgcctagtggagttgtcaggaaagggcaactgttctccaggcaccagaaaaatagatcaactgacagcttgtgccatgtgcctggaaaagccacagccattcaaggccagcccgtgaaagcagatgcaggaagtgtaccctgcagagtcacaggggtggagctgcctaaggccatgggagcccacctctttcatcagcatgccctggatgtaaaatatggagtcaaaggagattttggagctttaaaatctaatgactgcccagccagttttcagactttcatggggcctgtggctcctttgttttggctaatttctcctatttggaatgggaacatttacccaatgcctgtacccccattgtatcttgaaagtaactaagttgttttttatcttacaggctcataggtggaaggtacttgccttttttcagatgagactttggacttggacttttgagttaatgctggaatttagttaagactttaggggactgttgataaggcatgattagttttgaaatgtgaaaaggacatgagatttgggaggggccggggcagaataatatggttcggctctgtgtcctcacccaaatcttatctcaaattataatccccatacatcagccgggtgcagtggctcatgcctgtaatcccagcactttgagaggccaaggcgggcggatcacgaggtcaggagattgagaccatcccagctaacatggtgaaaccccgtctctactaaaaatacaaaaaattagctgggcgtggtggcgggcgcctgtagtcccagctacttgggagggtgaggcaggagaatggcgtgaacctgggaggcggagcttgcagtgaaccgagatcgtgccactgcactccagcctgggtgacagagcaagactctgtctcaaaaaaaaataaaaataaaaaataatccccatacatcaagggagggacctggtgggaggtgattggatcatgggaccagtttctcccatgctgttctcatgataatgagggagttctcatgagatttgatggtttacaagtgcagtttcctctgcgctgtctctctccagccaccatgtaagacacgccttgcttccccttagccttctgccatgattgctagtttcctgagtcctccccagtcatgtggaactgtgagtcagttaaatctctttccttcgtaaattacccagtctcaagtagtattttatagcagtgtaagaatggactaatgcattgaccatgttcattgtgcaatgaaatgggtattcagcaaccatatactcgagtattttattaactcccaaacgaagacagaataatccacatattcagcagcttgattaagactcataggaggcaggggattttaagtagcaaatcaagcactgccctgtcttcacagacatgcaaacatattctgttttgttttgttttgttttgtttgagttggagttttgcttttgttgcccaggctggagtgcaatggcatgatctcagctcactgcaacttccgcctcccgggttcaagcgattctcctgcctcagcctcctgagtagctggaataacaggcatgcaccaccacgcctggctaattttgtatttttagtagagacggggtttctccatgttggtcaggctggtctcaaactcctgacctcaggtgatctgcccacctcagcttcccaaagtgctgggattacaggcttgagccatgcgcctggccacacatattgcagctggaacgtggtggcatagcagtctctatgtaagtggccatggaagatcacaacaaagggcagcagggcacaaagtccagagagccaggagcaaggggaattggtgatgctagaaatttagagctggaaagagcagaaaaaagagcatcctaaatagcgatgcttggtcttctccagcagtcatggaggagtcagggttcactgtgagaagagagacaccatttccacaaattgtctaatgagaatctggagaatgaccctcttattctctgtggatttgaattttctctgtaggcttcaatgagttaaagaaaatactcttcaaactacatactaagaagttcagtctttcttatggcaaataaagaaaacctagtaactttttaaaactctactttattattatgacttgagatgtttgtttctaaaattacaacccagtggactggctgtacatttttctatgtcatttgtatacaatctaaaaggtctaaataacttgattgtgaatactgtgtttgctgtaaaaaaaaaaaaaagagagagagaaaaaaaggcacacttagatgagtggcctacgggtaaactatgaaagcagagattctactacacagataataatttttcattaaaaacttgtcaaggtttagttgataaatgtgattatcaataaattttacatcctgttatttaatcagcttatatatgtatctacagtcattgcataaacatggaattgtctgtacccaaaatgcatttagaagtacattattgtaatacaaaagaagtttccagtcttttatgttcttatcccctagatttattattatacgcaaacccaaaaagaaggtgtcactttctggaaacgtattctgacctattttgaagtaccctgaatggctggcagacattgctccatgtgcagttttaacctgcgagctctctgggctgtgtgtgctgtgtccttcacgaatgacttctgttcttcaatcactgtaaacaaagtgacaggagcaccaagagagtttaagaaagaaaatgttggcatacaaaaagaatttttttctatacaaagtaaaatttaaagaatacagtgagccagacacagtggctcacgcctgtaaacccagcattttgggatgctagtgagggcagatcattttgaggtcaggagtttgagaccaacctggccaacatgacaaaaccccatctctaccaaaaatacaaaaactaggtgggcatggtggtgagcctgtagtcaactacttggggggctgaggcaggagaactgcttgaacccaggaggcggagcttgcagtgagccgagatcgcaccactgcactccagcctgggtgacagagcaagactccgtctaaaaaaaaaaaatcatcagttcgagactatagcagaagttcaagtatgaagccacaggggtctgaatggtggtattgacctacaaggcaggctgaaaatgacaggagaaggaattatatgtgaagaaataatggaagaatactttccagaactggctgatgaactgaacatggagaataacacgagggaatatgtgttttggctataggtttccagcatttgggacagtagaacgacatggacattgtcggaatcagagagcttgtgcggaggccaggattataggccgtaagttctgtttgagatgcagtttatgaggcctctaagtggatgtgcccaaagatttcagatacacgttctgggttttggaagagtcagaagtggcgaggcacattgcagagtcatttggataaagaccataggtagcatgagcgggtaaagcaaggaggtccttgagggaaactttgagggctgtcctcagttagagaacaggaagaggaagacctgggagtcagggagctcagagaatcacgcaagataacagggtgttcatgagctttgcactaagaaaaaataagggttggatgttcagcttgcctataatatgggaaacagatgacttttttttttttttttgagacagggtctcactctgtcacccaggctggagtgcagtggcacgatcacggttcactgaagccttggctcctgggttcatgcgatcctcccacctcagcctcctgagtagctgggaccacaggtgcatatcaccaggcccgtctgatttttaaatttttttgtagagaagggttctccctgtttcccaggctggtctctaattcctgggctcaagcaatcctcctgccttggccttccaaattgttggaattacagacatgaatcatagcacctggctgacaattattaaaactacaaaaacctgatagagtatatgcaatcaggtccataaattatgaaacacaagttgtgatgctagttgtttagtgtcaatataaaaattcttaaaaaaatgtgatggaagtatttacaaaggaacttgaactagcttatgaagagagacttatcatcgtcacttacaaagaccacactcctctctcacaaatactctagtcccgcgggctacgagtgtgctggcaaaccctcaggtcggtgagtcccactctttgtgagttcgcctggagagcaacatggggagagcgggagaggtgtcatgagcaggtgaggagccctgggaagaccctgttgttaaaaatgtcatcatggatttatccattaaggtttttatttcatttctttttagaaacaaaataccttttggaacgtttcagcttacaagctgtttgtatcttgcagtataactataattagataatctggttgctcctctccaatgaatgaaagcattcagctgtttaactgggtaaagtgaaaagaaaggagaggtaattttggtgcctggagtatctcaaggaggtaggcgtggagggagcagccgttgcgaaggttttggggagatgccagcaactctgttgcccatcttttggtgtgtgtagggaaggtgccaaggtgtgttgtgggttctcaggaagggggaggtacctggagggtggcaagggcactggctcaggtcttccctcctctgtggccagcagaggggcacgagggagccacccagcccctctgggcttctgccttctcacctgtagatagggcaacaaccacacccacctcacaggaatagagaaagctaggaacagtgcctgggtaacaggagggaatcaatgaatgtaagccatgaacaactgcaaagaaaccctctgttatttctattatttgagttacctgcctcatcctcccattcttctgcctcaggctcccaagtagctgggattacaggcgcccgtcaacacgcccggctaattttttatatttttagtagagatgggtttcaccatgttagccaggatggtcttgatctcctgacctcttgatccacccaccttggcctcccaaagtgctgggattacaggtgtgagctactgcgcccagctttttttttttttttttttgagatggagtctcgctctgtcccccaggctggagtacagtggcatgatctctggtcactgcaacctccgcctcccaggttcaagcgattctcctgcctcagcctcccgagtagctgggactacaggcgtgcgctaccacgcctttttgtatttttagtagagacggggtttcaccatgttggccagtatggtctcgatctcttgacctcatgatccacccgcctcagcctcccaaactgctgggattacaggtgtgaggcaccgtgcccggcccaaactgatgattctaccccaagatgttcactcctatacgttgatcttcccaggtcagcctgcacttcagactatacttaccaaattgttattcaatcatctctatttcccttgatgcctaaagtgtccagtccagactcagcctgcagagagggctccctcctggctccctgatatcacctgccagttcattccaactcaggccaccttaaccctaacaacgagccactgtatcttgactatgctgtgctcccctctgtgccatcactcagggggtatcctctgcccagaacactcacccctcctcatctcacagggctcatcaaagtccccccatcccaatgaaacattttcctgactccagcccataatgatctctcctttctcttaaccagagcttttttccacgtagccttggtatgtacccttcatttggtacttaatcacttgaaatcttacttaactttttgtgattgtatgattgtcctcttcagagaatagaaagggaattaatatcatttagcacatgctaaatggtatcatttcatccttataataaccccaggaattaggtatcattttgcaaatgatgaactaataatgcccagaggagctccgttacatttccaccagtcacagcatttgaaaactggtggatttcactacataccagtgatggctttgaacccgggggtgcctgattccacacccaggctgctctccacgaagacagagtgtcattgattcattctttcgacaagctgatcatactaaaatatgaatccaaggaaataagttatatttctctaacacactttcctttttttttcctacccactaactggccccatctctccctaacatttagcacaatgctataactattgtagctattcagtatatatattttttgctttagcaaaatttgattaagaaatataaagcatcctcagtataaagagctttaacaaattggaacaaatctctgaaaaatatatgcatagcaaaattgtatgctgatgtaagagacaacagtgccactatcataacaatttcttcttaaaattgcctcctggcattaacttcacctgaaataatcctttcctgacctatttaattctacttatttggtcgagtgtattaaaattcgcagtacattatcttattcaaggagagtttttgtaaaatagggccatgttttacaattaataccagtggtgaaagccacaaataatctgtttctaacagtctcaatttctaaaactctgccaagacttttcaggcctatcatatatttcttgattcgttatttatgaacacctgttatcctgaagtacagttattctccctctacctctgaccaaagtatactatttttagcattatacagatatgtgatcaaggaaagagaagctttgacaatgtatttcaatatgtattttactcctttttatctccctatggttaaaataaatgcagtttttaaagttttaggaaattcctttaactatatgacaagaggttgagtgggaatgttagaagctatgaaacaagggattatttctttcttatttattacacttgaaagtatcattctttgactgttaccgtcgggaacatacaattcctggataataaaggttaagtgtgcataaatttgagatctgcttacaactgacctttagctgtcttttagcctttttgacagaaacttaaaataaggttattccataaaataatttgattctccattctcaaatccagatttgttactcagtaattaatatcttccagctagacagagccatcagcatttgtagtaaaacagccagccatagacatgatgattaatttgggcagaatcatcacccatctaagttttagtctacccaaccataagcaaaatcaatatatgcatttattcataaaaaattatttctgtcttccgtttatatttgtcaatcatcttttgtaattgtctccataaggtcttacatagtgattgttaattttattatcttaaagtgtttgttttacttcatctcttgctattgtgaacttttaaaaaatattttcaaagttgtttttaatcgtgtatggaaatgctattatttttagtgcattgatttttttatgcaacaatgtttttacagagcttttaattgagcatgtctatagactctcagggtgtgctgtgtagacagccatatcatcctcaaatataaacagttcttttttttcccttccaatctttgcatgtacttttcttgtgttaccacattagctagaacctccagcgtagggttgaataaaaataataactttcttcttatctcctttctaaccaaaatgggaataatcctaaagttcaccatgaagtatgggatctgctataggtttctgctaagcgtttttattttttagtgaagaaattttatcaaaagttttatctgcatctattaaaattatcttatttgtcttcctttaatctaaaaatgtaaacatgatgttgaaaaattctggcatttctgtgatatggcctatttggccatcattcaatgtgcctatttgtttggatttcagtgagattgaactctatggtttcagtgttaaggttatgtcggcctcggtgagattgaactctgtggttttcgtattaaggttatgttggcctcagacagtcagctgtgtagcttttcctcttttcgattcttaaaaagagtcagtacaaaggggaaattttctactatttggaggttaagtaatttcattaggattcaattcctaatgtgttgttctttctataatggttttctcttgatcgctgggtgattttaaagtgttcttaaatttccaaatatatgggggtgttaaaagtttggctatcttttagttaatgatttgttattttatttaactttctgcagaaaatgtgacatgtatgacatagacatagatactttggaatttctgaaggcttgctttctggcttagtgcttattcagctttccaaaatagtccttatatgcttgtaaagaatgtgttttatctaactgttgaatgcaaggttctatgtaggtccattgagtcaaacttacatgtaaaatttatgtgtaaactttatatgaaaaagtaagcaaattatggtaataataataataaacctaggaaagtaatgtaaagggaccagcctaccaaatattaaaatcatttaaacagtcgtgataatcagatcaaaatgatactgttcacaaataaggaagacaggccagtgaaacagaatagaaagtcaagaaatagaaatttataataaggttaaatctccaatcactggagaactagtcaataaatacaataggacaactggatatgacctaaaaacaatccacagttggaaacttaccttacattttataccaggaaaagttacaaatagactagtgatttaaatgtaaagaaaataaatcataaaagtatgagaataaaccattattaatgctcttttctgactgtttctattctttatgctacacaatgggggaaatattcccaatgagactcaaaaatcagcatctataaaacattaacgaattcaaaaacatttttaaattgtcatggcaaaagaaaaaattgaaactcctatcacactcaagactaatttctctaatataaaagatctcttgaaataggccaatgcctcagtagagaaaaaatggcaaaagataagaaaatacaattctcagaaaaggatatacaaatgaccttcaaaaatagctttaaaaggtaattattctcatagtaagagaaataaaacaaccctgaaataccatttttaactataatattgttaaaaatcaaactctgatagcattctctttggacagacattagaaaaacaggtagtcatttattttttatagaaatgtaatttggtaccatctctgtgaagcacgacttggcaatatgtatcaaaatgaccaatatgtatacccattgataaaacagttcctcttccaggaatttatcctacaagatactttttttttaaaacttcacctttattttccacctttcattgtcattatattttgagtgttcactttataaactaattcagaactgaaggacattttcccttttatgataatctcttttaataagagaatttaattcacaaacactttttattattgcttacatatttggatccattctacgtaagtttttctctccatattttttcctgggaccaggaggatatttacccagccttcaagataaagctggtactgtttttttcattccctcttctctattctcttgaaagttcattttatttttcagaataggtattcttaaactttaatatgcttaattatttgataagtctaaagggtatcaataactttatcctcatctctttcaaggcagagatattacctttgacccagattaccttcctctcatcttccttgctattcctttctagtatcttagccccgctttataaacccgccatattgatgatttaaaaaactcataatagtcactgcttatttagtcttaattcattcaacaatttatctactattagctctttcatctcatctctttgtcctgtgttcaactcactttttaataaattttatcctttggtaaagttgatgatccaggggttaaaaaaatacccttcagtcttagtcaaatacatttgatttgtctttatttttgaatgataattttactaagttgtattgtagatgaataacttttgttctttgagcatgttgaacattttttacccttttctctgacctctattttattaatgagacatgtaatttccatctaatttggatcttttattgtaaactgtcttttgtttctagttgcttttaatcttttccttgactttggagtttcatagtgtttctgaaaagtgtctagatctgcattttccctctgaatatttacatctttcttaattatgaaaaattcccagtcattgttgcttcaaatattgcctttccccatgatctgtcctttcctctggagctcctgtgagtgactcgagggagcatcccgggtcttgggactccctgcgatcttttccattgctttacctccctgtgctgcctctgcattcatcttccagctccgtgatccagatctctaattctcttttcatttgtggtgaatttattgttcaacctagctactgaatttttaagttaatgatactatattttttctaaaagttatattttttaagtgaaatatttttccatgttaagtatttttaaattatttatcttgagattttattcttctgtttccagttgttacctccacagctcgtgtctatgctcattggtctgttgagtcttccttttggtgactgcattgccacagtggtggataatttttcattgcgagctcatctatattaggggttgcattttctgtgagtcccatgtacgagattatgcaagtgttcatgtttttacatttgctttggcccgggccccaagggtttccttttcattatctgagactaatgctttcccttaatttctgggcttttgatttcctaggtttccatttctcagaggaggtttgtcccaccgagagctttgtcaaacaccaggctgtctttctgtttccacagacagatttgaagagatttttccagtttctttttcacaggtgaggcagcccttcaagtgtcctggttgtatgcgggagtctcggattagttcccttctctcaccaaatgctctgtttttctgaagacattaaaaccttattcctagttttgtgacctaatctgatacttcctggggtctcctggcatcacctggaactcacttctgcaactggattttgtctttatctctagcatctgaggatttcctgagctcagctttgcattgggcatattttgttttttaagtctgtagcagttgatggatgaatccgtttcagtcttgtctgccatcttgcctgaaatttgcttcatttctgcccttaagagcatttttcatgttaaaaagtcttaattttagcattaagaatctcatgtgctatattacatgattttagttgtatattcagtatcactggaaaatataaggtgagaaattatttttagttattcatcacaactgcatcacacgtatttgaaaaataatagtacatctacttgtaaaatatattatatatattttctgtagacagtgattaatgcctgtctaatttgtaagacctcttgtaataactcaatagctgcctcaagggttgagaaacactgttaagtctttattttagaaacgtcacaataagtctaaaggaggtcataatatattaatagataattatactttttcagattaatttgtgtttctgagcaagatccttggtaattataacagcagtcataagaacagatattttcaatgaaattttaattgctaatagaagcaaggatatggaaagcataagagtaagtctctgatttgagtttttttcatgaaagtcattaacctctgatgtggtttggctttgtgcccccacccaaatctcatctcgaattgtaaactccacatgtcgagggaggaacctggtgggaggtgattggatcatgggggtggttttccccatgctattcttctgatagtgagtgaattctccttggccttccaccatgattataagtttcctgaggcctccccagccatgcagaaatgtgagtcaattaaacctctttcatttataaattacccagcctcagatgtttctttatagtaatgtgaaaacggactaatacaacctcactgtgtttctgatgtttcaatatagtatcactgtcttacacatttgttatggggataaatatttgacaggctaggtcaagttagaattttattgctgctgaccaaaggtcattgtaagatttaaaggtcacatagtaggtactatgtgatctttaaaaagttataaaacatgaattttaaagatatattttatgagtaaaaacgcttcacatttctggagctaatatcaatgtaatccaggtattcacatataattttaactgatatgtctaaaacattccttgttctgtgtccctctgaaagcaattttcttttaattctggatttcttaaactttaaagaaagattcctaaatttgaaaactactattttatgttaaataaactagttatcctaagaatgaaaaatttactgaaataccttaactgaaataaggtttgttgtcacataaaccttaaaaatgactatttgtgaatctaaattaacaaaaggagccagcaattgagaagaactcttaggaatagcagtcacagtgtgacagacacacacatacatatagataagggatttcctcatttatctcttcttcaaattttggctttaatcttaaattattctcagtatctttttttaaataaggacctcttattgttatttatatggacagattttaatatgtttgcatttgatgatactgtaaaaaacagaactgttgccagagttttaaaagtaaagggaattttttaaatgtacaactattagatatcaattttaaaactaccaaaaaactcagaatagccaattaaaccctaaatgatttctagtgaaatgagggaaaacacaagcacccggaagcctatcttgtctattataatagtcataaaatttctgaaatgtaaataatcactgcaatgctaataagagaaaaatagtattttatttacagaatacataaagttgtagaatacataaatttatagaaacttacatactccttcacctacagagtcagtgttaaacagccgaccctcggtgcagctgccctccctctatcctaggcacagccactcatcatctggtcattgttccttagcaggacagccctctcaaggaagttaacacagggcagattcaaaaggtcagaattaaaattcaatgcatgcctactgaatacctacctattgtgtgcccagcactcttctaggcaatgacaagctccctaaaaaaaagaacttaagaaactgtaatgaataaatgatgaggctacaaaaaaatcaaacagggtgatagacaatagtaggacggcctcacagaactgaaattgagatgaaaggacttgccagtgagaggtctggagaggagaacggtgtgcagtggactgaatcgtgccccaccgctcccctccaattcattatgttgggcaaatcccagcgtgaccgtatttggagatggggcctgtatggaggtaataaacgtgaagtgagatcataatggtggggccttaacccagtaggcccattgtctttataagaagagaaagaccagcgatctctccgcatgcacacagaggaagggccctgtgaggacattttgagaaggtgactgtctacaagccaggaagcgatctctccctccacagaactcgaatatgctgacaccctgatctccaacttccagcctccagaactgtgggaaaatacatgtgtgtttttcaagccaccttgtccatggtattttgttaaggcagcctgggctaagacagtgcgttcgaagagtccctaaggaggaactgctgcgggacttttccttagttcggctgaagacagggttttttgtcccatggccacgaaaattcatgctcacagacaatttgaatttgaatgagtaagacagggttttgttgggtgaaaaaggaagaaaaaggggaaacagggactctcgctaagccagagtccctgctagggtgcttcccaccagccatcctcatcccattttggggcttcccaccagccattcgcatcccagtttccacacaggaagaggaggggccaggctactccctgcggcaaatggtgtgaacctgtgtggctcctcccagtgggcaggaaagatggagagggtggaccttctccaaggaccgcctcccccctggctgtctcagaaccagcgaggtcaggccaggccagggattggagggagggaattagggtgacctgccagtgttgggggtacaacttcaccaggtcaattgtgctgtgctgaggagaacagaaaggagattcaaggattagacacaaagaaagtcactggtgaccttgataaaagcaacttcagtgaaatggtgagggagtgggttaaagagggaacgggaatgaggaagcaaggacagtgatgataaagaattctcttgaaaaactttactatgaagaataatgtggaaatggagcggggaccggggacagtgtggaaatggagccgtgactggggatagtgtggaaatggagcagtggcttttcagaaaaagtacttaaagagaagtcagatatattattaagacacacacatgcacacatatccaggtgtgcacacacacatgcacacacacacgcacacacacgcacacatatacacacatgcactcacatatatacacacgtgcacacacacgcaaacaagcgcctgaggataaacgtaatataagagggattaccaaagcctaggccaaattcatccactgaaaacaaaattattataataaaaaggaaccctggaagatatgtaaaaggaatttacatacaaaaaatcatcctgtaggaagtagaactgtatctactgtgttaaaaaagtttgtgtctcaaaatataatggcaaattgttattctattattttgttgttatttgttttttattgttttattttttctttggcatttttatcattgtaaaatacacataaaacttaccatttttaccatttttaagtgtacacttcagtggcagtaagtactctcatacagtgtgaccatgaccaccatctagttccagaactttttcatcaccccacatggaaaccccatgcccaataagcagccacttcccagaatcctttcccccagctcttaagcagccactttctgtctcttggatttgtctattccgaacgtttcatagaaatggaatcgtacagtatgtggtcttttgtgactgtcctccttcgcttaggaaaatgttttcaaggttcattcatgttgtgtcatgtatcagatgctccacatcctacttgttaggaaaatgaaaatctaaaccacaggaaataccatttcacacacattagcatggccacaatgaagactacagaaaataacaagtgttgacgagaatgtggagtgactggagccctcatacatggctggtgggaatataaaatggtacagctattctggaaagcagtttggcagtttcccatacaacacagcatttgcactcctaggtatatattcaaaggaattgaaaccaggtgttcaaacaaaaacttgtccagtaatattcatagcagcattattcacaataaccaaatggcagaagcaacccaaatgtccatctgcgaattagtggagaaatgaaatgtgttaagtgcattcaatagaacattattcagccattgtttcattgtgggcaggtctgtgtcaacctacccctaagttggaggaagctgagagactaaagaaagagacatacaaatctagttgcttagaaaagaaacttttaacagggacttataaacagaagccatgtctgtgtccctggcagtgatgagatgatatggtagatcctgaaccattaccccccagaagcaggacttatgtgctgtcagggaggggtacacacacttcagaaggagtggtcatgaatttgccctcacggtgggatttatggtaagtaggtgctcttatacgaggaggaatagataaactgaaaatctcagaggcattcccggaactgaggttaatcagaagccaacatggcagattagcacccaggatggagttgctttggcttccatgctccacccctctaatgcagctcttacagtctctcacgccctcctcttccatgaccatccctgagccttagagagagcgcttgatgttgtcaaactttagcagcagtgctttggcaatggaaaatagatcaggcccagtgggattcctaatgagggaggttcacaggctgttgaagcacctctagtcttcagaatacaatgacctcggttttctcaggagtaaaacagcgtgagatatataacattaataatttgcactcaaggattacagtcaaaagagaatttgtatcccagaacaacaacaaaaaagtacctattccattaaagagccaactaaaagtatcatgaagaaaattaaaacctggttcctctttagacttgcagacagcaaataattcaggatttagcccaaattgtaggtaaataataaaaactcaaaaacaatggtgagggctagtatccaaattttttggtctctagtttccccgtttctgccaaggataaatcataataggaccaatttattttcaaaataaattttggtctcattatacttggcctggttatttgcataaaatatggcaagaatagtgatcagcctgagctgcttatttattttttttccagacagagtctcactctgtcacccaggctagagtgcagttgcgcaatcttggctcactacagcctggacctcctgagctcaagcaatcctcccatctcagcctcccaaatagctgggaccacaggtgtgtgccacaactctggctcattttttattttttgtagagacagggtctcaatatgttgtccagactggtaggctctttttaagttgtctttgctggaacttttatgagaaattgtggattctgctttttaaaagcctcaaggctaggagccaagccaaggattcaccattagactatgcttgtaatacctatacaaattcctctcttcttgaattcccaaaatatcttaaggttcccaggcctgttagtaaatgacattctttacttaccataggtcagaaaccttgtaagagaaccatttagacaaggtactaggccagtctttcctagaaagaatttataaagtcaacctccattcctcagtctggtcaattctgaaaatatgccattccagtcaatgccttggtaaaataaccaatttctccaattatgccctgttagaaaagaaaacagattcttactgaacttatgcaaataaatatattgctatcagataaaaatactcataaatggtttccaaatttagggtaactcaggtagagagaagggtaaattttgttcacaaaattatactttacccaacctctaagctataaacagttcaaaagaaaaagaattttcttgactcttcatcaatcagagtggcagccttctaagcaggattacgtacatccaccttggaactgccatccacaagccctgcagctctttgtccgtcaggtgagagctgcctattgggcaccgtagaatccagcagctccttacacagttccagaatcagtcgaacaaaagccatatctgtgtctctggtggcagtgagacgaggtgtttgatccctacctgttgttctaatagtaaggcaacatatttgcaatgacaacagatatttgcaaataatgtacaaacaggtcataaaaagaactaatgaaggctggccgtggttcctcatgcctgtaatcccatcactttgggaggccgaggtgggtggatcacctaaggccaggtgatctctaataaaaaaaaaaatctctacttaaaaaaatacgaaattaaggccaggcgctgtggctcacgcctgtaatcccagcactttgggaggccaaggcgagcggatcatgaggtcaggagatcgagaccctcctggctaacacggtgaaaccccgtctctactaaacaaaatacaaaaaatttagccaggcgtggtggcaggcacctgtggtcccagctactcgggaggctgaggtgggagaatcgcgtgaacccgggaggcagagcttgcagtgagccgagctcgcaccactgcactccagcctgggcgacagagcgagactccgtctcaaaaaacaaacaaacaaacaaaaaacaaaattaactgggtgtgttggtgcgtgcctgtaatcccagctactcaggaggctgaggcaggagaatcgcttgaacccgggaggcagaggttgcagtgagccgagatcgcaccactgccctccaggctgggcaacaagagcaaaactccatctcaaaaaaaaaaaaaaaagttaaaaaaaaagaactaaacagaagataattttttgtaggaaagaactgctgtggtcagtgatcttggaggatatgaagatgtagagataatttcttttctctttctcaatctctctcactcgctcaatctttcatttgacttttgtctttcaattgctccgtcttttttctcttttctcataacttttgtttttcaaaattttgagaataggaattatgcaggtactcagtatttattgtttgaaggcacattataaaagaaaagtgggaaaaacaaatctgtaagttacttcagagagacacttaaaatctaatgtcagaggaaggaagaaagcagcaggatagaaaagatgtgataaataaaccagttatagcaataataatattatattagaatcagacaaactgcatcaataatgataaagaggataaggacataagggtaaattcaacaatttaccaggaggttataataatgctgaacctcagtgtgccaaacaacaaagcctgagaggcagtgccgtgtcatatagccagactgcttgggcttgaaacctaattccagcactgactagctgcagaccttaggcaagttattaaatctctctctgtttcaatttcctcatattgaaaattaggatattaataatgcctacttcttccagtcgcttgaggatcaaatgaactagcacagtgttcacaacagtgtctggcatcacaaacattggtgttattattgttgctgttgttgatattagtattattgccccaaaacatataaagaaaaaatagaattccaaggaaaaatagacatgtcaacagtcttagtagaagacttttaactttatttatctctcactaagataaatttaagtttggaaatgtttaaggtagctgcaataaaatgtttgaacaggatgtcttagcttaaagtcattacaaaaaagtaaatagaacatagtgtacataacaaaactacaaaatacaaagaaaaaagtaaataaaaaacaacaaccgaagaccaaaaaataagatgacagaagttaaatgagaccataaatgtcaatgacttaatgtattaaaatacaacatcttaggccatagtaaaatacaaaatttaattttgtgcttacaagaaacacttgtaaaagtgtgacaataagctaaaagaattagcaaaacataccaaaaatgttttaaaaatatagtatagatgacatttttattatgaaattagtatacaatgtaaaattatccataaaaacattgggcctttaggacctaagaaaaaataattatttcaaattgtacaaaataatgttttaaaacatttccaaatgcacataaatctctgagaaaatatatattccataaatgtatgctgaataacataaattttataaatataaaaggaaagtaaagtaaaactgatgtctgtataaacctacattagggatttgttttctatgctccagttccaacagaggatctggacattgcctcttccctgcttacttccttgattggctggactccctctacatccccagcttctacctgaacatgcattgtaaatgggaagtctgtgagcagactgtagacaggcctgctgcttggggaactgtaggaaatttgattcaccccaacccacagtaaacactcaggaagatgatgggttcattacgagttactcacatccaggggtaggcaggcatgtggcgtgaaactccagaatgctgagagagagctggaaggtacaaaaatctcccactaagtggtattacaattttcggttacaaaatcagaatatcactttttatcccataaatatatattaatatatatataatgtatggactatatatagggaataaatatatgtataatttgtctctacatagggaatatgtatatatgtaatttatcaataaaaaatttgttaatctcctactaatgtaaaagggagtttctcaaaggtcttgatgggctcctcacttgattagaaggtggtaactagaagctgggtgcattcataaggatttgaaaaccaaggaaattatcacctcttgctgggaaggccccatcccttgctctgtgtagatgtattatacctgcagtctgagtctgtgggctcatttccatgtacactctcaccttcagctctgccgccttgctggcagtagctcaggccacaggtaccctggacagtggagggctcaagcaagaccaaatcttctacaggtagatgattcccaactcacaatctcttttctcaaccccagagttttagttcccattccctggtgctgctggatgctactgccaaggtctggacaggggacatggagggacactgagggtgatgggtggagatgtgggaaagagatttgtctccgctcccagaagaagcaggcaaagggaggttgggatgttttgactttgaggtgtcagtggtcccaggttcagcccactctttgtcctctccatttcttcttgatgccctgaatgttctacctgtcatccaggctccagtgaacaagccaggaatcatgcttgacctctcactctcctgtttgccccaaagaaggcatatgcctcccaggaacgtatgaacatgcacttctgtagctttcttcttagaaccttgggcaccaatctttttcagctgtttttatttctttcattttatttttacgtggatcttttcagcaaacattctagaggcttcttgaatcctattcaatatcatacttgagccaaatggtaacgaattaacaaaaaggtagcaaattattaatatgctgtcaatgtgcattgtatgtggatgggagatttaactgttaaggtctaaaggtccatgattttaacctcattgctcattgattcaggacatgatgacatacttcaggtcattagggggatgggttaaggaagtcttcctgaagttctaaagagcgtgcccctctggagtgggtgacagctgcatagcttgtctgccgtgctctgcccgaatgctgttttcacatggcgtctcttctttctttactttcaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaagtaagtgaaccggtgaaaaagcatcactcagtttatacggtgttgctttttgacaacttgctaattaagcaataaaccatgacagactgaggtgatccccagttttgcaggaattttcataaattgacttaggaggccagacaacccaaatctccaaaaatatatcccatcatcaatatttcactatggcttagccacataaataaaccaaattccatggggtttgtgctaatttaaaatgcctcacagtaatgacataagcattaacattaacttacgcatccagaggtctttacctgctgctgctaacttccaagtcttttttttgtaaatggcatctctaatttttaaattataaacaccgttatgttgagtatatttgaggtagtaccattcataattttaaggaagggaagcccagctgcataggtgaaaagaagaatgtttttaaatacctgaaacttttaatctacaataggtaagctgggtgactctggggtagccctgtgattggctttgtctgtgaaatgagattgtccttcctttctgcatgcaccttgctcacaacattgcacggccccttggactggttgtctaagaacctgaggttgtcccacgtgacagccttctggggttccagaacactctctggccattcttaccttgctgccagtagagccaccctgatgggcatgcctggcatccactggtacaggctcaggaagaggatggcctctcctcaagtcaaggtggcagggctggcccctctcaccctcaccagcacatcccctccccagccccagaattgcccacctgtcctgcattgctactgctgctactgctactactaattaaaagcagaggatcagtgcctcctctgaacactcattctgcagatgagggagaccctacctttttctcagccagagctgctccaggcactttcaccccctggatccaggcccaactgcccatggcttcgaggggtgaggaggcccctgctccccccgccccaagttctacctcatcttccactccaggatgggcagcttcccaaaatgattgacaggacgcttagctagtcttctaggttggggaaccccaccctcactggctcaggtgagctcttgccgtgtgctttcatcagaacaagaacaaactagctcaacatagggtcatctcccagagtctggattatttaatcgtatccaaggtcaccatttttattcattcattcgaatttatccattcattcaaatgtatcatgatcaaaatgctagatttccacagttctgctcttactgcttgcatcaaatcaactctgaaactctccctcagatctttgaggtctccgtagagatctgtaagtgaccacaccacatttccaccatgacagacagtgaaaccaaaccaaaggacggtgctacctgatgtgcgagtaacacagagagaaaagagactctgaaaaggggcttattaaatagcagcttgcttgcctcatccacagctgcaggaaggcaggctccttaaaggctgtcagggagggtgtagcgtcccgagccacgttaaaaccttttccaaaagtaatttcttctctcagatgggtcacatttttgaatacattaaattctacttgaactgctacatttctaaaggatgatatgtagctttctctgataaacaagaaaggcccagaatattctccgcaggaactatttgttcttttcctctggcagaatagcagcaatattcggacatatatcctttttttttttttaaatcaatgcttcatgttgggatcactgccttctcaggggtctctccctcagagtccactggaagacactgataggcagaaaaggaattgctaagtaatattttgattatgttgtctgcaattaaagcataccacactggagttttgcaggccaaggtaaagtgattttcaattttgtttgatctgtattttgaagatacataaatgagtaaagcgaggagtcatgtgactaaatttacagtacacacatgctagaggtcatctgccgatgagcgaaaacgttatcaagaactcagtaaacatgatttgtcagggaaaattaactagatatgaatttgatgatttagggttccggaagcaatgacaatttatcttggttgatgccattgcgtggctttcagcgcttctgctattcgatactgatcctgagtgtaactgctccttccttctcaatctgtttatgtcactaaaagcagacttttctcaagaagaaatgctgattacttatgtaaggtcatgcacagttccagcacagtgtgaaaaatattatgtgcataaagaaaatctttgaggaggaattctgaaaggaggctaacaggatctagaaaagggctgatgtacataattgacataacgtataacatctctgtgtattttattttcacaccatacccagtataattttgactctatccaggggcaaaaattaacctcaccattaccagcaagcagactagaagtttttttttttttaattctaactaatatctatgaaaacaaagcaaaatgtataaactcactgtgaggcagtgagctgggattagctgcccttgtatttctggaaactgggttgatttcaacaaattagaaggctgataatactggaatgagaaattgacacatttagtggctctggggtttctaatatgataacaaacaagaatccaccgttctttctcctactgctgcttggttcaagcccccaagttctggaataacccacaccgtgggtctcggacacctatttcactgacgttgttttctggcacaactactgctgctcccttttccctcccacctttctgatttccatcttgagttattttgggtcagaaactccaaaatcatgctgacataaagtgctcagggttggtgatggagcattgattgctgggagcagcagcaaaacctcataggggaggctgagaaaagagcagccctcttacttgtctggatcggggattacagattcacatttactccatccagtaggaaaagacaaatccttctcaatccatcagagtgaaaccaggaggcagtgtctggaatctccgcatacgaaattcagaaggggattcttccaaaacagcggtcaagagggcagagaggggccaagagcaaccagcaaactctaacaatctctctcctcaataaaagtgagaacagtagcaacactgcagccacagggggccatgggaaaaatctctacacacagggaaggaagtattgtgcacaatcggaggaaaagaatacctcaacaacatctggcatatgaaccagaagaaacttgtagaaacttgtttgacatcctcaggattcaggaagacgtggcctctgagaaacagaagcagaaatccagaagaggagattagactcaaataaaaagaagtccattttgaacaggacaaggcaaactgaaaatgccgtagtagaactaaaatctccatagaagtatagagaataatcaactgcacaagatcaattataaatgcaacgttaaggcgctctctcagaaaagacaagtgtataaaaataaggccagaaaagatattaaattggaggacatagaacacaaaagagttaaaagttagtgttcccaagaggaactatcagagcgacaggaatagcaatcataatggcagaggtgattcgaagagatgttctaggaggaaaaattatctcttattacgcaggtagaaaatacttgcagcaatctaaagaaaatcagtgaaaacagactcaggtggaggcacaatttgccaaaaactttaaattataacataaagaaaaatccttcaaacgtctggacaggggaaaaagcaatacaacaacaaataatactgaggctaagattttttgcaagagtaaattccagacaacagagcaccttttagagaaatggggagaaacatcttgggcgtgattttaccccggtcatgtgaagaaaaacactgtggacgcagtgactgcagtatccctctgtccttcatccagaaggtgaatggggctgtgctccagctcacagcaagtaaagcacagtgagagtccccaagtgaggaggacagtgtagtgtgaaaagcagtcagcactaaacctagggttatgtctaaatagtggagggaaaagagtttcaaagccacatgaagtgttgaatcataattttgcagtaatgactcttaaaaatcccaggaaaactggggtctacaccctcaaagtcaatgcagaagataaaggtagttaaacagagtctgtctattaaaaggacaaaagctgagtagacagcaaggaagggctaagaaccaaaagcacaaaataggatgaagaatgtaacatccaatagatcagctacgaaaattaactttacaactgaaaaaacaaaatctgtatgtaaactctctaaaaaacaaaataatacttaaatatgttcaaagatatattggaataaataaaaaagcagaagtcgtgattttaattttagaaaagtaaaatttaattgtaaagagttttcaagtgtataaagaggatcaatttataatgattaaaatattcacaacaaaaatttaatagtcatggcccactgtgtactgcaaactatgacatcatatttgagaaagaatcagctgctactcatcgttttcaccccggaaggaaggtagacttcttgactgagagctaaaaagatccctgtccttcctccacttcctgacctttgactttaagatctaggatcttcaccaacccaagtgaacagccttcctgctgtagcaccgcttcccaagcttcagtatgcatccgcggaccttggtaaaatgcaggctccagatcagcagatgcgaacggacctgagatgctgcatctctgacaagcccgtggtcgatgctgttgctgccgggctgaggcaaggcctgctagggcacagtgagtgcttggacgccccaggccccaccaaagagtcctggacacgagagccaggcgtgggacatgggtgggaggggaagagatgaatgctaattttctcccttgtatgtgggatcaggagatactgcattgttcataatgtgcatgattagagaaacacaactttaagattttaggccttaaatgtaaccattcatggattaaaatagatagtatgcatatgaggtacaagtgaaagaaaaaacactttcagtaaggcaatctttttttaaagaaagccaaggtaacttgtaaaaaaatagaaatacaacaagaggacaaaaggaaaaccaaataatctgttgtttccacgaaggattgggagaaataattcactagtcacaaggaaaaagtcttgatttggaaactcctttgaaagactggttttagcagggactgccagtcacctcatgttgattagaatttaactcccctccacaaacataccttcttccccactaattaatgatcacataaatactgttcactgcaagtcccacatctgctatgattacttttctaatacaacttgtttttctcagcattgataattgcctctcattttgcatacttgatttttatatacttcctaattttcttcaagtattacaagatctgtcaaaagaatattattttcaaaatgttcagaacattaaataacccagatttatctgacttcatctgaaattaattttatttccctttctggagacattcactcttccatcctccatccatccatttgctccaatctggaccacatattgtcttggcctgacacttcctgttactccttttttatgttcaacctctttccttagctctttgtcttgttttcctcatcactgttagagtttgcatcttctagtaatttccgggaagcatatgaaaggtatattttttagttcttgcatatctgaaaattctatcatcaagcttgattatgagtttgctttgttgaaaacccttttcattcagaacagggaggtcatgtctctatcgcctccagagtcttatgttgctttgaaaatcttgatgcatctgaatttctagtcatttgcctgtgacctattggcctccaatctctgaacatttttgaatctttatctctggtgatatgaaattttatgtggatatactttaatgctttttttttttttatcaattttcccaggaaatttcaatttagagacctatgtctttctgcactaaaaactttttatgtgttacttctttaacagtatcttctctctgttttctcttggttttctgatgtaattccagccagtcatctataatgcctcccagtggattctcttagttctttatctttttgttcattttttcctactctgtcgcttagttctatttcctgagaaatgtccttgactctatcttccgaaattgtgaatatttcactttagttattgtaactttcctttcctctgactgttcctttttttatactatttggttcttttatgtttattctcttatctctctgtgaatatttattatagatttgtagcgcttttctttgtttggggtggggggtatttagcagtttctttttggcttcctgacttattatttttttgacttattcagtaaaaataaattttccctttgctaccatttcagactttctttatcctgcttatagatcaacaggtaatatactggctaagagcatagcctggaatcagactcaccaattgaccaacaaggcagtacctctatgactctgcaagaatctcagcattactgggcttgcagtgctcccagtgcagatacagcttagacaacaatacccaagtcctttcgaatatctgaaaagccttccaaaacaggatagctataaataagcccagactgtgaagaccgcaatacctaacttttcaatgcccagacgtcaagcatcaagaccatccaggaaaacatgaactcaccaaaaaaaaaaaaaaaaaagtaagttagttaccaggtaccaatcctggagaaatagagatatgtgacttttcagacaaggaattcaaaatagctgtgttgaggaaattcaaagatattcaagatgacacagagaagaaatttaggattctgttagataaatttaacaaacagatccaaacaaaaagaaccaagcagaaattttggagttgaaaaaatgcaatgacatactgaagaatgcatcagagtcttttaatagcagaattgatcatgccgaaggaagaattactgagcttgaagacaagctattggaaaacacacactcaggagagacaaaagaaaaaagaatataaaataatgaagcgcacacttacaggatctagaaaatagccccaaagcggaaaatctaagagttattggccttaaaaagaaggcagagaaagagatggggtagaaagtttatgcaaaaggataataacagagaactccccaaatctagagaaaaatattaatatctaagtacaagatggttataaaacaccaaccagatttaagccaaagaagactacctcaagacatttaataattaaactcccaaaggttaaggataaagaaagaatcctaaaagcagcaagagaaaataaacaaataacattcaatggagccctaatacatctggcagtagactattcagtagaaaccttacaggccaggagagggtgtcatgacatatttacagtgctgaaggaaaaaacttttaacctgtaatatatccagcaaaaatatccttcaaatatgagggagaagtgaagactttcccagaaaaacagaagctgagggatttcatcaacacaagacctgtcctacaagaaatgctaaagggagtacttcaatcagaaagaagaggatattaatgagcaataagaagtcatctgaaggaacagaactcactggtaatagtaagtacacagaaaaatagaatattatagcactgttattgtggtgtacaaactacacttaagtagaaacactaaatgatgaaccaataaaaataactacaacaacttttcaagacatagacagtataataaaatacaaatagaaaaaaaagttaaaaagcagggggacaaagttaagatgggggttttgattagtttttgttttgcccattcatttatgcaaacagtattatcagcttaaaataatgagttatgagatagtatttgcaatctcatggtaactcaaatcaaaaaacatacaatggatatacataaaataaaaagcaagaaatcaaatcatatcaccagagaaaattaccttccttcactaagaggaagacaggaaggaaggaaagaaggaatagaagatcacaaaacaaccacaaaaccaaaatatcaaaatgaccatagtgagtctttatcaataataacattgaatgtaaatgcacaaaaatctccaatcaaaaggcacagagtagctgaattgatttaaaaaaaaaaaagacctaatgatctgttacaaaaaacacacttcacttaggaagacacacgtagactgaaaataaagagatggaaaaagatattccatgccaatggaaaccaaaaaagagcagaagttgctatacttatatcagacaaaatagatttcaagtcataaactataagaagaaacaaagatataatgataaaggggtcaattcagcaagaggatataacagttgtaaatatgtaagcacccaatactggagcacccagataggtaaagcaaatattattagagctaaagagagagacagaccacaatacgataatacctggagacttcaacaccccactttctgcattggacagatcttccagacagaaaatcaacaaagaaacattgacttaatctgtactatagaccaaatgaatctagtggatatttacagaacatttcatccaatggctgcagaatacacattcttttcctcaacatgtggatcatctcaaggatagaccatatgttaggtcacaaaacaactcttaaaacattcaaaaaaattcaaataatatcaagcatcttcttgaactacaatggactaaaactagaaatcaataagagaaactttggaaactatacaaatgcatggaattaaacaatatgctcctgaatgacctgtggatcactgaagaaattaagaaggaaattgaaaattttcttgaaacaagtggtaatggatacacaacatgcagcagaaacatgagatacagcaaaaacatgactaagagggaaatgtatagctgtaaggctacatcaaaaaagaaaaacttgaaataaataacctaacaatgcatcttaaagaactagaaaagtaagagtaaaccaaacccaaaattagtaggagaaaagaaataataaagaccagatctaagttagaaaaaaaaaaagacccaaataaataaaatcagagataaaaaaggaaacattacaactgatatcactgaaattcaaaggatcattggtgggtacaataagcaactatatgccaataaattggaaaatctagaggaaactgacaaattcctaaacacataaaaacctacctaggttgaatcataaagaaatccaaaacccaaatagaccaataacaagtaatgtagacaaagcataataaaaagtctcccagcaaagaaaatcccaggactcaatggcttcactcttgaattctaccagacatttcaagaagaactaataccaatcctactcaaactattcccaaaaaaaaaataaaggagaagagaatacttccaagttcattctataaggccagtattatcctgataccaaaaccagacaaagacacattaaaacaaaaagaaagaaagaaaacccaagctaatgtcactaataaatattgatggaaaatcctcaacaaaatactagcaaactgaattcaacaacacattaaaaagatcattcatcatgaccaagtgagatttatcccagggatgcaaggatgttacgatatatgcaaagcaatcaatgttatacagcatgtcaacatcatcaacatatgaatgaaggacaaaaagcctatgatcctttcaatttgtcctgaaaaataaaaacaaatgtttaacatcccttcatgatgaaaacccctcaaaaaactgactatcaaaggaatatacctcaacataataaaagccacgtacgacagactcacagctagtatcacactgaatggagaaaaactgaaagcctttcctcctaaaatcaggaacacgacagagcgcccactttcaccactgttattcaacgtagtactggaagtcttagctagggcaatcagacaagagaaagagataaaggggatccaaatgggaaaagaagaagtcaaattatccttgtttgcagatgatatcatcttatattttgaaaaacctaaagactccaccaaaaaactattagacctaataaacaaattcgtaaagtagcaggatacgaaatcaacaaacaaaaatcattagcatttccatataccaagagtgaacaaactgaaaaagaaattttacaatgtagtcccatttacaatagccacagataaaactaagtacctaagaattaaccaaagaagtgaaagatctccacaataaaaacttaaaacattgatgcaagaaattgaagaggacaccaaaaaatggaaagatattttatgttcacgaattggaagaatcgattttattaaaatgtccatactacccaaagcaatctacagattcaatgcaatctctataaaaatacctatgacattcttcacagaaacagaaaaaaacaattttaaattttatatgaaaccgcaaaagacccagaattgtcaaaactatccgaagcaaaaagaataaagctggaggaatcacatcatctgacttcaaattatactacattatggcataaaaaacagaagcacagaccagtggaacagcatagataagagagaagtcagaaataagtccatacatctacagtgaactcatttttgacaaaggtgccaagaacatacactgggaaaagaaaatctcttcaataaatgctgggaaacctgaatatccatatgcacaagaatgaaactagacccccatctctcaccatatacaaaaatcaaatcaaagtggattaaagacttaaatctaagacctcaaactatgaaactactacaagaaaacattggggaaaatctccaggacattggtctgggcaaaaatttcttgaacaatacctgacaagcacaggcaaccaaagcaaaaatggacaaatgggatcgcatcaagttataaaccttttgcatagcaaaggaaacaatcaacaaagtgaagagacatctcacagaatgggagaaaataattgcacactatccatctgacaagggattaacagctagaatgtattaggagctcaaacaactatacgaataaaatctaataatccaattttaaaataagcaaaatatctgaatagacatttctcaaaggaagacatgcaaatagcaaataggcatatgaaaaggttctcgacataattgatcatcagagaaatgcaaatcaaaactataatgagatatcttatcccagttgaaatggcttttatccaaaagacaggcaatagcaaatgttggtgaggaaaagggaaccctcatatgctgttggtgagaatgtacattaatacaaccactatggaggacaatttggaggttcctcaaaaaactaaaagagagctgccatgcaatccagcaagcccactcctaggtatatactcaaaagaaaggaaatcagtatatcaaagaaatatctgcattcgcgtatttattgcagcactattcacaataaccaagatttggaagcaacctaagtgtccatcaacagatgaatggataaaaaaaatatggtacataaacacaatggagtgctatttagtcataaaaaagaatgagatcctgtcatttgcaacaacatggatggaactggaggtcattatgttaagtgaaataagccaggtgcaaaaaagacgaacttcacatgttcttacttattttggggtgctcaaaattaaaacaatttaactcatggagatagagagtagaaggatggttaccagatgcgaggggagtaagcggggatggttagaaggtacaaaaaatagttagaaatagtacgacctagtatttgctagcaaaacagggtgactatagttgaaaacgacttaatcattcatttttaaataactaaaagagcataattggattattagtaacataaagaataaatgctggaagtgatgaatacctcatttaccctgatgcgattattacacattgcatgcctgtaacaaaatacatattgtaacctataaatatatatacctactatgtacctacaaaaaataaagcaaaaataaattaaaatacatacagaaaaccaccatacaattaagagaaccaaaaaccaaatgttggttggttcctttaaattacgaataacattgataaatatttggtaaacttagaattaaaaaaattaattagccagatgtggtgatgccgcctgtagtcccagctactggagtgggaggctgaggtgggaggatcgcatgagcccaggagctcagtgttacagtgggctgtgattgggcactgcactcccgcctgggtcacagagtgagactctgtctcaaaaagtatatatatataactaaatttaaaatgagagaagacagaaataaccaatatcagaaataaaaaaggaagtgtcacacaaatcctacagacattgaaaatatcatgatagggtattaagaacaacttatccctaaaactttgaattgttcatgaaatgatcaaggtggaaaatataacttaccaaaactgacacctgaaaaatagaaaataagttaaaatacaaacactaatacaacaaatgaagaaattaagtcagtaattaaaatcccccacacaacaatagctcaaggctcacatagcttcactggttagttgtaccaaacagctgaagaaaaaaataattgtcattttgtacaaatttttccagacaataaaactggagaatacacacttcaactcatttcataaagctagcataaccttgataccaatattcatggatattataagaaaggaaacttccaggacaatctcactcataaacatcaaggaaaatttattaaacaatataactaacaaatagaatccatcaatatataaaaaatgataatacctcatgacaaagttggttttatttcaggagtataagactggcttaacactagaaaaatcaatcaagccaatttacaacattaatgaattaaaaaatgattatttaataaatggtgaaaaagcatttgataacatttaacattcattcatgtatttaaaacaaactgagaatagaaaggaattcccttaatctgatacagggaattttatcaatcagaataaactagtttacatttcaataacaaccaatcccaaaaatcttaggggcttaaaacaatacattacttaaaacatgaacaatatagatttctgactgtgcaacctgtctgttgcaggttagcagcaaggttctgttcattgtcattgcttagggacccagcctgatagttgttgctggttcagtaccacaggaaacaagagctcagaaggtccaccctggaaggggcacatttcacttctattcactattcattggccagacatagtctagggcccatccaaccttaacagggccacaacgtgcaatcctacaagggcattatgaatacattttacagcccctggattctgttgtcttcctgtgaagagtgttgattctaattctggcagacaattaattggacacagaccccaaaccttgtcttctctgtggtggacaacagctgaagttatttcattttcagttttttcatcttgcagcttttgctcgccatctgggactactgggaatctccccatgtgtgtaattctaagaggtcagctaaggcagagcttacatgcaaatttcagtttacaccctctgcgaggccctcgcttccaagatcccctcttccaattttctacctgctcttccagcccagaactctctctccaagtcagtttacctgctttctgctgccccaggccacacaacttagctcgtagggaaaaagctttcaactcaccttatcaggtgcatttccagattttaagggcagactcctctccaaagtcggcctactttaaattctttggcatggctttcaaggattcccactatctggctgaaaattttgtttttgactttatttcttactatttcccttcattcaccctgtgctctagccaaaccgattgtgccgtagaacttgccttgcacttttctaattctttgtcttcgctcatttttcggaatgcccattctcacatccccagatgcctaaacattaagtgaccttcaaagcccagctccaatatgaattgatctataaagcctcttctgattcacctctccactccctaccctcaactccagtcctatccccactctgccttccctccccgacataactttatagctcctctctcatgtcacttagaacataatgttagaaagtaatacatccccacagcatctaatgtcctggctagtacacaagagatgcatcaaaatatttgcaagattaatttaataaggtacataactgctgtctgtactgaaatctgtataggtgccgtaatcaaaagcatgaagtggccatttgggcctgccactgtactatatattctataaaaactgtcgcataagactctctcatatgaaacaacagatgaagggtataatgatatagtgctttctatttattgggagaattatttaagtggtgagagtacatttctgttgattcatctacattctctcacgtgattctatcataagcagcaacatacttttgtgagatggcctagtaggaggagaggtgaccctggttgccaaagaattatggaaatatcactgctttacaaatagacgggccataacacggtggcttcattaggagagctctaacgaggtgaggtcatccggcagtaaagggcaggcgtgcacagacacagcggaagaaacctgagcaagaacattttaccaagcaaaatattctgttaaggaaaacctagtggggaaaaacaccaccgagtaagaatgaaatatgagaatccatatcacaatacaaaaattactttgggaattctatttactaagaaagaagcaagtacaattgaaatgcattaccctttactcatgatctaataattttacttatcttgacattttccaagtaaattattctgaacgtgatcataattattttaaaagtaatgatttttaattttggaaaaacaagtctaatctgtttaaaaaacattaaaaagaggtgtctgacttaggattattttggttaccagatacagaaagaaagtggtttcaaattgtcttagacagtaaagtttgcctggtcactcgccagaggaaggaatcaacatcaggcctcgccctgtatgaacaggggaatgaggaagggtgatccagcacccacgatggaggcggcagagatggagagaatggacagcttagctgtccctgccagcaaggcacagcatgtttaaagagagaaccagctagatgcattttcaagccgaatccgccgtgcattaactgtccctttcccactctcaaataaataaataaacaaaccaattctatcactcttctagtgtaatgtgatgttgaggggcaaaagctctgaagtcagactacctcatcaaaattccaactctaccgcataactgctatcgtccaagttaactacctggagactcaggagcctaacttataaaattggggcaataggaccgggcgcagtggctcacacctgtaatcccagcactctgggaggccgaggtgggtgggtcacctgaggtcagaagttcaaaaccagcctggtcaacatggtgaaaccctttctctactaaaaggatacaaaaattagccaggcatggtggcgggtgcctgtaatcccagctacttgggaggctgaggcaggagaatcacttgaacccgggagacggaggttgcagtgagctgcactgcgctccagcctgggcaacaagagcaaaatttagtctcaaaaaaaaagggggggaggggggcaatgatgataatgacatccaatttattgggctatttcagtgattaaatgagctaatatgtaaggttataagtgttatcattgtcatcattatcatcgtcatcattatcatcatcatcatcattctctgcctaaattacggcaacattttttagtcacccgggctagagcctcagactgagaatcttcactcctgctcccatgtggaggctgagctgtagtcaggactagcactaccgcagtgcctccccttgctcttcaaaagttgccgtgaaaccccacttcatcactattactagtggcttattccttaagccaccaaagcacaggacacagcaggtgtctcgaatgcctgctcaaagtccaccctagattctatgtttgctgtgccgctttgaacatttctcatgagcacacgccaggttggctgtacaccagtatcccatgcctgtgggtacgctgggagggtgaggggcctgagcatgctgagtgcagaccggatcccagcttgctactaactagctgtgtgatctcaggccacctgactcttttaactgtcccagagcattagaaaactgattgcccagagacactgtaaggagtaatgagattatacaaatagaacatttagcatggtgcccgatcaagaataaattatttttatatccttggttttccttcatggtcatgtctctgcagacttctaaattggggtcatcaaaaaaaattgatagatttggattctataacattcatccaagttacagtaaaaactttagatggaaactggactcgatcaaatatagatacatgaggtatcccactcagggctgtacaggctggtaccaaatcattagtgcgtattacttggatacaattgttcacagagttaaaaaaaaaaaaaagaaagaaagaaaaagcctactttttcaaccattcctgtatcctccctataaggaaaaccatagaggccttgccagatgctttgctgatacagtttatttattatctcctttatgaggaaacatattagaatacatgaggttagcttggctggccttattccagagagctcactctgactcctggtaacaactactattttcctaggagctcccgaatcacctgcttaaataatcagtcctagaatcacagcagttattgatgtcaggcttagcagtgtgtagttttcaaactccttcttggaaattggtctctttacccgtcttctattttgtgcacatctcttgtcttgttttgtgaagagcctgtgcacattgtatctttctttacactccactgcttctactgtctaaaccctgtggaaatgtagacaccttttctcaaccagaagaagaaatgtagcagtcattctttttttttttttttttttttttttgagatggagtctcactctgtcgcccaggctggagtgcagtggcgcggtctcggctcactgcaacctctgcctcccgggtgcattccattctcctgcctcagcctcccttagtagctgaaactacaggtgcccgccaccacgcctggctaattttttgtatttttagtagagacggggtttcaccgtgttagccaggatggtctcgatctggtgacctcatgatctgcccgcctcggcctcccaaagtgctgggattacaggcttgagccactgtgcccggccctagtcattcttagaagtagtggtgcatgatgcagcattctcttggtttttactctgaaaatggtgctaactccttcctttggtcaccttttcagttttcaccccaatctttgcagatgaactgagacacaatttaggtacagaggagcaaggagctccaaagacacgaacctgccccgcctctgacagtgccacagtgctgatgggtttactctcagtttctgtgagacgtgctcatacgtgtgtaagcaagtgcaggcccaacctgggcaacaagactgaaaaggagtatgttggatgacatgacgcttcaggtttcattctctgtgtctggaatatggggagtgtcaaatagatcatgctagggactgcatcatggagaccattttggtaactgaatactttcatttactcaaacagcatgaattatgtatctacatttaaaacaaagtatgtcatggagagaatggccaaacactttcaacaaatactaaattatattctacagccatgaaagaatatattttgatctattgaaaaattgaaaaagagtcagccacttgtaatggcaaaactttgatggaaaatctgagttttgcataaagatagttgcatggcatgctatggtatttatatattttacatattatatatgtgttgagagaaaaatcaatattttttgtatgacatttacttcaagtaggagaaacttgaaaacaatgaattaaagaaaaaaatgtaatccttattataggcttacctcatgtccataatagctgatctaaatcgatcatactttaattgcctaggaatatgataaatcaggctgtgtcatatttacttatatagcaattgagctctgttatggaaggagaaaaatttctacaattttgaaatctaaatttggtttgaaaatatattttgaattcattctaccctataaaatagaaaattatatggttggcactcctgaactagcaaaatttatatccattgtaatctaattcaactaacgctataatgggcccaaaacataaaatatttattaaacattttaacttcagaaaaaataataaaattctatgagacactataatagacaaattcataaagacaaaaagtagattatcagggactacagcaggggcatggggagtctttgcttaatggctacagagttgtgggtgatgaagaatttttagaaaaagataatggtgagacttgcacaacattgtaaatctaattaatgccactaaattgtatactttaaaaaggtgaaaaggcatggtggctcacgcctgttaatcccaacactttggaaggccaaggagggcagatcacttgaacccagaagtttgagactagcttcggcaacatagtgagaccccatctctacaaatataaaaaaattagccagccatggtggtgtgtgcctgtagttccagctactcaggaggctgaggtgacaggatcacttaagcccaggtggattaagctatagtgggctatgatcacaccactgcactccagctagggtgacagagtaaaaccctgtctcagaaaaaaaagtgggggggagtaaatgccatattttatgttacatatattttacccactaaacaaaataaggtattaaaatacataagaatgataaaaaaactaacatgcctgctctcagcactataatgctatattttcttttagaaattctagcctctgtcacctgaccaaaaaaggagagataaatattagaaagcaaacacaaatttaacaatatttttggtaatatcattacatataaaatccaacttaattcactcaaaaacaattagatccagtaagggaattaaataagttagcccgttaacaaagtaagtatataaaagtcatatacttttgtgtgtatattatcaataacctttaggaagaatattgggattaaataattttacacaaataacaacaaaatatagaatttctgtgagtatatctaacaaaatttgcaggatctatgtgaaaaaatactataaaacttttccaaggaacttaaagacaagaaaattgaagacatatcatgttcctaatggaaggattcagtagtaaagatggcaattgtctgccaaattattctctaattttaccaaagggccaagcacatttgcaatttcaactaattatcttaaagtttgtctcaaaaaataaagggttaaaaataattgagagaatattgagaaagaacaatgagaaatagattgaattctgatctattaaaacacaaagttacaatcatgaataataatatgtaataacaaaagaaaaatatgcactgtatattgataattttttagaaagcagtttttaaaagcgcttatcttttagtggaacatatgtctatggaaaagatagtcccttctgttagcgtctcagtacacaagtttctagtatttatgcagtttacattctattttataaaatgaggtccgagtgcaaatatgctttatagtttacttctttagtcacttgtgtcttaaacattttcctattttaaactattttttctattagatgactaataattttatagtttttcattgtgtggatatactatagtttacttaaacaatttgttgttcttggaacatttagattgtttctaattatcaataatactgggcttagcattctttcctacaatgctttgtgcacatttgcctaaatccttggactaactacccagaaatgaaactgctaggttagctgttttatgcatttttatggcttttaggtttattgccaaactgctctgtagaaaggttggaatagtttataacatggtgtctatcagggcgtctcctcttttctcttttctcaaacctgtttccacactgacagtgttaaattgtcaacaactttgtgttaacatgatattaaaaattaccaatgaagtttgtgaaaggaaaatatcttgggcccccaaaatcactcaggaaaagtcaagctggaaactgcttagggcaaacctgcctcccattctatcaaagtcactcctctgctcactgagatagatgcaaatctgatttgcctcctttggagaggctcatctgaaactcaaaagaatgttaactgtttgtgtatcacctctctgtgacctggaagctccctccccgcttccagtcttcctgcttttgctttaagttgtcctgcctttccagaccaaaccaatgtacatcttacatatattgactgatgtctcatgtctccataaaatgtataaaaccaagctgtgtgccaaccaccttgggtacatgtcaggacgtcctgaggctgtgtcaggggcgtgtcctcaaccttggcaaaataaacttcctaaattaactgagacctgtctcagattttctgggtttcacaagttgaacattccagaatagtaaatgttcatttttatgtattaatttgtgcgttgtctgtttatgtgccgtgcccatttttttaattggaagattcagtcctttattgggttgtgatagctatttgtatgttaaagctattaacatttaaagcatatgtcaaaaatattttttagaattttgtttgcttttgccttttgtttggtgtttcttgttttaaaagaagaagcagaaatgtttccttttttcctgataccacaatagtgaatgacatctaatagtagaaaaagttctcactttgcaaaaaaaaaatcataaaatagtggattttatgcctgagaaaattatacatgtagcatataaccatttaagataaataacttttaccacccttgacttcaaattattttttccttattcttcagcaatttctctatatctgaagcctctatcttgtttattatacctaaagccagtaagcagtacaatagaaatccaattttctgaatagaaaggttccatttgttgatctataatgtcagtagactcctcatgttagaaccttttcaaaaccttaaatcttgagttcaaagtcctcacttatgtcttgacaatagctttcaggcccatcaacaaaagaataaacacatttcttctctttcaagctacaaaatcatattctctttatacctgttagcatactttttcaaaggaaaagaactgtttcaaaaaaaaaatctttttgctttaattccgctgtgacagtaagaacaaaaagacttccgacttcatggtgtatcttaattctctgagaatgaagaagagaaatagaggaactgaagagaaaatgggcagtgtaagaaatccctgttggacgaagttaagaggcttttaaatagtgcatatcctgcctttgtttcacagctactgcagaagttttagagccattacctgtccattgaggaggacttagagctccattttagatgccattacgcgttacagttcaggcattttacttcttggtcactgtcaatccaataacgttgatcacaaccatgttaattcaggcaaggtttcctgatagctaatatctaatctatgtcctaatagttaatatcattatccattgtgagagagattattaatgcatgcccaaatgatcaattaggtatagacatggacataaacctaataaaaatttaatgttagtgttactcatatatctcatatatacatatgtgtgcatatatataatatatatattatattatatatataaatttactccttgataccagtatattctacagggcaaacttcttctctcacattggcagtagatcagcatacccaggctgttttattgcaaccttcggcgggcacacactaaaagaacaacactgggatacgccagcatccagtgaccacaacggtcaccaaaaccttttctgcaattaccacattcaggtagtaatcactttgttaccttccataggctctcctacttatgacttcatagtgtcaacagaacagctttttttaaaacacaaaaacaaaacctatgaaatggagtgaggactgtatgtgctcagtcatacatttcttttaatatatacagaaatgcaaacaacacacccatgtgattctgttctgtgtctaatccttcctcactaagcagtttataagatatttagctagctgtggctctgagtccttcttaaggagtgggatgggaaggagagatgaataaagagaaaagaaagaaacccaggatctcaaacatctgattctgtttggttgataaggcaaggtgggacccagggattcttgagcttgggaaaaatcactacagcctcaccctccttttgtatgcacctccatactcctctccagcacttccaaacgatcccaagaaagacacactcccagtgacacatccagtcagggtatctttctactatctcttgaatcccccaggggaatctcatgcatccaagctggagcagcccctgcagtgaaagaactccttactgggaagctagtccctagcgcgctgcttcctctcctggaaactcttcatgtaaatgacatctactcagccctggggtttgttcccacatctgggagccttcccttaaccctagactaggcgtgggacttgattgtctgcttaaacgccctgtccttcttatgtgtaattgtcacatttgtcatacttgtttaatatctttttccatactattttacaaaccccaagaggttggtaccatacttgcctgattcatttctgtccttccaattcctaaaacagtgatgggcatgtaatgcatgcactctcaatagacatttggtgagggaagtctaagtaagttaatacaggtgaagtgctcggtttaattcctggcacatggcggtgctcactacatgttagctacaggtgctgtgaatcacgcacatatctgtgcagtcctgaagcctaaacccgttgagcatagttggtagactttgaaagaatatcaactgcccccaatccttagaacatttctggcctgccagttctcctggtaacctgagcttgtcagtacataaggctcactaacccctgacattctaaaaaggcaaaacagcttttagatcagataagaccagatagagagtctctactgctgactgcaacacgctgcgtgccttcttcctcctcaccttctcatggtgatctgaaaccttgttcttgaatatctcatgactccagctcttaagctaaatgatagcattctaattttagttgtttttcagcagatagattttgtcctgcagtgtgtctaactgctgctgtaatgagccatcatgctgctgagttctatggttatatttaggttggttccctgagtgaaggctgagccgtctcttttcattacatttgtatttactttcaaactaaacaagaacagagtctggactggaccagaagttgtagggggctctgaagtgttttcatgcaacaaaccctagttcgttgctaggggggatgaatctgaccacatttttttaaaaaacttcctagtgattccagaggaaatggctgtgaaaccactaaatgatatcttatattctaggacttttaacagaggattcggtttagttcaaactagccaggcataaaggaagcacttaggataagtttgaactaaaccaaatcctcagttataagtcttggaaaataaggtatcatttagtggttttgcagctatttcctctggaatcactagaaaatttttaaaaataaagtggggtatgattcatccctttcagcaacaaactaggggctgtggtataaaaacacttctgagcaccccacaaattctgaggccaatggaagcgggtagggggccctgagcaattttagcaggtggtgagatgatcagataagcttgagggagggtaaccccgcggtaccttgaaagacaggttggggaagtggagaaagacagaaagaaaagagatccatacaagagcaggctggtgctccagtgaatgggtcccaaggatcagaaccagaggagtagcaataagaatggatacctagaggagagaaggtgaggatggagagtgagaccagagagagaagatgaggatggagactgggaccagagaagaggaggtgaggctggagaccaggaccagaggagaggaggtgaggatgaagaccaggaccagagaagaggaggtgaggatggaaacagggaccagaagagagatggtgaaaatggagactgggactggaagagagaagatgaaaataaagaccaggatgaaaagagagaaggtgaagatggaaaccaggaccagaggagaggaggtgaggatggagaccaggaccagaggagaggaggtgaggatggaaaccaggaccagaggagaggaggtaaggatggagaccaggaccaggggagaggaggtgaggatggagaccaggaccaggggagagaaggtgaggatggagaccaggaacagaggagaagaggtgaggatggagagtgagaccagaggagaggaggtgaggatggaggccaggaccagaagagaggaggtgaggatggaaaccaggactggagcagagagggtgaggatagagactgacactggaggagaggaggtgaggttggagagtgagaccagaggagaggaggtgaagatggagagtgaggccagaggagaggcagtgaggatggagactgggaccggagcagaggaggtgaggatggagaccaggaccagaggagtgttggtgaggatggagagggagacacaaattcaagagatactgcaaaaggaaaaccagatgatttggtaacatgaggaatgcgaaggaggagaaacaggctttgacctggagtgactgggaacaaggtttatctttactaaatatgaggaacatagggaagaaaaagaagttcagggaggaaatttagtctttggaacaaactgaatttgaggttctggcaagatccaggctgatggaaatgtgagctggagttcaagaacagtgtcaggactgcctcagagatgtattgaccaaagcatcatttctttttatagcctgggtccttttgtcccttcacagtggcatctgctttaaggtcatagtcaatctttttcattagaaggtagaacatcttacaaataagagcctttgacttcttcttggagtcatctgaggcatcacattttattaattgcacttttgaccttctataatagatgttttatctggctcttctacttaaaccatggtacttttagccatcttagaaagtgcataacaggctcccatgattgaagaaactggggccaagaaagtgccagtaagttggccaacctcgcacagccagttatcagcatcctgattcccgaccccctgcacttcccactggggcaagtggtgcctttcagaccctccctggtggcatcttgctctgtctctgcagtacagcttgttactttgcactcagaactgtttctttagaactgtcatattcctgtggtctcttatagcttatgtgttgtttccttctaactgaactttaaaaaattttgcttttctttcctactttgtgagggcctaaacgtagtcactttatgttcacttctaccaagaatattctcggtgtttgtaaccagcctatagatttgaacaccatgcctcaccctccttcccaaatgttcgttccatgttaatggttttaagaattgtatggattgttgcatgaaagagattgttgcatgaaaatgtatctgttgtcaacccacatgggttcctttaactccagcaacattaagtgatcttttgtctttcatactgcttatccaactcagagccccggcctcttctacgaggggaaaatgagctgcattcctagggctggtgagaaatcagtgccaatggggagaataaacagtaatcagacaagattccatttaaaacattagggttgcaatgtgtcatccaaagctataataataaaggcccattggtccccagtagagcacagtttaattaaatgcaaccacaagacaactttaccttaaccttgtagacctgatgctttctattaaaatattttctgcttggtccttcttttaccatatagatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatggtgagtgagcccacgagtcaaaatgtcttttaagccaaagaaaaagggagtggtttgaagtagagttaattagcaacacgtttaggatttattattgcatataaaccatgatccatttggagatctaaatagcatattcccacgccttctccagctactccctagggaaacagtaaagttaacaatttcatttattactcctcaggtacagcttacttactcagtacagaagtgctgaagcagttctataaacttccaataattaaatttgaagtttttttaatggtcttttgaatacattagtaggttttgagtttgttctttttcttcatagtgattctacctttagatacttcctgttacaatttcagtcagcttttttccattggtttaagatgaatttttaagcactattattaaaatctggtaaatggttttgatgattcatttattttttgtagtattattctataagctttggaaaacacagatgaattcatatggctctattttaccctaacaaagatattagcaagtttttggtgacctttggcaggcagtggatgtaaatctattcattaagcgtgtgatttcattgaaatgatgagtctaattttcttttttgttgttaattttgaagttccgtacttctcacatgcatgttataagtcaacatgaagttatttcctgatagtggtatcaataagttagtaatttaatggagcactgaatgaaacttttacaacatgatctgctcatcatacattcaagaaaaaaaatcaaacaagaagctgagtttacagcagctcctgccacaaacagacttttgtttggaatcactattttttatattattactcaattgctattatgtctgctccaggcatagactattcaggaaatcatggaattctcaaaaagcttttagctctctttcagtagtagaaccggcttatatgttaaatactatacatatttagaaaaaggacttcaaactggagttataggagcttacaaatgcctgtaatggagtgcttgcaatggtattctgttcaaattatctgaagagctgtgggtaaggtggacattcaggcaagatggttagtctttacgcaaagtaataactgggttttaataattgagtctcttattgttaaaatgtaatgttttagtaacaatattactacatttggaaaatacttatttaaacagtcttcattcatagttcatatttttaccatatagtagcagcaaatatccatgaagttatgggagactcccgatgtgcacctttttcaactaaggtcgataaaagaaactctaactgcatacctcatatttagattctagtaacttgagggagatagagataaagatgttctgctagagatgagagcattattaaagagatggaagcatcagggaacagccacccccaaatgtcttagttaacatttttgaagtgtgcgattcactaatatttcctcagtaatcctcatgcaaacctatgatgcatgtactattactatttccatttaattgttgcagaagttgcctcttgtagctttcctcccatgtgaacagttattctgtacttgatgatcctggaagatgagcctgaacacatttctcctttcttgcctgagtatctgggaataggtagctactgcaacactgctttaatgcttttgttggtcacacaataaaggctagaacttatatctaagcatcattctgtatccctgtataaaagtagaaaatcagtgatgttcaaaggacaattagaatctttctttatcctcaaggaaatctataaagatggataaatattgctgccgcaaagacagataaatcttgttgggagctctagactactaaacaaaacaattggtttctactgctttctcattatagtttttctttaaacctttaactcacaggtgttcatacacttaacaaagaaaattattgactttaagaataaatccctagtaagattttatcaatgtgggacatttaaagttcatacgagagtccttaattggttccaaactcagctaattcttttggagtctttctaaatgcatgcatcaggaattctacatttaaattatttttctgcttaacatttttctgacatttgtagggaaaaatattatcttccgcttcattttctacttatcttagaaacctgtcacaacaatgccagcctgcagtttgctgtattttcagagggtcctattacaaaattggagcattctagctataaaaacttaaaactgttccttaaagtagctatgttaccctagatccaattctttcagaaaaaaaagcttatcgcaggattttcaattacattagaattttcactaggaaaatgatttagctttaataacattttaagaaagcctgctttatgatatacatcacaaaattatatatacttattttatttaagcagatgtccttagtaacagatataattatttacaattaaaattacattagaaattgacagtatgtagcagtagaaaaaactcatcctaaatttcaatgtatttgagaacaattgcacatttccgtattcctctttttttgtatttctcttttatgtaaatcaatgtcttgttaaactcagattcaaaaatatttctttcaagtcccactacaaaattctttttagaatgagaccagatacaaatgacaaaaaagaatgagagaaaatattctttcaaataaaatgacctgtctgtcagcatcccctcaaagcgcaaacattagattagttctactgcctgaagtttttacaatgtctcctgttttaatgtcacatgaacttcctctgaaataagcagtgggggttgcagagccagggagctagacattgggacagtggcccatgtgaggagcccaggcttccagtcttttcaaggaccagttggaaatcaagtaggggagggaggaacagtccatgctcacagcaccaattcaggccccatctacacgatcagagcaatgaaaacttagagccagccccactagatcattcttgttctagcagagaaagtggctgtatcctcttgtgtgttcataatatttttcacagagtttaattaggctatagttaaaacaagaacagataaatctgagatgtgaatggtagtgtagactaaacagtaacattttggagccagaaaagctgtgacctcaggcaaatcccttaaagtctgtaatcatcaatttttctgtctacacaagatatgcatcgtaacaacttttcattagggtgggcataattagagacaaggtgttcagggcaccttcacatggagcctgtccatgaccgggtattaatgagagagccattatgattacacaacattatatacatatccaatattatatacatacaatagtatatattatagaagaatatcatgctctatgaattattatgtaacaacacaaccaggcaactgaaagtgttgtgtgtgacccatagcgctctctcgttgggtgacctgtcgcttggccctctgtgagcctgtgagtggcatgtggcctcccggtctcaccagctgcatcagtgcctttgcttcaaatggttcattttggctctaattgccaaatgcagggcgagtggccaaataagtgaaagactcagattcattcactggtaacaggttttcaaatccatcctttcctggcataatctctcagcttgaatatgtgactggagtttagggagcatcgtatttacaaaggagaaacctctttccagcacagacaaggaaagcctgggccacggtcctctttgaaaaaaccaaactgctgtctaagcttttgagcttatttgcctgcattctaaacagtgaattttggacgtaaaacatgctgtctttccagtgactgctttgaggggaaagaaaggggagttcctacaaaatattccttggatgcatttgtcatacagccaatagcaatttattctttcctatgttctttcacaaatgttattaaaggttacagaaaattaaaacaataggaatcttcaatttatagctttcagagatgaaactaccaaattaatgatgcagagtattacatttgaggagcatgagccaataaatggcattaaagcttttacagctggaatatgggctccgccagcagattagggctctccgacaggcctgtttaccatattttggttcatttctaacagtaccaatagttctgaaacaatccctacctaaaagatttcagactccagatatcagagactctgataatgttgtaaatttatgtcatgaaatatgcaaaagtaaacataataatgaaatatcctgtccccacgtttgtaggaatcaaattgcttggctttatctaagatgtttaccattatagactaataaaaagttcattaaagagacttaaaattttaattcagatgcaggcacattaaaacatatggggaatgaggatgcctgaagtttgcaaaattttaggatgtttgtaccaggtctttgacctgtaatttaaacggcttctaagaaatagaagtaattattttatgttgatcatcttttaaaacaacttctaaggagaacctaggccttgtaagtcaacctgattcaaaccctccttgataaccctccttgatattcgtgtgaattctctgggaccaattctcatgctcttttcaaacgttgatgaacttctgggaatggattaccaaacaacaacagcagcaacaaaaccttcagtttttctgtcccaaagttgatgtatgtaaatgttatttctcctcacagagatttacatttaattttggaattcaggttcatcccccatggaattctgaacaattctgcgttcatgatttacattttagaaatttacttcgaagtccctttgaaatggttaaatgtgttaaatttgaaccatgagattatcctaaattccttgaggaaattattagaactactgccccccacatttctgaaagttagatttggaattgtcatgcatatatctagtctctctgagcacttcctccatgcacacttaactcatttgtctgcagagaatcctgggattataaagttggaagatccgtgtaggggtcctttggtctaagagtatctccaatttaccaaactaatcaaccattacttccacgaaggcaaaatgtttgtgttggtctttccttttcttatatagagcttggcacacctagtagaatcaggtgcctaatatgtgcttgtgtgaaattagttcactaactcagcctacgcaaccagtacttatttattccgtcttgtccaagcagcctcactacttcatggggtagctgttctacttccaaagagaaaggcagctcctgttttgaaaggaaatttacacctaacatttccatctggttcacctctctcatctaaactacacagcacaatggttaatccttttccacatatagcaagccctcgggaaattatagaaaactttccttccccctcggtattcacttctccaagtgcaatatccctacttcttccaagcattctctataagcagagctcccaaagcctggaaaatctttgaggatggggagggaggactcatttctacagaaacagatggttgtgcagcgatctaagtgagagggcagcccaggacagcagatggtcctgggaagggctcaggcctccctccctcacctgatgcccccacgcgtggtcagcccataaagacctctttaccatggtgaaacctacacatgcttatgaggttaaatgcctttcctcttcactgagactgctacatttgagtctattttcaacccaaatccacttataaaaagcatcaggggagtggggtcagtcacaaactgtaaattacgtctctatgtgctcttctctgtagacctccctggttgcgcctgcccggagggaaggattattctgagttgtctgtaacctggtagggcgatgtctaaagaaatcagaatccagctctgaaggctgtgtcttagcttcctggagccacgtaacaaattaccatacacagaatggcttaaacaacagaaatgtatcgtctcccagttctggaggctacgagttaaagatcaaggtgtggacagggccagctctcactgcaggctccggggaagcctccttcctgctgcttctagcttccggaggtgccagccgtccttgagctccttggcttgtggatgacgcatcactccagtcccgccccatcttcatgtggccttttttcctgtgcgtctgtctgtgtctcttctcttcctatgagaataccagccctcataaggattggattaagggcccaccctactccaatactccaatattactttatcttaactactttcattggcaatgaccctatttccaagtaaggccacatcctaaagttctggaaaagacaggaatttgggggagacactattcaatccagtccagatgatatacctctttcctacagcctgtggggagaaaatctcatctttgataaataaaggtagaggttttgtgttcgtttcactccttcacattgctgtaactagtgttactgagcctgctctgcacggactaatgaaaactccctctttcaacaacaaaaatgtcatgccttttcctttcagcaggaagggtttgtttagttaagaaagaaactgggcctggataagttttgagtaggggagatgcagggaattgatgtttctcttcttcttcggtaatgctgcaaactaaccagagatggaagctcacacttccaacagctctggatgctgccctggggatcccatagcagcaccccagggtgctgccgcaccagcccagtctcgagggacctggccacggtgaggctggttcacctgggcctgtcccggcccaaaccagctgggcaggaggctcaggccactctgcctaaaggggtttgtaccaataaatgtgggtcacctggtggacaagcaggggaagatgcttgggcagatgggataatttgtggagaaacaagaaatgggacaaagcatgcagctgccgagcacagcactgaggcgcaaaggctccggctgcagttcttctgggttcaaactgtttgccggctgtggcttttgacgggtcatgtaacaactccgtgccttagtctccataatttaaaaaccaagttactgggaggattaaagcagctcattgacttgcagagaactataagaaggtcatttttcaggagttctacttggagagaaggaggggaatgaattgtggaatcgagggtaagtgctttgaaactagcgtgttaggtaaatgtctcctacctgcagcacagggtttatggagagaaccaaatacatgtggctttatatggtccttccaagaaaattaagtgaaatctttttaagttaatatcataattaacatctaagatgattacatatgaaataaatattcaagaatcaatacctttcccatatgtcagcagtcagaaatgcaatgcaaagttcattttctagatgctactaattcctaattgcaaatattccaacccagacaaactttcactgctcagctctcccttcccccgaagacagtttagttccttccttggccctctcacatcattgcaaagaagggctgagtagtgacctacgcatagggctgcatcagcaggttcactggcctgccccagtgaactagtgaaatcccaacctctttccactgtgttctgttttcgattggcccttatatttgtggtttctctgtataaatctttccaagttgttgtggccaagtttcctctggacatccccatttcaccagcatctggctttaccactgtccccacttatccaactttacctgaagggatcagactgccaggaggatacagagttgcagataggttcatgacccaggcacatccccattgtttctggaccagtggcaaatgtggtatatcaagaatggcttgtgtaagagaatcccattcattgcttctgaaacggtgatgaaaggtgtcgacaaaaagagtcacactctgtaaaatatttaaagaggcttattctgagccaaatatgggtgaccatgacccagggcacagtctcaggaggtcctgagaacatgtgcctaaggtggttgagttacagcttggtttttatatcttttagggagacataagacatcaatcgatatgtgtggggtatacattggtttggttcagaagggcggtggtttacaggtcatagtgggttcaaagagttcctgattggcaattggttgaaagagttaagttattgtctaaacacctggaatcaacagaaaagagtgtcagggtcaagataaggggctgtggaaaccaggtttcttattatgtagatgaagtctcataggtggtacccttagagaaaataagttggcagatgtagactctccgtaaatctcttcaggactgggagggtatggaatggggaaagatctattatgttaatagagattctttatagacacaactttctccccactaaaatgacttttcagtccatttcaaaatatggcaaagaaagatatttggggtgaaatattttgattttctactttgtctgtcatgtgaggttatgctagagtcaggctggaaagtaagccacgttatatagggttaaatgaaacctctctgatgagattttatggtttgtggggtgtgactccccaggtcccttagataggaatttgggcaagagaagtaaaaggtcagagttcagtcctcaaaaggaactgcagtatggaaacagcagctcaggatggagctggaactggcactcatgccccctgcctgtgtgtggaacaggccatgtgatctgaagcctgcttctcagcctacgagacaccctactgccattccagggactctgggagttatctctgctcttccctccatatccacactcagacatcccatcctttcagtaacctcccctgactccgcccccactagcagaacagagggctcgtccctccgattattcccaatctgccttgctgggtagaggtcctatttcttgtgtccctcctcaccaggcgggagagcccagatgccgggtgacagttgggacaactggcttttggctggacctgttttcaaagccatgtttggaatgtgtgcttttgttacaggaaaggggtcctgatccagatccaaagagagcattcttggatctcacgcaagacagaattcagggcaagtccataaagtaaagtgaaagcaagtttattaagaaagtaaaggaataaaagaatggctactccatagacagagcagccccaagggctgctggttgcccatttttatggttatttcttgaagatatgctaaacaacgggcggattattcatatctcccctttttagaccatatagggtaacttcctgatgttgctgtggcatctgtaaactgtcatggccctggtgggagtgtagcagtgaggacaaccagaggtcactctcatcgccatcttggttttgatgggtttgggccggcttctttactgcgacctatttcatcagcaaggtctttctgacctgtgtcttgtgccaacctcctatttcatcctgtgactcagaatcccttcactgtctggggatgcagcccagtgggtcccagcttcattttacccagcttctatttaagatggatttgctctggtttaaacgcctctgataccttgtcacccctccacccctctgaggtaccccaacagggatccacagacaaaatgactgggttgtggctggtttccagtgcttggccagtgacatccctcctgctagctgggaactggcacatttcccaatcagagattgcgaccaattcagctaaggccttacagatctgcctagagaaatctgtataatatgctttaatgtatttaaacgctcaaaatgggccccaagtgagcaggcatgcacatattcgcccaagagaaaatagcgttcttttctatttatgcaacagaaagttttacttaatctgagcaagaaagcaaatagcaatttctaaagctttaatttaaggaggcttctctattcagtcagctcataatttgtagtttttaagtcccctaaaatatcacctattctggatttgctgataattgagagttcattctgattttcctttatatgcaaatcttccatgagcaccaactaatgactttttaaaggtctctttgtggacattgcagagaaagtaagaatgtcaccaagtgtaattgttatgctgaataccactattcatgccatcgttaaaaggtccgtttaaagggggtgagagacaaaagctaagcttgactggatggaggagcctttccgtgccactgcggaacccctcgcaggggtgggtagtgagggtgagtaaattgttctgccctcccctgagttcccaggctccttgagtcgcacgtgctcttctagagactgatgggaacgctcagcttgcttcactctcagaccttctctccccgcccagcgcggacgggctccgggctaggagctcgcagagggacgggctgtgtcgcctcgcctctccctgcctctgtgtaggaattccccgccgctgaggtcaggagggcgggagtgacacaggagccgtggctgcctggactcctgggctgccccaggagccgaggacagccaggtggaggcggctacggctcggcccgaacccaccacggcctcccctgcagggacctgtgtccagcctccacggccctgcagctgcattcgcctcagcctctcgtgctgggatccctgggcccttctagattcccatcacgcagggtcaaaaatgcccccacccgtgcacgctcaccgtgagaaacccactcccatgccgtgcactgatcgcccggcgtgctgcccggactccagccctgctgcctcggcctttccattctgcaccgcagggaaggcccaggcgtcgcgcggccagcccctggggacaccttcaggctgctcgagagggttccagctgccaggtcaggagcagagcacagccaccgcgccctccaaggacaccaaggcacgtcccgctgtccccccagcgcgtggccagttccccgcgactctttaagcagttctgctggcggtggcccccacacctgcctgggcccacagctcacccaggtcgagggaccctcgtgtcagctccctgccacacctgtggtttgctttctccaaataggaaactgttggagaaatgttcctcttagtatgaaatcagctttccattttattgcctttcttaaaaatctgtaatttttactttgacagaatggaatataaatggctcagaagaagcttaaccatcaataaatgtggagttgaaaaatgcaatggacatattctctagaaaaactgcaaatattattgatattttcttgcttgcctgctttctgtattatattctcatgtacatcttgaattaatgttccaagtaataaagaagaaaggtaaagatggcaacgtaattatgaccaagttctgttcagagccctcgaagatcaatttactttttttgctcttaagtacagtactttaatatgagctttagtgagcatatttatattcattttgaggcggtcatacaatgaaattaaaaatcattctccattcagtgacttttaatttagattttgcataccaattacaactctgcctctgcccccgccccccaaaaaaccctacatttcatcttaagttcatttcttgaaagtatctttgtcacaaactaaaaaactaatgatacaatactggaatttaaaaaacaagatgtaattgggccataatgacaggattattgcctggtaattttcccactattttaagctttgtgtttgacctgcatgctagttggatatttatttgtgtacatcgggttttgaggagttcatagtttttctaacagaaatcactgaatgttacatatgtttgtatgagtctttatttattataaatatgataaacaatcacctaaccaaatgtcttagatgttgttctttctggaagcatattttgtccttccaaagtttcttacaagctgtgagtgtaggataatgatattcaaagagaatcagtaccttttctatttttttgatgaccaactaaaatttctagaagaatttctgttaggaccatagacaaccatggagtgaggagaaggagtgtgatgtcgggcctgtaaaaacctgcttaaaaaacaacccacacattcacctttcttcgtgtacctgctgagctagccactggcggtgtggaacatgaggccttcctgctctcaccgtaagcctggttgcgctgcctacacaaagactaatgcaccaggctacctccaaaagcattagagagcaatgtggtttttatgaaagtcttttttcggggggaatgccaaagagagaaccacataatacatccttcactgattcatttaaacaaaacaaaacaaaaaaagttgagtgcttactatgtgccagcgcagcaaagcttcctaaaaaatcctttaaaaacagacactatgcggccacacagtcattttcaatttaccaaatccctcaaagacttccccagagcctcgcccggtgaacctgaatcaatgtgtacagccacggaaggcctgaggggtgaaggaggttttcactaccgtcgggaaacaagcaggtctagaaaaggatgggaaccttgccacacatggacaccatcctgcaaactttatgttccttctaaccatatatccttaccttctactcctctctttaataacctgactctgaggtcagggtacagtttggaacagtaaaatccagcactgatggcagacttattgaggttgctaaatggcaaaaagagtgctgtttaggcttaatgctctctcttagctaatgaaacagtgaagaactgcaatccaatctcagattttccaccatcaacataaccctcctgcagaagagtaggaatgtcagcttcatcagtgctactaacatgctttgcatcctgggaagatcccaaggagagtctccctctctgggctacctccaaatactgtccatcaggtctctcctgaaatttctaagagtattttttttccaaatctttgctaggagctgcaatgtatatgatttttgctaaatctttgctaaggaccacgtgatgatatgtatatcttgcttataaacccaaccaaagcgcattagagaccatttgtcctgaagctacctaccaactagatttgcgagtccacccaaatgtgtatgacatatggtcagggaggatgatacatcacctgttgcatttcccatcatgaggactgcctaataggtctagtcttgttctaatcttaatagtcctgtgagatccaacagcaatgagctgaaagctagggtttgtttgtttgtttgttgtttgttttaatgtaggtattgttactaaatgtaaattccatgaaggcagggacttttgtcttttttttcactgctttatcaacagctcagcaattgttcttagcacttcctgagattaataaatatttgctgaatgggtggatggagggagagtgtattggttttctattgtcacaaatttagccgcttaggacaacacccacatattatctcacagttctgcagatcagaaatccagcagactcagctatgtaatatgattagaatctaataaggggatcaaagtgtcagttgccctgtgttccctgtagagcttctgaggaagaatccacttctaggctcatcccaggtgttgatagaaatcagttctaatggttgcaggactgaggtctccatttcctggctggttggcagcagtggggagctctcaactgctagaggcggcccacattccctggcccatgaccatctcatcttcaaagccagcaatggagggtttcctatcactcggcctccccttctgccgcatctcatctgccttccttttctgctttcaagggctcgtgtgattcccacccagataaagaagagtattgctcaagtagagtgttaactaatctaactttgttccactttttttttgttacaaggcatggaactatgtggaataatcccttgttttaaggtcagcagattagtaaccttaattctgtttgcaaagtcctttcacaacaataccttgattcatgtttgactgaataacaaggggacggaaatattggaggaacatctgtagaattgaggttttggaatgaagtcatcaaaaaattgatgcctggatgaccatgactgggagcttgaagtacatgttcaagaggatacaaaattaactgccaacatttagtgaaggtagcgcagctcgacactgtattatttttggaattgttattcttactttacagatgaaaaagctgagcattggatcaaatgacttgcccaaggtcacagggcaggaatgaaccaaagccagcacccaagaaataagcaggtcctccttccaaacctgagtggcaggtactctggaagtgtaaattggattgccagaaatagcatttctaaggtaattctgatcaaaagatttcttttatttaaggtactgaagtaaatggaagtttcattgatccgatttaacaactattatatgctggtagatcaaagtagctgttgctgatcttcacaaattcttatgcattatgaagcaaaaatgttttcatatcatcaatttctattgtggagtagtgttcaataatatcttgagaaaaactctaaacacagaaaactatcagcaagttcacctaattaaaaacatcaaacagaatcttctaactttgttccactttttgtgttagaaggcatgtaaccacatggtgtgcattcaatttttttttaatcccagccaaattccttctcagagttatggataaaatctgtgtatgtagctgtcttcgtccatttttgtgttgctataacagaatagctcagactgggtaatttatttttaaaaagaagtttatttggctcatgattctggaggcagggaagtccaagattgcacagaccatttgatgagggtcttgtgctgcttcaacttcaagttgaaaaggatgtaggcaggtgcaaagagaccagagtctctgtgggtctcatggggaaaaatagtaactcgcatgtgattcatttgtacaaattttagtaagatatagagcaagcttacaccttactcttttaggcaatttaatttacacaatgttttcatttctaaatgtaatcctttggtaaaagaccatttgttttaggtgcaattgttcacaatctcttttgctaacaaatcacatagttctcccaacaattctcccaaatataataggtaaacacattaaaaattgctcttgccatgtatacttcaattaccttgccaaattgatatttcaagttaaacacggttgtatattatacagagaagagtgttctcctagtcttaacaataactcattgaacaagtactcttatactatttatgaagtaattcaaaataaggcactaatctacatttactagtacattatggagaagtacttctatgaccctattcctgaaaatcagcctacattttcttagaaatttctacctacttttactagaaatttattgcactagtaagtttttcttgatttcccatattaaaaaaaaataattcattgcaaataaaacctttcctgagtaataatcacttggcatgtaaatgattttagtattaatataattctctctaaataaataacttccaggcccaatgcataatgtaccaagcacacctattaaaatgatagttttgtaatgtgagaatttccattataaaaacctgcgagacacaatctagcacatttaaagaatgatcacttttagattgtaactggaagataaattctaattactatttaatttcttggttgaacatctttggcatgtacaacataaaattgactctgaaattatgcagttaatattatcagcacttagctattccatttgaagctgcaaaggtttaatttgcttggctcaaagaaatattcaaccagaaaaaaaactgcttaaagtttgggaaatttaaaaagtggctatcgatatagttaactaatctataataagctatgttcagtgaaatggctcaacattgggtcattgaaaaaaatggtacattctttagaaagtatgctatttgaggtgttctagaccaggaagataaacatgtttttagaattctattatcaaagctatgggttaatatccaacattgtgacgtgatcctgtgactttagtcaaatcagtcatggaaagttagaaatctcctcccttaaacattgatgcattcttagaattgcttcttgcctaaactatgtttttcaaaaatgtaaatctcagagagttgttcttccagtcacattgctggagtagagatttataatttttaaaatttttaatgagattattgacttgttaatttgtagattattgacttattaatttgtttcaagttcttttgtgttaactgtcttaaaaatggctaacagttatttagtgctttttataggctagattctggattaagctgttttcatgaatcatctcatttaatcctcacaaacccaggaggaagaaagtatccttcctctaatttaacagatgagaaaatgaatgcagagagataaagtaattttcaaactgtcaatcagttagtaaaagggaacttataggattattcaaatggaaagagagataaaaagtgataacttgtacagttttctccatccataaatactgagtgcttcaactgcacctaatggggtatttaattacactgttatagacaaatcattcagctatattggtttaatcttccagtgtttaaactagcagtaataaactaataacattcctaaacttccagtttcttccaaagttatttttattcatgttactaaattaaaaaaagtagtgttcaatactaattatttactgtgatctgttttttaaaacatctgagtggcattattcttggatgaaaagtaaatccaaattcagcctttatgtaatagtatgacatttttacttttggagtttataacagagtttaataaatgtataacatgagcaataatcaagatttttattgcatatgtttattaaagctcacttatagctagttaatagagtatgcgtagattttgctgagttaataaatccaatgcaaagtaccacttgtacatgatgatgtagatagcttcactataggtatcctgaagcatggagttcttcatgcacaatagtttgtcctttgtgtgaaaagataatttgctgaccatttgtgcacggaagtcctcatcatcagcaggacttaacttgagatgattcaagccaattgcaagaaatgctctttagaaagaagaatttacaagacttgctcattaaactatgtaaattaattgtaacttgaaaagaggaaaaaaggctctagtttcacttttttaagtttggggaagatgagttgcaaataatgatcaagaagaaagtcattctgtctaaattagggcatggtggatcttcagcttgaatgtttatcttgagagaatgagaaagagaaacagagagagggagagaaatagataaaggaaaaagaaggtcagtgaatatgatgaaaagcacaagggcattttagtaggtagagagattaaaacctaaaaccatgagggttctttcatattttttaaaatctaatagaaatatgatgagaaagagaaagatgttgaagatatacagaaagaatatcaagtagagccattgatcttaactataaatataaggcagagatgcattgaaaataaaggccacaaactgcaaatgaatgaaaacacttagtatgtcacaaacatgacaaacaaaaagctcctggaatttttcagactgagatggccttatttcattggtggtggatcccagttgagtgtcaaccctcaacgagtgggcagagacccctgcctgaatctcctgagtcacacggcgcacactgcatcccattaggactgatactgttttgcaacagcttaactaatacaatttcaatatttaaccaaaatctgctttcctgtaacgttcccactgggggcttcatttggctgtctggaccgggcctctctgcttcatgagtttccatagatttcttggtgaatattcttctcgtgcatcctgttctttgatgtattgattttcaacaatacatcaaaatcaggtacaaggcagaccttttctttgttggattccaaatgtacaaggactcaatcttgattacatcctaatgctgacgtttctagacaatatttatttgctgttctttgtttccctttgtttctcttgctctataaatttctccaaaatcctaacatgttgtttgaaatttggttgtttcttcttatgcaagtttgcatttcaagttattttatagcctagatatataggaatcctgctttcctccgaatgtgtaaaaattaataactgttaatagtcctctgctatctaagttttaggtttgacataagggaggtggtttgaggctgaagccgtctgatgtggtttggctttgtgtccctacccaaatctcatgtcaaattgtaatcacccatgttggaggaggggccaggtgggaggtgattggatcactggggtagatttccttctttctgttctcatgatgatgagtgagctctcacgagttctggttgtttaaaaatctgtagaaccacccactttgctctcttcctcctgctccaaccgtgtagaaagtgtctgcttgcccttcgccttctaccattgtaagtttcctgaggcctccccagccatgcttcctgcacagcctgcagaaccgtgagccaattatacctcttctctttcccttttttttttttttttttttttttgacggtgttgctctgttgcccaggctggaacgcagtggtgcagtctcctcacactgcagcctctgcctcccaggttcaagcaatctcaggcctcagtccctgagtagctgggaccacaggcatgtgccaccacacccagctaattttttttttgtctttttagtagacacagggttttgccatgttggtctcgaactcctggcctcaagtgatccacccacctcaacctctcaaagtgctgggattataggcgtgagccactgtgcctggctgaacctcttttccttacaaattacgcagtcttgggtagttcttcatattaagttgttgcgccaacctatagcaatgtgagaacagactaataacactgtccatacaaatacaggaaatgtagatctcttgtacatttggaatccaacaaagaaaaggtctgccttgtacctgatctttatgtattcatcaaaatcaatacatcaaagaacaggatgcacaagaataatattcaccaagaaacctacaaaagcccataaagtcgcttgtttcttcaggataaaactttagatcactgttttggcatgaaagcaaagtatcaccttggcagaagactgtgtcaaccctccagtaggcatgctgacatcttgattgttttctgctcttttgcttctcatcattttattggacagggtatagcccagctagctggattcagtgtcatatttcatattggcaaagaaaacttgtgattgaaagtaaggtttctctaccagacaacttttacaaagaatccaatggtgtactctttcaataatttatttcccttgctccccaaaagtcaatcatttaccaatcttattacttgttcatttgcaactgtgtacccaccccactgttgccagctgcccctactatgctgtaacagtgagttcagagcatcactatcacacgttgtctatgatagcaaattcttctttgttctccatgcagcaaaaattacatctgttgtctcatctcgatttgaaaaacctctcagcaattctaggaacaggtagccaccagtccaaaagaatgctggacaaaattgtagtagtagtttgtggttttcctttcttccttttgaaatatttctatctttataatctcttaacattatctgagtcctatctaaggcattttagtaagtagagcattttagtaggaaagagaaaaatcaacttcctaagcacctcctcccctcaatgctttgaagtctcagcacatatgctcatgggacaaatgacacttttgtaaaagaagaaacagaaaacctgccaattgactgaatattgggaataaacaagcagggatttccactttttaaagaattcttcactttgttaagaatttacatgatgactctttctgtggtactatagagcctcctccacagtgaaattgagaaggagattgggacttgatatgcaaactcaagtatataactggttcattagagagaaatgaatgataaatatcagtttcatggagatggcaggaaaatcacaagatagagcttgaccactgagatttctagagcttgaccactgagatttctagagcttggccactgagatttctagtgtggagatactatatgctggtagcaattgtacaaagatacatttatggatagaaatccaggggaaagaagaggtagttcatcttcacagattccaactgagaaagggcagaggaaaacatggcaatgtctcctgaaggctgctaggccactgtttcactttgtgcagattcatgacgccagtctgggaagagttcgcttcctggtacctggtacagatggggttatcccacctcttctgacacacatgccatagaaaaaaccattcattcatctatttcattatttttactgaatattttatatgtgccaaccactgtgctaagcagcaaatatagaatagtgcatgtaaattaataaaagcacaaatatatataattacactcactggagttcaaagtgccagtgacaataatgatggtgatagcagccaacagtcactctgcatcccctccacatgagacactgtgctaagtgcctttatctgcagtatctgaacaaacttcaggccaggcaggagagcacagctcaatttgcttcgttcttgtctgagactcccagtggtcacattgctgtcttcaccacagagccccttgtagagccaaaataccatggtgagggagggtggatacaaaacattcacattgcacaccttcaccttcctctagcagcccctgggctgtcaccgtggcagcactttgatgctcagcccctcagacctgttgtgttggcaggaaaccagctaactgaagcagagtaaatgaagcaaacaccgcctcttgaaagggccatggtatggctgatgaggagacccaggatcagttactgctgtcttcatagcttgcatgaccacaggccagtcattcagtccgtctgtgtgtttcttcatctagcaagtaggaaggagaaacactcacatgtcttcaaatccacatgtgtcaaatccaaatatgctcttccctcttcctgctggacattctgtgatgcagattctccttccgcttcttacatctgtttttctttccttcaacctcagtgcatgttgtcatttatagtcaagcaattcattcctatttcttctcaccacccactttgtgcagagccttttacgctagaacctgcccaagaacaggaagacctgggttccattgcagataaccccagggttccttccctcccacactgtagttaatcccaattgcctggcaccaactcatacctgagctgtggaatcaataatttctggattttatgatccccttgtaaacgctggcaaaatcaatgagatttccataccagagggtggggaacaatgaagtagatgctattgataattagttcttttacagaaatgcaaggtaagtacagggtgtttatgccacttttatgcataatgaggcatttatacaaacaacatccacacagctagttgaactgcctggagcaaaataatattcaaccttcaaatttaataactgcataaacttagaactgataggatgctttctgctctggttttgaagtgcctaattaagtacattcaaggaggttattttgttttgttttgcttttagccccctccctttgaaacccacttgtggtcagtgttagagagctgatggttttcttaatgtgtcattgttatagaacatgcctgtgattctgtattcttcagtgtaatacctgtgtttctgtgaaataatctgtgagatttcatgctaagcattgctcttgtcttttctatttttattctaagtatattaactgatttccttggagggacgtgcttgcaagcttgggtgtatcttggtttatctaataaacatgctcctggcacatattgtgtaaatctaattttaacaaattgaatcatatatttaaatgcctgaggggcactcattttaagaaattaatcatattctgaattttcagggaatttttacacccaaattttattttctgataatctaggttttcacttgatttgctttatttaggtgacactgtaccaaattattaaattcattgaggaatttttaaaagcaaggcattgagggaaaggattctgggaagatggtagagtaaaaagcaccaggcatctgcctccctacctagacaacaattgcattgacagaatctgtctgatggaactttttttgaagtctggcatctattctaaggattgaaacattcacagaaaggcttagaaggtaaattgtggttaatttcagtcatataagctggtagcaaagtggcagctacccatcccccagtcctatggcagggagctgtgcacctgttcctagagtagcttgcacacagcttgtgggagccagtgcaggtgaaaaggaccctttcctccaaaacttggggacctgtgttctgattgctgcttctgaatgtggagctgcaaacacagagggggcaactattgctgtatccctccctcatttgttgcaagcccctccccctctggttgaagcaatttccagggaacttatatggccagtaaccccctttttctttttttctccttccccctcatttttctcctttgcttcttttggaaaccaggcatttaaaagcaatcacatgtgcaaaggcaactagaaagtcactatgcatgcccaaggaaaggcacaggcctaaagaagacctgagaagaccttaggtttacacctcaggctggtcaacagcacagatacaacagagaacaatttttttaaaagaaaaacctggggaagggggtagtctgatttccagagttactatgtcattagatcaaatatccagttttcaacaaaaatcacaaggcatacaaagaaacaggaaagtattgtccattcaaagtaaaaaataaatcaatggaaactgtccctaagaaacaacagatagtagacattgctagacaaaggctttaaaaacaactatcttaaagatactcaaagaactaaaagaacatggggaggaagtcaagaaaacaatgtatgaacaaaatgaagataccaataaaaaaatttaaaaagtctaaaaagaaaccagcttcacaactggaactaaaaaggacggtaactgagagaaaaaatttatcaggatacaaaagcatgttagagtggacagaaacatcatctgtgaatttaaagataacacaataaattacagaatctgaggaatagaaagaaaaagcatttctcttttgaaaaagtggacaaagagtgagggacctgtggaacatcataaagtggaccagcatgttcattgtgggattctagggagaagagagagagaaagcggtagagaagttattcaaagaaataatggctgaaaactttctaaatatgatgaaagccatgaatgtaaacatccaagaagttcaacaaactctaagtaggatgaactcaaagagaaccacactgagacatattataatcaaaccatcaaaagacaagcaatcttgaaagcagtgagagaaaaaggactcatcacgtatacagaatactccaaagattaacaactgacttctcattagaaactatggaggccagaagacaatgggctaatgtatttagcaaggaaaaacaaaacaaacaaacaaaaaaaattgtcaaccaagaacccaatatccagcaaaactgtatatcaaaagcaaaggggaaattgagacattcccaggtaagcaaaagccaagggagtttgctactgctacacccaccctgcagaaaacactaaaaggaggccacagattgaaatgactagaaattagcttgaagccatatgtagaaataaaggtctcggtaaaggtaaatacatgagcaattatagaaactagtattgtttcactttggtgtgtaactccacattttgttttctacattatttaacctattaatgcataaaaaatacaagttcatgtttttggacatacatacagtgtattaagacgtaattttgtaatatcgataactgatcccaacactttgggaggccgaggtgggcagattatttgaggccaggagtttgagaccagcctggccaatatggcaaaaccctgtctctactaaaaatataaaaactagttgggcatggtggtgcgcccctgtaatcccagctacttgggtggctgaggcacaagaattgcttgaacccaggaggtggaggtttcagtgagtcgagattgtgccactgcacttcagcctgggtgagagaactgagactctgtctcaaaaacaacaacaacaacaaaacctgaaaagggtgagggtgctgttgcataggagcattttttgtgtgtgttattgaagttaagttggtatcaattcaaattggagtcttataacattaggatattaaacgtaatccttagggtgaccacaaagaaaatagctatagaatatttacaaaaagaaatgagaagcaaattaattcactacacagataaagactaagaatgaagactgaattctaacatccatatatatatgcatgttattcagtcttgggaataaaggaaatcctatttggagtgtcatgaatgaacctggaggacattatactaagtaaaataagccagacacagaaagaaaaatattacatgatctcacttatatgatgaatctaaaataatcaaacttaaagaagcagagaatggaatggtggttcccaggggctgtggggtgggagaaatagggagatgttggctaaaaggtacaaaatttcagttataagatgaataaattctggagagctaatgtacagcatggtgaccacagttaattatactctattgcatactagaaatttcctgagagtagatatcaaatgttctcagcatcaaaaaaaaaaaaaaggtaataatgtgaggtgatggatatgctaattagcttgattatgataatcatttcacaatgtattcatatatcaaaacatcatgtgtacaacttaagtatatacaatttttatttgtcaattatatctcaacaaagctggaaataaaagaggaagcttctttaaagatgtgtctatgatttcccagtgacatggatcatttaggattgtaatcaaccattgaaactgttagttagccaactaaatctcttatatacaaatagaaaccttgaatctcataaaatcaatacttaatgaatacctactgcatgctgagttccagagacacatgaataaaggcgatgtaggctgtgaccttattatactgggctggattctgtggggtgggactgagtagaggggatgactcgctttatctgggggcatcggggaaggctttctaggggaccagtctggatcttggaaaaagcagagagctactttatgctttaatctgcattaaaattgtccagtggtaaagcttgatatgctgtgtggatggtaaatgtttcttacttaatcagaaaagcatcctaagagtgatggattctaaattgatttttactgcagtggatgcatacaaaatgaatgaagggaattagtctatagttcccccacgcccctaccctaagagatagtttgtgtgaaagattatacatgagtgaggaaacaacagggccaaacctgaaggatgaaaactgattgacggacttgagttgaaaataaaaacaagcaggacgaggctgcgattgcaatgtgaagtcagcatgcatctactgtaatttattcaaatccaaccaggcccagagagcaggccaggcccccttctgtccactccaccttccacgctactcttgggtccacactctggagagaccatgagatcaaacataagaatcctgcattcctctgtcagtttcagctcttcacctgcctctgaagtgtagtaattacgtcatggccctccagtgcaaccacgccctaacagaagcgagccacttcagctgctgcatctattccaatgctggaagaaaagctattcatgcctatgggcatttggggcctataggaccttaatccctgcttgccctcccaagctgagatatagttacacttctagaggacagggaaacttcctgaggggtgtattagtgcattctcacacagttgtaaggaaatacctgagactgtgtaatttataaagaaacaaggtttgatgagctcatggttctgcaggctgtacaggaagcatagcggcttctgctcctgggcttctgcctcaggaaacttacaatcgtggcaaaaggcgaaggagaagcaggcccgtcttacatggttggagcaggagcgagattagggagcagatactacgcactattaaatgaccagatctcagatgaactcatacactatcgtgaggacagtactgagggggaaatccgcagccatgatccaatcacctcccaccaggccccacctccaacactggggaccacaattcgacgtgatatttgggcagggaaataggtccaaactgtatcaaatgggggggatgtgtctgggtggaagtgagtcttttatatatttggagtgattgagagagtcagaacaacagtgtgtgcagagcgctcttggttgtagagaccagcgacagcagtccaggtatgacggaaatgaaaatgttagccatggcttagcaaaggtcttttgaaagaaacgagtgtagatgtttgctcatggcactatttctagggcttaggtcaggggctcaagggccattctcaagggtttgcaccaggataatggagaggaggaaaaagcctgagaagttggcaccttaaaatcagcaagactgaagagttcattaagtatgggctgcagagaagaagatgattcaaaaatgactgagaagcttgggtgttaggatggtgatgccgttttcagcactggagaacacaggagacgcaggtggtgcattgagtcctggacgtggtgagtcggaggtgctgcagggatccccagacgagcactcacagaagcaagttggaagggcaggctctccatgcctgtcccgtggccagcatcatttctccactccctgtcaccctcggaggaagagtttcatccaaaagctgggtgagcatgcccaggtacagctaggaaagtggaaaatcagaaagccaggagaggaaaatcagaagttgaataaaaggaggatgaattcagggaacactcatcccacactgtctagcgttacccttcagggtccctgcaaaccatctaggaaagagcatcacagtggaactcccagtcacacttgtgaatgtggaacccttcttggtgccagcaacaagtacagaattactgagtggcccctgtgctgtggcttcagctcactgctcaagggcaggggccacctagagactgaggccgcctggctccagccactggggaggtttcctaccccagcactaaggaggctggtggtgagggctcccaggaaatcagaaaggtcatgaaaggagtggaggttttgagattgcaaaagaaaatttctggccaggtccagtagctcatgcctgtaatcccagcactttgggaggccaaggtaggtggatcacttgagatcaggagttggagaccagcctggccaacatggtgaaaccccatctctactaaaaatacaaaatgagctgggcttggtggtgggaacctgtaatcccagctactcaggaggctgtggcaggagaattgcttgaacctgggaggcggaggtggcagtgagccgagattgcaccactgcactccagactgggtgacaagaacgagactctgtctcaaaaaaaaaaaaaaaaagtttctaatgaaaaagggaggcaaggtcactatgtggagattagataatcaaactctgaaactgttcagctgggtagaagaaagcaagatcatggatgtgacaatgtgttgatgttcatgcttgttgtcttacctaatgtacaggcagagaattgacaacatggctgttcttaaaattaggttgaggtttaagagaactaagcctgtaagagtgatgaaggctgacttaagcattccgtcttaactgggacatagaaaacctcgagtctgctattgactctgtcagtaattcattatgtggcattatatatatagtctctgtgcattaggggagaaaccgaggtgaaaacaggaattatttcctcagagcacactgactgccaaggtgtttatacactgcacaaggaagaggaaaataatacttgccacctacctacccattaggggtgacgtctggagagaggcattcaattttcggatgaacgggtttatgaatagcagcgtatcacctgcttctgatctgtcttatttttgcatcaattcacctcctgagtgatagtggcaatggtgccacttgtcctttgagtcactgattccatgtctcctcacccagggcatgtggaagggaaggtttgagagaagtgaggccccattctttaaggtgtgatagaacattactaattaaacacaaaaaaatattttttaagcaaagttactgcatggctaatgtattttatttatagatccccgtttctgggtcctttaaaggaaaactgttattcatgttaggctgatcctaccttacctatgtcacttgctaacttagtaaagaactctttttaaaaattcagagagtgtcatatttattttccatacatcttgtcatttactatatatgtttgtaaacaaatatgttccatttcttaggagacatctggtttctaactggtttgacttaataaggtaacagaagttccatgttcaatctgccttcaagggttgcattctcttagtgatttaatgcttcaaatagtgtttcattcaagggcagattctgattctctatttctctcctctcacctcctctttccttctcagacatgtgggaagtgacccttgcatagagactcggaaaaactctgaaaacagaacacataaagctttaggatattttcaatgacccattcctgttctttcctttacttgaaaaagttcagaaagtccaggtctaggtcacattctaagagagctcacccagagtggactctgcttaaccaaagccttcaaggggctctttcaggcatgagcaggaaaatacatccacaagagtccccgctgcatgcagatcccagggccatctgctgtgctctcagagatgctcattgttgtcatttaactgcgagggccacagaggggacaactgcagattcctgctctacagctagactcctggggcccaatacaggccacagctcttcgcagccatgagatatgcgagcacgctgcctaactcatctgtaccaccatgttctcgtctgtgaaacttgggtattaacagtacttacctcatgggtttgtttcaaggattgagtcaatattagcaaagcattcaggacaccacctggcacccagtgagtgtgacgtaaatagtaaagaaattggcttttcctggcacgatgatcaagtgattggtgcccagcagctctaagcaaactgtctttgaagggagagaagaagccccagcagagattgttcagaacagctcaacgtcatgcaggagttgctcagctacacccatctcgggatgatggagactccaagtgttacgtattttgcaagcttcataaatctgaccagatatagacaggagattgtaacctgtgctttttgtttatgaatcttgtattgagttgttgaagatggttaggacaatttaatgttgcataaaaaccacttcttgtaacatcttaatagtgagaataggagggtcaaggcaagaaaagtgctgagaaaacaatccccccaaaaagtttctctcttaatttcaacatcattttatgtatttttgttgttgttgttgttggtttgttttatagctttaaatgttaggattacattttggggcttattattcaaatcaaatatctggcaccattcattttctgcttccacatttgaaagaccaaatgttcatcatttctggtgtcggttcagcctctggcctcctttctaagacacattttgtagagtattagttttcccattcatagcacgagaaaaataatacattccttttttataatagaaatgtgatttgaggttgcttacagagtaggtagaggtttagggggaaaggctgtgttttgtgtggctctaggatgaattatatgaaataagataagagggaaagctatagtgggtcacttgaatactgacctagtattcaactgtttttgaaaagaagttctgctctgctgtaactcctgctggccttccagaagcatcagctgtgtcacaccacaagtcttaaaggatctcccttgtttccactgcacatctgcccccatgaataaactaagtgggcaacatggtcatggttatgtgttcttagctactctgtcctcagtgtgtgaaatgcccacctttaggggcgctgttggggtgaggcattttagctcccaaaggatcctattagagtttgaaggccctgagaccagacagccacactgcacagaggggcagcctggacccacgggacatgagatgagttaatccacagttagccaagaggttaccgcagaggtagatattcacttattcaaaatttaagtgcctactatgtgcaaggcagaaatctgcgtctactttctcctcatcagcaaaagtagttctacttttgtttttggtttttctttttaagaaaaaaaaaatactgtggacttctgtataatactcattttagccaaagaattctgcaactgaagagtttgagtcagtctccatggcatccctggatgagttctggtcatgaaggagctcaaatgatccttgtcagccgggggaataagctagacccaggccctcccatgcctggcctcattcctttttcaagggaacaatgccatacctcactagaccctagctatacattcctccagccaaatgccaggaagcatctgaccatgagactttaagagcaaaatgttgcttaaagaaaaaaatgggagctgttctaaattcaagagctaatagatatactcttccattttctatggtcaaagtcataacataacaacatcactacaaatttaagaaatagctacagttaattcagtagatattgtagtgaatgaatgcctgaaatatggtttgagggtcacatatttaacctcatcaaacctcaatttattcatcaaaaaatagaagtgatcattattttgttgtgaagaacaaatattataaaggaccttataaaccataaagcattatacatagtttatccttctcttttccattccttaagcaggactgtcagtgcaattgccttatattttagtgctatggagtacccttatctttttgctaaatattacaaatccttttgcttacaaattagtctgtcacttctattcgatggattatctgtctacctcggggcttctgtgatgcacagagtcatgggctcactctctttggctcatcttgtaggtttgcaatcactcttacaactgtcacttccagccgatccaggactgctgcggcctctctgctctgaaatacacctagtatgtgaatttcacatcacttctcagtcataaaacagacccatcagaagctcattttcctaagtttattttaaatttatagagcattcatttcatccttctcggtaatcttttttttttttttttttttgagacagagtctccgtctgtcacccaagctggagtgcagtggcacgatctcagctcactgcaagctccgcctcctgggttcacaccattctgcctcagcctcccgagtagctgggaccacaggtacccgccaccatgcctggctaattttttgtatttttagtagacacggggtttcaccatgttagccaggatggtctcaatctcctaaccttgtgatctgcctgcctcggcctcccaaagtgctgggattacaggtgtgagccaccacgcctggccggtgatctttttctctttctcttttttcttttcacttgctgctattctatacatgcggaggagtttttggaaggaaaagagggcgccttattaatggtcattttctactaatggtgattttgatactattagatacctactatgggcattgaaattggtctctagttccattgagaagagtagaaaaatttctagtataagtacattcataatgtttagataatatcttgagaaaaaaatagacaaattcacaagttcttctttgacttgatagatttctgagttctcatgtgtttgtccatcttcattctgctttaacgcatttacacacacacacacacacttccttttctatttgttcagctttactgagatgtaattgtgctatagttggtttgtgtgacccctccgaatcgcttgttgaaatttgatccccactgttagaggtggagcctaccgggcggtgtttgggtggtacaggcagatccctcgcgaatggcttggtgccctgcccatggtaatgggtgagttctcaccctgctgttcccacaagagctgtttgtttaaaaaagcctggcacctccccctcgctctctcgcttcctctcttgccacatgatcccttcgcaacagctccccttcgacttccactgtgaccagatgcagccccagaagtagacactggtgccacgcttcctgtgtagcctgcagaatcggaagacaaaaaacccctttccttcataaattacccaaccccaggtattattttatagcaacacaagtggactaagacaaattggtatatgaaaaccacacataattaatgtgtacaatttggtgagtttggaggtatacatacatttatgttaccatcaccacaacaaggagacagacacatccatcatctccagaagtttccttttgcgtgtctgtgtgagggaagaaaacttaacataagactactgatacagctccgaagactggagaaacaccagggtcctttgtctcatgccaatgctattaacgacaaggacacccgtggagtggttttaaggagcggagagtttaacaggcaagaaacaagaaagaagaaaacagctccccggtacagaaggagctgggctcctaacggagaaaaaccccgtgtgcccaggaaaaacagttgtttatacctggaggctggaggaggcggtgtctgatttgcttagggcccaggggattggcttgaccaggtgtgtcattcacatagccaacctggtcctcccaccctagccttttaatatgcaaatgcgggtcggcatgatgtcctgcacacgtggtgttatttggaggcagccatgacagctgtggtgacaaggagaagagggcgggaaccgccatgtcgggtggacctggtttttagctgctggcatttacatatcaatgttgccagcctggtttttcaagctgctttctgttagaaaggaaatggtttggggggtcgctttttattataggaaaattccaccaagaactctcaccctttctagctgcctaaaaattatttcttaataactcctatattactaccctcctaacagaattttaagtgcacaataccttatcgttaactctaggcaccgtgttgtacaggagatctctggaacttatcttgtgtaactgtaatttgataatccattgaacagcaactctgcatatgccccctctccatccgctagtaaccagcgttctattgtctacttctgtacatctgactatttttagatgctccatataagaggaatcactcagtatttcttcttctctgactatttcacctagcataatgtcttccagatctgtccgtgttgtcacaaatggtagtatttccttctttttaaagccaggatagtattctactatatgcatataccacatttcattcatcagtggacaattgggttgcttgcacatcttggccactgtgaaggatgctgcagggaacatgggagtgcagatgtttcttcgagatcacaatttcagttcttttgggtatatacccagcagtaagattgcctgcttatatggtattctattttaattttttgaggaacctccatgctgctttccatagtggcagcagtatgtattctttggagaaatgtctattcaagtcctttgcatgttgtaattgtgttttttgggagttttcactagtgagttgtaggagctctttgtatatttcagaaattaactccttatcacatacatggtttgcaaatatgttctcccattgcataggtggcctttccactctgttgattgtttcctttgctgtgcagaaattgatgctgggggaaaaaggggatttgaagtataggccaacttcagaacaatttgaccaggacttgctaagtttttttttaaattaggaaaatacatagaatgtgacttaaaaaaataatcaattacctaagaccttgtctactgggtcttaagttgaatttctaaattctggagccaactatgtgaccttgggcacgtgaacaaaagttaattctataaactagtttaaatcctgtaggaatataacattattttattttattttatttttcttaagaactttttggaaaagaggctgaggaggttaggaaagagcctctgattttatgaagaaatgtccagcatttccccaggaatgggattccacacaagaacaccagctggagcagtgccgtagagtcaaaggaaggaagaggctgcagttcggcaccagtggggaagccaagggcatcttgcatgctggcaccttcgagaggccgtacagctggagggtgcactttgcattgccccatgtaggctctgtaattaatatggctgtaaattttgaaaaactgttattctggcagtcaaaaataatcccctatatataggcatcatgtaaacttttaaaacgtctttcacatccttcaaaatgtataatctcatgaattacagtctcatgaaaatatagcaaataaatatttggaattataagagaggaaaaaataaagaagtgaaaaggatttgccctactccaaacaaagcaatgcaattgtgcaacggaaggataagtcataagaaaacagtagagcgttcagaaaaaactccaagagtgtatgtgggaatgtagaaattcaataaaggtgatattttaaatcagcaaggaaagactagattatttattaaatgaaattgagttaattgattctccatttagaagaaaataaagtcaggaggtatgtctcatagcagtctccagatacttttaaggatgtttaaagatttaggtgtaaaaatattaaatctataaaagtactagaagaaaatataattttgttaaataatttcagagtgaggaagccattttcaaccacagaacaggttctaggaagtataaggaaaagattgatgggtctgactatataatataaacttaaaactcacatacagtgaaaaaactcaatatagagctgcacagcaaacggcaaattggaacaacataatctcaacacatgcaacagtaaaggcttaatgcccagacctatgaaagacccctaaatagctataagaaaaagacacacaactcaatagaaacagcaattcagaaaagaagcatagtcaaaaacaatgaagaaatgagctacctcattaacagtaaattcaaaccgctatgaaatataacctccagtttttatgaaattccaaggaaatggacattcttgttaacagttgatgagaaggcaaataagcatgatgtttttgaaagataattagctttcttttaatactaagtgtgtataccattcaacccctaaactctactcctaggaaactatcccacaagaaataacaacacagatgtcaaaatagtaagaatttctgaattttctgaaatagtaaatatttctgtgcagcattttaatcaaatgatacatatgttctgccttaggaaaaaggagcacagtttattgtaacataaaacatgcacatatacatacaaacacttacacattgcagatcaaaatgagctgtctacatttatctgacagatggtctgtgtgtctgtacgtgtgtatatacatacaaaaacacttacgtatatcctagtaacagcataggaaaaagattggacgaacaggcacctaactgtgatgattctttgggggtcaggggattgctgggatgataaatttttatttcaaacaaagtatgccaaatgacgctttcatttataagataccaaaatacaatggcgttcaatttcactcagtagcatatgcaaagaattgtctcattaacctctgaatcaggcctttcaccttttgctggaatggctgaccttgagaccaaacactagaaccacccatggaacacctgttgaatacattaatccccctagatgagccttcccacttctgttcatttcacagaactaatttctatggcattttatttttacacaacattgaaaccaagattgtctttggtatttatgagggcatttacaaaaggaacagagcaaatgcggttgagacaggtcacaataattctctctgtctctctgacacccagtgtttcaagcttcaccttccttttacacatactcaattaaattaaaatacaacgtgcaaagaaagcaatggcgaaagaatctgaaagggcactgcagaggtgaaaatcaaataacctcatataaacctttcctattaagagtgaatatatttagatttttaaaaataaaaacccagaataattatgaaagcaaaatgccacagacccagatagacagggaaagaaaataaaggtgctgtaaatccacaaggcccatggtgttcacatttcttcttgttttgctcagctctgagctgctggcaggtgttgacccgaaggggagtctatccaggcacccaggtagcactgctggccaggtcagatgccactggagggagggtggaaacacaggtcaagtgctcttgagcccctccccatctctcaccccagctcttcatcgctaagtagctgggaactgactacgtagcatcaattacacacgtacaactctgaggagttgtcagactttagccctaatagtgccttcagtttttttatgagactatgtaaatgaatgccaacagggtcaatgaagtggcaagtgccatttctaacatttaacaaaagtggcgtcatttccagagctctgcccagctctgactctttctcctggagggtgcaaaaagaaaaacagaaacttttctcgaaggcatcatatttcagacaagtattgtttcaattatgacattttgtcaaattgtgaagtttaaaggacaaattgcctcggcctattcctgcttaagccttttcatgccacttatggaaaatagcctgtgcttttaatgggtattttgtcagttaatattgccatggagagagaacaagctgtagcttccttctgctgagacttgaagccccatgaaggacagacttgtctgttttgtccactgcttgtctctaggtctgccgcacaagtgtgtccttcacattcactattgttaaataagaatcttcaggtcgccttataactgcacaccctcaattggattaattcttattagtttccccttcctgggctatagaattaggttagtcatgacactgaagttgcaaaatgcttgacatagaaaagtgtgtatgctctctgtcatatatgaagaagtctttatctttacatttacagaaatagtttatcgtaaagtcttgtcatttgagtctcaccatgtcatcaggacacaatgtgccataacttccacacatgcttgtagctcagagtgcacagtttagcctgatgacagcctgctgattatttataaattaacagatccagtggaaatattatatcttttgtttggcagaaatatatattttaatatgtctcacttgtttttgtaatccatctcataacatgaactttagaatatgtactatgtatttttaaaggtatttctttgttccttgattgtggtttattatttttcaaacagcttcaaaatttccaatttccagaagatttttaaatttaaagtgtaattgttttaaaataccaaaattggtgagattattgaagaagatgattctctctactcaggaaagccacttaaaattggatgaaattgaggaagtacagcaaaagcttaattctcaggatattaatctaggctttctttggaacaagaagcagggctgagaaattgccctcagttgtaaatggaaaatgagtttaagcatcctcctaaagaatcataatttagttctagtcagaagtagctgagcaggagaaaacttgattacttaaaggcactaagtatattaggaaacgaaatacaaataccttcaaccagggccgctgctgcagtctggctgtgtaaggtctggtattctgatggaaactgataggctccattagagatgtctatcatgtagaaaatgaatttaggatgcctttgtcatttctcttgtctgtaggctgagcttttttaaaaattgagctatattcatgcaagttatataacttaatttactgctgaaatggaagctaaagtggttagtgcagtgatactcagcctcagaggctttaaaacactggcagattgttcacacagaattgtgcctgatttgcctgatgcatgccattaggatgatcatggacaagatctcagactgtcatttagccaaaactgtgtacatattatgcatagaacaactcacccaaaattgatagctaatgggaaagtttccaactaaataaagatttggaatccatttaccgctcagtaagctatttttgctccatatcatcaagtttccagaagtaactgctccttacatatattctaaagaacgtataataaaaaagcccagtgacaaaatttgatttgatatatatctcatccatctgttttttttggtagaaacctaggtggtatgtgttaaatgttaagtataagagaattctcaatattttaaaaataactcaaaatattgaggaaaacacctaaaacccattgatgattgtggtagctcaggctctaacagtttcttaaaatgtgtccatgtacacactgggttagaatcactgttctcatttacaagtagagcttcctaggccccacgattctcattcattccttaaatgagaatgggggggaagttggggaagggtctggaatttgcatttaaacaatttgagcgcgatttgaacatgcattcaaattccagaacccctgctttgatattatgtcaatgattttggaggcagatttagtcccgtcacaggacattgtcgttttttaggtgcccaggtttcttgtgacttcatccatgagatggcatgtacagtacctgagtacctgccactgggcaaaaagatgaccaggtgagagacgaaggaatgagactgcagccctcaccatcagggcacaaacaccccagtctcacattccgtcaagagtcgttctattacttacatgtcatccactctagacagtgcctacatttcaatgttgagcgtgttccttgttttcttatgattagaggtgacacagtactctgtgtccagtggccgcccaggtttttgaggtaagcaaacactgtcctcctgatcagcagcctccatcttcctactgatcacagggcagcgtggcagtggttaggagcacggactccacctctttccgactgtacatccttggccaaggtatccaacctcacactcagtttccttcctacctcacactcagtttcctccctcagtttcctcatctacatcataagggtaacagtagttttggctgtgaggattaaatgggtttatatttacagaatgcttaaaacagtgcttggcaaattataagagcttatttggaaaaataacaagattagaaggggtggatcattccagaaaattaaggaatcaaagagaaagatggagagattaacaccaatctggcaaaggaagccttccaaagaaaagtgtacctcatgtgtctcttatggttcctggggacatagtgggacaaaagaagtaaaaggagaaatggcaaaggcaaaataagcattgtcttagataaggaatgagggaacaatgaagaaaacagggctgcatagtcacttatataaccacaaagccgcttagtcctatgtgtgccttgactatgtgtatcccactggaatgaaggtggctgcactgagcacctttgggggtggaggatgctgaacaatgttagcaaactgcattggatgtcacacccagcttccctgtgtctgtccggagaaccctcctttctcctggtcttctatgcccaacgtctggctatttcactttattttttctcctcccttggccttaagtcaggaactaatttttccccactttgcccttcctatgtcattattctttcctttctttcctactttcttttctggtaccctattttgaatgtgtgtcacctttaacttcaggtacatgaacaagctcttagccagtctttggaagcatctgaccacagcacctccaccacttttctgtgcaaaacccttcaatgaccctgcacaataatgtcaagactttatcagtgattttcaaagatttttcccactttgggcacaacgtgcccttctagcatcatctcccactactgggcctctcccccatacctaatcctcctcctacaagccctgctcttgccaggctcagcaagcaggtccatggactgagagcacctttgcacttagcgggtcctttgcctggggttgtgtctgatctggcccaggagcagttagggaaacgttactgggccagaagcactgcaggtgggtgtactgagttgaaaagtctccccgcaagatccatgtccttcccagaatctcagagtgtgaccttctttggaaataggattgtgtaattagttaagataaggtcctactggagtcgagtgtgtcctaattccaatacaactggtgtcctcttaagaagagaaggtacagtcggccgggcgcagtggctcaagcctgtaatcccagcactttgggaggccgaggcgggtggatcacgaggtcaggagatcgagaccatcctggctaacagggtgaaaccccgtctctactaaaaaatacaaaaaattatccgggcgtggtggcgggcgcctgtagtcccagctactcgggaggctgaggcgggaggatggcgtgaacccgggaggcgtagcttgcagtgagcccagatcacgccactgcactcactccagcctgggcgacagagcgagactctgtctcaaacaaaaaaaaaaaaaaaaaaaaaagaagaagagaagttacagtcacacacagagggaagatgacatgaagacagtcacacacagggaagaatgccccgtgaagatggacgcagagagggggccgatgcagcttcaagccaagaaatgctaaggattgctggcaactaccagaatttggagaggcgcataaaacaaattcttctcttaaagccgtcagaaagggtggccctgttgagcccttgattttacactatgagacacttgtttttagtcaccaggtttgtggtatgttttaagtcaccaggtttgtggtacgttacaacagctgtaagaaactaacatggcagctgttgaatgttaagagccctcagctgtgaatcggagcgatcctacctccctcaccaccgaagagtgttgcagggatcaaacgggctaagacgtgagcgtgctattagatgtgtaaaattctacacaagggtcgttaaactttgacttattttttgaaaaccctcccattcccttgcataacccctaccacaatactttacccataaaatgcgttcaataggcacgtgttgaatgttttcatttattcatttactatatcacattaattttattttaaaagacccaaacttagtcataagtaacatggctcatcttcaaactactgcgtagccatttgtgtgcagctttgactgcatgtggtgttatttcagaaagatgtgatttggtttgtctagctgaatgtaagtaatacattcattataatactagcttactatatattaattttaatatgctcatgaagttaaatatctgtggatctgaaaataagatttattttatttaagatgaaaaaatttgttttgacaagattggctggttttatttatgccacttactagaaatctaataaatacatattttatttaacatgactttttaatagcattcctttgaatttactcatcagtaaatttaatcaatcacctttttaagaaacagaacaaacttgctagtcctagcaccataagatgatctcttgcaaggaagtaaagaagaatccaaacttgagtgccaggaatcattattgataaggtgaaggagaacaagtttcccttttgattcccaacttctacttgaaatatgacacccagaatgtgattctttctatatccatttcctctaagaatctttgagcaatttgtgcgtgccctgtggttaatacagcctagtcatagcccagtgaagctgtcggcagtcctgcttagagcagaaacacagaccatgacagttacaagcatgtgatccacagagccaggaaaagaccctgagacataacccacttctgtacctcctcagtaggagctatactcaactcatgaattaattttgagctcttaatggcacttattaaatccagaagaaaaatacctaaataattcttacttatatttaatagcaatttagattcctgcaagtggggacaaaagctttatttcacttccaaatggacttcaaataacatcaattggatgtgcactagaaaaatataattttaaaaggtgttcccaagaattagtaaagaagaaaagtcatgggaattagggagagtaatttctaggaaatttttattggctgcttttgtccacatgatatttacagtgtatgagttaggttaagctagactataccaaagtaacagaatatactaccaaatttcagtggcttaagaatcagtaagttgatttatttttcaggttaataggccagtattggtcaggtgcagatgacttgggagaagaaggatttgctccatgcagttgtagggacatgtggcctcatgattctagtcacaaggttgatgttgtggaggaggttttaataggccaggtctggaaggagtatgtatcacttatacttcttccattggctagaactcagtcacatgaccacacctcactgcgcaggaatctgggaaatgtagttcatcaaacactcaagaataagtggaactgaattttaatcaataactacaagtctctgcatcaaggagaaatgtgtacctgatgtttatcatggaagagaagaataattagttgactttttgtgtataatccccaagcaaaagaagtctgattcatgctaaatcttcctaaaacagaagtagatcatttgtggggaatatgttattagaacacccctagagaggagcctattacccaacttcattttccagcttcattctcttggcaggagacgtatttctctttctgcctgtccacggagtctgtgccacaagcaaagagatgctgtatgtcttgcctataaagcagggctgggctgcgaagctgtcgagcccggtgcaaaatggaaatgtggagctcttgattcaaaagcaggaaagcaatgttacaaactaaaatataaagcttttatctttcttccccagtctctcaatttgccatagtgttttttacttgctatttagctgcattctaagaaaaattaaacatttaaatattggcatgaattttaccgttcatcttaatattgtgcaattccaattttaaacgtaaacatttaaaacagggtctaactcatacgtgcaatcactgaaactaactacacaatttgaatttcgtaacttatatatgtgcatatacactttgttcttgcaagaacagcagacatgtcgcataaaaccaattcacttgtttttatttcacttcttgagactcgcacattctaccaacattctaccttcagtttactgatgaataaggaagaatggaaagggaaagaactatggggtcccctatctttcccttccgttccatgtcatcatttcctgcttcagttgctggctccaacaagaaaagcacaggagtaagaaaggatatgatagggttcattggtcactatgtttcttagaatgccattgccttctttctgcattcaaagcaagttctggttcaaacgaaaagtttggcgtctcggggctgtaagtacccctgcttactcagtaggagatgtcacacatttaccttgacccctgcacactgtgggttcaccaaaattctgtctccaatgggcgttgaagagacttaagccacgcatagagcccttctaagtgcagggcctcaagcaacttcatgttctgtactatactaaagttctatactaaaagacacatatttagaggaaggataccacagaccaacactgatgtctacagcagcaagaactgtaggacatgccgtcaattttgtaatggcttttaaggggaaaaaaatactctattaatgtacatcttaattggaaggtgcatccaaatttcagaaaaatgtaaaataacagggggaaagcttcaattcctggaattgtagcacatcacattcttttccctaatacctacctaacaactactactactaatggactaatatatgtttttaaatatttcaaacatccagaaaaacattgagactgatctatgaatccctgtgtacctaccaatcaactttatcaaatctcaacagtttttccacatttgcttcacaagattcttaaggggaaaaaaacatttcgaataacaccgacaccacctgtggacccctcctgtacttatttgacctctcctccctactctgaggtgatgagtttcctgaaatcattctttatcattcacacgcatacttttttactctcagtatatatatctgtaactagaaacaatacatttttcacgttgtgaatttgataaagaacagtataataatactgtacatatcattcttcaacacgctttcttatgcatcattattactttgagatctgtatttctacatgtgattctagttaagtcattttttttttttttttaattttagacagagtctcgttctgttgcctgggctggagtacagtggcacaatctcggctcactgcagcctccacctcctcggttcaagcgattctcctgcctcagcctcccaagtagctgggactacaggcacacgccaccatgcctggctaatttttgtatttttagtagagacggggtttcaccatattggccaggctgatcttgagctcctgacctcgtgatccacctgccttggtgtcccaaagtgctgggattccaggcatgagccacagcacccagccttagttaagtcattttaataactaactagtgtaattgcataaatataccccaatttatccatttatttgattgtcattttaaatgtttctcctttctctttattataaacaatgattcgggaaatcttcttccgcatttctcttagtatatgtgagctggagtgattttaaggtaaatacctagaagtagaaatgctgggctgaaagttatgtgcatcatatctttaccttttctacatgtggccaaatggctctccgatctacaagcccagaggcagtgtgtgaggtgcatcgctcgacaagccggctgacgcttgtaaatgcccaacatctgaatccttgttaaacacagaagtgcaagatgtatctttaaatttgcatttttcccaatgactagtgaagttgagcatcttttcttgtattaatcaagtttcttttctaaaaattgcctatttcaatgctttgttcatttttttctgggttatgtatctactttttatcaatttgtggtattttattcattatgaatactactgtttggtcatatgtgtttgcagactttagtttttgtgcctatttattcggtcttttacaaaaataagattctaagtttaatgtcattagattcatcaaaatcctctctttgtgatttcggatttttgtaccttgattaagacaaccctccattccctgacatagtagtgtcattgtcccaatctcaattattgacagcatcaccctaactccctgctctgcctctctctgatgtgaagtttccctttgtgcatgtgttttctgcttttcttgttttacccactgcaggtatacagtccctccatctccttcgaaattatctggtctgttcttaaacctttgtgtttctatttgaatttgaagatcaacttgtcaagatccattttaaaaatcttgctggaattattttttggaattgcttagatttacagattagtttatgggaaatttccacgtttaagagattgaattttcccttcagaaacaaagtgcatatctccattaatttagaattttttatacttcattcatgtttttaaattttttccataaagatttgcacagctttcgttagtttcagggttcattttttgaaaacactttgctgtttactacagtccttagatttcctctgtaacataatctcttaaatttattcatagttataacggaaactgttgtactacaccttgattttttgccaatttagggattactgaatgaactaatgcaaaatccattttatgccaatctatacacttggttttgaataatttattcaactaaatactttctaaagagaatcatatgcgatgaataaaaatatcttgaatagattggaaatgttcctgttttgttttcattgtaaatgcatactaaatgcgttaacaacatagaaagattctgggttctagtagattcctcaaatataaacactttggatgcaccactgtttcaaaagatgaatagtttaaacggaactcctatttacagccatgtttgcaaatgcattttttactttaactattctgagatataaaaataagcacagagattttgtgatagctttgcaactagcagtatttttgaaacatgaaataggcgttttgtctggagaagccttatctatcacagtccatgtctgaaatcacagttgtttaatgaactctgttttatggaagctgccgatgcctcattcgtaagtctccccattctttccaatgtcacacagactttggagatgaatttaaatttcatcattatccatgacctacaatgtgtgcattgaccatactagattttccctttttgaatatattcccaacactgcaactccctgccctgctttattgttcgcttgccagtcctcggcatcgttttattcctccggcattttaaacaaaataaagatccaggcttatgctgaggcagtgctgaacaaacccaccaaaatcctcagaactccatccattcaaagaggagcgccaggatttcccaagcgacaagaacagggcgagctctccgatcctttctccatccccccaaacctcccctggctctcgagaacaccgtcagtactccctaataccccgtgctccaaatccggagctcggtctccacccggccgcactccaagtgacagcaataatagctggtgtttctaaagtgcttactggtaccaggggctgcatccgtgtagactcatttaatcctcacagccctaagagagacacgtttgacagatggagaaactgctccgggatactccgtcggggaatggcaggagctggccccacagcccggcctggcgccaccgcgcactgcctgggccctgcagcttggagcaggccctgagtgggctccctgcaaatattctcatgctcccttctcaccaccgccctgcaaggggcatggtactgagctcaccgttttacaggtgaggaagccacggctcagccttccgagtctcctctacctgagcctcagagcctggctcagaggctctgtgcccagaacgacagtacataagaaggagtgggggagcctgtcggagccgcctggggcattagcagatccaagttccaaatttggaaaacttaaatcgagttacaaacctgtcatcaatttgacagtaatgtttttataattacacattgtgatacttacctgcattataaagcaatttaaatgttgttttgtttaacacctcagcttggatctggacgtttttctaacttaagaaccagaacaacggtcacaaatgggctcctgaagaatgtttcagaatgctctgttcacaaccatgggggcgtatctgccacctctgcccccaaatggacaatccgtcagtgtgataacccatcttctagaatggtaattaactcgagaagaggcagtccccaacctttttggcaccagggaccagtttcatggaggacaatttttccagtgaacaggggagaaggtggtttcaggatgaaactgctccacctcagatcattaagcattagattctcataaggagcaagaaaccaagatccctcacatgcgcagttcacaatagggttcatgctcctctgaggatctgatgctgctgctgacctgacaggaggcggagctcaggcagtaatgtgtgctcgcccactgctcacctcctgctatgcagcctggttcctaacagaacgtggacctgtaccactctgtgacctgggggttggagaccctgcttggagatgttctcctttatccctacctgttcattgcaacactgaataaaaatttaactgaaatgttcattataattcacatgcattcaaatacttggttgtacttgggtaactgtcagagtttcctatattacctcactgctctagctttgtcttttgttccattccatacatcatttctagactagtcatccaaaatgagtgttagaacatgagtttagagtcatatagaccggccatatcctgactccatcctacactgcccatattagtttcctgtggctgctgtaacagatgaccacaaacttggtggcttgcagaatgtgttctctcacagttctgaaggccagaagctcaacatcagcttcactgggccgaaggcaagctgcgggcagagagaatccattcctggcctcccccagcttccactgctaccagcattgcttggcttgtggccacaccacgcaagtccctgcctcgtcttcacattgcctcccgctcttctgtgcactgtgtccaaatccccctctgcttccctctcataaggacactgtgattgaatgtaaggcccatctgggtaagccaggatcctctcctaggatccttaacttaatcacatttgcaaagacccttatcctaataaggtacatttataggttctgggagttaggacctgacatctttctgaccatgggtcaacctgtgtgattgcagggaaattatttaatctgtctattttcagttgttttcactgtctaatgggtatctgtttcacagggttgcctgaggctcagaggagacagttgacataaagcacttactgcaatgcttggcaaaaaaaaagagaaagcttttaatcaataactatttgttttgtttctatataccaaaagttcagcatctctccattactttctgtcttaatcccttagtctattaggttggtgctaaagtaattgcaattgccaaagtaattgccgttaaaagtaattacaaaaactgcagttacttctgcccccacctaatagaaatccctatgtccatcatctagttccaacaattttcccaaccttgtcttttactattttctttgtagactttctagtctaactagatgcgtttgctaaggagtccctcaactgaatgttcttgcttctcccctttgtgtctttattctttgttgctcctgcctgtgaaagttgactccttcctctttgcctatccaagtactgtcccttctgccaggacgagccccattctcatcctctccttgaagctttccccagtcaacccagcccaggctggtctctccccttgaggatgatcagctgctctccatgatgctgcctcgctcttaccatgatggctctatacacgtagaccaagctgcatatagacatttacatgctatgtacgaagcacgcagcaatgatggataaaccattgcgacagagaaccccaggaagtcagacctgggctcagagactaaattaacatcttagatccctaggccagaaacagagtaggcagtgagggggcctgaagcctcaggcctcctgagatctcagttgaaaagcagtccgtggtggctgagagcctggcctccatggggtagagaggatgagagtctccctgtggggtggagtaccaggccaggcctgctgctcagaggcagaggccagagtggagtctttcactaaaaatgaaaatagaaataaaataaaaatctgctgccaatgccatctgctgctggactggaggctctaggagttgagtgcagacagccacaaaactactagctgggaaagagagagcaacaattgagaaggagtgaaagaaatggggaaaaacccttttccttctaaaataagtctgcaaataaaaaatttcataacccatgaagaatttccatgctaaaaaaaggcagcccacacaataaaaatttagaacacatgttcattctgttattaaaataaattcctataacagcatgagaggtcccgaaatcatgctagatatccaaagaaataaataggataagttcataaaagtaaaaataaattattttttgaaaaggatagaaatcttgaaacaagagcagacgaatctgaagaagaacaaatgataaattgggttaaataaaataagaagctgcccagggaggatggaggttaacggcatcatgatgggagagacgaatgagctgaaagctgctcttcgaattggaagtgtatttccaattgagaaagattaaatatgtaaattgtatcctaagcacagtgtgataaaactgaaaaacattaaagacaacaagaaaatatttaggccaccaaagagaaaaggcagacgccacaaagacccactggatcgtcagtggaattatcagcagcccgagacacaaggcagtgggttgatatctcgagtgctgagaaaaaacaaaagcaactacctagaattttacacacagttaagatatcacccaagagggaaggtaaaataaagacaatttccgacatacaaagatgaaaagagttcgccaactctacttaactctaagtaaaattacagccgaagtgagtacattagtaagaagaacaaacccacagctaagactgagataccagaaataatggcaagtcccaaaattgataaaatgtcagtaagacttatgaactataggatttttgtaatgtatgtgttttttttttttttaaagccaaactaacactccagacaacaatggcaggatgtcagaggagttttcagtcgtcagccaaagctttgttttatctggaagaaagttaaaaatatttaatcactatggaatttccatacctaaaaccatgctaaaagatttaaagaaaaaaaatgaaaaatccatattaagctaaagaaacataaggagtaatagtaagatcagattaaaaaaaagcattaatggagaaaagaggggcatcgtaggataagaagaagcaaaatccaccaaaatgacgtaaaaatcatgatcctgtattatcctaacaatatagcagaaacatgtaaagtaaaagctaacaaagtgataagaaaactggacaaatccacaaagtaaaggatcataactctaacagatcaaataaaaaattattgaggatatggatgattttttagtaagaaaattaacaggtgagttttgacatatagagaattctgcacccagtagcgatagtcctttgtatgctcctagaacatttacaaaattgaccatgaagaagattaaaatttcaacaaatttaaataatttatattatttaaatgatattctctagcaactaaaaaaggtacaactaaaagtatagtgtttgaaatgaatttataattcataagctaaagcactggatgaaaataaatgtagaccattcaatttaagaattagaaagtgagcaacaaggtaaatgcaacaaaaccagaaataaacaaaagagcaaacattcatgaaatagatgtcaaggaaatggtaaagaggatctgcaaaacaaaaccaggttctttgaaatagcaaataaaatacacgtttcaccaagaatgagcacaagaaaaaagtcacaagtaaacagtaactcattcataaatcaatgcaaatgaatttggaattcagttgaaagaaataatttactagaaacatataaattaccaaaaaatagaaacccaaaataagccaataaacattaaaaaaatgaataagtaatcaaaagcttccccaccaaaaagaagtcacatacccagttcattttacaatcaattttttctaagtatttaaatatcatttctttctctcaaactattccagagaactgaaaaagaagaatcgaagaagaaggtaggataacttatgtgagcaaaagacagaaaatatatgaacatagttgtaaaaatcctaagtaacatgttgtcatatttaaaaaatcctaatagatcaggatgaagtaggactgtccttggaatggacgtgatcactgtgttcccagagccttgctatgtggtttgagaagggcactgcaccctgtgatattctctccataaaacataaccccaacttcatgatgagaaactcatcagacaaacccaactgaagaaattctacaaaataccaggccagtatttctcaaaactctgaagatcatgaaaaataaagaccaagaatccgtcctagaacagaggagactctggagacctgagaactaaatgcagggctgtatcctggtggaatcctgaaacagaaagaagacagcggtggaaacgctggcgaaatccaaatgctatctgaagcttagttaaaaggaatatgttaacgttgatttcttagctttgacaaatacaagatttaatacaagatattaacattggagaaactgggtgagggatgcagagagctctctgtactatctttgcaactcttagtgttagtaaatctaatactattccataataaaaagtttataaaaaaataaaaagttcataaaaaaataaaaataaaacacctcaacagctactcatgatggaaactcttagcaaaccacaaagggaaaggtgtctcagcttgatgatggtgtccaccatggcttcgtggtttccaacgcataagtagaggttttatttcacacgttgtagtgaggattaaatgaaacaatatgtatgcgatgtcttatgaattaatattattattcctgtgatcccagagcaacaacatcagaagtcggcttgttgctttagcgcagagttcttggccttctttatgccatgcagcacttggacagcccaggaaggccttcagaccacttctcagaatgtctgccaatgcataacacacaattcatgtagttactctgtgtgtacatatacagttgttaaatcacaataatactttttttgatattgaactaaacttccattctaaggatagccctatttggtcaccatgtgtggctgagaaatcaacaggcctgggcgacgtcagcaaggaggtgaggcagagagaagaatccacgtccaatgccagggctgggtctcatgggtgggtgggaaactcagggcaaagagatcctgagaggggacggggaggaaagaccaagaggtcggtgtgggaacttgttgagtttgagttgaatgatgtttccaactggatatttttcataattgcgtaatcttttctgaaaagtagttttcaggccaggtgcggtggctcacatctctaatcctagcactttgggaggccgaggtgggtcctgaggtcaggagtttgagaccagcctggccaacacggtgaaaccccatatctactaaaaatacaaaaattagccaggtgtggtggtgcatgcctataatcccagctacatgggagtctggggcaggagaatagcttaaacctgggaggcagagattgcagtgaaccgagatcgcaccactgcacttcaacctgggagacagagtgagactccgtctcaaaacaaaaaaaaaaaaaaaagggaaaagtagtttttaaatcttttgactgaccatgcactcactccatcagtttaaaaaattatgcatgaaaagcaacacacatacacacacatacatacacacacacacacacacacacagttatattactgcaacaacgtgggttagtaatatgtaatgtatattacagtactaacgtttgcataatgaaaacacacgaataaaaattgtaaaggatgatgttaaaggtaatacaggccgggttcagtggctcatacctgtaatcccagcactttgggaggctgaggtgagtggatcacctgaggtcaggagttcgagaccagcctagccaacatggtgaaaccccatctctactaaaaatacaaaaattagttgggcatggtggcgcatgcctgtaatcccagctactcaggaggctgaggcatgagaatcacttgatcctgggagatggaggttgcagtgagccaagatcacgccactgcactccagcctgggcgacagagcgagactctctctcaaaagaaaaaaaaagtaagcacagatataagcatttttctctctgcatccctttgatttggtgagctccaggcagtaacatcaggtacagatgtaaagtctgaaaaaaacagaggagttgtgtctgcaaaggatcactttcacaatgaaagactagagcaggtagagagattggggacccctcccaccctcttttccccatcccctctgagccctgctgatgttgaaaggtagctgatgcctcatgcttcagctctgagctttactgctattgatgctacatctcagtgagttctggcttggagaccactggtcccacccaacccaccatgagagacgatttgtgaaaacagcccagagtctggagtctgaatgccttggtttgattctggtctctatccctttccagctaaatcttacatcttagacaaatcatttgatcactccaagccttggttttctcattcataaactggaggttgtatatttcttttcacagtgtaatgaggattaaatgagacaatgcaaatcaaagtgatttgtgagctagaatgccaggaactacaccagcatttgttgttactttttgtataatcaaacctagtcatgcagtgtacattttcctgtctacatcttccatcaactgtaaatacaatgggtcatattctgcctaggtccagaggtggcaataattctgcaatcattaggttaccttttcctatccacagcacttgttttcctgtcctatgcaaaacactggttttcaagctgggatgattttccctcccaggggatgtttggttgctcccagtgagggtggggatacagtactggcttcagcggataaaggctggccatgctgctgaacatcccacactacacaggacagcgccaccacaaaggacagaaagcgtcagtacctggagcggttaatccatcctctgaaccgactgggatgacgggcatggaagttttggttgttgatctttactcctcagttgaatcccattttctgttagaggttacttacctacattagcagaaggccctggcctggctttgggtgtgtctagggggcactgacgcctaccggagatgggagaggagaaggagacctgcagggtgagatgagaggcggtgaggagagagagctgctggctctgccttcacttacgaatgtaacctttctaacatgtattaagtctctggtggtgaaaacctcaaaattattgaatttcagttttgtataagtagcagtcacattttactgctttcccttcttctactgttctcttctcccttctgtttagttcttctgactcttttgaagttcaaaaagccttatgtaccagatcatcactcttccgttctccctcttcttctttcttttataaatctttgtgcatgacacacatttaatgaccaggagatgccgtcggtagccttgtgtccatttctggaatcccaagacttggctttcaccaccacttcctgaccacagcaagcagttaccaagggcaatggagatactttcattcctagccttggccacttaccctggtgccttctgttgattttcagaatcagaagtcaagttgatcatctgaattatgagttattcagtctaatggcaaggaaattaataagacaaagtcgtgaaactcccatctgtctccaagctatctacttgtggatgtttatcaagctaagaaacttgccatatgtgtaacatattgtctgaaggaaaagaaactctctacttttttctagaaaatcctgacattgtatgttgtgtttttgttccaccttattaaatggccttctcttcttgtcacaagtaaataaaatggcttcatcctgttcatctttctctgttagctttccataatagtaatatgaatggtttctgtttacatggggtgttcaacctcactcctcaaaggatctaataacatcttttaagttcaatctgttcttgtattttgccttacaaactaacatgtttttaaatgtcttttcagaaatgataaacttgaatttttctcatggtggcttttgtccaaacatctctaattgttttggagataatatcctattcattttcacaatattcctctgaaaatgtaggcaatattatgccaccttgcgcatggtcagaccacagcatgtgggagttgattaactctctttttgccatgcttctacattgctcatcccttttccattctgttagcacgtggatgctatcaattctcttctaatcatcctttgcagttagctgaataccccttatgaagtttatcagcctcaactcctgtgatagttccttgaggacatcttatcctccttcattagcttacagggtcagtctccttctctgattggtttaggaccatgtgctgaactctgcacatatgatccacacagttcaatgtatataattacaaaaatgtctaagacccaaattaaaggaagcaatatgagcattacaaatggatgcatcattgaacacacatatatttatttctcaaatatagaaaaatgaaaatgtagcattcttataggatgatagtaatatatttgttttcaatgtgcttttcttatttatttaatcctcatgaaatctgactatataagcagggttgccatgcccaacttaaagatgaatgaactgagactcagaggctgggttgccatcccagtgtctccaatcttgcaggaaatacagtatctcctaacaaattccagtgatcacatggcagttctttctattctgactataatattttctctgaagctctattcaccaatcttgccttcatgttcacctccctcatatctcactttcctaaaacccaccttttatcacatgtcttcccccaaatcaccaatagttagcaaatgttcctcagagggaaataaaaagtattgagcatgtgagttacagccttccataatatgggagttttgttcgcctagaccttcctcttgcacagcctttctttttgggcacactgggctgttcactatcccagccacgcttcacatctcccagccccggggaagatgctacccccttagcaatgcccctctagcacctttctttaccaaccagaatagaaatggactcacagagactcattcactgcctgtttcttcagcattttatgcccctttcaatcctccgtgctgcctcatacatttcttctacacagtagacatttggttaatactcattatctggttgataccactgaaaatatgaaattaggcaggaaactcactctgaggacaagacgatgtctactgtaatccacctgcagacgtgttagaaatttgcactaagtcacagatgcttatagtgtgtgtgttgagggcgggtattcttaccagatttttctttaatgctgcaaattggcagcctgagtgttttgagcatccatggccattagaggcagtctttcaaggggagttttcacgtcagtcatctctgtgccctcccactgtactgaaaacagtgtctggtatgtattatgcactgtaagaatatttttacatttttttcattgaataattcatttaaatttgatatacaaagggatccaatgcaaactttcattgaaaggcgtgatcctggagcctgttataatgtgtgcaggccacatctggccatcacgggcaggttcgcatctcacacagaaaacatttctagccagagagctgcatggaagcccaccacccttcccttgagaacacactgctttatgaaagaacaggacaatggcatctcaacatccatacattcctcttcagactcaagtagtggcatacccagtattccactgcaggataacactcagaatatggaaaatcggtcccagtgacacagcttttctctgcacagtagctagctcctctccagctctttcccatctgcctccaactttgcgtgtccatttctgcatgagatggagcatgcgagaacatacagcacacagaccctaagcagctcccaacactggaaataccttcctctctcctgaacgtgctctgtgcaattgcaatgagagattccagcgccactggtaacttacacttggtaccaacccataactggctgctgcacaactgaccggtgatccatgcacagtattctcgtggaagtgaatgagggttttgtgaaaaatctatggcggggggggggggggggggggtggaaaaatgtccctgacgtctgttgaaaacagtcaggccctgctggagggaattgtgtcactgtcgactggctctgttaggaggaaacagtttccaggccctgcagggccgtggctggcttccttccccttccttgaagctcctgccccggccctgccacctcccgcagaccgaaccctcgctgtcacctccccttctgcacagtccaggccggtcgggtgtcctcactccctccttctcctgcagagcttccggaggggacgcctcccgcgggcgctggccgcttcccaggccccggccctccccaggcctctctccccgaggctccagccggctcccccttccatcctccccagcgcactggcccgtctgccctcctcgctcaagtctccacccggtagatttaaaaagtgaaaagccaaggccacgtctatgtgcggcctcgccctccttccctgcgaaccctggagaacacggccttgtgatgaagcaaaccccagtctcctcgctttgcatgggcttttctatccaccgcgagctgaaacttctccctaaagcaaccgcgtctccagactcctgggcgctttcccttccgactccccgaccccgcgagcctccctgcaggccccttctcctccctcccccgggctgcgggtgctgcccgcacagcctccgccctctgggcgctcctatccttcgcactccagacccgcagccccaacccaacacctgtgagctccagaagctgtctcccccgaccccgggccagcctggagtccctgctgcggatcggatccccggtgcaggcctccctgccagcagcgcagatcctccttcccaccctgcgtttcctacctgggtcctgttgctcccgttggcttacggaaaggaaactcggtctcatttccatttctgtaggaaactcagagatgcctgggactcctcccgccctgggactccccactctccgtagttcacacaatttaaagttccccatttttaattttccctgcgggactgtctagctgtgcgttagttcaatccttctttcgatggttttctcactgggattcctgttgctagtcctctccctggccctcaacccgcaaaccggcgatgttcttcctgacgccggagtggcctctacctcgcaggctgtggaggtctgccacctgccaagtaacaccacgtgtttcttaacctgcgcctcagtttgatcatctatgcaaagggggagtgatcacatctagctaatacgagtgttgtgaggattcagtacgttatcataaatcatgccccaagggcatcccggagctaaacaaggctaggtaggagttagtgctgtcccacttgtcagatcccagcaggacacaccaggccgcccactggctggctctaatcctcctctacaggcttctgtccctctgggaccttaccttcctgctccctcgcctgtgctcacactggaccactccttgtcccttgaccatggggccgtctccatgccccaaggaagatgttctcttctctgtcaggaacatctccctcctgtcccccagccatgggagtttaaagtcaattcaataccaccttcttcagaaatccttccaggctcaagttcccccgcctcttaccctctaagaacaggaaaacccgtggaattatttgctccctctgtgctcctacccgtacccgggtcatgatttcagcccagcaattgtaacgatccattggcggttaccccgcttggtagtgactgctttgaccagtgaaatctggatccaacagtcttgagggtcactagaccactgaaaggcgagcagtaggtggcaaagaaatactggctaaatttaaatttttgaaattataaattttggaaatcatgacctagggtaatgttttctgtgctgggttttatctacattattattggtttggggtgtttgctctgcccgggaacttcaaaaaccagtttctgaccttcttttaaaagtaaatctcttacttaagattgaaatatattaaattcctttatttttgatgaggaaccataagtaaacaatggatggatttttaaaacttttacatctcaaagaagacatgaaaattgaaaaatacccactttgctttaacatgactgcaatttgataaacttttatttgcaaaagaatatacagaatctttattttaaagacttatttagtggagctgaaatctcaccattgtactccactagaatgaaacctttgttggcccggatcttggtttttgttgttgttgttgtttttaattccttgctctttagactgttgtttaaaatcttatgttttttaatgtgttaccaaggagaaaatgtgagagcaaattccacagtgtagactggaatgcctccccctgccctccccagcaacacacacttcacgatgtctgcatatgttcccgtcctcatcggcaggcttttgttccagtcctgagaaagacagcctcccactaaacaaataaggcctccaaagcatgtgtttttctttggtgttcctgcaaattagcacgaatctgtgctatgttgtatggaatttcagagagacattttattatttgtcctcgataggaaaatgtgcaaaatccatggtttgcttattccagatagaattatctcacttttctttaaatcagcatcagtaagcatgaattcagccacataaataactttacttttaaaatcatgaataaaagttgagtttacccgctaaaaagtatcctttgatccaaagaatatcaattatatagccttaattttttaacggaacttaaatattatcaaagctgtatgtctagaatgaagaatgaaatgaatcaatgtattagaaatttgcagatgtgttacataacaatcacttcctaacgaatgcttagaagatcctatttatacttttgagcccttagattctaccccaaatatgtcttcttaaatccactgtttttcttttctctttaatttcagtttgtttggtttaatgatagctactgaacataaatgccaaattacaatggcacttcccagctgtgtgcagaactttatattttaagtaccaatttgtgataaaagaatgcttccagctcaattctcatcagcattagaggttttagcaattgccaattatttttctaaattacctattttaattaagtaaaatattgtgaatttaagattatgaagtgttcaagcattatttcatctttaactaattagtgagaaaaaggaaattatattttgggacattaaatggctatttttagaataaaatgcttctatggtttcaatgccttaaattaacagaaaatgcacaaacttctctcgaaatcctgttacatctggggtctttgaagtacaccttgaactgatcatttgttctaatgtaacataaatttgtatattaattagagccaaaatgcccaagagattaagcttggtatctcccttgactaatttaacacatctagatccctcagcaacattttaaaaccacctgtttctattttgccttcatggaacaaagcctagaacataggaaggacctcaatgtataactattgatatgactgtcatccttagttcagttctgagatttccattcctaacttatcattgcatctacattctatttcttacaagagcacttcaagaaatatgtacagatgaaggaaaattggcaccaaaatctgcctgcctagcagcttacagcaatattggaaggcgttgaaagccattattaactgacattggcaaagtgattttgaaaaatcttcgttttatatgtcaatgcaggctatgatggtccctaaactgttgcttcaaggcagagatcacaaactttttctctaactgtgggtctcccagcattctccctcctgaacacggcctattaacggtagtgagctccggagggtaaaagggttagtcaacaattctgcttggctgcttcaggggagagccagtgttttgcagtctagtgaactaattatgcactcttgatgagatcattaaaggacaataaaggaaaatggaaacaattcacaatatgtatagacaaatttctatatcgaataatttttgtttgtatttaaatgttgggtagaaacttttctatcctgagtaatggttggttttaaaaaaagaaaatcttcagattgaaacttatcctttaagcataaaagtatagtcaggaatttttagtctttatgactaacacagatgataccgatagtttggtatctccgatctgatcaataaactctactcttacaatggagtggtgccctgtgagggaaggggtgggcactcctggatccccctgagcattttcagtgcttctgtttcattcatccaccttattctggaaattcaactggggagatttatattttagatatgtttttattaaaatgctcctttcaaaattgttttccaatttattcaacaggcaatattaggtaatatatttgaaaatacaaaaaatggtgaattttgtcattgattcctgtgtagtcacgtgaattcttggagtttctaaaaggggattttttttacattggtttacatcccatttcacgtgacaatttgaagcatccaaaatgatacaagcgaattggatggatgactcaattaaatacaatggaagtcaataaagatcaatgcaaagtagtgtcttgaacagcaataatcccataaatacaaactaagaaagaaaccaattaaatttagtgtgggaaaaagatgaagaggttttgataagtgagaacagtacaactcaaagaacagccaactattttgtgacatgtcaatactatcgctattgagtgtaaaatgcatgagtccgtctccctcaaaaccaccagctcctgctgcaatgtaaggctctgtggggtgaacagtctggaaagaagaaagcagtgattcccagcaatggtcagaatccaaaagctgagaggccctaagaggaagaacagcggtgattttgcaccagcgatcatatgtctctgcgggaagggcagcatttaagagtctgtggaaagagggttttaacatctcctttccccaggagggatgtcccagtctcagaactgggatccttctggcatcaggatgaccagaattggggtgcccttaacggccagccctggtgcagcctcctctgcggagctggacgtgcccccagggttgctcagccaaacagaaggatcgagaggcaacatgataggtgcctaggatgtggctataaaaggttcttgtgggcactgtgtgatccttcattggccagtgccactgcaggaatgatgaggaaaatggccagcagttgagatatttaggctggacattagctaaggggctgtcttggcagctccaggagatgggctgatagttcatcttaaagattacagacccttcctccttgcggcatagaatcctatgtgaggcagctttccagaggaatgctggcgtccccagtattaagacagacaaaaggactggaaagctacgggggagaaaaggaattaaataagccacactgatttgccagaaatccctccattctgtgcctagatgttgctcttgctcatgtgctatgtaggactgccagattcacaaagaaaaatacaggatacccagttaatttgaatttcagatgaacaagaaataatttttttaaatataagtatgtgtcatgaaatatttaagacatgcttatactaaaaatctttttgttatttatgtgaaatgtaaagttaactgagcatctgtgtttgatcaggcaactacaggaagaaccacatgcctcacacatacatggtctatgtcctctggccacctgcatgtgacatgctgaaactatcacatcaacaaaacaagcccaaagctcttatctctgaagcactgggagttaagttactaccttagaggagatgagcactttttaaaaattaaatgtggaaaaaaaaaaacgtggaacactcacaatgcaacatgacttatccttggcctccaaagccctcacacctagattattgaattaatttttcactagttcttcctactttccactttctccccatacctctcttctatacaaaactctcaaatcaactgctgcgaaggctgctttcctaacgtgactgggtcccctttgggcatccagtgaatgcccaaacaggcatgaaagacccttcccgagcccgctttccaaagatacgtatgcttcctctgcccttgaatggtaccccgggctaggaagttacagatgaggccagtgaagaggaggctcgtccctccatgaagctgggagggtcattccaactcaagggatcagggaacacttccagagggagatagcatttgagcttcgctttgaagaatgagtgaaatttaggtatgggacgctggggagagaaaagcctggctggtcttgggcaaaggccctggattaggaaggtcttgtgtgttctgagagcgagaggccctattggctaatggttagaggatgcccagattcaacaaactactgacctttttgtaatctctagaaactttttggagtgccatgtcataattaaggccatgcaacagggaaagttatctgcaacgattttaagcatcagaaactaagaagttcatttaaaatatttctgatctgtacctttaaaaattcattttcagtatcactataatccactcaactgactctaagtctcatgcccatttcagaagccctagctgagtctctatcctgtcccaaccccactccgactgcaggtaagattctaatggctgatctacctttgtgcccacgcacatcctcttgctttacttgctagccttctcagccgcctctagatctctgcacacaccgcgctgttcaggggcctttttatgtgctgttccctccgtctggaatgtcctttcccctcttttctccaaattcatccttcaggattcaagctaagaattgtctccttcaagaactcttccctgagccccgagacaggccgaggggcccttcgcagcgctctcctgaggaagccctcgccgccgtgtgcggaaagctgccttgggaaagtttctcccatctggccctgagctgccgcagtctcctctggctcttggctcctgcagcctcttctccatcagggctgtcagccagtctctgggcttcagccaccgcctttaagctcatgactccgaaatttcagtttgcctgagccacagacgtatatattgaattatctgttcctaaaagcctcaagatcactcccaactcaacatgtttaaagctaaactctcatcttccccaagcctgctgcttgtcctacatcgcttctccatccctgagcaccagaggagcctgggggccgttttagactcttcttcgcccttctcctgaaccagcaccccagcccagtgcgccacaggtcatatctgagcggtctccctacgaccgccacgccccatgactccctcctcttccactgctgctgcctgggttcccactgaggagctctctccttgggagccgtgcccctcccacttcagtcctccccaagacatttgtatttattttctattgctgccaaaacaaatttacagagttgggggcctaaaacagcagaaatttattatcttgcagctcaatagtgcagaagtccacataggtcatacaggactaaaatcgaggtatctacagaaccgtgtcccctcctggggctctgctggaaagcctgtttcctggccttttccagctttcactccttggctcgtgggcctcttcaaagacaacttcttcaaagccagcaacgttgcatctccctgaccgtttttcgtgtcatctctagctgtcatcttgtgcctcactctgccagtttaaggaccatcgtgattatacttgatccacccagattatccaaaaggatctccctatctcgaggtctttaatgtgagcatgtgtgcaaagtaccttttgtcatgtaatgcaacatagtcacatagtcacgggttccaggaattaggttacgttcatcttggcggtggtgggcagaatattctgcctaccacacagtggagtggtcttcctaaaacacatctcttctcctactgacaattactaactactacctgtggagtaaagtccaaacttcctatttgggcataatggtctccatcctccgtcccgcgtccagtagtgcctacattcaagaaaccactggcatttgctccgtagcagtgtgactgcctctgtgtctactagttctgctctttgaccttgagtggccttaccttccctcagctctcgtgatcattcccaagtcaccacctctgcaaagcctcccaggacccaccctccgaggtggaacggcacactccttctaggtgcttgctgtccctacaaccacatctctcatgtcacctctccctcttcattgcaccttgctggttaccagcagagctccctgtgaacaggaaacttgtctgtcctgttgctgcatccccagcaccaggcatagtgaattacaaatgttagttggatgggcagatgaacgcacattaggctgcagagctcgtgggctgctcctggggcccatgcttgctctcacactaatataagaacagttatccagccagctgaggatgtcaacagccacttctcagaatgaaaaaggacacgaaccaatgtttcactttactacaccactagtgaattaaacgaagccacaagcactcggcttggaagattctatcattccttatgttctattccccaccgtttgggccacttagtattttcttcagtgaacctttcttgagtgttcaataacactatgaaagttgtcattagaccaagaacaaatgaggtttagtttactccttagtagacaactaatgaacattaccaagctgacaggcttaactcttgacttttctattaggacctaaagaatccatagaaatgatctacggttcttggaaagaaatggaaaacaaaatatttgtgggttcatgtgtagacccttatggataacacctcttttattcctcaccaggaccatgtgaggtggtagcactgagagaatgggaaatgctcccaaattcttaggtacatgaagaaaacaagattggaccttcatctatgtgttttctgcttctgtagtaaaatgaggctgctgactgtattaagaattgtacctacagggagtggccaccttgattaatgtgtgggccgagaaagatattgagatgggcatgagtggagaattatagtaaaagcaatcccggtgatgaggaggagggactgatgggttttagtaactgcttgtgcatgcctggttgagctgaaccacgaaacctctttcacccatcattacttgcatcttaggatagggaatgagctgtttgagctgatgaacccttaaagatcaaagcttccatttttatgcaaatagccaagagcaataaaacctaggaaagaaaagtagggaacgtgaattacagtaggatgtgtgtcattaaaagttacagcaagccgggtagttattcagaagtaagctcccagcaaggacaacttttcaaatttgtgttttaaattatttttaaatgagaagaggtaatagcaaaatataaccctgagtttcatttgttctctaatacatcacagtgttaagatgatataaatatgcaatcttgaattagacattactaggaaataatattgcacactgacgtgccaggtacctcctcacactgcagcaggcacagggctttggtgctggaagctcttggaatctgacttaagtaccactctcaaactaaacatggcttctttagctttttttttgcaatggaattgcaaaacccattttgcagtccaggtattgatcgtgctgccatattatactgtggttctatgtaagaaaccacatccagatcctccctgaatagacctctatcatgttgcttggaggtagaacatgcctttaagaataagctgctttgaatgccatgagcacaggttttggagtgagagagctggttccagtcacagatctcctgcttccaggctgtgtgacctcaggcaacttagagaacttctctgaatccacattgtcactgcatactgttgttgtaagcgttacataatgtaaccttttgaaagaatttaaatgttatatctatctggcatttagctagagtttaaagagtttaaagtttcattttagctaagaataaatactgttatttattataatattaatctattatttatatatgttatataatatataatttattatatatttacattttagctaaaaataataaatgatttattataatataaaatttattgttatattagttcttatttttagctaaaatgaagtaaattcatgtgctgtaaaggaagagttattctacccttattataattgcatttatacaatttttaaaaactgatgctgaatctctagtggaaagagtactggactgagtcttgcattatgggttttagtcctgattctgtactcactaatttttttctaccttcctcagccactgtattcagtatttaatataatgagcgttctggtaagttctttacatacattatcttatttacttttacaaggtcaggggtgacattgacccaattacttgtcctttctaggttcttcttctgctttgataagggtgtcgagtgttctctcggtcatttcagcaatagtattctaaaggaatacctcccacaaattgttttctaattttacttcgaagaattccagagatgacagtcctagggtgttcatgacactggtagacaccttcccctccccttcggtggccccgatcctcattccgcctccacccccgtgacttcctctcctgcctccttccaggatggacaacccacgctcagccccactctctccttgccagccctgctccgacagaggctggctttccccatcaggtgttggttagcacttctctgtacttttaattatttttcattttgattattttcgctgtgtgttgggaatcactatgaggtagagagaaccatatcaaagacattactctgcatgggtctgtcctctgtcaagtccaagacatggattcattgtcatctcttatattttttggacacaagtttgatgaggtttcttaattttgacagttaatgcttccaagaaacttaataaagattctacagccattttagtaaccagggaactacagtggaaatatatctctgagtaataaaatccatcccctggaagctgtcaccaaagactcaataatcatgttcgccacccagcatcctttctggacctcaagctgtcttgtcaagtgtgcttaatatccaggatatttagtttaccacagagttaactcaagtatatttgtgttcatttccatgcaggattttgcaagtcaccaagacttaagataatggaggttttgacctctaggtgaacaattactttctttcttttcatgtactgaactcatgaaaatatattgatgaattaataaatggcataccttttataccaaattttaacaaaacaaccttaaaagaagcttgaattgctgcgtggacaatatggacatcatgataggaaagtaaggcattttagtaattaagttaaacagctattttgcccccataactcagttttccttccaattttccaaccccaattcagaattactgaacctgaaacttgctgagaagaataatatgtagtcagcttaatttccccccttgaatatgcttaagggaacaaaaccctctcttcttggaggaattcccaccatggtctctggtttttcctttccccctcagctaccatattaagcatttactctcttgggcattctgctaggcttcttgtaaatatcattttatttgctcacaagcactttatgtgaatatgaggcacctggagcccagagctactgcacgcccaaggtgacagttaggaagcggcaaagccaggatttaacctgtgtgttagaagtccatgctctcatctgttgcattagaaaatgtgctgctcttgacatccatcttccgggtcatgtaatcaacatcacgtatacttggctctctgttaccttttgcatttcaatacaatcccatagcttggagttcaaggtcctccaggatttcagtcttacctactgtctccactttgtcattactccagaggttgaatcttcatcaggaagcctaaggtttttatccccaccgagatgtgcctgccatatttgcattcttgataaaaaccttatttaggattattcattttcaaatcttcaagtgggtgaactgttgtttggtttgggtttggtttactgtgtaatgtgatgcctcgcagaacatgccatattagggcattttgatgtattcatttgttcaaagactggatgcattcctttgtactggcctgcacatatatgtaaccagttccttcttgatggacattaggttattttgaggatcttgctattgagaaccatatcataacttatattttgtacacgtgcgtatattttgtgcacttgtgtgtatatatctgaaaaatacagtcttaagaatagaatgtgcatgtttcatttcgaaagagatcaaccctgaccccctccaatcctccagaagttgaaaaggttgtcaaggtcctcattttcttaatttggtgttttacgtttgggtgtcctctgacatcggggttcaagtgagttcattccgtggctccgttgcactacccagcacccaatagcattactaaaagctgagtggacctctcaaaatccaggggctgcttgtcgagtatttagaaagggattgaaattgtaggcatgtgtttgttgtagccataaaagtatcttctcaaatgtatttgcatgaaattttaagtaagtctagatcttttgagtggaacagactgatacatacctgccagagaacagatactgaggagtcaaatacagctcattagaagacacacagaactgcatggggagaaaacacctgtcccacagccttgggtatggggcttgctggagcctccacatcctggactctgctggaggaaaaactgaaagtaacccgccagctgccagggcccactcccagcctggagagccaggacagccaggtctcggcaggtgctgacctacaaaaaggacggtcctgctaggtgaagtgtggtcagggagaggcagctgcaggtgatcttggaaatcaatgctcattaattatcaacgtggctagtaaagctctggtgggaccttggttctcaatcctggctgcacgttgaaatcacgcgggacgttttaaaagttctgatgccaatttctaatcccacttgttgtgcaataaccccaatccccctcaaatgcctccaaataatctgagtcacatgtgcttgacacaggcttttcagctttcatttcgtttctgccaatttcttcctctcctgctccatctgatgccacaagagaacagcctctggattggcaagtgcagactaccagagtggtaaatgcttgcccaagaaagaccccagttcacacggtcagagggtgattttctccacctttctagacctgcaaggattcaagtgtcacatctggagcttagctgggcaattttgcaagcttcccaggtggtacatgcagccaaggctgagaacaactgtggtagggctgcagccagggtgaggcccactgggtccagcccccagagctggcaagagctggccagccgtaaaggccccagcaaagcagggcatggtggtctctaactctgactatgaaactggtgatgaagacagagccagtccttctggttttcggtagcacagtagggttgtcaagggttgtcaagggcagcacagagccagggaggtggagctgctgtaggactcaccagagaccacacagcaaggcaaactccaaatcgatcagcctggctgctaatggaatcgtgtcctaaccaagtttcgttaggaaatgtgtgcaacttcgctgcagggcatggctccagctgggagggactgcaggaaatcaggacctgacccacctttttctttccaattaagtggatccagcctgtgtacaccaccggggatgtggctggcagctcccacctaggggttttcaactattgccacacctacttgctaattcagctgctttatcagctccacatggttttttttgttgttttttgttgttgttgttgttttcttttcgagacagagtctcactctgtcactcaggctggagtgcagtggcatgatctcggctcactgcagcctctgcctttagggttcaagcgattctcctgcctcagcctctccagtagctgggattacaggcaactgccaccacgcccgactaatttttgcatttttagtagaggcagggttttgccatgttggccaggctggtctcaaactccggacctcaggtgacgcgcctgcctcggcctcacaaagtgctgggattacaggcgtgagccaccgtacccggccttcagctccacttttgagctagatttaaatgccgaggattttattagtataaaaaataatattgtccatatttttgtatcatgttattcttgtatctgtgttattgtattttattaatttagaaatggtttatgagtcattcaaaaagtgttcagtagcatattaaatattgagattattaaggcaatttatacccaaatagatttagaccttcagtctgaatttcttttggtataataacttttattgtaaaatacaaaggttgataaataattgtgaagatacattttcaaagggaaaaagaatttgtaggcctgaattattattttaaatctataaataatatattttacagataaatagatattgcgatttgtttttaagctgtcatgaatcaaagaacagcctttctcagataagcagaaattgattaaaatagacatgatttcagatttttatttatattatttttctgttctcatgcctaatcatgaagttctacaaagttccacatttaaaaaaaaatgtttggcttaaaaaaaataagatgtaaaatatttgtttttgaaaacactgaggccatatcaggaagggtaattgggaggaaaaaattaggtcacaatgagtaacaaaatagtatttgtttctgttttcacttgctctgcaatagccataatctccctcaaattcctttcgatatctcagtcacatgtgttcatggcacagccttttcagcttccatttggtggctgccaatctcttcctcttctgctccatctaacaagagaatatcctctacgttggcctctaaactaagtccccagttcacactgccaaagtgtgaattttctcccaggtctggacaagactctgcctcaattcccatccagcctctatgtcagtccacactcagtgggcgctggggatggttattaagggacctcgggctcttccctcgcttgagttaagaagctgcataggagagagagtagagctaccttaagatctctttgaacctttcactcctccaggaacgatgcgggctggattgcaaaactatcagattaacagataatacagttctcaaattcattccacctctcagccactggcccgtttttggggccttagttcaagctgggcccccatcacacttgaattccaaacattgtgaactagataggccacatggtttagagacagaaacctagatttaaatcccagttagtagcgttagctgagtggccttaggcaagtacctgaaccattctgaggttcaggattctgactttatttcctggcagagctcctgtggtgatttggtaaagtcatgcatgctcagggtatgtatgtatgtacatgaaccaaagatgctggacaagggtttgcaatggtgacttttttttaacagaggttaaaaagccaaaagcatgtgttgagcctctcctaggtgccttacacgtatgttagggtctatgggggtttaaaaaaaaatactaacaccaggtccctatccccaagtgccaacactctaccaaggacacgcatgtggcaagtgctacatggtctcacatacagaatgcagacaaaagctttagaaaggtctgatgaagaaaagccctccagaggagtgacagtttctggagatgcacgttaagtgctgtctagggccaggaacagcatagcagaggcaccaaacagggaggccgcgctgcctgcgcaggaaacggtaaatggtttggtggagccagcgtggggcaggggctggtagggggcgctgaggacggcagaacggaaagggccctgggggagagaggtctgactacaacccaaagaacgcaccaaatctcagtgaggaaccgcggatggggagtgacatcactcatcccatcagccagtggatatttattggttgcctggaggaaccagtaccaagaatacacccataaaggggtcaaagccccacccctgtggagacccctgtctcagggggaaaaaggggaaatggccacaaacctccatccttgtgataagtgttgagatccgggtaagcacagcgcactagggtaacccaggggagaggcgctggcccagcgtggggtgagcaaggagggggctcaaattcaagccttcaagtcggttcaccctgtccaggcttcgggaagctaactggagggagggagcctggcagaaaggggaaagctgggaggagaaacatcactcagaggcctctgtgacggcccaggcgaggggaccagggaggcctcatttaggacagtgaagatgagaatggggcgacagggggagagaacgaatgaaagggcttcattgcatctaaggcaccattagccattctttaaaaacttccttcaatacagaattatttttaaaacgttatgattctaatataatacaatttctcttatttgaaatcttcactggtttgcccacaagcgccccgatttcatctaaatccgagtgtaatgaaagacagatgcattgtttggagtaacacagaagctccaattcctcggctgcagggcttggcgcggggtttctgggcagcgtcgcttgcgcccggcacatgtgaaagggttttgtgctcgtttcctctgcatctgccgagggcaacactgaatctgtcttctctccctgctctcctctttgactgttttgtttgttccatttgccctgctcaacaacaacaacaaaaaaatgtagattagaatcggccctttatttcaacagcagtgaaagaattattttgttaattggtatattgataccccaagaactgcttactgtgccaagttattaagaataagtagacgaggggcagattaaactttgaatcacctgttcctttgggcaaaatacataaaccaaattgactgcaaccaaatgtcatattatttacatggcgtgcacaatttattttctaaaaacgtgctcaacaaaagatttgaatttgctcttaagcgtctaatggatcccacttaatagtgaagctctgtcatgtgcccttctgtataattaaatcatatggaaaaatgtcacaaagcaaaataaaatgtatttatttcagccatatcttcccaaagcatgacatgaagtctgaaaaaagaatcactaagcatttttatgccatctgtgctggtaggggatatgtttaccaagtatgtcactgtaaaatattccattttgaattaagcatagtctacttattactatatagtgtctggctgaatgagtataaaattggacaaaattccatatctgacaaaatactttttatttgttattttgttgcaaacctagtccaccgtaatgtcctttactgaattccaagaaatccaaagaaagaatcatagattatatttgtgttaaaaatctgcatgcttttctatccaaataaagttcagatcatcttttccaacagttgaaattatagcttctcattagcagaatatgtctcactgtgacaacttggatgatgatgctattgggtctgttaatctctattgcaaaaggagggctaaaatgtctgcacaatcaaaaaagctgttgttccagtttgctggtaaaacacaaagttatatccattatgatttctacctaccagacagaagaaaccttaagcttatagtttgccattattatgattaaattttatgaatacttatagaatttttatttcctatatgcgataagccctctttgtagtttgttaatgagatgtaaaaattctgtaaatttttcggagggcagtttgatcgcctccagaaagcatcagagggtcgcagcttaatcactgattcattaagtaaccctgatctatgctatatccttcagggttctttgccaagttgatatatcatggcattgttttgagactcatgtgaataataaaatgtaacatagtttagaaatgaaaatactttataactatgttgagctccttctagttgtaaatcttcccaagtcaataatattcatatcaaaattttcaaatctagctaaatgaaggagatgtgacttggtaaaaagtaataacataaaattgtatcattttgatcatgattaaacaggaaagctattatttttctaaaatgaaaaaaatagaaattttagtttgtcatagaatcaagggctagattcacttaataaattgtcttgattctgctcaaaactctgaaaaaatttaaagctctgtaaggtttttgaagtcccacttcctttcaaaccaaccctgctatctccttgaagccatttttgacaataactgcctgtgaatgtgatttgtaaactattagacagcacacaaaagtgaactgctgtcactaatcatataactatcattcagattgtggcagctactctttccgatagttcccataggtttccaattgaacatagtattttttgctgcggtgtttgttttatcaattgattgtatgtattttcatattattttgtacactgtctttgaacttgaccttaaatattttctgtccatggcatatcccttgatgtgattacaggtcaaagtccacatcatagatgcctaaagtatcctgtaggaaaacagaatgggcactccaataaacatttattaaagcatttggccgggtgtggtggctcatgcctgtaatcctagcactttgggaggctgaggcaggtggatcacctgaggtccaagaccagcctggccaacatggtgacaccctgtctctaccaaaaatacaaagattagctgggcatggtggcaggcacccataatcccagctactcaggaggctgaggcaggagcattgcctgtccctggggccggggttgcgggttgggggtgggggtggagtttgcagtgaaccaagatcacaccacctcactccagactgaacaacagagcgagactccgtctcaaaaaagaaaaagaaaaaattgttaaagcattgcatgaaatctgctttaactcctattctaataaaacaacaacaagaactctgaaaatgactttcaccataattagttgaaaatgttactttcctttggcccaactgtatgtaattcattattatatctatgtctgagactgagtgtgggttttcaatataatcaaacgaaagaccacctttaccaaaagaacaaatttaaagttcttttattcctgtgaaccatattctccaatcatctacactgaatattttaaatgggaatttttgaagtgttaaatatttatcaccatgtttttctttcctcatttatatggagtactggagcttgtggccataatattctaatgcaaaatatggatcaactttcagtctgaaagtttgaaagttaatacactgattttaccacctgcaaaagatatccatatttgaataaaagcgaccagaagtgaagctaatcaatttaataacacatgcagttatttcctctttcttttaaaacccagaaggaaagtggggtccacatggtcctaattgtgttattagttcttagttttcctctaggtgctcttctaagtcttcttttgagcaaatatcatgaaaagctcaagatgagaagcagtgttgatttgaatgaaaggctaatcccagttgtcctttttctaattgataaaaaccatgatgatcaggatgagtctcactgaagcgtgtattatgataaagtaaactacggttcatggagtcacatttgatgttcagggatctcatctgagaaggaaagagagcacctttcctcagcctggagaaaatgaggcgtcggtgggagcaggcagagctgcatctgtcagtgtgagtgaggaaatccatgtctgattttccaaaggaagtcaagattcgggtcaactgtggggcgaaagaacaaagataccactggtggttcaggacgagaggtgcgggttgggaatagccatggagctggacgtgtggtactgaccagggatgggggaattgttgttgcgggtgtggaactggccccacttcacacggctgcgtgctgtgctcctacggcagccaggctgtagagcaggaattctcatgtgaccactggtttggttatcccagattaggaattagcaggaggagtgtggcaaaggccatgtctagaatgtgctaggaggagctggccagacggctcaggagagagaggccgctgggcaggctgggcggggaggggccatacagacttggggagcgccttcttctgctctggttgcccagccagccacaaactgggtggcttccacaacactcgtgtcctttctcacagtgctggaggccggcagtccagggtcagggtgtcagcaagatcggtttctcatggggcctctctccttggcttgtggacggccactttctcgctgtgtcctcacagggtcgtccctccgtctgtgtgttgttgtctgtgtccttatctctttttataaggattagagcccacccatgtgacttcatttcaccccaattacctcaaagacacttctccaaatacagtcacatttttcggaggagctggaagtcagggcttcaacataggaattttagaggctgaaaggtgacagttcagcccgtaaccagaaaaaggcagttgccctgcggggaagggaactgttgaggggtgagactgctggaggaagaggaggctgtggcttagagcggggaacaagaggtcccccaagagagatgggacctgagtatgagttgaaatggcctgttccgtgttgttctcaccctgtaaaatccctgagggcaggaatcagctttctgcatctctggttgcctggcccaccgtcagctcggagcattaaactatagggactcacccctgctgaacatcagattgagggtcatgtgcccgcaattctctccaggcaccactagagggcgagcctccattttgaaaactacccagaatcccctgctcccgctggggtcaggaccgcccctactctctcaaggactcaccctactctgttgtgccacacaagccgctgccacagggttcgccctgcttttattctaaatcttatggtagcttggaaagtagcctggcatctgatagaaacagccctcaagtggtccagcttcccccaccttgcactgccgggcagtctctatttgctgtcgattccacgcagtctatgcatctgggttattttcacttttccaaaaccaactctcagccgattcactgatcttctacagggttgctccagttcctacttcttttatcgcttagacctttctttttattccctccttcattctcccactccttttcatctgtagtctcttcttaccagtacgagtccgtgttacttcatttgtagctcctaatgtcagctcatcaaatgaactatagtgaagtaaaaggatatcgcctagtgctaggttatagcaaaactctcaaacagttagacttgcttttctgcaaaatgtgagcatgtagacttttgcatcaactcatagtaaactttaattttgttttgatgtctcaaaagatttaaaatgcaggttcgaccataatttttaaaagcaaagtagaacatgctggctatattatgaatccattcaatgacaagtagtattagtgactaaatgatcattataatgtaatgttagctgcagagaattttgaagaaagataaagaagcttgccacctagtagtcaagatgagaaaagaaaagaaaaaaaaaatcacagatcaaagggggaagtcccaagagagcatccccacattgcaatagccaagaagagctggcattgactgagtgctgactgggcaccaggctgtgtgtccactaagccgtttatctgcttttgctcacttattgtatatctttgcccctccgtgaggcaggtatgactgttctgcccattttacagatgaggaagctgaagctcagagcggttaagcaatttgcccatgaccacacaactatctgatctaaagcataggctcctatctactcccaatgatgtaccaatcctagcacgattatagctcttctcaagtgcaaaaagttcaaaattaatctagagataaaataacttttccccccagtttctcatgagagtaactaagcccttccatcagctgtggccagctgggcagtgataaggtagtagatgtatacagaggactgaaaagaggagaagaaacacagacagactgaaaaacaactgtctcctccctggtggagcatgagcccatgggtcgggaccctggactgcagctggcccaagtcggtagcactgcctgtggggaccccttctgagagtgtggaaaagtcagctttcccctgtgagagcagctgggtggggaggggacattttccatcacagactctaccatggatttatttttataccaaaataaacaagaagtccatcaacctggcacaaaagttaatggacctgcccccagctagggccctgtctacctggggtctggccccgtaagtgtgcaaattacagaacaggcttccaaacatagaaatatctttcactgtaatcccaggaagctctaagcttctacattttattaagctgcagttattattttaaaacaaggccaagtgcctcttggtatatacttaaaacctgcaaattgctttttaatgtctcagacttgtagccagcattggaaatttccagttcctctaccttgatcagctcagacatttccaccccctcaacctaaatgagcagaccttaacttcacacctgattctctaaagaaagctaccaaaaatacaacaaagatgatgggatttttgttactttaattattttaattgccagaaagtatattttgcttaagcattaggagaaacagaaagttgccccagagaaagcctctttgattcaggccgtggaataatttgttttagtgtacacatgcacacacacacgcatgcatgcacgcacacatacatacaacctgaggaggagtaaacacttttgtggatttttcttttctgggaagaagaatgcagcgttcattgattaacacaatttcttgctctcttgacttctggtggatcctgaaacacatgcgagaactcacatctgggggccagggagctgggctcaggacactgtgtgacactaagaactgtgcggtctccagaaagttctaaatgtcattggcctcaattacgaatctctaaaacagagactggtgtgccaattaggttttaaaatattaaaaaacttgacctaatcatttgaattctaggagttaagcctaaggaaatatcaaagatagaaagaggcttgaatgcctagatattttcaatctgtttttaataatagtgaaaaatgaaaataagttaaatgtctaccaatatgaaaatggctaaatcatgttttgttctcataatggaatattatatcaccatttaaatgagtggagagtatctaagaacatgataaaatcatcatggtataaaattaagttaaaaaacaaggtataaaaccatataatacagtcttagttgtgtaaaaatatgtgcttgtgtgaatacacacacgttaggaaatacacctgagtggcaatgatggctatttctgaggagggagattacacaggatcatttttctttatccctctctgtttgccatctcttccataataaactgcatcatcaaaaaactaagttattttgaaaataaaaataatggattggtctagattatctctaaatttctttacaatataaacctctattccacttatgaaccaattaaaaacaaattagaaaataacagggaggttttggcatttccaaaaacagtggctccttggggtagagaccttccacacctgatctcatcccatccaggccaaaaccgtagaggatttgcagccagggttataaagatactgcaacccattttagaaaacgaagcatgaatgtcccccttagaggcataggtggtttctcctctagaccatggcttgaggcttttgagccctgcagtaaggtgggctcgtcctcactgatgagagaatcacgctctccgctctcccccgcaagtggcatatggtttttgcctcaggacctccagaacgtgggtgtggctgaagttgctgcttccttttccataggaaatattttcaaggtcgccctctccaccctgaaaactagagggcacctcaatgggtgtctgcaagttcccagctcaggagctttcacctctatttgacaggcccttcataagttcctagttaaaaccttggggttagagtgttggtgccttgtcctctccatagccaaaggcatcgctctgtgctctgggcttcagatgttaaggagaggtaaatactaaaggacgtcattgttccctggagcacgtatcagctgcacagttatgactcaaggcacaaaatctgaagtaatcaagtcgtcctttgactactctgtgcaagaaaatgcatgcctcagaaatgtgtagccacgcaccgcacttttttcaaataattctactcagctggaagtgattttttatgtagaatatcctttcatgattactttagagcaggaatacccaatcttttggcttccctgggccacattagaagaagaattgtcttgggccacacataaaatacattaatgatagctgatgagctaaaacaaattgcaaaaaaaatctcataatgttttaagaaagtttatgaatttgttttgggccacattcaaagccatcctgggctgtatgcagcccatgggctgtgggttggacaagcttgctttcgaggatcagtttgcttttcagtctgggcatagaagagagaagtgggaacttctgaatatgacccaaaacttcaggttcccagtgcctggtcatagagtcacagactccttattcttttgaatatcactttgtttttaccatagagagactgtatagaatcatagtgcaagaaagtgccttcaaaaatgaaccagtctatctcattgccttcaagctaaaccataccaaagccattgctaactagtaagtaagggtctctattttaaggaccatcgcaggagaatcccagactcgtacagagtttgtcaatcatcattgttgggaaactttttcatatattcaacttaaacctctcagaagagtttgtcaatttcttcttattcaattctcattcaaggtgaaaacagctgggcaccgtctccatcatcatcatcattattgttactgttaccatcactaatgccactgctaccacctgagacaccaaggacagtaggtgctttgcctccactgtctcattgagtcctcacagcacacgtaaataaatagaggggttttatttccacctttgatacatgaagaaactaaggctcagaaagacaaaatgtttgtccacagtacagcttgttgtagcagagtcgaaatatcaaccaggtggactttttgtacagggccatgttactgcgtcatctactttgtatgattacaaactttcttaatctccaataggtgaaattattttagcctctcatcctgtttcctaacccagaactctatacctctcagaaatggttgctgatatctgtttgaccactaggaaaagggggaactggactagtattttctactgcgttccgatctgccctcctaagataattaggtttgagctggggagggaagaacagctaactttaaagcttggggaacaatgtcagctcccaaatatcttaggggtggagccatctgtttgggagggacctgaagagacttctgttgaagctttgtttgtttgcagagggagcatagagtgtttactcaaatgatgcattcatttggggttggcttgcgggggagtgggacctgtgaaggctggggggagtggttaaaggacatcactcccccccagccacctgtgactctactgctcctgagggattgtggtaacagttctttctggtgggatgccactgaggctttctggtatccccggggttgtgtaaaagctctaggtgctgggaagtggtgagcagctgctggggtgcataagggggagtggggagggacggaatgtcgggagcaggtgagctgcaggtggaaccagggtttcctgaggcctggcctgtgatactgtgaaacatcaaggagtgtgagtccagggagatctgagcagcacctgtcaaaggaggaggaggaggaggaggaggaggaggaggaggagctctgcttctcaggctcaatttccactgaggaatcccagcatttttaactcataacccaagcttttgcctctgggtcatagtggatcaaaagataaatgggccttttcaattttgtatttccaatctcagatactcgaatcattcccaatctaaagcacagtttgtgtttcagttctctggtgcatagcccaggtaatgagtctattctgtttatttatctagttcagagatttgggcttctagtcaaagtaaccttacacaaagaaacaacaaaacacaagtagacccgttaagagcaattgtaagatgtcagtttctccgtcttacctgccccccaccccccaacttgtgggggtttcttctatagtctgcatagagaatctcaccttttcctttgaacggcctctttatttctttaggcagtcatgactgttcttggacacagaaggtgatcagaacaaagatactaacacttcactggttctcttttcctgctcacagttgcttcaacaataaaaattgtgcaatcttgatataagtcacaaagtgtaaaacattcctattctttcataagtgacacttttccctattaatggagaacaaaggaagaaacaaccagacagaaggaaaatgctcaccacacaggcagtaaactagccccgttatgcccttgactcttttgcttttgattatcatttgtttactcaaatatttattgaaacctaccaggctaaaaagcattgtgctaaaagctggaaaagaaagaaaggggggagggaaagacgaaggcaaaaaaggggagaaactcagacaaaattcctgtccttaaagagactgcagtcaagtttgcaaagttaacgtatgtggtagaccgtgagagtgattcagatgaaatgctcttggagcctggctctagagatgagagaaggtttcctaagacatttcacttggacttcagacactgggcaggtggaagaaatatattctaggctaaggaaatagcgtgagtaacgtctttgaacataaacaacaaatttgcagccgaagttgcatggaaaaggctggagagagggaaagtcaagaaataatggagggtgttaaatgacaagcccaggaatctgggacagtcagctgtcgttgaatactgacaaataggcaagtgacatcatcacacatgggcttctgtttggaggggagtgacagccctccataaggagtttagggagttgaggtggattcaggtgagccagcctggagactgttgctgtatccgggacaaagagcaagaggcagaactaggacagtggcagtggaaactaagaggaaaataaaatgcttaaaacagtgcacagaaataacaacataacagacgccccaaggcacacacagcttagcagttagttacacatacggcccagggagatagagacagacagagatatttgggagtgtccacatgaaaccagtaactggaaatgttaaactgagtacaattaccaaagatcttctggtaatgaaggaaagtgagccaggaacagccctctgttttcgagcatgtccatttgagagagggatggagacagaagatgagcctgagggtgacttagaaagtcagagctgggaggagaaacctggaagagtctcacatcagagaaacctagggaacagagttttcagaaccagggtctgagtgacaatgtggagagctacacaaaggaaagaaaataaaagaccaagcgtgaagaaaggctccaggctgtggagggtttgtgctccacaagttacaggaggctgcggggacagaagccaggcaacagggccaaggtgtggcctggggagtgacggatcataaagccccctctcgtgagaaactgggataatggaaggagagactaaaagagtgttagctaagaaattagaaaagggatttttttttttttttttttttttttttgcgggtgggattcgaccgtgtttttctgcaaggagaagagtctgagaaacgtgccctaggcctgtgcaggttccattccaagcacgtccaaacagcacacatgcttccaaacagcacacacgcttccctccatgcacccccaggtgggaactgtggccacaggtcaacgcttctcttccctgctggaccatttgttcaccacaggcacaaatctgctctgtcttgttcaccaactgacacttagaagaggctcaaacctggtcattggctggggactcaagacagaacaaggagtgttcccactaccaagcttccagaacaggaaggaaagttggaacggagagcagacggagctcagccaggagaaacacgaggccagctgaagccagtgggcctgtgagaaggagggctccctgcctggcaccagggctgcagtcccttgttgaagtgcatgcagaggcagggtctgggaatgctcattcccaccttgttgcctcatgagcacgccccatgcaattctgggcaccaccctcagcaacaagactagctctcagccaccctcacagctcggcgtggcacggacgtgctgatcttatggtcagagggacaaggggaagtgctgcgtagactccaactggcaggggcggatcttttgtcctttccttctccttcctgcagcctggaactcaaacgagaaggcccgggctccggcagccacctttggctatggagtaatcttgagacacagacacatgcaggaaactttagtattaaagtaggagaagccccgttcttctctgacttcatagagccgttgcactttatggtagcctggttgcttccttctggactttttctgacaggagagaaattaaacacctgtcttacctaagccagtattatgttgaattttctgttacatgcggccaaacttaatctttacattaatgctacaacattaatgaaactgctaggagaagctgccttgccaggctccccggtggctgccatcacatccagcacccggtttctcaaacttccccacacccaccacagaaaagcaagaactaggtacagtatctggcattctgtaggcactgatggtcatggaattcagtctctctggtgtattttaagttgccattcaaaaataaagcactcaggtaatataagtgaattttgattaaattacaagtaacaattcctattcgggttgatagagctctttctttaaaaaggctgaattttatctccttttatagaattaaagtttttacttttcatttgtgatgagctgaattttcaggctgatgaaataagtcactgatatttaccacacaggacttaatcaaaaagaagcttaggtttcaatggtgggtttcctttttgggcatggaccgtggttttatagtggaaagctttgtagcttggctcacactgatgtccgctgctcctcacatgtgcgtcttatcttggaggctgggctcctccgtaggttctcctgccaacaagcgagacagaaaggaggcggcagctgggggaactcagccttccttcccaccacacctgcaccttgctgagccactgctcccaagacgaggcacagaattcccagagcagcctggcttcaacctactcatttggtgttctttaaattaaaaaaaaaaaaaaaaaacttctggcaaatcgtggtggctcacgcttgtaatcccaacactttgggaggctgatgaaggtggattgcttcagcccgggaaggagttccaggccagcctgggcaacatggtgaaaccctgtctctataaaagaaattcaaaagtaatccaggtgtgttggcacgtgcctgtagtccctgctactcgggaggccgagatgggagaatcagatatctgagcctggcagtttgatgctgcagtgagccagattgtgccactgcactccagccggagcaagagagcaagatctgtctcaaaaaaaaaaaaaaaaaattttcttacatcactagttttcttgcatggcctatgagttcccatccactctgtaagcctttataagtgttatggtgggatccaagtataagctctgagttactgtctcattctcccccgttcacttacagatgacattctcgcagaccagaccagcaagtctccttgcccgaggccacacaggcaggaaccgccaggcaccccgtccagtgtcccagccgagccctcctgggaggttcctgtgtgctggacacatgcctggctggctattacctgtgtagtttatccagtggttacactgacttgaagtggtctttctgaagacgacattgactttgaaattacttgcattatccagtgatcagctctggtcattgtgatcctttccaagccatacataattttgggttttgctgtggctgctgaccagcatctctgtttaagagactgagctttgtgctagagattctggttttgatgcatttcctaggcacgcccacttctccagtagaaagccaggagtgagtccctcaccgagctgatccttgtgaagatgaacagttctctccatttgtgtttagtgacaagtatgttcgttaaaatatcacgaagccttcacaagatgttctactaactagttcgagacacagcttgtatactgtgcactgaatgagtttgcataggttgttacatagattatcatacacctataataaatagagtatggaaaacactgctaaaaagtttcaatgaggaccaggtgcagtggctcacacttgtcatcccagcacttcgggaggctgaggcaggaggatcgcttgagcccaggaattcaaggctgcagtgagctatgattacgccactgtactctagcctgggcaacagtgatactctgtctcaaaaaaaataaaaataaaaattcattgagtttaagaggggttttttgtatggttacaaaaaaaaagcagtttaattcctttactcttatgagccacttatttggttcttcaaacatgtagaggccaaaaaggcactgtttctttaggttaaaaaaatgggcaaaaaatctgattttatgtttcttttctcaaaaattattcactaattattaacagcaaacgctgcgtctcctggagtcaccaggcaccgagcgttgtgtgtgtttcacccgcttggcgttttcattctcatttcatgtatttgaaagctggggctccgtacagttatgacattgacccagagtcactcagattgcaaatgacagagccagggtgtgaacccagataggtcaacctcagcctgagtgtctctaactcttcaggttaacagccttctccggataccaaagcagcactaaaccatctattcagctgtgcgggcacctgtgtgggatagaaggggctgagggatcctgctgccacattgataactatcgctggaaccagggtctgaaaccgagtcagactgaccctgaaacctacttgcctgaccattttactcccatacctcgggctatcttgcaaaggaagggttaaagaatacgtgatgcaacctcctgaaacaggcagcctaggaactttgacccacacactcagccccgatctctgtggccacctctgtgatacagacggccgcttggggacagcagaggctcaggggcagtgaaaagcagtgccggggctggagatgaaagagccaattctccattcttctgtgagtccccggagatgaacactgtgaacttgttcccagtctctgtgtctcgtgccagcggccctcccctcccccttccaaggacaagtccacccccagaggatttgcccctggaaatgggtcctcatggacaggggagaatcagagattatttgcttgaggtggcaaaaaaaaaaaaaaaaaaaaaaaaaaatacagacacatctccggccaaccctttttatagatgtatttttgttttttacaaaccaaatagcagaggttgattattagtacagtagtttggggttttttctcatcattaaccacttagttactataaatgtgttttaactcacggggaaaaagtccagcataccgtaaaacctgagtcccacccagccagctcggaatggaaggcttccaaggcccgggaggcgcgctctgtcaagttgctgattcgggagatagcagtgaatcggggttccaccacgcccccagaatactattcacagcagctttgtcattgaccgttctcccttttggacgagatctgaaacaaagcttccaatcacttccgatcctaatagcgttacctctcttaggtagggtgtaaggattcttagtcaaatttcaactcaagtaggttacctaggaacattcttagggcttaacctacttagttcttcttgcggtttcagttgaaagtgatagactcttccaggctctttgtgttccacggtccggtggtgaaatcactgctatctctccctccttagagagcccactgcttcccaccaatgagttaagtagtttttcttgcccatttctgcaaatttgtgttcataaaatcagttgatggatgaaagttactgaagaaattgctaacaatttcgaggctttccttaaattgatagtttgttttactttattctagttctcagtggaaacaaaaggcaagaatgatctttggaatgttctgtttacaaaatcaacccaaacaagatatagatgagactcattgtcttcctccagaataacaatcgcctttaatttctgtgctgctgaaacagtcacaagagtcatgatagatccagaaagagacccttggtgcttcatgtggtatctttctttagtacgggtctcttttacattcagcaggtttcattagaaaaaagaatttcaaagtatttcattaacaaaattgagaaaatgcgtatttaaacattgacatccttatgaaagagtaatttcttacataaatgtagcattttcacctatgttacctcatttaatcttcagaactaatcttaagttgcaatttcacaattttatagacaaggaaatggaaactcatagatgttaattcactcgttccgggccacggaggtgtactttttagagcatagtcttatttaatggtcttgactctaagtccaaaacagaagcctccactttgctgagcaccaaaagatcgggagatgagtcagtgtgtgagtcccaagaggaagagaatctgcgggtccttagcagttaaggaagcgtcatgaaacatttcttgaagaatggataggatttaaatagtttagaagatgcagtcttgaaactatgtgggtgatccaggttgcatgagcaacaaatatttgttggacaattgaagagtgaatgaatgaggacggagggtgtctgagatcaggaaaatgatctgggaaggtatgaaggcaaacattcccacgacgtgttcggggaaccgtgagtaggagccactggctctaagagagtgtccctctggacaagtagagagagatggactgccatgggtgctctgggggctcgaagggcatggaagggcatggaaggccaggctaaaaagtgttgattttgccttacagattaggtcaggtcttcattgcttttgactaaggaactttatcctgaagacaagatcatgggaaatcattgacaacttgtaggacatgatatgaccaaactcagtgttttaggaagatgagcagggagtgaagcacaaaacagatgaagagtgtgtgttgactctggttttaggaactcaccctgtgcctctctaaagcttctgtcagctcttcccatcagtgggaagcagatttagaggccaagctgcctagaagacatagggttaaagaaaaaaaaaaggaagaaaaagaaatgcacctttaaaatttcccaaccttgatttatacctacagagatgtatgtgtggtcactccttttattagggtttttaagctaatcagtaggcttgactaaagaattgtaaaactttcactacaagaaaaattaaaagaagtcatttcctgtatctaaaatgatcacgtatacttctgaaattaggaaaacgcaggccaatgataaaaatataactgtaacgaaactgtaggttttttactgattgtattacacaatatttccttttggattcttaatacaaagcaatgcaacactggtttggtttaaaataaaatatggagagattcttgttctgtaggaagctcatcactctaatgggtgtcttactcactggaacagtattttggctgtactggagcacatcgaaaggaatgagatttagctttgccaaacttccactgtgaaagagtttgctacaacagtgttttattttattcttattgaacttcagccagttgaaaatagaatctcctcaccatccttttaaattagccttaagctgcagataaaagacaaaaatcaatgtgcaaatttagctccttgtgctcggttccttaagaaatttaccccagtgctaatatgcaggatgcatagataatagaacatagagtaactggaagttttaaagtagcatttcttgttcagtttaggtctacttaagagtctggtaaatcctgtacataaattgtttctttaatgctacattaaagacagtgcatctctttatactgtccatactagctcagtaacactgcccctgataacatttcatgtggccatgacaaattatggtgaaattttcagtgtccaattggaatggaaattgctagaaaaaagcggtgcctaaataatggtgcaattctatttattccatttcactaagaattactaagggcttcgaaaacccaaatcgaaaaaggaagcacataaacaatgttcgtattggccatactagcttgaatgtctctaattgttctaagtggtacaggtgctatgagctcctaagaatatccctgtgtttgagaggagttaactcagagccttgggttgcttgctgtcctgccgcactgcacgagaaaggttagcaacataaagaaatgcaactttgcctacttcaggcattaatataaagaaacctacgtacaggcacccagagacacaaaaagagagagaaagctcaccattcttgaaaaaggcagttctgcaggctccacaaacaagtacaccagtgaatgggaatgataagaggagaacaatttggttacattcagagacctggtgggcaaatggaaatgggacaagcagtagaaattaggccagatcatggaagatttgttttgttttgttttcatggcatgatacctgcaaggccaggaaggctgaagccagaacaccaatgcaattaattagcagaaaccaaaaagtaattaatttagcacaccaccatatagggcagaagcaaatactgctgtttgtagccagggatggggaaaggatctaaccacactccaggcacctctgcacatggcaccacagagagaaagatggaggaggagtgcagccgtacgctgggagtcatcacaattgtttttttaccgataaaagcaagtgggaacaattggccaaaacaagcctggattgtagtagaaaattaagctaagaaagaaagatcaggggacattgtgataaaacaatccacgtaatttctataacatggatccagcttaataagatgtcctgaagttcagcatgagtaaagttccaggacagttcagggttgtcataggaaatctacatttttcaaattaacaggacttaaagatgttactgttacttcaacacttggtaaatttcactgcaaatatataagccattttaaaggaaagtattagataatcaaagaattcgttaagaaaaagaacaaattgagtgcccacaatataaatggtggccctgctgcagattagttcccgatgcctgagataagatgctggaggaaatcgcggcatcatcaatttaatcccacacaaaatgcaagcgaccaccttagcttagttgcagttgtggtgggcatgaacttcacaggggcataattgaaggccaaaattaaatgctctttatttctctgtatctccgtgtaatgtcctgatcctgagccccagactgcctcatgggtccagtagggatgcctctcagcaggttgtgcatcgggagaattttgctgcattgagctccagagctgcttccctgtgtctcctctcccactgctgaccccacccccatctactctaagccccagcaaatcaccccagcactcccaggcagtgagtgggggagggcgtgccccctcctctctctgttttggtccagcctatatgtcacagggcttctttaaacagtgactgggcctttctgctggccttcacttaactctcagctcagcttgcaggcaccctctgagacgcaggcactgcccccttatagaatctgcatagtgggctgcctagccagggggcttcgttgtgtggccttttctctggcaggctttcagatttcccccttcccccaagaatggagccaaggggtggaccccaacatagcctgctggctgcaaagctgcacacgcctggagagctgctgtccaatggcaaatggaagcaacattctcattgtctccactctcagacaccctcagattactgagggaattctctcgtgtgcccccttcaacacacaggcagacacagatacacacacacagacacagacacacacacacacgcagacacagacacacacacacagactacttgtcattctaaacttgccacctctgtcctcagcatggggccagtgtggtggagaggcctgttttgcctggctgtgcccacagtctcatctctcccaacttagattcttactaagagttggaactcttgattcctctggccgcttctggcagcctcttcccctggacacaccctatctccctgcccagtggagccgtcgcgtgcaggtgtgcatctctcactcctgccggaccaggcgctccctggccccatctcacagactaaaacatgaggctgttcctttgcttccgagtagtttgatgtcattcaacccagcatgcatttcctctccaccgctctgctccctccctggaggtgcttctgttcctacccgctgaggggcacagtcaggaggtatttagtcggcctcccgtcgccctcaccgcacacacaagaccaatttgacggttgtttgggggcatccactcctggggctcttgacattttccccgggctctgcgccatcagcgccctttcctgcccccacttcacgggctctgtctcctctccaggcacctgctctgcagggagggagacaccccccgtcctcaagctccacagggtcccgggtaatttcatccgtttcccttccctatcagtggctcccaaatctgtttttctcaaagtctgttttcctctgaacaccaaatcacagtttcaactgtatgtgatacaacacctgaacctcaggatggcctaaattgaactcattattgacttctcacatccgctcctccgttgtatgcccaacatccctccatagactgatctgttcgcggcctctgctggaacctcagtgtcaccttggacgccaccctcgcccaccctacccacgccagtcagtgcacccaggcctgtgcaagtggcctgtgaaaggcttctgtgctcgccgcccgcctttccagtggctcaggactggccccatctctttgcagcactgctgagaacgcctctcaactgagagcccgcgctcctcccctccatgaatgtatctgctttccaccccagacttcatcatggtgctgcaacgttgacagccccgtcacctgcagaaccatccaaacccatcggcagcacacagagaccctgctggatttcccagccccgaatcccaccttttctacttcaccctcttttctacctcactcagtgggtttcccatcccaaagtggattctcacctccatggtgtatcaaagtcctactccttctcccaggtccaaaagagcttctctggggaggaaccccagcatcccaggccatgagtcaggactctcctccagcactgctgtgacgcggcacgtgaccccacctgcgcacttagcacctcctgttacgcgcctgtccgctgatctgcgcctgtcatcacgtgaagagctccagggaggccgggctttctcccagtcccctttatattcctcgggtctagggcatgcctcacactaagtcaataccaaataaattgtccactcttcaacaaggcaggaaacatgaggggagagttaaaaagtcccaaaatgagcatatctctttgaaacaccccttacaatattagtttttaaaattctacttgttgagctatgttggagttgtgtgggtttatatgagtatcttttcctacagggaactatgtgatctgtgcaaatagagtccccacacacaggactggtttgcatcagaacatcggggaggcaggagccccaagtcaaccattctttgtatagaaaaagctctcccaagtcactcttttctttggcatgtgcatagtcatcttttaccaaatgtttagtcagtatcaaattcatttgctactggaaaacctgttttgatgacagttgttgctaaaaacctgtacctgatcaaaatgattgagcttactaactctaaattaaggagtgtctatttaagcccccgaagctacagtagaaaatctaacgtcatctcttagaggtgagcttgttaaaatactgacgtgatgcctttgtgagtccaccgtctcctttataagaatcaggccactgatcctcaggcctgaaggctcatctcttgggaaatagaggtcacaccaagggtttggtccgtgagtgagaaggtcgtctccagcctagaaaggtgaagactctttgattctacagttctaaagcgtggcctgaccgttttattttagtggcctttctcacactttgtctagtttcatttttgttacataatctgcataaaaattccctcagtagttacaattgcagtttagttcatgtctgacttggtgtgtcgttctgttgtgtttgagatctgaaaaactgtcgtcattgcccatccagatagcattcagtagaggggaaaggattcctttgtacaaagcaagcatgggcttaggatatttccacatactattcatttgcagacattgactaagaacaattaggaatgtacgctagaacgtgaaaaacatcttttacatttggatccatcttgtaagtgaccaacatacttttctttgaaaaaatagagcccatacgtttgtggcctaacaagacatgagaggataattgattaaaatgtcaaaggtggttggggaatgctgagatggaatgatactgcaggaaagatttcgcaaaaacaaattaaagtggaaattacaattcatgtataaagcccgtttgtatgatcaaagcaggcatcatctgtactgctaagttctacgtataacatagttttgttaaagaaaagtcaggcatgagatggacataagggatttgctgacaaatgcataacagctctaatgactaattttggttttagttagtgcaattctgtaggtggacatttagccagtttgttaacaaggtgttttaagaatgtcttccaggacaatttaaaaaaagagagaattatcttctcttacagaacaatgaaaaacagaattatctttcagggatggatgtttattacataacctattggagaataatggaagggaactagatgccttatgcccagcttattcattatctgatacctttaaaggctgaatggcattgccaattattcattgtggcaggggctgccatcaatttttagcttacagattgctagtttctcccgtgttctcttccatgaaacagcaacatactccattttgttctctatttaaaaattttacattgcagccctccaacaaattaattccatttaggtttcttcgggaagagatacaaatgagttttgtgaaagtgtacttaaatgcagccatccagccatcagcatcaacaggcagtcagctgtgcccagtgccatgcgcctgatgcccgtgactgacaagggcccgcattcactgtcccgggcttatgtgaatgctgacacactggtcaccgcagggcatactgcttgttgctgcttagttcatgcttgcacgggcagacccccaggtggcctgtcatttatttctataagctaggtctggtaacaccacaaaagcagtaacattcatttatatgaaggagaagtacataatccaaaaatcagaaaaattacttctgatagaagaaactaggtttcaaatgcgggtcttaataatacaactggattccgattgcattacattggttttctcttccaaataattggcaaatgaggacaaacagctcatccccatcctaacaggaaggtctgaatctgaagccttaccatcggtgactcattaggaccccattaagagccagaaaacttgcctaaatataatacaaatcgaatcttcaatgaggactacacatttgtaaactaaatttgaagtccccaaacatttacaagtacatttgttcttcataagtacagtcgtaaagaaaagcccagtcagtgacagtcaaccttgagcaacgttggaatatgaggtttgaaagtgaaaatagaggtcggcgcacaatctagttagtgcagagttgcattagacacaagtagtcagtgaccccgatgcacggaggaaattctgaaggttcaacatctgtctgaaaataatcgaaaggccctgcctagcagcacaagggactttcaagaatgggctttcctgtaaattttggatttcttttcttagagaaggtaaaaatgacctgctttctacttttcttctgattggactgcaatggccaaaaatatttataagaataaaagttaacaaaaacagtctaacccgtcagttcagaaccctagtaaaatttgttttggagcctagaactagaattgggcaaaagtgtagggctctttctcttataccaaaaagcccactcaaatgttctgtgagcccgctccaaagataaagtcagaaacaacttaacaacttcgtcttctttcactgattacttccctcgtgttctgtctattgctgatgatgtcctgacaaacagctccaagcacactcacccagtgcccgtgtgcagcatgcagaccacttgtcacccaatccatttctgagggatgactgtgttcctgaaacaactgaaatcagaaatcccttatttagcatttattagaatactgaatttaaaatattacatattatcatttgaaaaacaaaacaaacaaacaaaaaacctgttacttagattcaagttaaaagagggactatgtattcacccttagtccaggagaacagcttaaaatatgagcaccttttcctaagccattccacttaaatggacactagacctcaaaattgcaaacaataaatacataaataaaagcaataattaaaaaactaacttcaccatcatcccttcccgccaccccccaaacctacttccttcccaggcttcagatgaaatttctatgaatgatcccacccagtctcattcctcagctcagtgtcaagttccagtgtcctctgatcttccctttctctgacccccacacctttatggcgagtggccccccaacgccacgaggcctttccccttcactgctatggccgctttctgcaccacccttgggggaggtcacagcctctctgtgacctaagctctctcctctctaaagagaaggcatccacttaggtggtttatagggtttctcctagctcaaggatcttgagtgtatcgttgagctaagatacactcacgagctgagacctcctgactcaggcactgtggctgcactccaccaggtgacttatctgtggaccacactccacgtggccatctgtgcctatgctcttcctccacccatccaccaaaatgccatcttctccactcccactcagagccatgacgtccctctgcccccaggttgtccaggatcctctcatcttccatttccagccaccttttttctctaaaccctgtaacacttcataggagtccctcccaatgaaagccacaccccgcctggtgtctcacaccccaaagcagactgtaagcttcctgaagactgtcctgctcctcaatgtcccatcccctcccgaactgaccagcggtgctatctacggggaagcaccggggcagttgttgttgaattgatttcagttaattcagtttttaactgaatcacacaaaggatgtcacaagctagcttttataactaaagaaagcacagttgtgcagctgcctccagagtctctgggggttagagggaatgaaatagggaaagtccccagaagccagctgactgctgctcaaaccaggtgcaggttgggagaaaatctgtagtgaatgaaggaaaatgaaatgcacagtggaaaagaataccaacattcttgcaaaggaaccttaaagtattatttttgcaaagaatgcaaggattatttcagttcccttgttgactgttttgtatggtcttcctacagatactttcagaaaaagatctattgtttgtttttctctgtgctgacacagtatccattgtttagaactgtaatcatagcacacatagttgaaaatgtgggctcggggacaagctgtattttcccctctggttctttagacagtgaatactgtgttctttatctcttatcacagctcttttgtcaaacatttaatgattttttcccccagacaaatttgtagtttgttatcaaccataaaaatgtctattgccttatttttaaacatttaaactttggtaagtgtgtctcaagatgagcatgaattaaggtgtttatttcattttaaatacttttttttatcatagcgtacaaagctagagttctctgacatggatggcttatgtggatctctatttagacttgatgagagaacattttatttttgtactgtgtgtatttgcagggaagatggttaggctgactggctcccaggttgggtgtgttgggagcatctgtcaagggttggacaggtgcagacatctgtgacgtcctgcagtaggcagccatcactcgatttcctgcttaaaaagatctgacacacttcttcactccttggatctccattttttccaaatgcccgatacttcttaccattctacaacccttaaaccggatcccaaagtctgtgagagataaaagccttttttaaacccaataaacagtcactctttgttgttcctggttttaaaatgacaatttattgcttgatacagacatttgaagcctataattcaaatgaatatttataaaaataaatttcaagcacactggcatgtaactgcagggtaatttttaaatattcatttttaaggtggtgatagagtctagaaaaattttaatgtgccacgttatattttataaatatccaactatagaaatatgccttgtgtgctaatcatttccataaggcttcacttagattgagagagtgaaaatgggtgtcagtctttcaaatatccagaggaaaaactttcattttgttttaaatttgtttttgagggctgaatttaaacttaagacaatgtatgaagagttaaggtcagagttggtactttcaccactattccatttgtattgctttaaattctctgattaagtgtggaaaactatcaacaaggcgattgttcccaggggctgcccggccagaaataccgagactgaccatttttaagaacccagtgctatgtgcggaacagggcggcatggtggcctcctgagaactgggagggaaacactaaatgaagacgtgaacacatgggatttctttctttctttatttttattaaataaaaaatatttttattttgttatattgaactcgacaaattttcctcagagataatttttgtttcaatattcaaagttagaaattgtaccagcccgtcatagtttgaaagtattcctaaaagtaattcaaataaaaatgtattttaaatgtagtacacattttaaacatattggagaaaacatagaatcagagactttttcaaatccatgttggactaggaaactgtttctttttgtttctttttttttttttttttcctgagatggagtctcattctgtcacccaggctggagtgcagtgccgcgatctcggctcagtgcaacctccacctcctgggttcaagcgattctcctgcctcagcctcccgagtagctgggactacaggtgtgggccaccaaagccggttaatttttgtatttttagtagagacagggttttgccatgttggccaggctggtctcaaactcctgacctcaagtaagactgtttcttaatactaatcagatttgacaacagatgaggccatctgtgatggaggttctgcgcccgattacacattcccctgtagctcatagactcagtgctcctttctacagaggagagattccatagtcagtgttcctggggttctgtttttacttttgaagttccagaacttagtttcagttcttcctcttgatgtctctcttttgttctctccccctctctccctccctccctgtcttttctcctgtctccctgtcaccctccttccctcctttcatatctttctttcttcatcttgttatttccatctgtctgcctttcccaaggcaggaaaccccggcgcctccaggctggtggtgtctggctctgggctgcacaagccacaggccacctgccatcaagcacagaatggacttgacggggaccctgacagccagtcattcctgggactagatagggtgcagccggggtgtccgaggtgtttgtagtcatagtggcatacctacactgaagaggacagcttttttgtaagcggtggttgcttcactcatcaaaatagcctatttgtgaaggcatcaatgtgcaagtattttggagcaagtaaaatcagtcctggagattagaacatgcaggcctactgggccacaggaatggggctgcctgttgagactggagtgcaatgccccccaaccccacgcctgctgttcttccctctgctcttctcccttcccacctccttcactctcccctccttccccacgcccctccctcccttttggtcatcagtgcactttgcaggcatcagatatttggggctcttcaagtgcctcccctctacatcggtgtccacgggcttgctgaacagtgagcctctcctccctcctgggactggtcctcttcaacttgagccttgatctggagtcgatggtagagggagtccacttctcttgaccccgactctcaccatgtcaaaaggaggtgatgtttccaaaggtagcaattgaaggagcctctttatccccccataacagagaaagcatcggggatgccttggcctctcagccacgctttgatgattggcatttgattgttctcacatttcattatcgtgaaccactaataatgttggctaattgtttatttcatttataattccttaaatctccatctagtcttgaagctgttgcatccaaagagagtgctgccaaagagaagtttaaccacaggtgccgccctgaccacacttccaagactatctcctcatgtgggttctccttacatcatacatttgaccgtgaaacccatgaagacaggcgtccaatggagaggagtgttggaggcctcttccctttccacatggccctagagcccagtgttttcaatgtggtgtgactcccttttccagcggcgaaatcgttcccccgcttcccagaagtgtgctttaaagacattttgtgataagggagtgcaggtaggaaggggtctaacctcccccagggctccctgcgcctcggcggctgaggaggtggcagtggaggccgcccgacccccctctcagcctccctgtgctgcgttccctgccctgccgggaaatggagattctgcgcctaaagacacacagtcacgctgctttcaaagtttcagttcccacggccattctaaaatggcccctggagagctctggcttcctcctgcgccccttcccgcgcccgcccctgggtgtctccgctggctccccagcatctcctcccagctcgggatctctctcactcattcctccctccctgattctcgcctccattctcccgctctccagcagggcgcagctccctcttgctctttctggagaagcagggatcccagagaccccctacgagctggttccctcccagaccccgtccctccagtcgctggctcagtttccttcagtttcctccagctcatctcctgcccacctcaaaagcaacaggtccaagatcccaatcagcatttctcgcacagcgtttccgcgagaacgttccctgatcatctagagttagggaagtagaaccgtgccctgcacatgataagcacatggagactctaatcaatgagagctactatgattgctgctcacggacagcgcccaacagctctgttgtccctgctaatgacaccgtcgtccctcccctggtcaaccacgacccaaatgttaaagtgacctttcactcttttcgccaacatgtatccgctccaagacctctcctgtcctagggctactgggagccttacctgtggcctcaccttgctgtgcagcattggggagttgctgctctgcaccttagagatgtcaaatgggaagagtgacagctacttcagcagggtttgaggcaacattaggcaacacagtgtaaataaattacataacaatctgcttggcacttagtgatggttcaataaatgttacctgttgtcgtcgttggaactgttgacagaattcagtgagacttcagtgatggtttcttgaaagagtcacttatcatattctgcaatcaaagaaggaagagaggccaagaaataaacagatacatgtgcacatgacacaagacccagggtgagcagatgttcagaagacagagctaaagaaagactagagagacagacagacagacagaaagactagacagacagacagacaaatagataaacaggtagaaagaaagactagacagatagacaaatagacagacaaatagacaggtagatagatggatagacatgtagacagactagacagacagactagacagatagatagatagatagatagatagatagatagatagatagatagaggcggacagacagcttggtaaatgggcaaatgatagaaaatataaataaatatatgaaggagggagaaaactgaagcagaaaaaaagtaagaagaactcgtggtcattttactaaacttttaaaaacttgaacctaaaattttcaagataacttttttctgccaggaaaaaatacatatattagtagaatgtgtcaatacctgattttttccacagtaagagcatttccctttgaatacagtcataactggttctccgttagtagtaatcacagctcatctctgtggatattgttggtgctttcagttgctccagtacacatctattttgaaatcacctttagctataaaggaagaaaaaagaaataccatctgtaaatgcttgctctagaggtgtgtcataaaagtacagtcccattaacctactgtccttatgaaactggtggctattttcttttcttttctttttttttttttttttttttttttgtgagacagggtctcactctgttgcccaggctggagtgcagtggcgcgatctcggctcactgcaagctctgcctcccgggttcacgccattctcctgcctcagcctcccaagtatctgggactacaggcgcccgccaccacgcccggctaatttttttttttcgtgtttttagtagagacggggtttcaccgtgttagccaggattgtctcgatcttctgacctcatgatccgcctgcctcggcctcccaaagttttgggcttacaggcctgagccactgagcccgccggctattttctattcttatgttaaatgttctctctttaccttccattttaagggaattgacaagggagcaattcagagcaggggttatcttatctttcaaaggaacagaactggccacatcccagtagaaagtagaaaggatagcatccctgtccatgtcaggagcacaaaacaaaaagtacaaaaattgtgatgtaaaccacttgaaacttacaaggcagtacatagggatataatgacttcatcatcactgatgcaaagagaggtttctagatacgtgtttatctgtgagccccaggtccccgctaatctgtgctgatgtcttgaggaaaattggagtgagagtaaaaactttgattcactcacatactttcctttttcaagtaggcatttcagtctagccttggacatgcattaaccaaacgactggaactagttattcactaaagtgaccacagatttttaatatagtctgcatcaactgttttgattatgagaattttacttctcttttcttgctaatataatgagtcaagatagctcagtaagttaaaaaatattcagagtttgattatttgtttatcatttgttcaaaaaacaccatcaaatacctagattgtgagataaatgaggaaatcatagcaccatctccatactgcttatgcatcaggcacttgctctcagcactttacatgtgtgtgtgtgatttacagttgtgtgaagtggatggtatcattgttctcactttacaaatgatgaaagtgaggcccagagatgttaatttgcccagggtcacacagtgagaacgggtggatcggatgggcaccgaggttgtctggcaccaaggatctgtgttcctgttttgctacatgtagaaagtgtgttgccttgcccattaatgaggtcccagcatctgccccggtgtttgataataataagggcttaatgatcgtgaacccagaaaatctgagacaggtctcagttaatttagaaagtttcttttgccaaggttgaggacacgcccatgacacagcctcaggaagttgtgacgacgtgtgcccaaggcggttggggcacagcttagttttatgtatgttttagggagacacgagacatcagtcagtacatgtgagaagtacactggtttggtctgaaaaggcaggacaacttgaagcaaaggcaggaaaactcgaaacagggaggggcttccaggccacaggagatgaaatgaaaggttacattcttctgagtttctgatgagcctctccaaaggaggcaatcagatatgcacctatgccagtgagcagagggtcactttgactagaatgggaggcaggttggccctaagccgttcccagcttgacttttcccttgagcttagtgatttgggggccccaagatttattttcctttcacatgatcatgtacggaataaagaaatagatgaacacccatgatgttcaatgtactcaatgaagctctgagtacttaaagaataagaatgataaaatgtttcctgccctcaactaaattgcaggctgattcttgcagcttgagctaattcataagaaactagagattctaatccactttcaccagagggccttcagctaggacagaggctcctccagggtttgtgtcagccgctgttccaagtgaaaagtagtgctttgtgtctattcattccttcaaggctcatgacaaccctataacccagggactattatcatcccgtttgcctggggaggaaacccagccacagagcaggcaaggacctaggccttgatcacacaggcaggaaagagctgatcccagattcaaactcaggcagtgcagcccaggaggcctcacccttaactgccaagcttggccgcctctcaggcacctaatacttccctggaggagtaaatggtggaggtggggatagagaatggccagactgaaactccactgagaaggatgcctggggcagagctgtcttcctttgaactcctcgcagaactcattctttaacttagccccagaggcaaccacaattcagtgtggttcttttgtttgttgtgtgtctgtgtttgtgtatgtgtacagatatgtatctacgtgtctatatacatagatagctacaaacacaaatacatatttgtatatactgtgagggttatatttgtattatatgtaacatatatctctatcactgcctagaggaaggtcttggacattttaaacatcattaaatggcactatagtgtatttatctttctgcagacttgccgaagaatacaaaacatttgaccctaaaaagtgactctgctcactttttaattttaaaatgtgatcagagatatagtacttggatgggcaaaaagtgaaggaatttgctttgataaagactggcaaccagaggaatcttttagtcctctttatgtactgccagtctgagcctacaaatattttttattaaaaatacagaaaaaaaggcaacttttttttctaatatagaaaaggaaatgtcctaggtcttttagtcccctgggactcttgcatcacaaaatcaggaactgggacattggcacctcctgaggatgggaccacccagtgtgggcttatatatatgtgcacacacacagcacacttgtcccaatgtctacaggatgttctactccatgatctagaccatttgcgtgacctcgcgcaaaggcaacagtactaaccttggagtctaaacgccaagggtatgaacgtgggcacgtgtcgcatacttcccagttcatgcatactttccaaacaacgcacagccatgagtgggagaggggagaggattgaatttcgtgagcagcatgcaagatgtattgacaggactgcaccgagagtcttttctccaaggaaggtcaaattttaaccttttaacgttggaagtgaagacacctgatatgatcattgacaaaccaagaaatactaaaaaccctcaagagttgaagcattcttttacaatccttgttttagatacctttttaatagggtgaccaattgccccagtttgctcagcactgagaagtttcccaggacacagaacattccaggctgaggcaggatgcttggtcaccctacttctgcacgtcagcgtgcttgggaagcgccctgcaccaccggcattcctgggccccagaacccaggcactgggccggatcaggccccaggccccaggccccaggcactgggtgggatccgcagaacatgggtcctgcctctcagcagttcaggtctcttcacatttctcagcctcctatggccacggtttcctgtgctctgttcacgtttttcaaatgtgatgtttattatttcttaacttgtaatgtgtcaaacaagtataaggaaagctaacgagacggaaacatagggaaaaaatatttttaaagcagtattacaagaagaaagtgaatacttaagcggaattggtgaaaacctttaatttacagaaagtgtcacaaacccacttccacttcattagagtacatatattatatcaattcttaatagtagttataaattgtaataggaaccaggaagactacaacatttatcagttcacaagtggatttttcgtaatcctgctgtcttcaggtatacatttatgtcccaatttctttaagacacagagtcataaagagattcgggtgttccctgagctacaaagcagaagagcctccctcggcccctggggagcctgctcaggaatcgggctgtgtggggacagtctcctcacctttgggcatgaggtggggctgggcaaagaccacccagctccctaacccctactcatccacctcctgccccagttaaaatcaataaatatttactggcagctacaggtgtctggggaggcagaaaggaacaagtcatgggcccccacccaaggagggggcaggatgcagcgtaagaacctgcgcttggtcactgaggtgcttggcctcaggccaccacctcacctgcgcaattaggtacatggtaagagcatggtgacggttctctctccgctggggtgacatggggatgttaggtgacctcgagggccattgacacagtcagatgtgggagccccgggtccattgcaaatggatccagtctaatgggggagagagacctgccttcctcacacggtggtggccaacctcgacgttagatttgggggaagttcagaggagtgagcgggcctccctggggggcttcccagaggtgggcttagagccagactttgaagggcaggcagggttagagtaatgagcaaagggcagaggaagcagtgcgagcaaacgcggggacctgagcaggcccgttggggcagcaggagggcagcagggttctgggaagcaggggaagccgtcctgtcccggccggctgctgggagaaggtgggggcagaggggaaaatggagggaaactggtgcttccgtgtccactggtcaggggtgggagttgattagtaactgagggaggaaacataagatcctctctgagtggaaagtctctagcagtgactatctctgagtccttctccagtcccaaagctctgccatttctgcctttgctgctatgaaataaatatatatatatgtatatactgtttgtatgtgtttatgtgcatgtgtgtgtgtatgtgggggtgcatatatgtgtatatatgtgtatgtgagcatgtatgagcatacatatgtatgtgtgcgtgtatatgtgtgtataaatattatagattcagattttcccatatttccccacattctgccagcagtaatagaacaagctacataaattgccacaaactgtcaaatattcaggattctctgttctcagagttcaaagagaagtagttgtaacgatggttttcatattgaaatgagaactactaagctaagctaacctagagaggattctagcaaatagatcttggattgattccttgcttgcaatttatctaagcaatccataccaaaaaaaagtaataaatatgcaattttgcctaaatctcatgaataactgataaaaagctagattatctgggcttcagcaagtactttcacatggagttataaatacagaacattgaaggagtggtcgggaggccaggatcccaagtcagactgtgagaattcaatctctgggtgccttttcatctctagtctgattgatagactgtggagtgcgttctccaaaaacaagttttagaggagccacaaagtcggaaggggctgtgggggaagcaccttcggttgcctgcttgccacagctgctagtcagggaataggtacatcgggccgttcctcatcttcctggcctgctgacccacaattatcctcactcaaaagcactgtagatgggaccaggcacggcggctcacacctgtaatcccagcagtaatcccagcactttgagaggttgaggcaggcagatcacctgaggtcaggagttcaagaccagcctggccaacgtggtgaaaccccatctctaccaaaaatacaaaatttagccgggtgtggtgacatgtgcctgtggtcccagctactcaggaggctgaggcaggagaatcacttgagcccaggaggcggaggttgcagtgagccgagattgcgccattgcactccagccgggcgacagagcgagattccgtctcaaaaacaaacaaacaaacaaaaaaacccaccaaacattgtagaagaaggaaacaccctcactgtggatcacatgcatcacttctgaagatttattttgttaaggaaagaaactttgtttgcctcgggttttgggttggtgatgagttttcctcgttcagctcattagcccatagaacaactgcttcagcgcatcacgctggcagggccctgaaggagaagataatccgctctttctgaatccataggacaataatagcaaattctgagcttattaaaatacatggtgtcaccagctcatcagaaagggcaacaggcagtataccaatgcagttctggtcttgtagtttcaaaaggctaattacttttacaataaaataaagagaacttacctgtcattgagctgatgcatgtaaaagctgtttctagctaatagaggtttctgcaaatgattcagtacacattttccacaatgttccacaaatcatattggggtatagttgttggcggcatttcatacctgagtgaggtgtgatcatgttttaattaggatcctgtaaggtgaaaatagactgcacatgcaaatagtcggaactaattgcctattttcatgatacatagtgatttctaagaaaattatgactaattttaaatgaactaaaaatatgaagtgatatccaacctgaatcctgtgatagggtttgggagtttcttacctaaagggctaaatctttgtcatttcatttatagccattcatgaacacaggtaatagtgtttgcagatctttataaaaatgtgtgacatggattgttaacattagcttggcctcaaggtaattttcctctagaagtatttatatattttaatagacaactgacagactattggggcttcaagtcctttccttataaatttgaatccacctttatgttattactgcattcaattttctctagattatatgtgccaatacaaaaattctaaccttttccccttggtttaatatttttctgtgtgtttttatatgcatatgggaaacactgacagagatgaaacacccatcccatctgttatccttgtcctctttctcttctcctctacccccaccaatcacaagtgggaccctggaaacccggggctgtaatgcatgaaagatctagaaacgaggagaggtagaacacactaataagaagagcccatggtcagagcacccctgcagattgtcaggagctaagaatggaggaaaagagagactcattaagccatgccccatggagaggcaatgggaggtgcataagaaatgtttctggaagtcctgaccagggcaatcgggcatgagaaagaaagaaaaagagaggaagtcaaactatccctatttgcagacaatatgattctatacctacaaaaccccatagcctctgctcaagacctccttgatctgataagcaactttagcaaagtttcaggatataaaatcaatgtacaaaaaccactagctttcctgtacaccaacaacagccaagctgagagccaaatcaagaacacaatcccattcacaatagtcacagaaagaataaatacctagggtatagctaaccatggaggtgaaagatctctgcagtgagaattgcaaaagactgctcaaagaaatcagagatgacacaaacaaatggaaaaacatttcatgcttatggatagaagaatcaatattgttaaaatggccatactgcccaaagcaatttacagattcgatgctattccaattaatctaccaatgacattcttcatagaattagaaaaaacaattttaaaatttatgtggaaccaaaaagagactgaatagccaaggaaatcttaagcaaaaagaacaaagctggagggaacacattacccaacttcaaactatatgacaaggctacagtaaccaaaacagcatgtactggtataaaaacagacacataaaccaatggaacagaatagacagcccagaaataaggctgcacacctacaaccatctgatctttgacaaacttgacaaaagcaatagggaaaggactccctattcaataaatggtggtgggatagctggctagccatacgcagaagattcaaactggaccccttccttatactgtgcacaaaaatcaactcaagatggataaaatacttaaatgtaaaacctaaaactacaaaaaccctggaagataacctcagaaataccattctggacataggatctagcaaagatttcatgacaaagacaccaaaagatgttgcaacaaaaacaaaaatttacaaatgggacctaattaaactaaagagcttctgcacagcaaaggaaaccattgacagagtaaacagataacctacagaatgggaggaaatatttccaaactatgcatctgacaaaggcctaaaattcagaatctataaggaacttaaaggaatttacgggcaaaaaccaaacaaccccattcaaaagtgggcaaatgacatgaacagacatttttcaaaataagacacaaatgaccaacaagcatgtgaaaaaatgcttcacatcactgatcattacagaaatgcaaatcaaatccacaatgagataccatctcacaccactcagaatggctattgctaaaaagtaaaaaaataacagatgctgacaaggttgcagagaaaagagaatgctatacactgctggtgggggagtgtaaattagttcagccattgtggaaagcagtgtggtgattcctcaaagaacttaaaacagaattaccatttgacccagcaatctccttattgggtatatacctgaagtaatataaatcattttaccataaagacacgtgcacgtgtatattcatgacaacactcttcacaatagcaaagacatgaaatcaacctaaatgcccatcagtggtagactggataaaaaatgtagtacatacataccatggaatactatgcagccatgaaaaagaatgggatcatggcttttgcagcaacatggatagagcttttatcctaagcaagctaacacaggaacagaaaaacaaatcccacatgttctcacttataagtgggaataaacaagaacacatagacacaaagaggagaacaacaggcttcagggattacttgaggctggaggctgggagaagggagaggatcaaaaatctacttatcaggtactatgcttagtacctgggtgaaaaaataatctgtacaccaaacatctgagacacatgtacccctgagcccaaaataaaagttaaaaaatagaagaaaaggaaagtaaacccccaaaaaagaaatatttctcagactcttggagaagctgtcccctcacagggaatggggagaacagtctcttaagtttccccagagaagctttgtcacaagtaatctcaaatccagatctggttgaattctctgagagagaaagaaatgcaaaattaacactcaactcaggaaggttgattaagagaaggtgctaatatttgctttccttttcctcaattctgaaaatatcatacttcattttttttcttttaccgctgtttataagtatgttcactttgctatcaggtcagtttggttcgtgtgggacatttcgctaggattttatttcttttcttaataaatagtcaatatttgtcaacatatcacttttgacattctgttttttaaatacgctttgtagaaagtgagagatttctttaaatgaaatgatttcagtcgcagaacacacatttgtttttaatctctggtcccagtggtatttatctcttactaagaaagcaagctttccttttagaaagtgatctgttccctcattgttttatttataatttagagtatgggtagtctgtctgctgaaatgaaaataatgaccacagcctattaagtttctccaaatggaacaggtgatacccagggtttcaaaagtctgaaaataacaaatgatcaatgagcaaagaaatgaaggtataaggcctaaaatttgcaacataaaaataaacacatcctcaagaaatactgaaatcgatttttatttccttggctcacatttgtgctcattacacatcagacatttccatgatattcaactccctacggtttagatgtgagaatagcacatggaaacaaggacactcacacccagttgtgtttcccatccctgtttcctggctcatcactacatgatgagatgcttgagggagctgctcttcacacttaacgcccagcactcagcgtgtgcccagatagaatggaggcatggatggtagcctgctccattttaatattagattaaaatgcaagcatctcatttctttctacaaaattaaaatataagactgtcaggatccataagtgtctcttataatgaaagtggaagaattagaatccataatcttatttttgcaataaaaatatgaatcactgttcacaaatattcagcgcaatagaataccaagtgagattgtgcctgtcttagaaagaaaggcaagctctcaatctgtggataccatatggatgtcgctgagaaggagtggggacttgggcagcaaagctgccaggcgttggggagcatatggaagtggcctgtttggggccacagacggtcgggcaatgcttccttctctcttcacagttgtctaacatattgccactgtctacatgagcataacttaatagccaatttgaattctattgtagttaaacttggtgttatcctgttagtaaactagcttatattgcacaatcgagtccaaagattatttttgctttatttactacataaagcaaatactctgtaaagaactgaaaccacttttattcatagactatattggagattttcttttcttttcttttttctcttcttttcttgtcctaagacataacatagtaccttcaatgaagatgacggtggtagtgctagtatagtatacaaattagaaaaaggataattgcagagatcagaatctaagctacattttactttttttaaaaaaaaaagattgtcaggttatcatgttaaaattagcatcttctctatattaataaatcaattctgtgattaaaagtccagaaataaaataacaaataaatgtgcattttatttagctatttttagtgtgctattggatttgaagctaatttggctaagcacacgtttggatttccatcttttttggtatcacttcctaggattttagtgcagtggctcctaaaaagaatgctcaaatattacttataatcccccaagatatatcttctttgcatggaataaaatgtgaactaacttggagaaaggaacactttagacatacatttcattaatgtaaatatccacctcaaactatgtggattagcatctcttagaattgatgttacaatgctaacaagagaaaaagaaaacaaagtaccggtctacaaaaatatttgtctaatgccgaatgttagattattaaacagaaaagcacattagctaatgtgaaatgatgtttttctccaaatttattacattttccccctctgtgttaaattttctttaaaaggagatctcacaggagtggataggcaagctggatctgtgagcagctacaaatagaagcacaagacaaagtaatctataggctggcactcacattcatttactaaataaggtcgtgagcaatattaggcacatttttctgacacctttcccagttgactagaagttgagtgcatttagtaaaggaagtacacagtgaactgttgttagtatttatcaggaaacgtgatgagtggccctgaaatagagcatcttaccatccaaatttctcagtagccttaataaagaatagtcagtagccttagtgcagactagctggagtagatctaagcagtattaatgtggcagtccgcctcagcatgaaagtggagctttgcaaaaggacgagaaatggatttggatgggcaaggttgaaagtagttgtaagttgatctggcattttatatttcattaatcaatttctaaatctataattaaaagaaaactacattgagtggttgggcataaagtagagattgaatgatacccacaacaaataattgttaatattgacaggttatgctacagggattgcctaatttcacagatgagggtaacacaaaatgagacaactgctacataatgtttattctaaaggaatattatgacattactgagttttgaattttcctttgtattgactttttcataatgcatgaaataagcatacatcaacctagttaatacctgaacaagacaacatatccaagccataatttgatgtaaagcatgtgacacaaaggaaatatcatattgtaaatatcgtactgtaaactaacaactgaaaacttccatatgtctaaagtacacaaacatattctttattttaccttcacattctttcttttaaagaaagaaaagccattgcaactcagcagtgaacaaggcaaagacagtcaattgaaatcaaccctccattgcacagtaagagtatatgtgtgaagttcttgagccgagcccctaaaagtctccatgaacatcaaaccacgcctgttgggggacctcagttctctaccaaatgtcttgttaattgagctttggcaaatgtctccatgaggaccattgtcacccgtcatgctcatgagagtcacggcctacgcttccacatacttttaaaaatcttattaaagattacagagcagtcaggtgagtacacagacaattacatccagacgatgaacagaaggacagaataatgtactaactttctgctctttaatggactttacctgtgacccaaatatattccttctaaagcatttatagaactatcaaagtttagatattgtaataccaatgtgtaatccattctataatgcagaatatctttctaaaatgtgaaaaagtgccaagtattcaattcaacacagtaagtgttgaacatgaggacaaagaaaattcactggagggccttcattaaaaaatatccccactgaaaataaagcagagaccaccagagtggacagagcactcaccatggccttagaaggtggagcttccaagcggatgcacccatttctatgggctgaggaccataacctctgagcattaacttcctcttccaaagcacatggatgatatctactgcagaggcatgttgaagggattaaattggttaacgcatactgaagcagccactaaatttctctgttaaatacatgtatctcttccccttacttttgctgagaacaaaataatttctgttctttgttgcacccagtttgtactgaagggcataaccttgaatatttgaaaaggaaaactctcttcagttcaatggaagatataggacatgttaagtaagaaacagcaagctctttaaatcagtgaatagctgtattggggggaaaaatgtggttcatcccaaggcagccaaaagttgacctggtgaactgtctggttggttttatgccctatttaaacacacattaaacagatctgaagtgtcttaaaatggaaaaatgtcttcgttcaaataataagaacttaataaaattcttcattacttcactggagccttatttgacaatactaaattttttctcctaggcttacatgatagattctatcacagaatctttctctcccaccaccttttttttaaattccctttggctcttaactctaccattatgacagcaacacttaaagctgacctttttttgacagagttagcaattctcctccaggctatgtagtgattcttcaatgcttatgtgtaaattatgcaactgtctcatacttcacagaaacattttataatcctgtgtactattccatcattggtttaatgaaaacattaacacttggtttccataatatttaccatatggtaaagtcactgttttatagagtaaagggacagatagctgaggtcaatttaaataattgtcttaaaattccccatgatgaacaaattttttaaatttatcttatctaccaatagcatggaaatatcaagcttatatacacaggtggacttgcacctttaccgtatttgattatttttcataacttagaatctaggcatatatctatgtaatggagtttttacagaagcctttggacaagaacacatttgttgtaattctcggtatttaaatcaattgcgcataataaaatgactcatgaaaacattctacttaatatggtatatcttcccgtagtaaaagatgacttcctcgttcctccccctataagagttaccaatgtaagcagtcgaaatggttgagcctcttggttttgcactcctaccaagtctggtttgtaactaggaaaataagcaaacaggtcatgagggtatgaggggagggtagcataatgcagtgctcattctcttcctcttcctcaataattcagcccaaagccaccaaatggagctgagcacgtgcagtcagcgtctacctgcagtggcagagggagccactgtggtccagggaggggtgtcagggcctaagaagagtgaggaagacatctgtgtggttgggaagcactgccaatggccctgcaagtgggatcagaataccagagtgaccagaaaggcatctgcattgggatgaagaaggagtacagagcagtgggatattggttacatacaggggtagatcaaatgaataaatataaaaaggataatgggagccaagagagttacaaatatgaaaagatagagaatttgaaaatactctggggtattggattagagttgagatactggcataaactcatgattttcattatagataaaggtagctgtggaaatgagcatggttgtaactatgtgtatgtgtgtatagctatgttcactgtgagggcccgggagcagtggcaccccaaaagcagtgagcacatctggtacctggattttggtttctaagtaccattctccctaaaaaggaaccaaagctccttgagaaatggccaattccagaactaaggcaggaaaagtccaagaatgatcttggaacagagccatgtcaaaaagaaagaaaatgcttaaagagcaaaggagacatgtgcaggggacacagatgctggctcaaaagggttgcccaattgccaagtcagggaccctttgaccttcaaaataaatgatagtaaaatgggctataacccatagactacattaggaattaatgactccatattaatataaatgaataaatgaataaaagtttgatgaaaaattgtatatttaccattatttcatattatctcccaacaaaatgcacattaattataaagggaagaagagtaactttactttggaaactgataatcttttttttttttttgagacggagtctcgctcatcgcccaggctggattgcagtggcacgatctcggctcactgcaagctatgcctcccaggttcatgccattctcctgcctcagcctcccgagtagctggaactacaggcacccaccaccacgcccagctaattttttgtatttttattagacatggggtttcaccttgttagccaggatggtcttgatctcctgacctcgtgatccacccgccttggcctcccaaagtgctgggattacaggcatgagccaccatgcccaaccagaaactgacaatcttaattgaaggatcaaggttaacatggctatgaaatggacaaattaaaagcacgtggcagctgatggagcacagtgggatatatctgccagaaatgcaaaacctgactctaatcattaggaagtgtcagacaaaccccaattgagggatgttcaatttttaaaaaacaaaactgccctgtaaccttttaaaatgtccagggcatgaaagtcaaggaaaaaaaaaacaaaacaaaactgaagaactgttttagataggagaataaagagacatcacaaataatgcaacatgtgattctggattgatctttttgctattaaggatgttattgggacaactggcaatatgtgaatgagttggggataaagtggtagtaatataccggtgtttgttgcatttcagtgcttgtgttacgattatgtaggagaatgtccttgtttgtagggaatatacactgaactatttaggttctttttggtgataaatgaagtttagtatcttttcatgtgatcattgaccatttatactttttttatgaagcctctatgtatatcctttacccatttttctattgttttggttatttttttctcattgattggtattagttatttgtaaattaaggaaattaaccctttgtcagttataggtattacgaatacccccacttaaagtttacaaataaatccattgatcttttcctcaaggacagtaagggattttgcttaattctgtttttacattttaattatttgctctaactgaaatttacattggtttaaataatgagataaagatctagctgtacattttttaaaatgattagtcaattgccccaacaccatataaaaagtagcctctctttttcccacctttgaaacacaacctatatcacaatctaaattctactttattttgatctacttttggactcgattctgttcttaactatttcttctccagggccaaccaaactcttttcattaataacatgcttcggtagagtattgtccaatagaaccgtctacaatgatgaaaatattcactgtttactctgtccagtatagtagccaccatcacattgagcctggagatgtggctagtgtgactaaggacgtgaattttttattttataaatttctaattaatttaaacttaaatttcaaatagccacatgtggctagtggctaccatattggacagcagagttttattatcttactggggagtttctacccattctttccacagttttccaagatattctcacacgtttatttttccttctcataagaaatctagactttctggttttccagaaaaggtcacattgaatttacagaacactttgggtacagttgttatacttttaaagtatgacatcattaagccttcttttaagtctctcagtagagttttaaagttttctttatataaatttatacatcatcttttaaatccattcatatatatttaatctttttttaatttttattttgttttatttgtttgctgttgtaaatggtgtacttatttcaatgtcttttactatattttctcactgataattatttatatatagtgcagctatgtaggtatattttgtaatcttttgggtaattctctttatgttttcaggttgttgtaattcttctttccagtattcaaactttctagttatttctcatttaacactgttggctgccatttcaatggcagttttaagtagttgtagcaatggttaggatcctcgtcttattccacactttaataggtatgttttagcattttatcattaagcttcatgctggcttaaaaaagaaatctgtcaattcttgccttaccactgatttttaacatcagaaatgaaggttgacatttgttaacatgcctcttctcctaccttctatgtaagttatataatttacctcctctaatatattactagtatatattaatttgacccatttgtaatttttttttatctacccatgtattcaggaaataaatgccactcagtcacggcattttttttttgtgcaatgtactgctaaatttctttggtaattatgtaaagatttttgtaatattcaagataatcatctattttagaactattctatcatctttcagtgtcagtggtatgctgtcattatttaaaagaattttggaggattctttctataatagtttaaataagcttaaatagagaaatatcattccatggaaagtggaattaatttgcttctaacgccatcttggcatggcatatttttatgttaatttagcaatagctttaatagcatgcattgttatattgttctgttttctgtctcttctggagtcaatttagtagattccattctccttgactaggttgatcctgatatcattaatctaatgccaaatttagaaagaggatgttttagggaaatatgataattttatttctagttctgttgcatttaagatgctcatgggacatcgaggtagaaacagccaataaacaaatagaatatatatcttagagctatttatgagcaatctgggctggaaaggtagccacatgcatgactgtggtggttaatgagatcacccaaggacaacataaagcaatgacgagtaatggcccctggtggaaccctggaaaccccaacatttaactgggtaggaagaggaaaaggcttgagaatgacaggagagacagaaaagtcaagaataaaagatcaaaatctcccaatgcttcagaaaggacaaatagacaaatactgaagcatacccattggatttattgtttaggagatcaacagtggcctcagcaaaagcgatttccaggaagtgtttgagacaaagcctgcttttgggtggctgtaaagtgcactgaaggtcaggaaccgcagcagtaagtgtaggatgtgctcatcagaagcccggctgggaagagaaggatccatgagtcttaagtaattttagagatcatttttcaattgaacacatgaaatgtagacttttccctcttttctgtgtccagaggacgtgagaaagaaagtttttcctgtgttgtctaatagagagctggccgttgtaaagagcatctggggacagctgccttgtcatgcactttgagggatctgggacaccagggtgatgtggagatgtgaaaggagggccataaagcagtgtctgtccccagtggagccagcaccaagggcaagggctggaaaccgaggggcttgcacatcaccaaggaaaccaaggtggaggaacttagacaaaaacctggtggaggatgggcagaagacagtaatgaaaccatcgattcacaggctgctctcaagagaaaaggggaagaaaaacgaagaggaacacaaactgaaggcaggatttttaaggaaatatttacaaatgcttgaaaactataattaatgtaaagcaaggatagctgataaatagaatatctaaaatgcaaatgagagcttaatggcttagaaaaatcaagttgagtctgactacttcacccagccctcaataaacaccatccatctacccttcagcgcacccagcccccgtacacacatgcgtgtgcatacatatgcacatgtacacacaacgcagagatacaactttatcatagtgtgagatgctgtcgtatttggcaacattgctatattttcccccaatttgctgtccaatttattttaattatttatatttaggaaaccctcttccaagaacaaaaccacctattatttaaggttctgctgtctttaactagcactgcaactttacaatattcaatgtgcttgctttcaacttgcattgtctaattaaatcctccaataatccatataaaagcaatgatcgtttatacttgctgtatctacagaattacattctccatgaggaactttgaaatacccacaagcattccaccagcacgcctttgcaagtgaatcttcccaattttcattcaaaacttccgttgagtcctaataggactggggtctgggcacaagtgtgaaagactctgggatgggcagaaccaggcttggcgatagaggcttagcctgactaaatgaggcctgggaatgtaccgctccctgcagaagctaggggtgcagcccgattgttgtaggtatgatgcccaaaggctaaaacaagctcctggcaagcaccaaaggaaagctcagactcaggaaactcacccccaacgggagcccaatcccaacagagcaggtgataggcaggtctaggcatacgccagtccctggacaggaaggccagggttccaggggaggcccagtcacagatacaaagcccacgtccacgcagtctgctcaggaggggaggaggggcatccgctcacttgaaacctttgatcatgattctcaaataggcaacaatctttctacataccccgagggtaggggttcccggggtaggggtccccagcccccgggccatggactggcactggtctgtgctctgttaggaagcagctgcacagcaggaggtgagcagtgggcaggtgagcaaggcttcatttcatctctatttagggttgctctcattgctcgctttactgcctgagctccgcctcctgtcagatcagcagcagcattggattctcacaggagtgtgaactgtgttgtgaactgtgcatctcagggatccaggctgtgtgcaccttgtgagaatctaatgcctgatgatctgccactgtctcccatcaccccatcacagatgggaccatctagttgcaggaagacaagcttagggcccccactgattttacattatggtgaggtgtataattatttcattatatattacaatgtaatgattatagaaataaagtgcacaatcaatgtaatgcacttgaaccgtgaaaccctccccgacactggtccatggaaaaattgtgttgggtgagactggtccctgatgccaaaaaggctggggcccctgccctaggaaattcatatttgcactcttaggggtgttgtattcttcattctttgcgaataaattagcttcctcttctccaaaagaaaacagaaactatcacatgaagactagcacatcttcccactgaaaacttttatcaacttacctctctctgtcctcatatctcactttccctcctcgtatgatggatacagcaatctctgtgcagttatctaacacagatagatgctgaattctggctgtactgaattccatcctctgttatctacccaagaagttaatttctataattattccactttctactgcaattttcatgctagaaataaattcctttttgcccccacatccccttatgggtattgcctcttctctgcttctctcttcaacagaactccttccaagggctatgagtgctttccatggccacgtcctcaacactgaccccgtcccctctgcaacccactccagttatcttctgtctccttctctccattgaaatgcctcatgtcagggcccctggcagccttggtgttgccaaacccaaggtcctgttctttgtcctcctcttactcaaactcccagcaacactcaccccaaccatctgctctgataacagccttgtccacctgctcctccagctcctcccagctcacaggtcgctccctcatctcctgggctggctcctcctccctctgccgcaggggcagggctcgggctaccctcttctccagctgcactctctcaacatgtatatagcccagtggatctcaacaggggacagctttgccctgcaggggtcacttgacaatgtctgaagacacttttgtcacaaggtggggagatgccgcaggcattcgtgtctggaagccttggattcggccaaatatcctccaacgcacaggacagcccccactgcgcttactccgcatagaaggtccacagtgcctgttctgtccagcaaccctattctagtccatggttttaagccattttatacacagatgacagagtcacaggttgatatgcccagctctaaccacccctctaatttgtatgtccaaccgccgcctcactattcctatttgaatgtctaaataggtgatttagaattaacctctgacacagctcttcattttcctccaaagtccactctttcttggccatttccctctcagccaatgccaccagttatatagaccaaagccctaaaagtcaatctttattcttctctaatccttataagacacagcccatccagcagcaaagctcatgggctctgccctcacaacccaccttaaagctgagcatgtctcacagtatccagaatgtgtcttcccaagccttcactgtctctgggttgaacttctgcatttgtcttctagttcttctccttgcatctattcttaaagcctgaaaatctgctttctatgcaaaagagttatcttttcaaatacattaatcccatcatgccattctcttgcttaaatacctcccaatggtttctcattgagctgagagtaaaatcctcctccccactgcggcctgcagtcagcctgcctttcccacctgcctcctcctgcagctcagcctgcctttcccacctgcctcctcctgcagctcagcctgaatttcccacctgcctcctcctacagctcagcctgcctttcccacctgcctcctcctgctgcctccctccctcctaccagcatttccctaagcctcagaaacaccaaggacatttcctatttgcagcctttacagtttctgctcgctcagcccggagcatcctggccccggtctccatggggtgctcaccattgttgaggtctctgtccaaacatgcttccccaaagaggcctcccctggctgccctatggaaaggctgcacaccctcctcccatatcttaccttgctttattttgcttcacaaaacacactgctatttgaaaccaagtcatcatctactatttaatatcaatgcattagctctctttctccctagcatgtgagccccagtccaagcaaggatgccgtcttttcaccaccacctgcccagaatccagaacagagctgcacataaaaggagctcccaatacatgcagagtgacttctgtgtcttctgcgacagatagagtcaggacagagggcgggggtgggggagtgcaggaaggaaagggtgtgctccatctttttagtaattatgctcatgctcacaaagcctcgtctgtgagtttttccatacattgtctaatttatccaggggtgtgctcccagtactcaggcctcttggcagggcattctgagacaagggacagaaggactgactgctaagcgggggcaagtggggctgagatgtagatttgcacacgccctctctctctccatagtagacctgagaacaagggtacgaggcaggagtgagagccaggctctaaggcggagaagatggcacagaaaagacagcgtttgggaaaactcacagaatgccatagagtttccataatatatgataaattaaattaggtaagaaaattgcagtccagtacttaaagtcaaagaccactttttgaaacttccagatgtgtgtgatttggagataaatatttgcatatctttcctttaattatgtttttttaagagagtatgtggagaagttaaatactcatgattgcacgtaaatgttaccaaaagtatatggaatgtctaatcatcattaataatggctaaactgtattgcatatttaccaagtaccaggaaccatcctaagagcttacctggatttctttgttaaatcctcacaacatccctatgaggtaagattcattattgtccctgtcatttgggaaaggaagacctaagcttactgatgttatgcaacttgggctctgcatcactttgctgtcttgttccagcaatttcacatgagaggcaagacacagtgagaataaatcatatagttcaggagtaaaacaagctttagtgtctgcagattactattttaaaaatcctaatggaaatcaagcattttgaagacaaaatacataagaaaatactgtagtggtctgtctcagtcatctagaaagcatttcattatcttggaagtaaatggcacatgataaaataaatactctatttccccacatctggctcagcatcgcagttttcctagttatttgttcctgtattcccaaataaaacagagtccagagataggaatcttcaggaagccactgggtccttagagtctgaatctgggtgttgcgggaaggttgatgccacttctcttccgtgcgggcaaaggcagtgagaagaaggagccaagctccctgcaaactttgtacacgtgcctttgtgccttgcctacacctcactgtgactctgtgaaatagacattactctttgattaatttcaccgtgtgcagctgaaccagtgactctcagggaggtactttcatggttgcaaagcacatcttacgttgaagctggaatcctaggcttccgcctgattatcagaaaggagggtatttgcagccaagggaactatttgaaaataaccacaactttaaataaacaagcaagaaaacataggtaaatgaataatattccaaagaatgccaaagatgtgttgtgtccctgcaagtgtgctgaactgtactgaactgaccaaagcactgcagttcagtgggcttgctgaggacccaaagctcaatgtcattcgctcactgttgacagcaaggcctttgcctattaaaggacttccctgccaggcacaggtgtgtattggagagaagagctgaggatactgggtcgtgggaccttgcacagccagactgttaagggctagaagaatattttctaatccgcagctctgggatctataaaatctgctagaaggtatgagaatacagacaggctgcaccctgatcacctggcgatattcaggtgcagtgcaggagacactgaattcagcagcagctgatggaacatttttcctaaataaatcaagttgttcaggtgcgctgaccaaatgacaaaaaactgtaaagtattttgtaaacttttattatagattacagtggtaattgaaaagtcaagaaaattaacccactataaaaaagatatttgagcatgtaactatatttacaagaagcaggttggaattctcagggacagcttgtggaaatgaaggtcccccatggtccatcgcaaccaaccgtgttcctggcgatgctgtgagggtgcatgagatgggagcttgcatccaaagaaggatgtgtgaggccgaggcgggtggatcccccgaggtcaggcgttcgaaaccagcctggccaacatggtgaaaccccatctctactaaaaatacaaaaattagccaggtgtggtggcaggtgcctgtcgtcccagctacttgggagcctgaggcaggagaatcgcttgaacctggaaggcggaggttgcggtgagctgagatcgcaccactgtactgcagcctgggtgagagtgagaccttgtctcacttaaaaatatatatatgtgaacaaaagcattgcacggaaaacacttttaaacacgttcacaaataacaaggatggagtggaattaatggccatcctaaaagagctgaagcatttgcccaatctgcccaagaaagaaaaattaagagatttgaaccactaagaaataatgtagattctgcagaacccaatattgacatcagataaataaacagttataagtattaacatatataaattactgggtccaaactgcctccatcccaagtaattaagagaattgactacaacatttcaaatgttacttttgaaaaatcatgtagagttgtagtaatatcagaatgccgtagagaaagttaatgattatgtagctcaaaaaggaaaagtaaatgagactgtaatattgtgattatttaacttagtgtacagattgatcttgccttaaataattaccaattaacttctactgaaaaatgtagtaggtatgattgtgtataacatacctagggaaaaagaagtaaaacaaaagaacattgaccgggcgcgatggctcgtgcctgtaataccagtactttggggggccgaggcgggtgaatcacctgaggtcaggagttcaagaccagcttggccaatgtggtgaaaccctgtctctactaaaaatacaaaaattagccgagcatggtggcaggtgcctgtaatcccagctacttgggaggctgaggcaggagaatcccttgaacgtgggaggcagaggttgcagtaagccgagattgcgccgttgcactccagcctgggcaaaaagagtgaaactccatctcaaaaatgaaaaataaaaaataaaagaatattaaggataaactaaaatactgagaataaaaatgtgtgtgtcccattgagaaaacattttctgagtgcccactgagctccacacacaatgggaaagcagaagaaggatggaagtagtagaagcttgcattctaatgagagtgttagacgactcgactgtaatgcacaggaaaaagtaaatgctataaaagaagaagcctaaatcaagggttacaggaggatttaattttggaagagggaacaggaaagagaaagtggtcagaaaaggcttgaggtagactgctttttgctggctttagcatgtggtgggctttcgactggctgaggaccagaagaaacatgcttagggagagggagctggtccacaaacaggcagaatggcatgcattatgaagatgtgccttgctaattgaattgcttttctaaacagtggatgaaaaataaagtagaaacagagtgattctgttagtcaggttccctggaaatgggctctgagttggagattcttgcacagaaataacgcctataagagactgagaatgctatccttatcaaaattccagtggcatttttcacagaaataggaaaactatcctaacatgtatatggaaccacaaacaccctgaatagccaaagcaacgttgagcaaaaagaacaaagctgggaccaggcgtggtggctcatgcctgtaatcctagcactttaggaggccaaggtgggaagatcacctgaggtcaggagttcaagaccagcctggccaatatggcacaaccccatctctactaaaaatacaaaaattagccaggcacagtgacaggcacctgtaatcccagctactcaggaggctaaggcaggagaataacttgaacctgggatatggagcttgtggtgagccaagatcatgccactgcactgtagcctgggcaacagagtgagactccatctcaaaaaaaaaaaaaaaaaaaaaaaaaagaacaaagctggagtcaccacactgcctgatttccaaatacactacaaagatataataatcaaaacagcatggtgctggcataaaaacagacatgtagaccaaatagaacagaatagagaggccaaaaataaatccacacatttatattcagctgatctgcaacaaagctgccaagaacataacacagggaagggacagtctcttcaataaatggtattgagaaaactggatatccacatgcagaaaaatgaaactgggccttatctcacaacatacaaaagtcaactcagaatggattgaagatttaaatataagagttggaactgtaaaactgctagaagaaaacataggggaaaactacgtgacattggcctaggtagttttgttgttgttgttgttgtttttgatataacccaaaaggcacaggcaacaaaagcaaaactagataaatgggattatatcaaactaaaaagcttctgtacagcaaaggaaataatcaatagagtgaagagataacctacggaatggaagaaaatatttgcaaaccaaaaatcctatgagttaatatacaaaatatataaggaactcaaacaatttgatagcaagaaaacaaataacccaatttaaaaatgggcaaaggatctgaatagacatttctcaaaagaagacatacagatggcaaacaggtacatgaaaaaatggtcagcatcagtaatcatcaaggagatgcaaattaaaaccatgatgagatatctcttcacacctattagaatggctaatatcaaaatgacaaaagatagcaagtgatgtggtttggctgtgtccccacccaaatctcatcttgaattttaatctccataatccccacatgtctagggagagacctggtgggaggtgattggatcacaggggtggttaccctcatgcagttctcatgatagtgagtgagttctcacgagatctgatggctttataaggggctcttcctccttagctcctcactccctctctctcacctgccaccatgtaaggtgtatctcttccacttctgccatgactgtaagtttcctgaggcctccccagccatgcagaactgtgagtactttatacattacccagtctcaggtagtatctttatagcagtgtgagaatgaactaatatagcaagtgtttgtaaggatgtggaaaaagaggacccttacgcactgttagtgggagtgtaaattagtacagccattatggaaaacagtatggaggttcctcaaaacgttaaaaatagagatactgtgtaatccagcaatcccacttctgggtatatagatgcaaaggaaattaaatcagtatgttgaagagatactgcactttcattttcattgcagcattattcacagtagccaagacatggaatcaacctaagtgtccatcagtcgacgaatggataaagaaaatgtggtacatatacacaatggaatactattcagcctttaaaaagaaggaaattggctgtgcacagtggctcatgcctgtaatcctagcactttgagaggctgaggcaggaggatcacttgagtgcaggagtttcagaccagcctgggcaacacagcaagaccctgtctctaccaaaaaaacaaaataaaaagaaggaaatcctctcattttcgacaacatgaataaacctggaggacattatgctaagtgaaatataccagtcacataaagacaaaaactgcgtgatctcactcatatgtggaatctaaagtcaaattcatagaagcagagagtagaacggtgtttagcaggagcctggggaaggaaagcggattgggagatgttggttaaaaggcacaaagttttgatgagacaggatgaatgagttctggagatccactgcagtctggtgacgctggttaataataatgtatatttgaaaattgctaagggagtaggtcttaaatgttctcaccacaaaaacatgagaagcatgtgaggtgatggatatgctaataagcttgatgtaatcatcccacagggtatggcgtacatgtgttgaaacatcacattgcggactgtaaatgtatatagtttttatttgtcagttaggccttaataacgctggaggtgggaagaaagaggaagaaacggctgggcaggagaggttagactgcctggaggaggtcccaggcaatctccacttgaggccaaggggctggggctctgtgcctatacattagccagcccatgcaggctgctggaggaaggggtaaccttgagtgaagcagctcctgtctgaggcagagggcaattcccagggtgagacccagccatcggtggctcacatcccagtgcctggggagaacctgttctctaggagggttggggcagtactcagcagcagcctccaccgtgacccatgatgtagtaaaggataaactccaaaaatgtttgaaagtgtttgcatcattgatgtctattttaattaaaagagccaatgggattaaaaatcatggtaaactgatcctttgtagttcataagtgtgatgagtaggatttcacactcatgtgtgagatatgcctccctcaaaccttataaatgatgatggtacgttaaaaaaaataatggtaaaccacataagattccacgggaatttttgtggcatgtaaaaacatgacttcctgcttgtattaggccattcttgcattgctataaggaaatacctgaggctgggtaatttttaagagatttaattgactcccagttctgcaggctgtacaggaagcattgtgctgccatctgcttcccaggaggcctcgggaagcttctactcacgatagagggcgaagtaggagcacgcacatcacaagatgaaagcaggaacaagagggaggtgggaggtaaggtgccacgtacttaacaaccagacctcaccagtactcactcactagggcagggatggcacccagccatgaggcatccaccccatgaccaaagcacacctcccaccaggcctcgcctccaacactggggattccatttcaacacaacatttgagcgcgatcagatattcaaactatagcactgctgttctaatgagttagaagttgaagatgcaccaatatatgtaacggaaagataacgagaggactgtaagccattcccatgggtgtgccgtccttcatgaaggagcagagccagcagcctacccatcgttacaggacttgcactgagccaggtcagcaggagcagaaacagctttatactgatggggactacaaagctttaacacccaggtccagcaaacattcacccttacacccagaccctcatacacgtttgcaagactggacaagataggtctgcctgttccattgagacgaactgccctccctgtggcgagaatgaaacccacaacttgggtgttattagcacagcctctcatcaaattgacaccaccagccataggttatgataataagaaaataaggcaaatgcagctaagctgatatgtccaagtcgaaaaaactaatttcagcttagaaaaacagcacactaatgaagcttttaaaaattaacttgtgattaaagatcatacagacaggcagtgttggtgaaaaaccacaatgaacatcaaaacaagcatgagttcagagtctggaaatgtatccagaaggttattgtttttaaatatacagagaagacacatatatttgtttcctgtttaagatatatatgtatattagaaaacaagaaaattatttttttttcaatctaccactaatcagtgtgacaaaaatccatgaccctccaggaatttgaccagctctccaggcaatggattcttcaaatgagagcaagttgaagtacttgtggtatcagaagatgtagtcagagtccctgagcccagagggtgttcttaatctacgcctgaaaatgattgaaatggacatcagtggaggcagataagctttggaaatctttaagcaggcaaaaaaaaaaaaaaaaaaaaaaaaaaatggaataagtaaacctagaagagtacctggcacacagcggaggctcaacatgtgctggattaattcattaattcattcaaaattatgctggcggtcagtttatgacaaatagattaagatagtgcacgggtgcacggccattagagtatgattagtaaaccaactttataccaaagaattcctttttatggaaaaagtacagtcacttttttaaaactttcggcaatactgcagaagtaaaggaacgatggtgaacgatcatgattatttttgtaacatttcccaaagtaaaaatttcagctgaaaataaaaagaaacctttataaattggaataaatgcagactggagtgattctctagcacagtgaccaacatttggacacatcacataagtcttaaaggtcgcagaatgagtctagttatatatgtttttccattccagacagcttgaaatttactgtctaattcaaaagtccaaaactataaaactcctgaaaataatctttccaaatgaccagtttactttctccctggacctgaaaataggatggaagggaagtctaattctgagaaagtagaatctccttctgatgttttgtttataaaaatagtaaacattttactgaaccagaaagggctaaatttcatatctcaatttaaaagtatttgcaggccaggcatagtggctcatacctgtagtcccaatgctctgggaggctgaggcaagaggatcacttgagtccaggagttcaagaccagcctagtcaacatagtgagacccccgtctctacagaaaagtaaccaggggagaggtggtgcacacctatggcactcagggggctggggcaggaggatcactttgagcccaggagttagaggctgcagtgagcaataatcgtgccacagcactccagcctgggtgacagagtgagacctctgccttctgcctctaaaaaagacaaaaccaccaccaccaccacaacaaaaaatccagtatttgtgatccctttcaaagcactgattcttctgcttctcagagcactcagattgcatctgatctttgcttgccagaatcatcattttatggtttagcaaggagttgtctgcaggctttgctccagtaatggttccaaagacattcagccacagcttgaataacctgcacctgagcacaaatgtggcattcgtagtcaagcaccatcgttccccttcagttagttagtctcgtgacttttttaagtagtaattccacacctgtcaaatgctgttggaagagacccttgaatagttctaggagaaccctcctctgggaagaaatttgggacagaagaatttttcttaagaaggaagaaaagatggatgaggaaagcgctgacttcctctcatgaggaccaacaggctccacaattcctttagcggcagttgtcagcaagatgcccagaactgtctccaggcgacagcagaggtcaatttcaggtccacagagtcccactaacctcctataatttagaacctaattcaattgtaacctgatggtgaaattattcaacagtttgcttctgggcattgaaataaataataaaaaacagcaaatttaatactgccattgttgacattctctacagtggcatcagaaacgcctcaaagtcctatttacttccaagtggccatcttcatagtacattgtcctttgtgaaagctctttgcaaagagaatgtacgtctatatatgtaacatttgcaccatgcattacagtttttaaagagcttagcaaatatgaatcttctttactacacagcactcctttaagataaagcattcaataaccaatttttaatctcttcattgtagcacaggtaactgtgtccttatgttaggaaattatgccccttagaataccagttattccaatttatcagcctaaaatgtatatggagtacttactgtaagtctacatgcatagaattttttagtgtaataaaatattcactatttaatggacaaaacatccgaaagagatcctactttctcagaattagacttccctttcctcctcctattttaagttccagggagaaaataaactagttatctggaaagcttatacttagtggagttttatagtttcgacttttgaatagacattaaatttcatgccatctagaatggaaaaacatatataactagactcattccacggcctttaagacttatttgacgtgtccaaatgtgtccaactatgtgtctatatgtctgtttattgctgatggaaacagcaacagtaattcaccttcaaaatccctaaaacgtggttgaataaacaaatgaagaacgcaggatggtgtgtaatgccgaactgctgtaggtgcagagttagggagggaaaaacccggaaggttatcagagcctccaacattcagaaaagacttcctggaggagagaggccttcaattaggcctcgaaggacagtatttggagagagaggaggaggtaggtaaggtgtccctgccagtaattacagcctcgtgaaagaagcctgcgggacagaaatgaatatggtattgagatggcagaggagagaggtcaagggtgccacaatcttcaggcacaactaagaagatccctgcaaaggcaacggctcctctgggccagcagagaaagtggagaccccaaacaggggctctcaagataggatggggctgcggctgggagcggcaccacctttgggaggctggcaaggtgggcaggcccacgggggagccgtggcttgctggctggggtttctcctgccagcagcactggcgtcctccaaaattgcttcctgcggcttttctatttctcttaacttcatccactgtcttttcttatgtcctgtgacccactcactgccatgccactgaaaatgctgttagaacaagaaaacagtagtctgtgtcatgttaatcacatcctgctcgaacatggccagagttccctgcccataccctttataaagcagtggacagtccccagatgggcttgctggaagtctgcaccggcgctgcatgcaggagagccccgggctgctctgaccacagtgacatgccgggttgtcacaccctgcacggatgcagacaattccatacagatggatcagcaactttgcaggtcttcacaactatgagcccagatccgctgagccaggatgcctcagcaaaaggtgacttcacatagggtggcttgaaaaggcaagcaatcctggctgactgcatgccttccccaggaccagcacccaccaggtgactccttttaccctcaacaaactccatctgccagtcagagccccttatccatgagcttgcatagtttcagaatcactctcaacaagcagagatccatttgcctctctgaggtgggaccatacaggtgcaagagcctctccagaccactggctgcaggttggccatgataaacagcctcacccaagaatgctgagcacgcagttactgtaggtaaacaagtcccggcttcactctcagctggagctggcactacgttggtatttatgtaatgctgcattggcagatatttcatctgcagtatatgttgaaatggacagataattatttagaacaaataaaataagctacttctgaagatgacttgaagtgggcactgacttgctgggactctcaggccagcctctaccacccaaggcagctctctacagaacacaaaggtccagcctagaagggagtggctgaggtgagtgcctcaggacaagccaacacagtgatgttcattccaggaatatttatgatgaagagaacccaggagagctgaagattagcgtcacactcttataatagagaagagttcacctgcaccaggtgccgtgtcccgctggggcctggctactccagaggctcctccgctgctgcaatgtgcccgagccccaacctgcaagtcctcctggtagagtagctcttagctccagcctgcgtgtcagaccaacgcccacactttgtccacttcttactttgtttagtaagaagggaagggaaaaggaagaaaaagaggaaaggaggaacaaaggaagaggagaaggaagaaggcagtgcagtaagggaagggaaaggtgggaaggtgtggaaataagaagcagagatgagaaggggcagaggaaggtggctctgtggtcctggccttgttcatggcaaaacacacttatactttgagggtgttccgcttccctaaggcacaccggggaaggtcaacaggttcctgtggaccagcgagaagaggagccctgttcaggaacagcaggcaataggaagagacaaaagtgattgattccctgaggtgccagagcaggaagaacagtccaggcatggcctgagagcagagcaaggtaaagagcacgcctcacctaccccccagctcacgctcccaggaggaggccctggccctgcacagccagcccctccacccctcctccaggagcctccacccccgaaaccagccctcagccctctcccaactctgctcctccagctgaaatactgcccctcacaccagggccgcatccctctgggactacagctggagtggccctgccagtgtagcaaagggcatctctggggaggagatggtctcagcaacttcaaacacattttctgttaagttttctcttgtattgtgatgttacagaacacgctcagcaggaatttgtcccccaagaagtattctttgctgcaatccatcttcaattcacaatgggaataacctgctcactatcctttgtatttttctcacctactttcatgttttctacatctctgttaggagatttaaattatttagggacaaagctgaaggtgtgtgaatggatggatgaagagatggctgaactgattgatgaacaaaaagttcacctgccagtaaaaacagaggaatggagtagaatgcaggaggccggaggctgcaggggcattttacagttgacctagatggtaatttggagagagagggagagaaatgacaccagccttgaacttgagagatgccattttctaaattaccctgtgtggctaaatgacttttgcatgctagcccaaagaaataactgccatgcatttcactgtgtgagaaaacatattatgagttcaagaaaataagaggaaacattttaacatcaagatgggaagggataaagacagtccaagaggccgtggagggggcaggatacagctgtccacatgagaaatggcagtgacttctttgtgttaggggcagaggagatggagaaaatggaaatatttgaaaaatattgaagacatataaaggacaggtcttaataacacagaattgtgagtgaggaagtaggatgagtaaaagataacttctggatttctgttctgaaaacaaaattctggaaggggaaatggaatgaggagcacgtttgtagggaaggagggaaattgtaagttgcactgtccttcattgttaagatttcaccaaatgagagacattcaaatagaaatattccctaaataataagacattttgtcttggggctcaataagaaatgcctggtgggaagtaatagattttattcagccatttaagagtgttcaggtcttgggggataactatcatcattaaaggaagagtactcttgtcattaatgatggagatggtccatagaaagtgacacagagcagggacagaagatgatctagggtgcagttctgagtctcaccctctgctatagtttgggtatggtttggatatagcttgtttggcgctgccaagtctcatgttgaaatttgatctgcaatgtttgaagtgaggcctggtgggagggtcatggggggtgcagatccctcaggaatggcttggtgccattctcaggggagtgacttctcatgggagtgggtgagttctcactcttagttcctgcagaaactggttgttgaaaagaacctggcagctcctcctctcttgcttcctctctggccatgtgatctctgcacacaccagctccccttcgtcttccacaataaatggaagcttcctgaagccctcaccagaagcagatgctggtgccatgtttcttgtatggcctgcagagccatgagccaagataaacctcttttccttaaaaattatccagcctcggcattcctttatagcagccccaacagactaaaacacctacatttaagggacagacggctcccaaaggagaccaagcagatgtagccacagatgcaggtcaaaaaccacaggagtttacttctatgggcaccaaaagaagaatgtgtttaaacaaagagagcagagtcaaaaatttctcttggaggcaaagtaaaataaaggctgaaaaatgtccattgaactgagcaacaatgctgtcttgggtaaagcagttttcatatagaggtaaaacagaagccagattataatgggtaaaaaaataaatgagagttgaggaagagagcaagtacaggcaactctttttaaaaagttgattttgacgaaggaaagtggggccaaatgttggtaacgttttgggttagacagagacttgctagttttaagacgaaaagacacgactatgtttaaatgaagaaagatatgagctccatgaaactgaaggtacaaaaaagaaaggctataatctattgtacaagggccctgaggaggtgggaagacatagcggaagaatttgcctgaaatgagaaggggctcacctcttccatcgtaagccggctgaatgggagttgtgggcatgactcgagcagttcagacgcaccacatttcctgctgctctctaatatccccaaacctgtcatatttccccttttgcatgtgacagtctaatgataatcctgaagcatatacagatatatttcttctccattgataaagcatcatataatcttctggagacacaggctccattaaaataatttctcaatttccccattgtacgtaactgccttccatgaagcttgccactaaaatgtcacttgactgagaggaggtggtgttggtgactagaaaatgtatgtcttgagagcatggtgttcttttacttgtggaatatgaaatatctgcttccaaattcctcaaggtccttctccttggagaaggggttttcctcttgccagatcatgccattcatcccctgtgttaatgtctatagactagcaaggaaatgtgcctaaattcaacagcttgccagcacctaagagaaattatcagaaatattgtccacttcctcttatacatttctctctggaaaattttttcaatttcacaaggttttatcatctatattatagggatttgtttttaattcttcacaatttccttacactcctccaaaggaatctttaacaagtacagttctctttttcaattctgcccttggtgagtcaatttatagtgtggtttgatattttattattgtcaaatattgcttataagagagaggctttggtttggtaacaactaaacactaaaaaagaaaggaaaaaagttgttttttttgtttgtttttgtttttttaaagagaggctttgggaaaactggcaaactttctgctcttccaaaggttacttgttatatgactgatctccaagcatttatttatctgaaaaaatctgtttgtgattctgcctatgtcagggcagcaatggctacaagatactttgaaagatggtgggatatgccacacagggtatggcataccctgtatgaacctcagggtaaatcatgttaaatagaactgttctcctcccatctgccaaagcacatttatttttcttcaaaccaaaatgtagtttgacctccaggtaggtttcctaaacaaccctgcccttctccattcctcctagtgccaccttgagctggccttcttctgaatactctttcatttattggtaattgtgactcacttatgtatacttatgctttgctagcttctttccccctttggaaattaatctcagcagaaactgagttgaatctcttctacgtattcctaagcatagctgtcctttgagcactccataaatatttgtctactgactggttgaagatttagtctcacacaagtgcagatgaacttcatctcattttagaactctgatgggaaatatgactgtgttacacaagattccgggtcttttcctaccctcgggtgaataaagagccataatcaattacaaatgtctgctatgggactgaaaagatggcaagaagaggtggagactgtgccgctgtaccaagagtttgccacttcgttttagtggggcattgaatggttgattgtattagtccgttttcacactgctataaagaactacctgagactgggtaatttataaagaaaaaaggtttaattgactcatagttctgcaggctgtacaggaggcatggctggggaggcctcaggaaacttacaatcatggcaaaagctgaaggagaagccagctcatcttacatggcttgagcaggagggagagagcaaagggggaagtgctacacacttttacaacaaccagacctcatgagaactcactatcatgagaacagcaaggggaaagttccgcccccatgatccaatcaccttccactaggcccctttcccaacattggggattacaattcaacacgagatttgactggggacacagagccaaactatatcattgatggtttgatacaggcttttgagatacgtaatgtgtagatatttcctttaattacttagcatgatgaatttcatcaaacctaaatatatatcagtggtttgattggctagttggtgggtggggtttttttggcagggggtgggtttaccctccatttctttagtctgacagtataacttttggtcacgtgattgttccataaaatatattgggattgcatacatcctaatttgcagtaattttattttcttgatagacacagtcttctgtaaatggatttttatcttagcaagtattttttatatacatattttctaccaacatagctaatttgactagatgttattaaatagggagaaaatctagctctagttcatgttttctcttgcttaaggaaaacaaaaatgctcaacttttgttgaaaatgaatgtaaggccaacggtaacattattcaaaatataataatgtcctttttaagataaagtaaattggagttgtctctttgtcaccccagttactgtctctaaggccacatttctgttctcataagataggttatatgaaaagaaattgaagcaccataaattacattagtgtaaggtcacaaattaatcactttataacctattttctcttgaaaactctttctttatagaagttctaccagaaaatggctcacactattgaacttaataggttattactacatgttttgctcagtattctaagccaagtcatcaggaaaagattatagttaccagttcccattgtcctgtttgacatcaatgaaaagatgctttacttatattttcatgtgttatttatcctgtcagaagatatatccattttatatgcagctaaagttcctggggcttttcattaatcaactaaacacaggatgtgcttgaaggaagagctgtggaagggagtattgccccactgtggaagggagtgttgccaaacccttttagtaaaactgaaattatattttcttggttaactgaaaaagaaaatgttaatgatggtgtggactagcatcagaattaattttactctacaattgaatttatggtcaaagtgtcatattcctattatttaagaatgttttgtattatatcttaaataaaatttattagctgaataaatatttatatgcatgatataatggaataaaagagggagcaatggagactttatttcaataagtgagttttatatacaacagtaaataattaaatccaattgattccagaactcataaggcacttcttttataaggataagtgcagtattggtgttagattgagtctataacttataacagtatcatacttgggaggaagaatttgaatagaagggcagaacagaatttgaatctagttcaaatgagagaaaatctttgtaaagtgctggcataatgaaggaagaagtgatttgacattggcatagattctctctgctgtcaaagatctgaagaagtcgtttcatcccactgccccacatggggcattttagccagttgactgctggtggtctcagacaaagaaggaacacgttcaacaccaccatcaaggactttcgtagtcttgattcttagactttgaataactcttctttgagttctattaacattcatctttatttttctcagtattgtagaatagaatgtttagacttcccagaatatttttttctcatgtaaaaggctcaaaaaaatggtgtctcttctgtatttctatcagtcactctttcttctttgtccttcatacttgagttaatccatctcatgcttcaacctcacttttggcgtgtaatcacccatgttgttttgctatctctgatgatggaagtgagtttggtggaagcaaagatggcatttgtctgtgtctatatccccaactactgacctagtggtcagcacttagcatgtggtaaaagcttgtgaaagaagcgtttcaaagtttagttccaaatcccatcacctcgataaattactgaacaaggcacttattctttttgaatatttttctcatttataaaatgaggctaatgatatcttctctctgggttttcatgacaagcaaaataatgattgagagatttgtaccatgtaagatatgattatttttctaaccttcaactggaggaaattctgtcaacacacggttttaagtttccaagtagtatatttctgtgcattctgttggcattcaatacttactgcccactgaaatgagtcttcttcttttatcataatattcttaagatgcttgcctggcgtcttggtttcaaggaccacctctataagagactccacaatctacacttcaacacttgatcatttacctctgcccagaatcatgtctgtaagaattagctccatcagaatttcgtccaggagtccctaggtggacaccttgctgcttctccctgctacaactcaatctctccaagtgcaacccctgtccttcttaacatcacctgatggtgtgggcacagctggctgttcattgcccctcctgctcccacggctgccccaacccctacacacacccacaccccccacccctacacacacacgcacactcccacatacacacacacgcacactcccacatacacacacactcacactcccacatgcacacacactcacacctccacccccacacacacacacactcacacattcacactcccactcccacccctacttctacacacactcacatacacacacactctcacactcccaccccgacatacacacactctgacacacactcacactgtcacacgctcatacttccatccataacacactcacactcccaccccccccacacactcacactcccatcgtcacatacacatacacacacactcacacccccatgcccacatacacatacacacaccctcacccctacttctacagacacatacacacacactcacacctccacccccccacacacactcacacacacaactgacgctggctcgcgcacatgctattcccagagctctgcttccgagacggtggtggctccccggggccgcacctgtgcctccgccgggcctgtggggtgagtgggatgctaacgcctggccttggagagagatgtctgggaggaggagggggggacgtgcaagggacgattggggggtgcattaagaaagaaacccatggaatatgaaagctgtgacggggacagaaaatttaagaaaaagcagaaattttgtttaaagatttagggaaagtgtggctgtttaagagacaagctctgtactcccgtcctcgtgaagacttccataaaatctatactatttaaagctgcttttggtgttgagtgttggagtctgtgagtacagggtgaggtcacggggtccaatggtcgccttgcctgacgccctgtggggtgactcccacctccttggtcccctcctcctcaaccacctggctgggagagggctcgtaccctcctgctttgggctgcgttctcactttcacccagacctcacgctcctaaacacctccttggatttgggcacatacgcggtggggcctcttcagctgtagagtcattaaccctaaactccttgttcatggaatcaacagccgactgtgccgtcctcaccctcggggcgctgccctgtggagggaacgtggtccattccggagcgcagctctgcccatgtttgcccggtgacctcgaccagtatcccccctcaagtaaacgagggctgcatcaggcttccctcctcgcccgtagcaaggggcttgcccttttgcttctgcaccataaaagcactcatgttccagaaagacttctcataacatctgcttgaaattttactccccaaaatcggacttttcttactaatttctaattcttctcaaaaggcaactcaagtctatgtgacatatttatctgccaatctttctccaattcttaatgtaaattatacagaaaattggtatttgatatttttcggcatgtttcctagtgaaagataagattttatataccatgtaaatttcattacctgagagaggggaagaaaaaaggtgaaaggtactgctgaacctgtacactgcaacagtttaatttaaatttatgatatgctgtcattggggaaaaaatcagtaaaatatctgaatgttcacttaacatattttcaacaaaatctcatttttttctcctcaagtctttatttgatttacacaccaagaaaagcagaaaggatggcaggttcaattacaaagctaagtcttgaactttatgttcatttcgcttttaacaggtgtgtgtatgtaatacgcagcccttccgtgatcatctgacctggccctcttgggagatgtggcccaggctccaggagccctcataccctgcactgtttttacacgatacatgcctggggaccagggttttggaaaaaggacctggagggctgagctggcagctgaaaaggcagggtaccaggagccacccctcaatgggctagggctagggacagagctgggagccactctacagtttggtctgggtagatgtggggggtgatctgagttgaggtacatgtttatagcttttgaatggagaaggtaggaggttgatttctggcaaccagttgagaaccatgaagcgggtgtgtagaaggcaaaaggggaaaaccaggtgaatgagaggccatggtaaacccaaagggggggcacgggctggggatggaacagatgaatccattctaatgccaagtccagcccccgtctggcattcctgacattcatacccatttgtgagtaaatctggcagaaaagaaagtgaagggggagacgtgagggtgggctcagactcaaaaacagtcatgtcactgcctaattgcttttatccaagttaaaacaatttttttaaaccaatgatgttagctgaggcaaagctctttaaaagaaaaaaagatttttttaaacttattgagctataatttgttactgttttcatccatgcaacaaaaaacttgggatcaaacattagaaaattaaattaggttcatgcacaaccaaagatcttttctcttgccctatggacctactgagtcgaaattccattttccgtctcctcacagcatttcagagaaatgattatcatctgatgaattgcactaaaagcaaatcactaacagatagatcagcaccattcttctattaattaatgccactgtgtgttgtgtatgtaacaaatgcaaattatcgcatagggcaacattgattttcttttccatgcattcctcagtacaattcaaatgtgttttggaaactgccctggactgggagattgcaatcattgtagcattttcctcttgatttataaggctcaattatctttctttggttgtatgaaatgtcttttctaataaaagagccaaaaagtgagagacagcatttctagcaccaggcacagaagggtgatgggataatatcaaatttcctatggtttagcaaacattgacaaataggggaaattaggattgctcatccaatatgttttggcctcaaaggattcagctaataaagtaactagaaaaattaaatatgtgtaagccacagcacctttagaatacttcacagattaccgagttgtgtcatttatggcaatgaatgtttccaggctgcaagcaaaaaatttatttttcactttacttgaaaagaagatgatgcctccaaatatcacagggaattgtttcttttgtgtccaaatgagttgagatctaaaccaacatttaaatgggcttcaatcatgaattgcaaaatgcagttgaaatgaatattgttttgctgatagtttagtctgaaagcaattgtctttttccctacagatacagtgcctccttcattaagtgacttttagttattttttcataacaggccattatttgtttgaacaaataaattaacctggggagaccaaccatgacccgcattggacttttctgcctgtaagcaaggcgtggtccaggagtcataggttacgtgatgtatcactggctggtgccactgattccactctgagtactgaagctgtgggcctgctattaaacaaatgtcccgaacacccaagtctccctgggcccccagctggctgttgctgacagtgccacacagtcactgtgaggacagaagttccacggggaaaggggaggggcatgtgcctggcaccaagttatgccttcagtagaaatgtgtccagcgtgtgaatgttcacgtacactctgtgtttgtgttgcccagtggtacccaagcgtatgcctgcacccccaacaagcttcttggggttttcattaaggacatttccaagctcccaagtcacttcctgtgtgtgtcagaagtggctcttttcatttccaagactgtgtagctggttggcatctacttgtacctacacgcccacacacacagcaggagccgcgggatggtggaccacccctcagctcctcctctctgggtcctcagtcaccacctaacccaccccagtggtctcctccaggttctggtcctgtctgtccatccgctgaaaaactgaagatgcttagagtctaaaaaacttgagtgaaaccctgaaacactaacctgatggaaatttattatctaatttagaagagaagcaagtgtcttaattgtctccttgttttaaccaacagaagagatttcacctgggtctccaaggcccagctgctgagacttagtaactgaggctaagaagctatctcaccctggttaaataaacagggtccgtgattgatggtgtctgtacaaaaacgaaatgtagtcaaacagagtaagcagagactgagcaagcatttactaacatgtgggcatctgacaaagcattcttacatttgtagtctttaatttgacacagagattttgtctgtaatgtctttggccacttttgtgtgttcattcagtgattcacaaagacgaataatttcagtgccatgtgtgattgtatttcaaacaaaactgagtgtcctaatctggaatatagtctccatttcattttgtaggacaagatagagcagtttgtttcataccattcatttaaatcattttttttcctaaaagaaaagctttcttaagtctctttcttaattccttcatttgcattcagtttgggtggagctgattgatgacgtgtttccgtgtgagcttcatcgaggatctgtgcttgaatcatctagtattttctgtaaggtcgggccaaggagacctaacgtgtgctaaactttacaagcacattttagacactgaaaatacactgccgtgccttgcaattgcacaaatcatttaagagcccctctgtcatgggaataagctgcctccctttgtcatgcactgtgttctgtattttcgaaaggaaggcccagcactgaccatatttcctcctacaaggccccagcccatcagcacaagagctcgtgaggctgaactcaagccccggagatcaaaagtcccatactgtggaagctttaagtatctcattcaggattccatgaaacattgcttcatttctcaatacgtctgtcctccgaaggcaccaactcattcagttgctaaactaattcttcattttcatgtaatcttttgggagaataaaagtgagcagtactaaaatgaaagtgttttttaaacaataatggtgccagaacatgagatttttaaccttggcaaacaaagtattttagccactaaaaaattgcagagctgtaagaaattgctgaaaacttcaatagagaaaaattaattccccgttatgcttctctttttagtaacccatcgacaaagaagtgaattgtcctccatgttagcgaagtggggaggtccagacttgctccttgtctttctaccattttctaccatcattgtatgtaaaagtctaatcttcattttaagtcagtttatgcttcccagactaaactctgcaacaaataatatgaatgtcacacatttcatcatttgtaattaattccaaactaaataaaacaaggagttgtgaaagttgtttttcccctaggatgttctacgtacatttagtaatagtttattatggctttatcttttaaagtctactttcgcggcactttttaacttaattctgttaaactactcttggaaactatcgattctataaactatgccattttcagagacataaaattttgtgcctgaattataattatagcctaaagccaaatataatttagcacattatcagactgggggtatttttaatactaatcagggaggaccctcactaaatatggctttgttcattcaaaaatcgcacagagccggcgtctccgtgacaggtttggagagccgcacgttaatatggttagttctaagtcagccattaaggaaacagaatggatcacggggttcatagagatggagcctcagtcctcttctcctatttatctgcattcattcccttggccatctcaaattcagcctcacagttttcaacaccgtctctgcactgatggttccctcatttgacacccctctccccaccacacactctgagcttctaactcctgtgtccgacttcctaatcagccgctgtgcttggatgtccagtaggccttttaaactgaaggcgctcaagacaactcttgactcggtctccgggcattttctgcccctactcaggtctttggccacctaactacatgggaccactatctatgatttaccaagaaccgtaaagttatcttgaagtcctcattccttcacctttacctcctacctccaaattctgcagcagcaaagcactgctctactccatggtcttcatgaatctgctcacccctcagcgcctccacctctgcctcttgcctggattgctgcaacggcttctaaaaagtccctctgcttccgggacagcccatcgtccactcagtagccagaatggtctttctcaaagttcaatgagattttgtcactcccttgcttaacatcctccaatgatattccatgacgcttagaatcaatgtcagtgcccttacctttgcatataagaggtaacatcacctcaccctatgtatctccctgaccccatctcatctctttcttgtttgatattctccagttgcatcagaagtcttgctgctcttccagcacaccaagattgatgctgcctcagggcctttgcaccagctccttcttctgcctggacactctcgccctggttctgcgcatggctcctttctcctttttgtttggattgctgctcaaattgtgcctccacatggaggctttctaagtgatccagacctacaggctcaggcacactctatcccctcactctgttttcttcttcataatatttacaaccatctgaaatatgtaatgtttacatagccgtttgcttaatacctgtaagattccaccaactagagaggcagcatgtgagaacaggggctctgtctcactccgtgtcagctgcctcttgcccagagggtgctcagtaagcatttctgatgattatgtgacgttagaagccatcacttacatacaaattttctcattccttgttcaacatttacacatatttattttttcacaaaggatttgaaacagctttaggcaaaaacaaatacaatgaaagtcaaaaatagaaaacctagcaccaaggaaaaaaatacaggagaaaagaaaaacccaaagcaaggtggccagttacaacattatcatgagaaagtaggaaagcacagagtatactgtgctttaacagaataagacttttcctaagataaaattctaagtgaaggtcacacagtacagggcaatgtcctcagcagtatttgtaaagcaaatgcagtgggccttttcaaatggctgtttctttgatcatggccaagggcccaaaagaaaatgcagtataatgaagggggatcattaaggggctgagttcatacgctccaagaatagagtgctctggtatccttacttgaaccaagaaatgacttccattctagaaggtttacctaataacataaccagcattttttattgctaagaattaaagggagtttcataattcaatgaaaataaagcattaaagaaatgctagtgtaaatatgtgtccactcatattgctctagctagaaaccctcaatctgccacaggcctgccacagccctggaggagcgctccttatgctccttctgtgaatgttctcccatatgtttcctactcccttagaaaaataggtattattattattaaaagcattaagagatattaagaattgcaatgtgctttatattatgtagtttatcttctaaaaaattaaaatgcaaaattgtcatcatgatggatcttctgtcacatatagattgtgaagttcaggagttggtattgagcagaacctgcttctaacaatattgagcattcctttgaccacagtttgatgaggtcccaggagcacgctctatttttaaaagcattacttaaaaagcactcctggaaagtcttcagtgagcctcaggtcaaagctgcagtcatttctattaggacccccctccataacaaacaatctttaacagacaccaagaagcctgctgttaacacaacctcctacttcaccgtctacctgccactgtcccatctcatcagtaaacaagcagctatttgtctctttccgttaaaagcacctacccccaacttcaatcagattaagaaaaattcttttctactttttccctgtgaagttggtttttattctatgtattaaaaccagggtcctttgaaagatacacttctgtaacattggcacggtagagacacaactgcatgttgacgaagtatataacctctccttccagcaacaccacagacttccaggtaaagccaaagactcgttttcctatgctgcaaagccatctccaagaaaatgctacctccatgccccactgaatggcaacaagggtcatcaatattttgcaaagggcaaatagagaatggcaagaaagagacacacagtgccaggcggagaggttgttgaatgttgcatgggtggggtgaggagcctgtcacaatcatgtgccccgcaagaaagattcccttctttgtttcattcagctgtcgctgagaatcaaagaatgcattagtaattgctattgtttgtagcatttcttgtggttcatagccagatgaccatcctttactgaaaagcttattgtgtggggattgctcagcaccctttcaagatatctagtgttggtttgcggggcaagaggggagtgcatattttatgcaaaaaaaaaaaaaaaagattttgtgctaccacattcctcaattattctaatattttccccaatagaaatatttcctcataatgcaaacacactattccgagaagcagaatacttttctggatctaagttgtctgatggtttctctgggtgatgtgctgcatggcaattgctttcccatgaagccacagaattcccaatttccaacaggagcccaaatctaatccaaaactctatttcacatctgacaactattaggttttctgatagccttgagtaagcaatgacatgtgcttctttctagaaaaagggcatgaccctctgtccacttaagacgaagctgagggaggccaaggcggccagatcacgaggtcaggagatcgggaccatcctggctaacatggtgaaaccccgtttctactaaaaaaaatacaaacaattagctgggcatggtggcaggcgtctgttgggacactactcgggaggctgaggcaggagaatggcgtgaacccgggaggcagaacttggagtgagccgagatcacgccactgcactccagcctgggcaagagagcgagactctgtctcaaaaaaaaaaaaaaaaaaaaaaagacaaagctgagaatctggtttgttcttaatgaaaccaatagaaagtcggtcacttaagttttcaatttatagtgctttcttagccataacagaatgagaaacatgttttgatcatgtctagtggcctgtacgctgaaacaaggatgcacgcaaagtctctgggtcaatattatgttgcctgtagagtggaggttgccctcaaactcaaatttctcactgcattccaacattatggaaatggcatggctaatcatttcaaaagatctgaaaatactaatacattttcaaacatagaaattgtccatttaaaaaaaaacatgcccattatccagcctttcaatatgattaaattcatttgttacatttatttgatttgtttggggccaaaatagccggctggcaagtgcatatcaccagtacaaaccttaagttatgaatatgactgaaaggtcccaagttaattctagttaagggcatgagcctttcagaagggggatcctgatgggccggaagtggagccaactctctcgcctcctgtgcctgcttacattcctggtttggagcaagttattagattccatgggacctagtggtctccgggtgctgtggagattgtgtcggatgccaggccacgaagacttagcaaccagcgaagtttctgtggtttcctggcagcagaagttgactgtgaagtgtgagtttgcttggatgacagggcacccggctccgtggtgaccggcttctgggttggcttctcagtgcaaactgaagtttgagtcagaaaaggctgttgtttaaattggagtgtcttttatgccaaaccaacatggatgctcctttgttctcaaaagggaagtgacgccagctggccagtctgaggctaagtatttgcacaaaggctgaccagatgacacacactccttgcccattgtggttcccaccgcagggaatgtccatggcaaactctctggaatgatcctctaggactgccactcttgtgaatagttggtggcattcttccaagtggtcataaggtgatagacacatttttctgatcatcacattgtccattgcaggaaacaacagttgcaccatttttgtaaatggtagctaatgaagcaacacaaagttctgataaaataagaacagaggtaacaaagcaacagactgccctcttaatggcgccaccaaaatgtgctgtaagattgaatttgcaccataaccattgaaaaataggaagtacaaaaccagagatatttttccttcccgctgattgcctggtcatgagacagactggaacagtgcttggctataaatttgttagcagctgaaatgctcgggggccccatgcaccggagttctgctcctccacactgcttctgcagaattaggagaaagcattgcattttactatcttttaaaattatgaatattggaaactttgctgaattcttttatcagttctaggagctttctggaggagtctgtaggtttttcaaggtaaacgatcatatcgtcagcaaacagtgacagtttgacttcctctttaccaatttggatgccctttatttctttaagaactagaagtagaactaccatttgatccagcaatcccactactgggtatctacccagagggaaaaaagtcactattagaaaaagatacttgcacaagcatgtttatagcagcacaattcacaatttatgtttatgtttatagcacaatttatatttattttatagcacaatttatatttatgtttatagcagcacaattcacaattgcaaaattgtggaaccaacccaaatgcccatcaatcaatgagtggataaagaaattgttgtatatatatatatatatatatatacactatggaatattactcagccataaaaaggaatgaattaacaccatttgcagtgacctggatgagactggagactaatattctaagtaaagtaactcaggaatggaaaaccaagcatcatatgttctcactgatacatgggagctaagctatgagaatgcaaaggcataagaatgatacagtggactctgggagcttagggggaagagtgggaggggtcagggataagagaatacatgttgggtgcagtgtatactgctcgggtgatgtgtgcatcagattctcacaaatcaccactaaagaacgtactcatgtaaccaaataccacctgtaccccataacttattgaaaaataaaatattaataataaaatttaaataaataaataaaattgtgcatattggaaaagaactgggatcatgcagcctttattgggaacttctgaaaccttatctctgcactttggaggtcgttgcacattcgatagtgatggagaacacgtcggggacttcccggaatgcaatgattatgtattttagtggatcttaaactggtttcccaatattcaatcataatctttggcagcctgagtggcagaaacatttgctttctatggggtcctgatttttagctaatattttgggaacactcttagtgtgtattaatcgtcctcttctttggccatagctcatgaggtcaacagtataagggatgagagtgaagatccctgttactcatccattctgtattgcgctgctcggacctccacaggagaagttagggcacgaaatccaagtggcagctcattattggcatgcaatgtaaaatacaaattccaggatgctcagacttccaggacatctgagatatagcctttggaaaataagaaatgggcttgcgatcatagttagttattactactgggggccgtggggcctgatttggggtctttatcatctactagctgagcgaccttgggtaaattgcttaacctttccatggttcttcaaatggaataataataatatcaactctgactgttacatggttcgatgtaatggatgaaggttgaaggagacaaggcacctgtatacctggtctaagccacagctaagcacggtgtctctgcacagtaaatcctcccgagctgtctggtgatcagtgttgccttttgtgttgcttatccacaccgcaaaacgctcccacgtgcgtttcctgcctgcctcacaattaccccacaagacgggtgcactgcatctcacagaggaggaagcagagccaagagacaggcctggtgcacgtgagggccgcagcccctgctgctgtgagcacgccctctgcacccactgaatattccccaagcatcgctgacgctcggccaggcgccggccttcgttcctaggctgtcatctctggacaaggcagacgcaggccctgccttcgtggagtttagatgagcagcaggggggcgacatcatcggggaaacaaatcactgcacgggtgattctgggatggtaactgctaggaagagaatccagtccaggcaggggccggagagggctgggtcccgtggctctgactgaggaggtgacgcttgaggtaggcgctgatgagagccccgctgtgaaggccagaggggcagtgctgcaggcggggctcaccgtgcagagtccgtgactgtcatctttccactcctaagttttggcttagggattgtgaactagatgctccagctttcaatttgtcaactggtttatctcctaacggacacctcaccagtgttttcctcacacattcacaaagacgcttttaacctgttggcaagaagcagatttaattggaaaagggtctgattcctaacagaacaaaagacaaagtatattacatgtagtgactacgttatactcttgtgcagtcgcttacaacttcaggctgggtcaccaaggagatggtgagtgagctttgaaactaaaagtaagcaaattctgactaagaatcatgtccagtgactgagtatgtgtgtgtgtttcttctccattgctgctttgacctattcagatgtcaagaactacaaagaaataagatgctaaagaaatcagaaaatctggccaggcatggtggctcgtacctgtaatcccagcactttgggaggctgaggcaggcagatcacttgaggccaggaggtcgagaccagcctggccaacgtggcgaaaccctgtctctactaagtaaaatacaaaaattagccaggcatggtggcgtgttcctataatcccagctactcgggaggctgaggcaggagaatcatttgaacccaggaggcagaggttgcagtgaggggagatcgcaccactgcactccagcgtgggtgagagagtgagactgtctcaaaaaaaaaaaaaaaaaaggaaagaaagaaagaaatcagaaaatgtaaaaaaatagatgagctcttgtgatatttctaagaaatataattctattaataaaatcgaattggttggaatccaaaggcattttaaagtttcagaacaaattaaactttttaaagtttcaggacacatgtctaaatgtctgtctatctaaaatttattttaggggtaggagggaaattggagattgtctatctaaaccttcttattttacaggagaggagactgaggcccaaagaatttagccatgttgtataagcttactcagccaggtggtggtcaaatctaccctagaaagaatgttccccatcacctggcccaaaaactgcactgtcagttttataaatagaatgcacgttatcaggaccagagtaatattagaagagattaagccacacaaaactatcttccctcaccaggtgcctccttgagcctgaaattccactcttggataatcattcttggggcacacatttccgagttggcctgctcctccaaaggacgtgctcccggccctgcagtcactgagtgccactggagcagggctcccagctctgagagggaggggcttagtgttcctggagacccctgacggggagccagggtggacggctgcagtggcaccccaagctcactggaagccttggggacaagggaggatccaggagaaagggacgggtgtagagcacagggcagaagcggagggccagccacttctcctgctaccaccagggccagccctgcctctgcatcttgggcatcgggacagcagcaatttcaacatagccctgagccaacttaaaatgcaacagcactttaaaaaaaatctcattcatcatgtaatatgtctgatcttaaaactgacatctgattttttaaggcagctgctctggaagaaattttctgtggatcgcaagagtctgaagccccatgaatgaccaaaaatatgcgcctgaaagagaaatgcgctgatgaagggggaggaggatgggaggggagactctgaaattgtttctcactttagggaagaggcacaacaataaaaaacatgaggccccattgaagtaggactttaaattccacccgaaaacaatcccaacaaacagatccattgttatatgttttgctacaagtaatagacaaagcaattgtgaaccaggacctgagccctcccgtcagcacatagtctgggttcttcagctcgcgagtgggctcagatggcctcagaaatgtagtttgctctcccctttaaggtcactgtccaggacgaggtgaggtaaacaagggttccaagtaagccatgtgttacccataattgatcaagggaagataacagccatgaggctgtcctggacccctgcccgtgcagcagggcagaaccattgccactctgcccagaaggtgccccctcctcactcccttctctcgtccaccccataggccagcaggatttgaaggaaggaaaacagttacagctgcaccactgggcttggcctgcactgtgctgatgtttttaaagcgtgggctgtaacagaagagatgatcttcagcctcactcttttcctggtgcctcctcagtatcttaacaccttctttttctaatcaactatttaattacacaagccacgggctttctacgtcaggttctcccttacacgtgaaaccgaggctcacgcagcacatgagaaacaacgtgttgccctgagaggttagcaagttaacctggacttagacccatcatcaaccaaagaacaagaaagacccaatgtccatggcaacatccagctagaatagcacctctccctaaaactggattttgcccggctgcagagttctgtgctgtctacatagaattgttggtgtcacctgggaggctcaggaaaggagagcccgaataaagaggaagaagaaactgcaatttaggtccccaagcccaggaccagcctgagagaccaacctggccaggcttggtgtcaaagggtactgcaaggatttccaggcaggcaggcaggtgacctgaatccaggtaccttcaatgtccaggaggtgactgacgggcagcagccactcaggtgtttgcatagaggcaactggacaccatcctgcaggccaagaggaggtctgtgcatggggcaagaatacaggctctgtctgagggtcaagcaggatggcaggttgtcaggcacagtcagcaggtgggcagccagggagaaagagacctgggccttgggggcgacccacccaatcacctgggaacaacaacaggtcctgattctttttcttcttcttgttctttttttttgaaacagagtttgagacagagccttgctctgtcacccaggctggagtgcaatggcatgatctcagctcactgtaacctctgcctcccgggttcaagcaactctcgtgccttagcctcccaagtagtgggactacaggcctgagccaccacacccagctaatttttgtatttttagtagagatggggttttaccatgttgtccaggttggtctcaaactcctggcctcaagtgatccacctgcctcggcctcccaaagtgctgggtttacaggtgtgagccaccatgtccagcccctgattcttactggaagcaagggggcacaaatggtacaaaatttttaaacagcagaatgtatcactattagctttataacttccccaactgctttcactctttgaaagttattatccttccagaggctcatgtactattctacgttctgctaatttttctatgaatttttaaacatatttgactttaattttcttttagttcacaggataggatgtgtatctgaaattaatttttctctaatgtgctatatctcaaaatcagctattaatcctcccccactgctttgtactgcctgttttactgtatattccattctgactcaaaattcagtctatttgcattagtttaacaaacacatgctgagtcccaccacgtgcggggcactattctgggtgctgaagatgcaacagtgaacagcttggctgtcacatctgtacttacagaggattctcgttggaggagacaagataaacaaggaaataaactatcatctatcacatggtgatcaatttcatgaagaaaaataaaacaaagaaggggaatagaaaattccagccaggtggtgaggtgcaacctaaagccaggtggttagggaaggccttaccaagaaggggacattgacaaagacccccagggatgatggatccgtgaggaaaacgttccagcccacagaaagcacatgcaaaggccccaagaagggacacgtcggtgccttgaaggaggccagtgcccgagtgaaggcaagagtggtaggaggtgacagggaaggtggccggcagttcatgtagagacttcactgtgaggacactgacggtgaccctgagtgagacgggaggtccatgtcctggggatgctgtaactaatgaccgcaacttggtggcttaaagaaacagacacttatcctctcacagttgcagaggccaaaagtccgaaatcaaggtgttggccatgtcgtttccttcgagaggctctgagggagactaaaggcagggggaaccctggatcctggcagttgcaagcgacctttggtgttccttggctcgtagacacatcactccaatctctgccgccatcttcacgtggtcttttcttgtctgtgtctcggcgtctctgcctatctgtctcttataaggacacaagtcattggatttagagcccattctaactaaatctaggatgttcttataccgagatccttaataacatctgcaaaaaccctatttctaaataagggcacactcacaggtatgcaggttagcagtggggcgcatcttttggggagacacaactcaaccccgtacatgttgagttgagaaggtctttgaacacaacagggcaatgatctgtgttaaagggggcattctgggggctgtatggataggggtaagggggttcaggcagcagcagagagcccagttaggaaagactataccagttatccaggtgagaggcgcagttggttgaacaagtcagtggtggtataagaaatagttccatgagactaattacgtaagacacagaaggagccgttattcagaaggtggattctgatcccttagtcagttccactcatttaaattgttatttttttacaactatcaaactacgttcattgctgtttctctatgttttcaaatatctcatagagttaatcctcttcttccttttcttagttggattatataaatctattaatttgcttgagacaatattttccttctccttcaggaatactgtatatatgtaagtgtatgaacagatagattgattgatgtcaacttattcaagtcttttattatcttttaaatattttttaacttctttatagctaggacacatgcctcaatagatttattgccaagggtctcttgtggaaaaggggttgatattgtggacaggatttatatttttattacaacaactggtgccaactaataattaacaaggctattaattttggtatgcttattttagatctagtactttattgaatcattttattaaatattattatttccgctgattcctctgcacattctggttttccattatattaagcacaaataattatcttttctctcttcccattattatacctctttatttttttatgtctcattgcattaactagagttttcagaacactattaaggaatcattcttgtttccatttttaaacagaatttacttcatctatccattaagcacaatatgggctcttattttccacaactttttatcatggtagaaaaagtagaatctattcctaatattttaatatttttggaaccttattaagtgttatcagttgtcttttagacatgtcatttattttaatttaacccattaacattgtatacctttttagtgtatgctgtcatgttggatttcttgcattgtggaatataccttccagcagactcctttagatgggcttaaagcaagatttcagggtgttaatttttgcatttctttgcttatttttatgattagggatctgcttgatttgggtgacatcctcattaaaatcaatattctcgccgggcgcagtggctcacgcctataatcccagcactttgggaggccgagacgagcagatcacgaggtcaggagatcgaaaccatcctggctaacacggtgaaaccctgtctctactaaaaatacaaaaaattagccggcaatggtggcaggcgcttgtagtcccagctactcgggaggctgaggcaggagaatggcgtgaacctgggaggcggagcttgcagtgagccgagatggcgccactgcactccagcctgggtgacagcgagaatccatctcaaaaaaaaaaaaaaaatcaatagtctcatattataatgttcgtaagaactatgacaccttgggagagggtcttggagaactggctaccaacaatttttattaacacttctggcaaaagcactagctttcggtatcaacatcattatgataaaaatgtgtttatgaaatgcctctaataatcactaatgctttggtgtggttccaaatagttcttgtccccgaggaactaacaacacaaagttgtagattgtgtcagattttgcagttcataaatcgtctccacatcaatggtcatggggcagcattattagacccatttttacaaatgaggaatctgatacctgacaagaataggaatttacataaggtcattaagcaaccaagacaggcacagacagaacttgaactcaggagtcctgatcccaaccccgtgctcctttcaacgtgccacactgactcaacacccagcaactaacaacattcagcaaaagcatgagaagacatgatgttctatgctaagactggctaataactgctatggggagagattggaaagggttcttctggaatccccatgctccccaatgccacttcctaacaattatccccattcaccgtgtagaaccccattgctcctttaacattcaggccagttagtggtatcgtcctgtgtccctctcacttgtgtcacctgctgacctcttcagccactgaaccatactgattctagcatctggcccagaagcctccatctctgtcatccgaggtgacctggtgtccatacggaagacagctccgaattcttccttgacctcttcggctccactggtcatttgggcatcacttcagccatccagacccacagcctcagcctcactttggacctcaggaggacctcaccccaaaatattaagctctgacatccttcactctgactataaggtcttagccttcatctctctacagtacgccttcccagctgttccctcacccaggtctttcccatgttgccccatctgtggcccctttccttgccttctccaggctgggtctcagggttgatcgctaggactataggagacctcccatccgccccgctccacccccagaggctgagggatgaggggcgggcagtggagctgatggaggaaggagaacaggattctctgaggagctgcttcaggctaaggtccggtcctctgatgatgtgctggtttcagagttggaagagggtgtgtgcctgtgtgttcctgatgtcctgatgagggtgccccaggacacacgagggccatcccgcccctccaagccccagcccctggcttatccttggtgcctccagatctcactccaactctcatcccccttcccttcccgatgttttccctgcagcatcgtccagtccccaagcacttccatggagctctgctcactgccgtctgggccaccagccagcacctcagcagccccttcagcgatcgctggcatgggctctgccttggtctctcctggtctgacgccaacccggccgcttcatttcctgcgaggggagctctcttcagctcccacgttggtccaaattggtttggtctcttctagacctcagagcccatacacaaagaacaaaggccagttagtctcccactctgcaattattcaaagttcgggctttaaaacgcagagatttttctgcttcatctacccacagctcagcaactgtatttctacacctattgttattctatttctgttcctaattgctattgtagaaaaccgtgcctagctgaagcttcgggagttgccaatccgtgggctcccttcaaatgtaaatgtgttatgcaaatgtcttctgaggctgggagtgggatcctgtggtcttccctgggtagagacagggaaagaatactgctgggatggctgagaaacagaagacaatccgctgccctcgttatttaaacgctcactgttctgagatggtttcctgtctccaacttcctctcctgctctagcagctgaatttaaaatacttgctacagaacactgcttcttctgggcagggaacgctgctgcttaacccttccatgctcgttccctgtggggacacagcgtgttggccagctgcacctctcccagggtctcaggaccatgtctgtaaggtagatgctattcgaatctaggaaccttttttttttaatatggaaaatcacctatctaaataatgcattgtcatcgttagcaaaaccttaaagcatcagtactggtggagaccttgccattccaagcagagttcgaatccttccaaaaacagccacgacatcaatgcaaaaaaaatgttgttttccaggagtgctagtcccatcgggagagctccttccctcctccctctgtcttcccggctccccatgttcctgagcccggagctgatctccgcctcttctgccctcagcttagctgcctgtcatcatgccaggcaggcactggattttcttttctttctatttttttaattttactttaagttctgggatacatgtgcagacagtgcaggtttgttacataggtagacatgtgccatggtggtttgctgcacctatcaacccgtcatctaggttttaaaccccgcatgcattaggtatttatcctaatgctctccctccccttgccccccaccccctgaggtgctggattttcactgtcctgagattttcactctccctcataccctctttgctggcctcccattatcaccagcagcaatttggtccaaagaaagttctcagcttctgaatgaatgagccctcaaacccatgagctccttgactcagtgcttatgctgtgctgagccaggcactcgcaggacactcggccctgctggtcagccctgctggccgggggctccacatctgtggatttggcaaaatgcagatctgaaatacttggggggaaaatatgcctgtactgaacatatacagaaattttttcttgtcattgttccctaaacaataaagtataacaactatttacatagccttacattgtgttagatatgataagtaatatagagatgatttaaaggataccaaaggttgtgcaggggttatacgcaaatactgcaccatttagtatcagggacttgagcatctgtggattttaggatcacccggggtcctggaaccaatcccccaggaatacggtgggacaactatattaattaattaaccttttttgcatttatcagtagtttctgtgttcaatattgtctattgctgctatttccaagatgtggggaaaaggtgaccacaaatatatagaaatgtattctgtgcattctaaaataaattctaaactatatgaaagtagagggcaaagcagaaaatgctggaaaaacggccctggcccaagactttgagctgtttgtctttcgtttttcacactgtcgtgttactcagtagtcctggcagctctactgtaccattctgaatttcagagaaagaaaggggagctaactctgccctggaatattatttatgttctaaagtgctaaaagtactttcaagcgcaattagcttatttaagaggcagagattatgttgttctctgcctacctcatcgggtcactgggaggatcacaggcgggggaatatatatctgtgttttgagcacagtaggaagaaaatctttgtgtaaattcaggttggctttataatgatccggcaagattggaatatctgatcaaagcgaatcactctgatctactcagttacaacatgatctctttttttttttcagatctaataatatatcacaaattgacatgtgcttgtgagaatgatttgtggttgatctcgatgctcagacatggccatcggcattccaattattccctcccctttacttaatttcactacagacttgccccatagctcatggttctataacagtctctgacttcatcacatttttatcaggaaacaaatggatcactggcttgcacaaaatacaaatttaggccaggtgcagtggctcacacctgtaatcctagcactttgggaggctgaggcgggaggatcacttgagcgcagaagttcaagactagcctgggcaacatagtgagacccccccccccatgtcaactaaaaatttaaaaaattagcccagtgtggtggcgcatgcccaggtagtcccagctactcaggaggctgaggcgggagatctcctgagaccaggaggctgaggctgcagtgagctatgatcacaccactgcactacagcctgggcaaccgaacaagactctccctcaaaaataatagtaatatataaatttgtctgcaattgtgaaaaataaataaatttacatactagatccaaggccctgagttttaacttgataactggggccaggtatcttacagaccccaggaggcctttcaaacccgttacttgcgtcgtcatgccaaggggctgagaacccttcccttcccatcccgagagcccagaaagaattctgcaactgtctgtgagccaactagacttgaacaggctaactgacctgctactcaggaaagaaacattagcttgctcacaagagcttccctcacagacttggtacagaagtctaaggatcacgtggcggccgcagcctctgtgtttctgtcccctgagtcagcacgtacagaacacgctgtgcgccaaggaccagaccctgctgtggagaaagctacagtgaaaggtcaagtctgtgcagaaatatgtgactattgaacaccctcctcttctcaatcacaaaagctctttataattcctcctctgcaggcaaaaactgtgggaaactctcacattaggcagaatttttttctgacaatatctggaaccaaagacccacagtcaggttaaaaatcacattttcattgaaacagtttatgaaaagcctattacctagcaattttatatttgaatgcaattatgttaatgttattagtacattatgaatggtactaatatgattattgtttcatgtggtattacaggaaattaattcaaatggatttacatattttttagataaagggcactgctaacacggataaataagaagcctgacgttactttaaaaacaaaagatagcactgagaaagccaggttgtgacttcatttgtaatactaacacaccatttttgtgcttttttgttgatgtaaatattttgcaatttccaaagtgtttttcttgttgaatgcagcaatctgaattaatttccccagcctctgccagtgtgcctttagcccattttatacttgagggagttgagagtcaagagaaggaaacttgccccaatttatacccagaatccagacagtgcaagatgcaaactcaaatagctgagaactcaactcctactgttagatcatcggggaatgtaacttctcacgtcgaatcattcagagttgtaattaagtaaggccggacctctggaagctctccttccctggattttggtgaaaggaaatgcttgtttctgcactgggcaaggctgatttccatctcacagtacactttctgcatctcctgcttatccagaggagaccccaccagcctcccgagctccatcgtccctcagagtcactccgcatccactgcgcactgctctacacactgctctgggctagtcacactgtgctgctggagacaaaagtgtgagcacaaaacaagccagcagcaggggacactgtgtgcactcagcccatgcaaacagtaggtgccagccgaagtcgttcaagggcgacagagcggtcacaggtgtggttgagaagagccgcccagaaacaagatctgggctgggcctagacagagattggtggggcagctgaggtgaggggagctgtgggtgcaagggcagagggcaatttgcagggtatatacacggtgagggcagagcttccgctggttggaaaatagggggtgaaactgagttggggacaaactgcagattacctctaggcttaggacggaggagttgctgccaacttttaaacacctgaaattgataagggagaagctgcctctgccaaaaccaatctggcaactgtgcacagaaaaacaggttaagaaacgagtctttcgcaagtatgtaggcctggggtgataaaggcctgaactacctaggagggatggcctctgccccaagccaaggaacgctatcaaatctgataaactagtaagctgggaatgataattctatggtgatagatcctagcaatggatgatatgcttttaagctgaaagtgctttgaggactagtactctatcttatttgtctattttcagcttgtagtaaagagccggcttccactcctgctgggtgaatgaacgcatgcatgaacgaatgaatgcaggcatgtgcgaatgagtgggctctaaagatagtatgttgtagataatttcctgactaatgatagggattccgaccctgataggcttacaggaagctgcctctcagtcggtcctggtgtgggtggctccatcacctgtgtgcaggccccttctggtccgcatccttttccctggatgaggagggcctgcaggctgacagtgacaggtgttcctccagtgcccgtcaggaatgcccgggctcccttcttctccagggaagggggtggggggcactcttcgggcccgtgggtatttgttttaatggaagaaatgtgggtaaatacagtcttcaagcacagaatgaagtgaggataatattaattactaccttcggtgattgttgtgaggattaaatgagttaatatatatgcatagagtagtcgctgatgtatatataataagcatatagtgttagctgatgttattattatttgttattactaaccaaaccaattgtcccacctattaaattcttaatatttccattctagaaataagctaaataagagcaattccttaaattctttcagcagtaccaactttcctactttcccttaaagccacagttaatttctaagtagctagttgacatgttaatgatcgaggttaaatattacatcaggattttattttagtgattaaagaaaataaacacctaaacttttatattgagcatttaccataattccgagtcaaaaattaatctaatattttgactactgtacatttcacttctgcaaataaaaatttgacccataaatttaaatggatgttggtgcatctccaactatttagcattaaattcattctgtcaacactttccaattatcttctcataagacaaatagtaacagaccaattcctaaaaagtcatttgtgtttaattgaattagtagttgtgtttgattgaaatatgttaaagccattataaaaataaattcttttcacttattggtgaatttttctacctatgctgtcaaaatggctagaaatatcaattacaaactttgtgaatgggaagtggaaatgtccattctttattctttcagaacagataaaaatactgtaaaatcagaaaccggatttggattttaaagactataggtaagtaataccggtaaataggatatctcgtaaagagaaaatggactgtggcttaggaatttaatgaaatagaggggagcggtaattttgagtccatttaggattttactggcttactgtccagcaagaggacttagattaaattattggttttctgtgaatctgaatttcctggtctgtgttgtcaggacagggatggaactttggggaaatgtgtggaacagatgtgtgggagaagccagatggggccaggatcttgggtctaagagagctttctgtaaactctgtagtctctcatgctcatctaacctccttctcctgatttttttgctcacatttattgatcatttactctatgcaagacaaaattctgtgacttttgcatgtattacctctcaatcttcaaaacagcccacagattaactgcttatgtgaccctcatctgacagatgaggaaactggaagctcagagaagtggatgctttgcccagggctggagagccaggctggggctgatatcccagccgtcaaatgtcaggctcctgctctagaccgtggccacaagatttggggaaagttccctcttcccgggcagcaccagttttatgagcacgttcttccttcctgcccaaatgtatagtgagcccctcatcaaatggcttaacttcaacatggaacacgtctgtcacacaggaagctgcgtgcccagagcctggccagagaaccagggccaggggcatgaaagcaaaaaggcagagggtactaaagaccccaggagcttgatgctgaggcagtactctggataagtcactgtagggaaaaatgctccacgtaaactaagctcttcctgaagctttcacactgggagagggggtctgccactcgttggtgctgggtaggcagaactcttcatcctgggaccacaaatgacccctgcattcttccatgagctctgggcttcactgtcagcacagtcccatcagtgacgagtccccgcctcttcctaactgcatgatttatcttggctcattcatttaccaagaaactattgaatgcctactaagtgcctattattcagcagttgtttagtcaagaaatgagccaacgtacaagaacagaaggcagcctgcttctaagtcctagttttctaaagtacttttaagatcagtcatatccagtgggaccataatatttcacaccaattctacaaaaagctacattcaattaatgaaaagcgtaagttatcaaacatgtaaaaagtaccatttgtttctttgaagtatctactataagtcaaattttattaatgagacattacagatgacctgcctcaaaggttagattaaaaagtatttttgcatatcaattctatgtatatgtgcagatcttctaacctattctaaggtgtcataaaatggtttattcttagaacaatcgtataaatcccctgtcacatttaaacaatttactctgtgagtaaaggcttactaagcaaggaaactcccatacggtccctaataaattattaatttcaaataaatgtagtctttctctcccaatggctcactctctgatgtttctcatgcttttcagcactgccagatctgagaaataaaacaaagtaacacccaaatgagttacttttaattctgagaagaatttataactaacagataagatgttgatattttcaatatgtggctttagaaaacattaaagtaatttagaaagaaaaatttagctagcttccataaaaatttagcacattaatttaaatgaataaaatttaacagaaaagcaaaagtacgttatagatactttgaaagtgttgaaattggcctggcgcggtggctcacacctgtaatcccagcactctgggaggccgaggcgggtggatcacaaggtcaggggattgagaccatcctggccaacatggtgaaaccccatctctactaaaaatacaaaaaaaattagccgggcgtggtggcgggcgcctgtagtcccagctactcgggaggctgaggcaagagaatggcgtgaacctgggaggcagagcttgcagtgagccaagaatgcaccactgcactccagcctgggtgactaagtgagactgtctcaaagaaaaaaaaaaagaaagtattgaaatatagtaggatgtaagcttccaaacaacttacagtttaaaatctcaaaaataaaaatcttttactaatgtgatataatttattacttcacatttccaacactatagtaggaatattagcttttttctttcataagaaagccctaaacggtcagtttgctgttcatactttttctgatggccaaatccttacttttttttccaattgttttatggttctatcagctataacatcatatttgctgatttcattctgaatctttccaggtcatggttttgcctgcttttatgtaatattcatttgtgttttatttttatccatgcctccttgaaaagtaggaaattcaatttggattgctatcatgtttttctttctttgagtggctccccgtagcttccttcttgctctgtgtttctcctttaccatggaccccgtgtgctgctggcctgggtggaaacaccaaaatgatgtgcttccgacttcttcctaagtttgtgattataaggttttcaaattacatgcaactttctataacaggcttctcatctggcaaatgaattaaaatatttactgatattgtctcaatcctagcaacagccaattggaaatgtcagtttttaaaagatcctatcgagagtgtcaacaagaactgggtaactcctccaagtaaacttagtaagacatctgcaagacctctgtgaaagaaaccatccaagaaagatacaaaagattggaacaaatggaggcacacatcctcctggctggaaggactcacgttgttggttttgcccatccagcacctggtaacacatgcttagtttctctttacagtctcagtggggtaggcctgccaaggatcccttcccatccctggccaagaggtgagcatttggcccaacttaggccagctgggctctgcctggggacttgaagcttgactgagggtcaaagggctgaaaatgtttggagatgattcttctggttgacaggttctgtagatagcccctacatcatgccacctgtgtccatggagcttcccaaattcctgcctctttctgagacctggttcttcacattgttctttgattcagttcgctacctcctacctttccagtaggttctctttatgttccagttatctgaagttagtttccacttcttgtgagcaaaaaactcaactgttacaattcaatatggtaaagatatcccaccccaccaagttaaggagccaatgggaggcttttatggatctttaaaaaagtgattcaagtatccatatgaaagaaaaaatgggtgagaataccactgagggggaaaagaagaaagagagagagagagacagacagacagacagacagaaagaaagaaaggaaggaaggaaggaaggaaggaaggagaaagaaagaaagaaaaagaaagaaagaaagaaagagaaagaaagagaaagaaagaaagaaagaaagaaaacaaagaaagaaagaaagaaagaaagaaagaaagaaaacaaagaaagaaagaaagaaagaaagaaagaaagaaagaaagaaagaaagaaagaaagaaagaaagaaagaaagaaaggagggagggagggagggaggaaggaaggaagaagagagagagagaacaggcatttcctccaccagatattaagataaatttaaaacaacagtaattaaaaatgtgtggccccaacaatagcatagacagatcagtataacagaaataaatccaagaataattttaaagtttttaatattttataaagcgagcatttcaattcactgggaaaataaaagatcatctcataggaggtctaggtcggcaggctaaccccctggggaaaaatatttttaaaattattaggacctgtctcatatcatcacgaaaacttaaaaatacatatggcttacttaacaaattaaatgtaaaacataaaatgaatttttttttttaaatttcagtgataaggtctcatttggttgccaagctggagtgcagtggcgcaatcatagctcactgctgtctcaaactcctgggatcaagggatcctcccatctcagcctctcaagtagctgggactaaaggtgtatgctaccatgcctgactaatttttttttttatttcttgtataaagggatctcaccatattgcccaggctggtctcaaactcctgggctcaagcagtcctccctccttgcctcccaaagtgccgggattacaggcctgagccaccacactcagcctgaaaccatttttttaaagcccaaatacaatatgggcaaatataacataaagaaagaaatccaaaggaaaagatagatttgattacataaaaatgaaaagattctgtcaaaatcaccacaaataaaaataaaacaccaatgatatgagagtgacgatttccctacatcttctccaatagaaaatggtagcaaacttctgaattggttgtatattaatcagggttctctagagggacagaactaataggatagatgaatatatgaaggggagtttattaaggagtattgactcacatgattacaaggtgaggtcccacaataggacgtgtctgcaagctgaagagcaaggaagccagttcgagtcccaaaaccttaaaagtagggaagccaacagtgcagccttcagtctgtggttgaaggtccaagagtcccaaagctgaagaacttggagtctgatgttctagggcaggaagcttccagcacgggagaaagatgaaggccagaagactcaggcagtctagtcttttcacattcttctgcctgcttttattctggctacactggcagctgattagatggtgcccacccagattgagggtgggtctgcctctcccaggaccgactcaaatgtttatctcctttggcaacaccctcacaaacacaccaggaacaatactttgcatccttcaatccaatcaagttgacactcaatattaaccatcacaggtttgaatgaatctttttcttttcattgcttctggaaattgagccatagtttgatgggccttcccaattcatgtttataaagggacttgcctagatcttttgtgactttacttttatatttaaattcatttggaattatcctaatgcaaggtgtcaggtatgaatccaaatcataacatcaggtgccccaacatcacttattaaatagttcatgttttacctactggtttgagatgacgcatgtatatcaattaaattcctgtatgtatgtttgcccgcatattttaatgtctggtagttcttatccactccaaacatcgattattggtcttttaaagaatgttcctggcaattgttgcttgtgtattttcacatatgaaatttgagaccaatatgtctaattacaattaaaaacctggcatttctactggaatctctttaaatgtaaaaattaacttaagtagaattgctatctttgtaatgctcagtttccctgatcccagaacatgatgtgactttccacttgctcctgtcttacaggcccatcaactgtgttttaaagttttcttcatataggtcatataaaaactattgaagtctgtgtatttgttttcttttcttttcatttcttttctttcctttttcttttttttttttcaagatggagtctcgctctctcacccaggctggagtgcagtggcccaatcttggctcactgcaacctccacctcccaggttcaagtgattctcctgcctcagcctcccaaatagctgggactacaggcatgcgccaccatgcccagctaatttttgtatttttagtagagacggggtttccccatgttggtcaggctggtcttgaactcctgacctcatgatctgcgtccctcggccttccaaagtgctgggattacaggcgtaagccaccgcgcccggcctgtgtattaattttcaaccctactaccttactgaatttgtttgtttattcagttaattctcaggttttccaggtgtaaattttagaaaatttacaatcctcctaaatgtgactatattaccttctccttcccaagttttttacctcaaatttatttttcttgtaatagcattgactatttcctatagtaatagcactgtgtaattcttgtaatagcactgactgttttctatagtataatgttaaataacagtgaagatactggtgagggtggaactttattgagcatatttatgatatgtctccaccaagcagggtgctggcttttggactgagatagatgtattttaacttataaaggcagtatttcactcttcgtattttgtttttatcaatggtggttgttaaatattgtccagtgctttatcaacatccatggaaatgatcataatattttttacttatatccttagtatgataaaatgtatgaatagaattcatagtaatgaaccatccttacatttctgaaacaaacatttggtaatgatgcatcattctttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttttagtagagacggggtttcaccgttttagccgggatggtctcgatctcctgacctcgtgatccgcccgcctcggcctcccaaagtgctgggattacaggcgtgagccaccgcgcccggcctgcatcattcttttgatatgtggctggatttattttgctaatattctgtttaaggatttcataagtgacattggtctattgtttgttctctaaaatgtttgtctttcagtatcaatgttatacttcctccagagaaaaaaaatcttaaggtgtttttttgttttgttttgtttgtcgttcttgttgttgttgttgtttccctaagctctagaaaaagcacttaatttgtggtattctcatgtctggacctagcgactttttctttttgattagacaagaatagctttttgataaccttctgtatttttcccatagaaataagactttttagattttctgcctcttcaagggtcagttttgactaattatattttcctaaaaatttcttcaatttatccaaatttcaaatgtatttgcacagttaaacaaacttatgtcctgtgtttcttttaattctcttaattttctgttactttcctccccccttgatatttcctgtttgcaagttctccattttttttcttgattaaattagatattggctcatatatttcactacatttttgtcttttaaaagccatcttttggacttattttgtagttctgctgtttgggttttctagttaattaatttcagcttttaaaatttcttatgatttaattccatttattttgttgctccttgcctaactttttgagttagtttaattccttttaaattcttacttgttaattaaattaaaatgtaaagtaatgcatttttctctgagcattttagtggcatatcataacttctgatatgcagtatctttattatgttgttttctttttctttttagtttttttttattattatactctaagttctagggtacatgtgcacaacgtgcaggtttgttacatatgtatacatgtgccatgttggtgtgctgcacccattaactcgtcatttacattaggtaaatctcctaatgctatccctccccgctccctccaccccccaacaggccctggtgtgtgatgttctctgccctgtgtccaaatgttctcattgttcagttcccacctatgagtgagaacatgcagtgtttgtttattttgtccttgcgatagtttgctgagaatgatggtttccagcttcatccatgtccctacaaaggacatgaactcatccatttttatggctgcatagtgttccatggtgtttatgtgccacattttcttaatccaatctatcactgatggacatttgggttggttccaagtctttgctattgtgaatagtgcctcaataaacatacgtgtgcatgtctctttatagcagcatgatttataatcctttgggtatatagccagtaatgggatggctgggtcaaatggtatttctagttctagatccttgaggaatcaccacactgtcttccacaatggttgaactagtttacagtcccaccaacagtgtaaaaatgttcctatttctccacatcctctccagcacctgttgtttcctaactttttaatgatcaccgttctgttgttttctattcgttctataatttgggactgtacttcctctttgatgtagaagttgtttaaataaaatcaagttacttggtatgtacctttgcttctgttaaatgtacttctttttcttttctttctttctttcttttttttttttttttgagatagagtctcactctgttgcccaggctggaatgatgcagtagcatgatctcagctcactgcaacctctgcttcccaagttcaagcaattctcctgcctcagcctcccaagtagctgagattacaggcgtgcaccaccagacccagctaggtttgttttttgttttgtctttttaatagagacggggtttcaccattttggtcaggctggtctcaaacttctgaccccaaatgatctgcccatctcagcctcccaaagtgctggtattacaggcatgagccaccatgcccagcccttatttttctattatttgatatatctgcttaaaataatgttctttaatacccaactattgcaaatgagacagcagcaaatgaactctattttccatctttttctcccttcttcctcttatttttttgttagcagcatcatttctacgttaccaaagcttttcatatgtatgttctgttttgccacccacattgttttcatcttagctcttcagtaaatatactcaacactcagcactgatcatttttgtcatcgctaggttgcctgagtattgtcctctagtcattttctcataaaggcaagaaatgatatttcccaaatgtcacatttttttcaaaactgtttgcctttagactttttatttgaagaacagtcttactggatctaaaatttctgacatattttatttcctttggtttgtatagatatttctccactgtccttcgacctagaaggtagctgcggagaattctgagaccaacataagttttctcccttttaagtgacttggtctttttttgtctggctgttcaattatttttctttatatttaaaattcagtaacataggatatggctttgtgagataatataaaggatcagattttccaactaagctctcaagaattagacctgcctccttattaataattcaaaggacatagtgactgcaagagacggggaaagcatgaagtcaaagtgtcagtgcagctcctcaagtcctttcctgccacactgggacactgttcccggctgagcagctgaggactccaggtgatgtgcgaagagtattgctttttttttttattattctctttccttccttccttccttccttctttctttctttctttctttctttcttttttatttagacagagcctcactttatcacccaagctggaatgcagtggtgtgatcttggctcactgcagccttgaccttccaggctcaaatgatcctcctgcctcagtctcccacatagctgggactacaggcgagcgctaccatgcctggctaatttttgtatttttttgtagagatggggttttgccatattggccaggctggtcttgaactcctgggctcaagtaatctttcctccttggcctcccaaagtgctggaattacaggcatgagccactgagcctggccttaaaatagggtattactttcaatcatgaaacagcacaaggtatatccaataattggcattttccttcattttgtttccactaggttcgaagtgaccatttctcttttccttcctttctccccagacatcctcagggtagagaggatgagggacagaccagcttctaacccttcattcctacctggtgttgatcattctgggtcagttttccttgacatagggtgtgctcttccaatatgtgggttgccgtggtcggaatgtttgtgtgactccaaaatgcatatgttgaaatctaatgtccaacgcaaagtattaagaagtgaggcctttggggggtgattagatcatgagggctctgccctcatgaatgatattaacacccttagagaatgagcttgagggagccctttttgcactttcaccacgtgaggacacatagaagcaaccatctatgaagaacaggccctcaccagacaatgactctgctggtgccttgatcttgcacttcccagccgtcagaactgtgagcaataaatttatgttgtttacaaattacccagtctaagatatttggttatagcacttcaaactgactaaacaacaggttcaagtcttcagttatttcaagaataatttctttaatgaaatattttcatattcgttctgtttcagtgtattcgctgtcctcaggaactccaagtatgcatgtttttaaaatctccatgcctgtcttctctacctctcactttatctttcatcattttatttaatgttttacaattttttttatttcaatagtttttggggaacaggtggtgtttggttacatgaataagttctttagtggtgatttctgagattttggtgcacccatcacctgagctgtgtacactgtacccaatgtgtagtcttgtatccctcaccaccacgtacccttccccctgagtccccaaagtccaatgtatcattctcatgcctttgcgtcctcatagtttagctcccatgtatgagtgagaacatatgatgtttggttttccattcctgaattacttcacttagaataatagtctccaattccatccaagttgctgtgaatgtcgttatttcgttcctttttatggctgagtagtatctcatggtgtgtgtgtatgtgtgtatatatatatacacacatacacacacacacacatatacacatatatacatatatgtgtatatatgtgtatgcatatgtctattttgtctatatatgtatacatatatacatatacatactttgtctatatatgtatacatatatacatacgtgtatatatatgtatatgtgtgtgtgtgtatatatatctgtatctatatctatatctatatatatagatatatatcacattttctttatccactagttgattgatgggcatttgggctgattccatgtttttgcaattgtaaattgtgctgctataagcatgcatgtacaagtatctttttcatgtcatgacttcttttcctttgggtaggtacctaatagtgggatttctggatcaaaccacagatctacttttagctctttaaggaatctccacactattttccttagtggttgtactagtttacattcccaccaacaatgtaaaactgttcccttttcaccacatccataccagcatctattatttttttattttatgattatgaccattcttgcaggagtgaggtggtattgcattgtggttttgattttcatttccctgataattagtgatgtggagcatttttccatatgcttgttggtcattcatatatcttcatttgagaattgtctattcatatccttagcccactttttgatgggattgcttgattttctctttctgatttgtttgagttctttgtagattctggatattagtactttatcaggtgtatatagtgtgaagattttctctcactctgtgggttgtctgttaactctgctggttcttttgctgtgcagaagctttttagtttaattaagtcccatctatttatttttgtttttgttgaatttgcttttgggttcttggtcatgaagtctttgtctaagtcaatgtctagaaaagtttttccaatgttatcttatagagtctttatggtttcaggtcttagatttaagtctttgatccatcttgagttgatttttgtataaggtaagagatgaggatccaacttcattcttctacatgtggcttgccaattatctcagcaccatttgttgaatagggtatcctttccccactttaagtttttgtttgctttgtcaaagatcagtatgctgtaagtatttggctttatttctgggttctctattctgttccattggtctatgtgcctatttttataccagtaccatgctgttttggtaactatggccttacattacagtttgaagtcaggtaatgtgatgcctccagatttattctttttccttattcttgctttgcttatgtgggctcctttttagttccatatgaattttagtattgttttttctacttctttgaagaatgatggtggtattttgattggaatttctttgtttctagattgcttttggcagtatgatcattttcacaatattgattctacccacccatgagcatgggatgtatttccatttgtttttgtcatctatgatttctttcagcagtgttttgtagttttccttgtagaggtctttcatgtccttggttaggtgtattcctaagtatttagttttttctttttgcacctcttgtgaaaggggttgagttcccgatttgattctcagcttggtcgctgttggtgtatagcagagctactgatttgtgtacattaattttgtatcttgaaacttggctgaattcctttacaagttctagaagctttttggatgagtcttgggttttcgaggtataccatcattatcagcagcaaacagcaacagtttgatttcctcttcaccaatttggatgccctttatttctttctcttgtctgattgctctggctaggacttccagtactgtgttgaatagatcttcaatcattttacattccctattgcaatttgactttgcttaatttttctaatttctagtatctatctgtttaccaagttttccctagtgcaattcttcctttgctcctgtcattttgatttccatttctatgatttattattcttttagctctttcctgagtgctgtcaacttgcttttcattttctccagtagtcttgctgtctgtgccctgagatcttgtgtttttgctttaagggctcttaatattgaattcaatcagaggtttaatattcaataagagatttcttggcagttgtgtctgtgagtatgtgtgaatatccttcctctaataattttcactactctttcctgtatttttttcttattatatcaatgctatgctggcttttgtttcaaattattcactatcacataagtcatattttccagctaattgaaagagcttgcttgagagaaggagagtcaactccatgaagatagattattcctatgttattgaattacctgggaagaattatcttcccaaatcaacctagcagggcatccaccctcagcctgcactgcgcatccttgttttgggatctgttggtctgtcctgaggttcatcctttgcactggaagcttctgagtgagccctccctccagaggcagagattgttttcgctcgggtctgctgccacctggccagctggcccttccttcaccaagcgtctctgctccacttccactctgcatggcctctgctcagtctcctttccatcctcccagatctagcagctcatgctgtgtgcatgggatgtggagttatcactttagggagtgagtctgccacctctagaagctgtgttgttgctgccgtgtcctgagccctgcctcctctgaacgtcctgctctgcacccccatgctagcaccaccacagttccccagttgtggctcttgagctggccccacctgtctgggctgtctcaacagttttgggtttgcctggatttcactgcatcttgagctggtaggggttatactgtgcaccaccccataggcacacacagagccaggcagtgtggtgaacaaaggcaaatgttcaatgaacactcatttcaaggtcttcactctaaatgagaagatcccatctatcccatgttgtcttagtctgctcaggctgccatagccaaacaccagagactgagcggctggaaccacaaaaatgtataatctcacatttgtggagacaggaagtccaagatcaaggttcggccaatttagtatctggggagggctcttttcctggcttgcaggtgaccaccttctcactgtgcactcacatggcctttcctggatgcatgtgcacagggagagagcgggagcaagctttctggcacctccttataagaacatgaatcctattagatcatctgacctcgtttggacttaatttcttccttagaggtcccatctccagatacagccacactgggggttaggacttcaacatatgaatttggggaacacaaacattggtttataacacatgtaaaccacaacttatggcaggaaatgatgtcatgagaagtagaattaaaatcaccaaggagggaatggaagagaagatgctccttcccgtcagattatgaaaagggtatcatttgaactgagatgagcaagatgggtaggctttgtgcatccggagatggggggatgctccaggtgcagaagccagtgcaagcacaagtgggcaaacataaggcactagactctgggctggagcggtggagaggtggggccagctcaagagccacaactggggacctgtggtggtgcgagcttgggggtgcagagcaggacgttcagaggaggcagggctcaagaaacggcagcaaggctactgggaaaaacaccctcaggagtgaggaagagcagatcattgccattgaagaagcccttggctcctgtggagagatctgagactttgcctcagcacagtcctcaaaggtatctgcatgggatggaagtggggtggcagcagctggcatggctggagctgtaccttagaaagggtaagcttgcaacacaatgtaaaatacattggacagtaaggccagatcaaaacattggcgtacaactgctaaaaaataacaatagccaaaaatcaagatgaatttttttttttgctatatgaaatctagatagtgtacatttaatttcatttaatttcagaagtagaaatctatagcaagatctctagtaaatgaaccttcaaatttatcattatgaagacaaaatttaaacatcttatattcaataattaccaattctaagcaaaattcagaatccatagagtaataatatataattgaaatacagtgtatatgagtcaggctacattgagctaatcttttgatctagtaattcaacagcataggaaaaggaatgaggcccacccaattttggcatgcattccaaattcaattaactttaaccgatatcttgacagcattctttcctttcttattaaaacaaaatctcttaaatgttcaagataaaatcagatgagtatcatgtgcacaagaagcagatcaagtttttcaagaatctttaaaaataatgtagattaaatcaatagaaatagaagcattaatttgaatattcagaacttttttaaaattattgtttgggtcacttgaaaaaaagggcaattttcttttccttattgaataaagcatttggataatattaagacatttaaagtaagccaccagagaagaaaaatttcaccatagttacgctcattgtaagtcaaagactttgaggtgatatacaaattatgctgatgttaatatacacacagacttaagaaaaagaaattttcccaccccaccaagtaattagcaggtcaaatctgtcctcttagagccaaaaagtgaaaatctaaatgaagtccttggtcaagaagtcttgactgaaaagctacctcctgtgtctccaatttaccccctacaaaaatatttatttctcttatctctttatcaaaagaaattcatctgggccaggtgcagtggcttaggcctgtaatcccagtactttgggaggacgaggcaggtggatcacctgaggtcaggagttcgagaccagcctgaccaacatggtgaaaccccatctctactaaaaatacaaaaaattagctgggcatggtggtgtgcgcctgtaatcccacctacttgggaagctgaggcaggagaatcacttgaaactgggaggtggaggttgaaatgagctgagatcacaccactgcactccagcatgggcaacaagagtgaaactccatctcaaaaaaaaaaaaaaaagaaaagaaattcatcttaaaggttttggatttagccatgacaaggcttacaccatccagtgtgtacttttcttcactttcttttagacataaaaaacaatgggaaacaacaatttctttctgcaaacacatggccccaaattgctcaatcatcaagcccttctacaaggaaagcctttgcacccattgctacaatgacctgccactggggcaaattttgtgtaaacatgtaaattttagtggttatcattttattaaaaaaagaagctcttgaatgttttttactactgattcttggcattctgtgtcttttgtgtatgtataatttaaaaatcactttgagcatttatgcacattactatatgacatgataattttcatgcaaaaaatcaaaatcaagttttagattaatttaaagggtatctgtaatatacactcagtttataaatgtgggtgatgtgaatgtaaagagacagacatgacctttcctgactctggttggtggcagatgtgtattttagtgtctgagctttccagccatgaacacaacattcctgatgatttccaaaaagcgcttaactcgaagatgtggaaattgcaatgaaggaatcagtccttctaacttgtagccagcaattatatatccaaaaagattggaactagggatcaaacctgaacaaagaaatagatatgcaatttgattaagattatgtttttcagattaggatgccataaacacaatgttatggataaatcaatgtgttaggtttttccaataaaaacaaatttagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtgaacccgggaagcggagcttgcagtgagccgagattgtgccactgcagtccgcagtccggcctgggcgacagagcgagactccgtctcaaaaaaaaaaaaaaaaaaaatttaggccagatgcggtggctcacacctgtgatcccagcactttgggaggccaaggccggtagatcacttgaggtcaggaatttgaggccagcttgaccaatgtggtgaaaccccatctctactaaaaatacaaacttagctgggcatggcggtgcatgcctgtaatcccagctacttgggagactgaggcaggagaatcgctcaaacccaagaggcagaggttgcagtgagccaagatcaaaccattgcactccagcctgggcaacaagagcaaaactctgtctcaaaaaaaaaaattaaatagggtttaataaacagatttattttgaatttttaattattgcaatccaaagaattatacaattataaaactgtaggttttctggaagattatcttgtccctcttgccatcctgcataaaaacaagccaaggttcagagagtttgctgccagcccggggccaggccagcagctgctggacgttctgacctcagtcccagactgtcagctcctttagaggggagtcatcttccgttccagccggtatcactgccctctggccccacagagttcacgggcatgaatttcttccatgcacatgctgaagaacagtggtctggcagagagccttgaactaggaactgggagatgtgagtgattattagaaaattgctcattaaagctcatagtgtgtttaacagattaatgttattttattttagatatttttattttagatttttaaaaccatcttattctagatgttttaaagcaagaaataaaaccggtattgaaacacatgacatcacataagtgctcttccagcatcttgatggtatttgagttctggatgtccagagccgcccccaacccccgctccccgcctcccttctgatgcctctcagggactcggccttcatgtgtccaaaggcaaattcctgcccttctatctcctcaagcctttgtcctcccctgttgcccctgctaaagctgttgccatctatccctttgcacaagagaaatacaggtatccctctctctcactttatcaaattcaacaccatgttctagctgttttttaattttccaaaataggtcttcatttctctaccaccctaaaccaagccactatcatcacattgcctggggcagtgcagtagccattgaccttcacacccatcaaatattgtccaaacagcagcctcgactcaaaatcagtcatgcactggtccacttgagccttccttggcctccttttggcccttagaataaggtgaccacccatcccagggacctcagggccagcatcacctgactcctgcctgcttgtccagcctcccccagacacccctctccccaccccacctgcaactccaccggactcatctctgcttctgaacagatccaactctcccctaccgcagggcctttgcgcaaacccttctctttgcctgtgatcctttacgcccctgtctccttccttgttcgtccctcccgcttcccctgacacatccccactcgggcagcacccccaccccgccagccccagtccaggctagatctcccgtctaagctcccacagcacagtagcagtgatgatttatttaaagctcctcttccctgctagagtgaatccccatgaggtcaaagaccggatcttttctgtcaaccactgtatcctcagttcctagcacaatcctgacatctttaatctctgcttcacatcatggcgggagaagccaaagggccccggagatatttgccagagaagcaattaggaaaatggcccagcccagagagctggagcagaaatgaagtccaaggaaaagaatgcaccgtccgtgatggggaaggaataataaccacagctcctgcacaggcagagcagctcggatgcctgtgtcataaggagcagagctgtcatggatgcatatactatgtgcggctctgtataaattcctctcaggtagatgacagcatctagcaaagaacattgcccacagtaggtgcaccatccgcctcgaccggtttgatttgactgtagactctgaaaggagcctcactgttcagctaggctgctggaagggactgaatgactccatcccttcatgacagaggctccttgtcttgaacttggaggaaaatgctctattgcatggttctgtcgtgtaaatcacttttaaaaattattcttccctctataaaagtatgcatattttggagcatgatctatctttatgcaagtggaggggtgaacggaatatttcatcaggataaccatttactgacaattcatgctattttatagtccatgtcttttggaatggatgggagtttgttattcagtggtttataaaatcttccagactgaatgatgagctcacatctgttacaattggtatggaaagtaaaactggcgtgagttgtccataaatatttattgtcaggaaatatcagtatgtacagctgtttttaggaaaataatgcctattttattattgatacataaagtgggacatttatgtttactacccataataacacaggtagtaataaaacaatattctgtaaagagtatcagagaggcagaaacaaagatgaaattttggtttctaaagcaagttttacaaaaacattatttaaagaccatactactattctcaatccctttcaaagtgttaaaaaactttaagtcagtcaagaattggcaactaattttcagaatcaataatatgatcataatttctgccatagaaaatggctttgctgtcaaagaccatcttgagaacaggcagtatatccatgctgaattcaacagttcttacctcctaatgtgagccttggtcatctggaaagaaacaggctccttactgagttccatatcgtcccttcctgctccccaaaaggcttttttgagggaaaactttccgcaacaggtcactttaaaactacataaatatgtatatgtggtatgtaagtgtatggatgtttatgtacatgtgtgtatgtatatgcatatgtgtatttatgtgtgtgtttatgtgtacacgtgtagatgtatgtgcatatatgtaggtgtgtatttgtatatggatatgtatgtgactgtggatgtgtgcttgcatatgtgtagatatgtgtatatgtgtttgtgtatctgtatatatgtatatgtacatatgtgaatgtgtgtatgtgcgtgtgtgtgtgtgtgtcttccctcaaagaccatctgattatttttcccatgcagcagatagtacatgagtagtttgcacctaacttttaaaagtcttatgcgtatggttggtggctgtcggaacgaaagtgatttttcaggacaatgtcaggctgcagaatcaagggccctgaggagagaaatggcaggcaaatgctggggtcgcatttgctttggtgttccttgcaggtcaaaaagacagcaagctcttgcctttcactttgcaaaatctgaacaacgttttggaaacctggtccccactgctcttacagaagggaaagggacccctcaccaggaagagccagtttcccaaccccagaagccggggaccctcagccctcccagcagccttcgccgccacgtttgtccccacaggccgcacacacggccatgctcacctcctcctgcggaggctgcccaggcccctcacagcccgcaggatctgggtcacacctgagccagctctggggacacttcgaggctctgcatttcttacatgtttcttttcaatcctgaccttctcttagatcaccccaaagggacaccccgagccctgaccatttacacagatagtcttttaacacttggaatggaagcatttgagcaaagaacaccagaaacagaacaccagccagtctcctgccagatggatgacattattttccactcatttaacagagaaaaataattgaacgaggaaccggggtacatgtgttgctctgagtgtggcgtgcgcagttgggaaacctcagaacggtgtggcccgaccgtggccatgctgagggttttgtggtctggaggttcctggagattttcaggatctcacattcagaatcccacattttcagaaacaccacagaagaagctatttatttggctttgttgttttcttaaaaattaaggaaatgatttggagagactaggcctccgggttcttgcttttcttttccccacagaatttagacattattcaaacatttattctgtatcatctttttagtttgtttttcaaaaaagacatttatcttgtgataatggctagttgcagaagctcagtgagattctcaggttttcttaattgcaatttcgtctcatgcgcttgaaatgccaagcactaatggtgtttgaagtggggctggcgtctgattcaccttcagagttatcttgagctttcagccacaagaattttaaacctgacagtggtaaagaaatgcccttctttcctgattgctccgtgtgcgtggtattctgtaaccgaggtcattaaaggtagacgtcacagtggcaagagcccgacaggcctgtctcctggtgtgccacctccatactttgggacttacctgttacagtttcttggccttgatttcctcatctgaaaaacaggagaataagctctgttaagcaggatcagtacaaggattagattcacttattaacattctcctacatttgaaattctaaatgagcacaaaagagtttcgcgactgtcatacctttgaatgggaactaataaaactaaaaatcccatgttgccaagtttataatgctgattcattttatgcatcactttgcctgaagtttcagcataaaatgtgctctcgattatctaagaaaaataatgcatagagaactttttatgaccaaatactcgtctataccactcaacacttttgaatggctttcccaattaccttcccggaatatacagggaccataaattagttctacagaatatctaaaataactacaatttagggggtatgtgtgtagcaaaacatcatggaatgcactctaaagagaaatacatgtgaattcagattgcatgttcttcaggagggacttattcagatgcggcccttccttagtgcaattaactgtgaactgccacagtgagatcagaaggtcgtgcccagcaaaggtgaaacacagtgataaaagcagtccctccatcagcgaggacaggctcaaggtcagccagttgccattgagatgctagactgtggcatgcagatgggagcctggaactggtcgctggaaaccacaccaacaaatttggaattccgtgcactgatatctaccccacatgagcagaaactgagtttggccgtggaccgactgaaccctgcgccagttcccatgtgtcaggactcgctggtgtgcagagtatttgctgcggctttgatctcattgttttagtttactggctctcctgatttggcattaaatgcgttagaacctaatcagttccaagatggctttcacgatgcggttccttttcctaactatttccaaatcaattcacttagggacattataggttaagagtagttgttgttctcatatgaatcttgagtcagtttttcttttgtaaataacttcattctttttcattgacctcctcaatatttatttctaaatatttttaattttttaaaatacttaagatttcatttgaaatagaattaaatgaaagttaaggaagccttatcatgaatccagttctgcaatgtcattctattaatagctgcagtctaaataccagtcccagccatcacagcatgtccatcgggtaaatcctcactacgtgtggcgcatgttgtcctccccagccctgtactagtccaggagggagttattctgctccctgctttacctatgaggaaatgaagaccgggagtggggacagggggagctggtgccagggcagggacagagcttgtgccccccaccttgaccacagcaccactcagtcctcttctgttttttttttctttttcttttttattttattttattttgaggtggagtttcactcttgttgcccaggctggagtgcagtggtgccatctcggctcaccgcaacctccgcctcccaggttcaagtgattctcctgcctcagcctcccgagtagctgggattacaggcatgcaccaccacacttggctaattttgtatttttagtagagactgggttggtcagtttataatgaccacgttagtcagtctggtctcgaactcctgacctcagatgatctgcccacttcggcctcccagagtgctgggattacaggcatgagccaccacgcccggcctcagtcctcttccagttacccactaccctacccagaagtcacggccaatccccaccctgtgccaactccaaattcacttaattatcatacgcacatgtgcgcatgcacgcgcgcgcgcgcacacacacacacacacacacacacacacacacacacacacacacagcaatcactgagtgaccatcttaatggggattgggttacattcataacctattttgtaggagagaattttccaagggaccaaaaacgttgaccagacccaaatctaaaaagtattgctgcccctgcgcctgtgaaaatgcaagggactgagccaatgggaagaaggtggggagaaggggctgagcgccccgcagcctgcccccacccctggacctgcggctgcctccacttactcctgggaacctgggcaaaccacttcacttctccaagcctccattgcctcaactttcagtaaggatgctaatcatagcacctgcctcacagttgagttactaagattagatgaaataatgcatttaggcacagttcagctcctggcactagaaaatattcaacggtgttagcactgtcgctattactgtgtcatgactcaatgggagagcacttaagctagtgccttccacacaatggtcacttaaaaatgtccttagttaaatgaaatcggatgcgcatgagttcagcgtgaggtccgggtcagggagaggaaggggcattggcgggtagggttgcgtcggtggggcctcctctctgcctctgactggcctctttgcccctctgctttcctggtcaaaggttcgtaagcaaacggtttctcccactcctcggaacatggacttcctttctggaaggcactggcctggccatttacctcaaatgccggtgttcctggcttcagtgcccggctgcccagcggcctctccctgagtctgggttctcaggtttctgctccgcctctagatgacccctctgcccgccagagctggcctgcgggtcaccctgcaagatgaccctctgcctgcccgagctggcctgcgggtcaccctgcaagatgtcccctctgcccgccagagctggcctgcgggtcaccctgcaagatgacccctctgcccgccagagctggcctgcgggtcaccctgcaagatgaccctctgcccgccagagctggcctgcgggtcaccctgcaagatgacccctctgcccgccagagctggcctgcgggtcaccctgcaagatgaccctctgcctgcccgagctggcctgcgggtcaccctgcaagatgacccctctgcccgcccgagctggcctgcggggcatctgcagcccacggggccagagacccggatgcaactatgggcccgccccgtttcctcaggcagctagatttctcttcatattccttttccaacaaacgtctcttgaacatcgactgagttgatagacaccacggagcctaattcttgtaaatgagatattttcacagtaacttcagaacgtggtatttgtcaagggcctctagagaagcaccaacattgctagcgcttaaaagaaagacaaatgtcttccgactctggtgattcagagatcaaggcaccttcacagattttcataagcagagctggggaaggaactccagcaggaagaaatgactcaaggccagatgaggaggtggggaggccctgactcttgtctgggggtaacaatcgtggtttaactggatcctgatgttgctgtgagggaggattagaagacaattggcctgaagcccatcacgtagggcttaatgccaggccaggggagctgaaatttattcaacagataatggtacatttctgaaggttttccccagtggagaaatgcaacacgagctgagctaacgaaggtttaagtaggcagtggaaaagggtgaatttaaagggatagagagaaggcaggagagggcggtggggaggttattccaacaggaaggtaaatttggagacagaccataagggacaacgtgcggtggtggcaacagaaacagaaaggaagaccgacctcgacagtcgaggggctgggggataggatgggcttaagccagctcctcctgcactttcacaagtggcaagacccaactcttttggtagcgtaatccagtgtcttaccatttttcatggaaccacatttgcactaaaatgaagcataagaaattcagaatggaggaggaattgttatgggaaactatcactgggcccatggctttttgttttgtatttttgagatggagtcttgctctgtcacccaggctggagtgcaatggcacgatctcggctcactgcaacctccacctctgggttcaagcaattctcctgcctcggcctcctgagtagctgggattacaggcatctgccaccacgcccagctaatttatgtattatttatttatttatttatttatttattagtagagatagggtttcaccatgttaacaggctggtctcaaactcctgacctcaggtgatccaccctccttggcctcccagagtgctgggattacaggtgtgagccaccatgcccagtccccaatggttgttttaaatggcacacaatttgaaaacatctaaatttcctgaccatttggctaaccttaatactctttaataatattaagtaatctaaaccagattagttcaaagttctgtttctttcgatttctttaaaaagattttcctccattccttgtgcgttgctattacagaagacgattgttaccttctgatcaatgagcaggcgatctcacaaacttgcaaggatttttttcaaagatagaaatagatacagattgatcccgaatgtaaaaatcaagcatagtgctaatatttagacattttcccagtgtatccagggattatttgagtcaccagaaaagatttttcgtgacttttctttattcttaacatgaaaagtttagcagcaagtcaagtttctggaaaatcctatgaaccatcttgttctttggagagcttaacgacacctaggtcatcaacaacaatcaacaatgaactattgatttcagctgtaatgatcgaatagcagtgccttaaatccttcctggcagggatggcagcattgcatgcacatgtatatgtgcacgtgccagagtaagccagtgtgtgggcaccaaagttacctctgtggtttggaacatccagaggcccaaagccagcccttagctccgtgcaggtaaaaagggtaagaaagtgcaacagttaaagcaatacaacggagtgaagcctcctgtgcttatttctaagtaatcaaagcagctgtataaccacaaggcagctgtcccaggccgactgctgaccgtgtagctgacagttacatcatgaactaagggaatgtgatttttagaaatttcacttattacctacctacccatagttcatgagatgaaaaagttttgtaactaaaatatgtaacttccacataaagaatcggggaattaagaggacatataacaacaagataaacatacataatgaaggtccacgttaccattagagaaagtgaacataaatactgaaatattaaagtaaggtatacagggaatataggtttacagtgttgtgatttttaagtagaatttttaatcatttttggaaactaaacaaaaatccagaagaaagcatatgtttttctcatcataaatataaaaaaaaactgtgaaaagaaaatggcaatactaaccacattttgatacattctcataaagtctagtaacaataacttctagcactttaaagttttctagttccgacctagattttatttttgccaagatacaacctagcctgatagctccaatagcaattacagaatatgacccaattatttctttaccccccaaaaaaattaacatttttttggttaggaaacagaagatattttaatgaaaatgatctaaaacaaaaaatgcaattgtggtaaaatagatgaggaaattgtacttctttgtattaaaatatttttcataaaacattaaaaatatattaatgagaatttaatctcatataagaaagttaatatgctataatattgctttatgtatgtttatacgaaattgcagggaagtaaaacaaattatgtcatcataatattattttgtatcccctacagaaatatttttctaaaaccactaaaaaagcatattacagacttagtgaggaggctacctgtaaacaaattattttcatggagaagcaaggaaaattactaaaaacaaaatttacatttaaaatgtagtcaataaaggtcaggtggtcaatgttggtctcagttttccccaaatgtaaaatggcagcccaaggaaaagagaaccgttggacaaaatttgaaaggaaagacatatttttaaggatcagttaggaacaactttttattttcttttatagtaaattttctgacagccatatccttgcatttaaattctaccaatcacagtgactcaaaattataatttgtaattataattgttaattgcttaatgaataattaatttcacagataacttgaaagctatagatggatgatagattagctagataataatagagaattttaagattagaaggaaaacagttttcatctgaataatatgtccattataaagaaatgttttaagtggtattttttatttcactttgttttcatatatatcacaactgaatttctcagccagagcatctataaagacatttcattattttgcatatggtggtttccctttgatgtttggtggttgaacttaacctttctgtaccatgggctcctcctctgtaaaaatgtgagcagtaacattatcaactttccaaggttgttgtggggattaatgagaattcaaattaaataagctaaatgtatttaaatgcttagcatagtgcctgacacacagtaagaattaaaatttaggtcaaaccacatgaaattgacattttttagccaaaaatagttgaatattggcaacgttatctggttcattataaagcagtattcacttttataattattctaggctacgtgcctatttttaaaaacgtaaatgcatacaaaagaaaaaatgacacggaccaaaaagtatttaaaaccaagtaatccacagattagggggagctcctgtcctaaagtgattacaagggcgaccataaggaatttctgtgttaattggcttggccacaccgacactgagtgcccttagcaaggaagcagactgtaagggaaacagccgaggcttcagctttaggttgacctgagatcaaatcccactttgacaatttgcttatccgtacagtgggtagatttggaatattaatgaatgcaccatgaactccttgaattgatcttattacggaagtgaaagaaagtaacattttttagcaccccataattgtcaagcttttggctaggtgctgtctataaattagttcatttaattgttagaactatcatgtaagaagcactgatactgttattataataatgattataattacagcaaactctgctgcaggacttactagtagatagcagctgctttgcatatataccctatttaaccttcacagccacacgctaacatagatccctgggaggaatattcgagagtttttcccatcttcttcagcatcatggccaacctcatagaattaaggattaaatgaaggagcatacataaaactcctagcctgatgcctgacaccttgcttcccacagggccaattcagggtccttgtcccatgccctgaggccctgagtagccctggccttctgctatcagaagggcttccttagtaaaccccacgcagttctaagctctataacccagagcagcaggaggctgtcttcataccgcagcccctggggggtgttaggagactcgtggaaacccattttactttattcttcaggaaatataggcccccaaagtctatttcttgccaaaagctctaatttgctatcttatagtggtcaggtttttggggtagaatagtagaactaattaaaaagggagtccattgtgttccttcaagcaggaaacaatcataacaggacttaaaggaatttagtattttgagtaattttcttcaccttcaggcattttttttttgagacggaatctcgccctgtcgcccaggccaggctggagtgcagtagcacaatctcggctcactgcaaactccacctcccgagttcaagcagttctctgcctcagcctcccgagtagctgggattacaggcacccgccaccacgcccggctaatttttgtatttttagtagagacggggtttcaccatcttggccaggctggtcttgaacttctgactgagtgatccactcacctcggcctccaaaagtgctggtggaattacaggcgtgagccactgcgcccagcccaccatcagactttttacatggagaatgtttgggggcccagtgatgtagttctttatgggattcataaagggtttcctgacagacacactactcgagtaatgactgtagcacgcagagatatgtgcagcccagccatttatttcactcattttaatgtactttgctctttcagacagggcaataattagacctgccagtagcttttcgatatgagaaaaaccactttaaatgctccacactgatttctgtaaacagcttgctttttcttaatttataatgttatctcttctaacaggccataactacataaagggacatgaaaaaagtaaaagaaataccagataatttcgaacttaagatcacatgtactgaactatctatccaaaccattattttaccttaacttgaatagctgtcaattgtcgatctgattttgcaatagctcactgcctatcagaaattccaaatctttttgtaatgtttgtttttaactttcaaacctgctctcaatgtaatatctttcttcctgcgacgaagctttgtttctttagttaaattgaaataagactatgtaaagactttgtctccctattattcactaaagagggtgaacaaaatcaccagacctcaaaacaaaattgacaccctggtgcttactggtgcttaaagggaatgtcagcacacccactgaaatacttcttcagtggaggtcacggttcaggttgctggcatggttttataaggaggctcgtgttgcagctgtctgcactgtccctagcctgaagataaatagcagacttcagtttccactgctactggtcttttaaccttcaataagaacaaatacttctgccttagcttcatctgcctccaagttcatctcccaggacctagtgagctatctcttatctatctccttcccagccttcagcttgggcttcctagagctcaagagcatcccagcccactctcatctttagaggctccccatacattaaaaaatgtagaaatgccaacacaagttcaaatcaattgcaatatatcatgaatgtttacattgaacaaattcacacttttcacatacaaaccaaaataacaatgactttatgtgtagcctcattgagacttaatccaacttaagacactttgtaaacctgagcgctgcacccagaagtgtgagttcttgcctctgattagcgacccctcacagccacctgatgggtgggtgggtgtgcagtcataaggatgtaaagcaagctttttagaaacctaattcactgtaaatgtccctccttctgtatatgaccatcaattcagcttctcacaatgatggactgaccgtgcagtgtcctctgcattgcttaacacaatccctccaattcttcggtgcccaaggtggtggcccgggatacctgggcacctttagaagtgatagtgactcttcatcacatctctctgctctctgaaatagtgcttattgcatcgaccaaaaagaagtgaatgctggagtggcttgtgcatgccaaaaaatctaacttctgagatcttctggtctactccctagcttcccagggtgataagatgagactttgttttctttataacctctacccagtagacaaataggccaaagataagaacaaatcactctcacaaaggaaaaaaaaaaaagcccacacagcaaaataatacatgggaaaaggttaaccctccttagtaattagaaaaatgctaactaaagcaaccttagagtagcattttatagacgctggattggcaaacacaattttacttctaacacccaatgctgtgataaagcaggcacccgtatgtgttgctggaacatcatacactggcctaacctttctgaacaatcaatgtggcagcctataccagtaaccacaaaatgttcatattctttgaagcagtaacctcacttttgagaattctttcaaggaaataatacaactaaggaaaaagactttatgcacaaagatgttgattgcatcactcacaaaaattgtgcaaatctggaggtagacttaatgtctctagccaaagaagaacagctgagtaacttgtattccttccactccatagctattaaacagccatgacaaatgataattaggtagagtagatatcaatgttgaaaatcccagatgccataactcagtgaaatcatcctctccggtaacaacgcattccaacctcaaggtctttgcctttgctgttctgcactgcacgttcttctcaagcttatttctttctcccaagccgacttctccacactaagatgtcagcttaaatttaattttcccagggagatcttctggatcatcgtgcctgtagtggccccccaagtccatctctaccacatcacctttccgttccttgccaggacttctcactctgaagtactcttatttaatggttggttacctggcatattaccggactcctctgccagaatgtgagccccctagtctacattcccactctagtccaataatctatcctcagctgctgaagctctagaacacagctggtcttcttgaaatcacagaatttggatgatgacatctgagttcatattagaagctggttcctgagtcccaccttggatttattgccttgttcttttatcctccgactgggaagccagtttacaaacagacactgatctaagcaccaggcaggccatgtggccaaatgaagagagctgtatttcaccaaggcgaatgctccagctgttgctctgggggtccttcccaccacccaagccccatagacgtgtcaggaaccatcagcctgacctgcccgccctgccctgcagccagagcctacctgtgatgaggagagtggaggacggagttggcgtcctcgaggccaggaaggttgcctgtccctcagcacttcctctgccagactaccttgactccccaaattcccaccactggagctgctcctttgagccaaaggtgtctgtaaaaactaaacataggccgggcacggtgctcgtgcctgtaatcccagcactttgggaagccgaggtgggtggatcctgaggtcaggagttcgagactagcctggccaacatagtgaaaccccgtctctactaaaaatacaaaaattagctgggcatgggggcgcgtgcctgtagtcccagctactcaggaggctgagccaggagaatcgcttgaaccagggaggcagaggttgcagtgagctgagatggcaccactacactccagcctgggcaacagagggagactccgtctcaaaaaacaaacaaacaaacaaaaatatatagcctagactgaggacccaccatcacatggcaagtctttaagtccagggtcttgctgatagaagcacgtagggggcacagagctcccagtacagatatttccaagaggctggaactaagtggaatgacctatccggaggccttgggcaggtgaaggacaacagaactctgggaggtaacactggggtgaagccagaaaatcagttgagccctttacccaggtctccatcaacctctggaggtttacattgtccagacctaagatggcaggcgccagacttagtggaagcttggtgagtgagcctgcttaccagagcatttgcctcagtttactcggcgctctcagtctactctgcagatgacgttgaatttggaagcctggtccagggcaggagctctgatgtctaccccatcccaaagggcctaggaccatggcgctgaagagtctggaagaggacggagggtttctttgggctcagaggccaacgtagcaatctatgcagagaaggtggcggtagatgcggggattttcgcctcagtagagaagcggagggagtctcctcgaagcctccgccctcactctcttcctgcagggaaagatgtgagccagaatgctgccaatgcctcttactatctcctgcttaaccgggctgtctcctcgtggccagcaacgggcaaggagatagtctctctgtcaattcagctacttatctgacataaattggaattataacacatgtattaagtgcctttagtgcctcaaaacacaaaatcaggaaaccggaatataaattattttgcaaatattaaatcccatagtgatactacaaaagaatgacctttttgtggcttaaagcacaagtatcaggtgtgcatttgaaaataaaatctgcttcctcccatgagtttagtagggccacgtccactgcttcctctcgtgagtttagtagggccacgtccactgcttcccatgagtttagcagggccacatccactgcttcccatgagtttagtagggccacatccactgcttcccgtgagtttagtagggccacgtccgctgcttcccgtgagtttagtagggccacgtccgctgcttcccgtgagtttagtagggccacgtcagctgctgcccgtgagtttagtagggccacgtccgctgcttcccgtgagtttagtagggccacgtctgctgcttcccgtgagtttagtagggccacatccgctgcttcctgttggcttatcagggctgcatgtctcacagtcagccagcagtctagggaatgggccagtcatgagctgtgctcctaaatttggaaaaatcaggaccttgtggagacaaaaaggaagtaaacagagctaccatccttcagatgaccacgtctgggtgccatttgcagaagaagagccagtcttttccccattcagttaagcaccaacatattgaactatatctgaaggaaaacggaacgattaagtgtaagcttaagctataaattgtttgctcataaagtcctacgaccaagtatcttaatcagagatgtaagcagggtgcaaggtaccagtctagactaaaaaaactcataaagggacatcccaaagatgagggctccaagttcaaggtgagtccagataacaatgtcctgctgtccctcatggcctgaggatgaagcagttgctctttaaaagtgttgctcctttgtgaggttgtagagtaaactcattttattaaacagtaaagcaaaaaacactccatggcgttctgtggggctatacttcctgtcctctcccagaggacagttaaatgatggccagtctactcttatctgggagctacagtatagacaaaatagcagctgcagtaataatagttgtcgaaatttatcaacagcacgttaaattaatataaacataatgcatattctcttatttttgtcctggaacctgtccttacagatggatattatttcccctgtttcagtggagctgggatgcatggccatttgtgttcaacaagagcacgcctccgcccctcaggggtcctgttgtttcatttccaagctgcctttgtccagactaatcttaatgtcctgattcaggggaaagccatcgggtacactaaactgaggaattttaagagataaaaatgtaactcggacaaataaacattctttattcaaaagtatcaaaagtcagcatatttcacctatcaacatttccaacaagcttcagtgtctattgtgcaaacccaattttgctgctgtggcaaattaaatggccacattcaaaacttccccccacagtttagatactgttctctctctctctcttttttttgtttgtttttttttgtttttttttttgtaagatgtggccaaaactttgattgggctttaaagccttaaacatttgtaaaaatatcaggcaagctcaagcattttcagactgtgtcctgcattaatacacttggggcaaagtggatgtctcttgccacatttaactcaccagtgtagaagctgataaaggctgatagccagagcttggaaagatatttctaggttatttttaactaagacagttgtaaaaggcgtgatggatttaactccgtcactttcagagcagctaactgagttcagccagcagactgctttgatttgttcattaaatgtattatgtttgcattacttgagttcatttgatgagatattcccactctgtaaaatatccagctaaggatttggaaatctattcaaattttgcatccattaattcattttagaattttcaaagagtaggtactttaggcaagctaagatatatcccaaatattcggggaaacatccaatctacagaaatggtgtaacgtgttttttcatcgtaagcacgattggtgagtttatccatttaattatttttcttgctagaacaagcagtacatcaaggccatgagaatcttttactttgtagctctgtgccccgctgtgcagcccagtcacctacaatgattcagccttatcttgttatgatggtgagcactgggatggctatgcaaaggcttctaagttctgagttcatcattttagaaatgcgtttccccatagtttaatgtgtttgctgataacatttattagaaatctgagatgagcagggtgagggggccaagcctgtaatcccagcactttgggagaccgaggtgggtggatgacttaagtcgagacgttcgagatcagcctgggcaacatggcaaaaccccatctctacaaagataaaaaaattaaccaggcgtggtagtgcgtggtcccagctactcgggaggctgaggcaggagaattgttggagcccaggatgccgggattgcagtgagctgagatcgtgccactgcactctagcctgggtgacagcgtgagaccctgtctcacaaaaaagaaaaaaagacatctgagatgaatttttatttttgtgcctcaatcacagaaaaaaaaatcagagctgaaaacaggttgtatctggcatcattaacattacctagaaatggagaagtctgatagcagctgccaggctggctcatttttaaaagttttcaccaccagtgtagaggtggttacaattatttccagtaggttttatcactcctgagggcagccatcagtagttcttttccaatcaaaatcatctattttgctgtttcgcgagctggttgaaaatcaccatgtagctatgaaataaaccatacaaaacaaaacttagatattaaatgaaagcactataaaaatccgatatgttcttcttcttggagcaaaagctgctaaaaagtaaatgggaccaggtgcagtggctcatgcctgtaatcccagcactttggggggctgagacggggggatcacctgaggtcagggattggagaccagcctggccaacatggtgaaaccccatctctattaaagaaaaaaaatacaaaaattagccaggcatggtggcgggcgcctgtaatctcagctacgcaggaggctgaggcaggagaatcacttgaacagggaaggtggaggttgcagcgagccgagattgagccatcacactccagcctgggtgacagagcaagactccatttcaaaaaaaaaaaaaaaaaaaaaaagtaaatgggataatctcatttttcactatgaacaaaaagttttttttcttctcaaatttaaagatgatccaggtaaaccccactttaagttgaggagtacatgattgaaaagcagccagatgaagctacctagctgtagagaccctccacatattgaagctcatttgatcgaacatttccaaattcatgtaagtgctatttccatggataacaactcacaaatatgtaaatagtaaacaaagaattggaattaggcacatggtggccactacacctaccatacactttatttagaactgagtttgcttatatcagtatctggatccagtaaacccacaaggtagcaatttacttatactttcattcattcagtttacaagtgcccaatttgaatttgatgcccacgatgaggtttataacataattaccatgatcctttccccccacgaggtggtagaatgcaaaagggctaagtaaacaggaaacatctattaagggttttagagtaacctggaaataagcagggaggggactacaggcctagtgctccaggaattcaaaagaaagaaagatgatgtggatgcaaaatcaaagagggagtaacattagccctgaaccaaagtaagcttgaacttaccaggaggaagaggagagcatattcccatggggaatttaggcatgaatgaaaatttcatgcagtggggtcagtaggaaatccagcctgagtgaagcaggaggtcccactgtggaggagaatgcaagtgaccggcttcgtgagggagatgagatcacacaggggccagacgactggggttttgaatcggatccattatagaacatggagacactgattattaaccagaaaagaaatgatgagataaattgttctgcagggtaaatcaggaagaggaggctttgaagatggaaagataaacagactattaactatgatccaggaggaactggagtgggaggcctggccccaccgtgtcccacacagcagcaactgcacaaagaaaggagggccaagggcagcatttcatcttccgagcccacactcggtgcctgtgctcctcacaggagccttctgcacttaccagggggccatctgagggcctccacaccacattcaattccagcaagaactgttggagaactgcaagaaccctttcctgaaggaaacccagagactctcctactcttcgtagagaatgggaaccttcaactttgattcctaaactttcccaacataagtgacttcaatgtggctttctggtttgtttcttaagaccattcaaatacttggaaggttcctcctttttaccttctcactctattcctgcgatcccacagttataggttctcctcgtgcctctggtccaataccaggcgtccgtccactaagtagcaatgacgtccctgggcagtcacgctcagcctgctcgtctatcttgtattcatgaaagccttataatttcctcatctagaagactatgtaactaatatctaccagactaaaaataaatcataataaatgcccataaagatgggggtatgaaatgtgaaattgatcctagactttgcccatactgaccatgtgtttatggcactgagagaaaagtccttgaaatcagtcggccttgatttttgtcatcctgcctgtatctctgtgagtgatactattttaaggacctgtaatgaagtaaagatagtgtaatagtctatgtcataaaaagtgatattttttatcatagcaattgactatcctaggaaacactacccggttggttgcagtggctacagtatctccccatcacttactcacctggaacctctctgctgatgatacggggctaaagttcttctgtaggtagcaaatgttctgctacctcctgctctcgctgtgatgacatgtgatgcttggacctctctttctgaaccttcccgccatcattcttgcacttcagcagattcttactttgatttctctttttcaggatcccagtatcacttactgcttacatcatttcactacattttctcacctctcaaaacctcaattttctcccctgtgaaggggaataataatagtatttagctcatagggctattcttagttttaaatgacctaatctttgtaaatgacattatattgttgttattattactccaccatgagataagacagcgagaaatagatttaacacagacagctggacttaactctctgctctttttttgaagcactctgttccccgaatcatgttggccaataagaaaagagatgagcttttacttcacaagcttgaattcagcttaattcaatgataactgaatctattgttataattatccagtagagggataaattgatgaacccacctatttttcttagtataactttcaggtcaaaacagtaattaatcagagaagaccttagcttgcctttttgtagtcttgaccaaatcattgtcaattggtatgtaaaaaagaaattaacccatataattggtctttaaaaagctatatagacttactgaaatagcagaatgtaatagcatttgatgtagggtgtcaacaaataatatgaattttgcacagtgctctcttaactagaattaattatataaacatttggtcttttcaggttttcttagaacttgacttgacacctgattttgatgcttatgaggtttctgacttactttgaagaattacatagttgctttgtgatcatcttttcagttgaaatacaggcatccattgaataactgtcatttctaaatgcttattccaaagttacattgtgatattataaaaagtaatattaggtgaatagaaaccagagagcatccaaagttcagtctttattcagaggcagtaactgagattcagagaagttaaataacctgcccatagttaaatagctagtgagttattgaatagtatagctactaagttattgaaaattatatctcaggctatttgccttgaagtccagtattcttttcactatatcagtatgatcccattgttagtgttgtacatttcatagataaatgaatctactttgcagttggacaacgacaattgtttagaaattgtcattgtctatgtgagggaaatttagatattgaattgactcttaggccaagattcatgatctcttcaggtgaccaatggccccattcagaagatgaaaacgtttcctcaagcttttggaaatatgatggcttagtaacctagtgctttagtgacccagccttcggtgtcaagaagagagaaagagaacgagacatccagctgggaatcgagtgcttacttcaaagcttttatcttcagaggaaagaaatcttgtgaatttcattaatgtcaacaagatctgagaagatttgaagtgggtaagcccttgggcatctctagcgtgccagatgccgtggttattgtaagttttggttgaaaaaccattgcaactttgattcacacacccatgaaccaagactttggaaatatccattgtaaggttgtatttaagggaatgtagggaaccttcggtttccaagagaacatgaagtcagccaaggaagcagtggctaagcatggcccagacacagaaacacccaggattccaaatggggaaacacacattatggttaagggggagaaaagttgagtcccctcaaagttacatagcaaagctaaaaaaatagagtgaaagaagcatttctttaggattctaaaagcagataacttcacggcttctccccaaaaggctcttctcttactcattgtttaaaaagaaaaaaaatgaatttggtcctaggttttcccctgcctctttcttttctttctcactccttcacctccagaaaagaccagattggaattcatagctgtttccctataattatctaaactttactggagaaaactcttattctaaaacaggtaacactatttctatatagtaaattcagtccaagctaacccaaacaaacacatttctggcaaaacaaatggtgacaatttaatctaggtattgaaactgtaaatatcttaaaagataaaatatacctgtagctttccttttcccctttcttaattcatattaaaaaaactcaaaagcaaccatttctaaattcgcaaacattatgagttattgttaatgactttttttagcaatatgttatctgttgaataaatttcttttgaaaatttttagctttatttcactaaaattgacatttctgcttaaaaaacaaggagtaaatacaaacaaggagtttctgttttggtcatctcaatcttttaactactaaatccaataaacacaaaggaaaaatttggctgggtgtggtggctcacgcctgtgatcccagcactttgggaggccaaggcgagcggatcacttgaggccaggagttcgagaccagcctggtcaacatggcaaaactctgtctctactaaaaatacaaaaattagctgggcatcgtgatgcacacctgtaatcccagctactcaggaggctgaggcaggagaatcgtttgaacctgggaggcagaggctgtagtgagccaaggttgcaccactacacttcagcttggaccacagagtgaggctccgtctcaaaaaaaaaaaaaaggaaaatttattcagaatcatccaacagagaatctgtgatggcttagtgtcgtcaagaaacatgataataataaatgcagtgagttccacctgcacaaacctgccaagacctgagccaggccgccagggctcgctttctctctcaccacagcggatgacatcactgcaacccaatcagaagaaagccagctttagctgtgactgatgacgtcaaaggttacaggtcttaataggtgaaaatccttttacttgggccttaaagctcttgaaattttttagttcagcatttgagaatcaaaaatatgccttttctggtccagaaagaaactatttgatttcttctgtcagcattttttttttaaattccactcagtgttgcttcagcgagattacctggccccagtggggaacacatggcaaggcgatttctgcagtcggcttgattccgacaaatgctgggtacggaaagagcttggatctggcctgagttcactcaagcgccatgtgtgcaaagtggctacgcctggcagcaaatgctccacatgccaacggccagagcacagccctagaccgatggcggtgcggctgaaccacgaggcctccgcagctatttatttcagagccttggttttatggctgtcattcagccttgggtgcgtggagagagtcagtctgcctgagtcaatgtctcatgctctctgcggctaaggtgaatgttgttctatcagtataatcgtcatgtatttgtctgagatagttgctaatttctacagtcagttctacagtctagctattgtgtacctaggaagtaacacaaaccattgttgttactgagcctggcaagttgcatcataaaattcaagcttccgaaagcaggtatttagtgtgaagaaagactggtaatgatagttttatcatcatctcagtcacctcttaaccatttcctgattcactcaggtggtttttaatggagtttcccaagttagtgtttcctgggagaatgtttggttcgttgccttctaacagcctccagctcttcaggcatctcaggcaggagagcgtgttggggccgggactctcctcccgtggacctgacaactctgccttccccggtgtggtctcgctgttccctttgagagtgcgatgctgccgcttcagccaggacgttctcaaaattagcagaagggcttccttcctgaaatcgtgcctatttaggattttcttagtcattacgaaaaagtatagatagagttcataaatgacttcatctattcggtatcaaatgaacaacacttcaggcatgttgaatgagcaatctaaaggaaacatttatttgtttaatttttccagtgccttcaataaggctttcatttccaaataactcctttgtgtattgctgttcatacaatggctatatatttaccatttaacagtattgccccaaagcgtaagagtgagaaaaatccaaatttgaattaaattctccctgagcctcgcagtggccgtcacacgttcccctcctgcttttcgcgtctctaggatctccgagtgtcttgactacaacaaaccgttcagagttctcaagacgcagggctcggtggcaagcaaagcgccacgggggacacacagcgcgtggaggctctggaagcagtggggtgcgtgggcccagacatacttccatggaggagaaagtgaccactgtatgctacaggaagcgtggctaattaggcttcctcagctggatggcaagctcccgggggtcttttttgtctcgcattgccctatagcgcggagtagatgcttagtctacagggaggacagcctgtgaaacagctgcagctgctgccacgacccacggcgttctgcaggacggaggagcaacgcgtcagcacacgtcccgggagtgacgtgggaagacctcgctctggccaccaaaccgtccttcctttctgtctttgcttccttcaccttcgattttttcctttctcctgtaatagtcataactaaagaacgtagaagaaagaatgaagtttgcacacagtctagaattgaaatggagaatacatcatcagaatcctaggtcatccaagcctcttgctggtccgtgtccacggagtggcagatatctttgtgaaatgtaaatgtgtcaggtgcagctccccattgcggtggccctcggtgacaagatatacggctgtcccttcacagccccaagctgagttcacgcagcccggaggatgctatcgctggacaagagaccagagaccgggatagacacgtgcgtcctagttctgaacaaaatggtatccggaaagagaaagcatcccatggggacagtttaaggaggtttagatagaaaaatgagtgtgcatattattcatgcttaaactgcttacatcatcaaaaacaccaatattcagaggaataaatgcacttaaaataattcttaaccaagaacaactttgaggcagtaggtcacatgcctcctgcatggagggatctccaagaacagaaactaaatccctcgttctcctctgcctgcctctcatctttccagaagcaccaggtctggcttaaaccattgctttcattctatttgtttgattataaataaaatatatcttttccatcatcaatgtatattttctagctcccagacataaaatccactccttgctttctaaattgaagtgtcattttcctaatcagaattgacaattgtaaataaccatttgggtttattcgttttaatgtcctattctcacaaacgtatttttcacgtgtcgcatgtatttaaaatggtgagttcaaacttaatcatctcaatttcaggccctcaaaaaactgtcaatgtagcaggtttgaaatggagacctcatgattcacctgcttctcaacatagttagaccccaaaccgtgcagggtcattgtttcagcatgaaaagtaaaggaggtgttccttttttggtcttttttctaccccaatgatacgcattctgcaaccacaaatattccaactccaactcactttttgaataagcaactcctattgtgttttgttcttttatcatttgaggttatacactgtggaaaaacaaaaaaagctacatagtttacttactcctatggtcaaattttttttaaaagtaagaacatgagataaagttctgcttgtcattgctgccttctggggcagtggaaaagcaggtgccttaagctttccattgtgtgcagatcttccacgccctttccctccatcaggaaaatatgtctgtctcctggtctattcagctcttgaccttctgactcatatgccgacaaaaggcaccatttatgagtgactaatgtatgtatctttgtccataaggaacttgatcacagcagccacaactcagcatcatcatcaactatcttttccgtgtgccctccaggggtttatgcaatgggctctgtcctatgcaaacaggccatgccaccttctccctaggtccacctctttcatgcctaggaggagtttatcagctataatttggggagaaggggcacacaaagatgagcccaactctgaggggacatttgtccctgctttggttggaatcctggaaagctgaagttgtttctaaaaagcacattctctgctgctgacctcccctgtcacgcagggtcctcccaccagcacctctgttcaaatcccctgttgcttttcatcctgcccaccttcttccttaacatcttttctttacacctgtagcaaatgtcaacaacgcctcctcccaacacgagcttcctcctcctctctcaatccaactcaaagtccttcgtggaaggctccccacaagcggagccaccgggcttcatctcccccgtgcagccattcctgcctgcaccttctcacgcctccgaacaccatgtcaatcttaagaaatataaacagaaaaaccggtggacttcaaatgcatatccatttacatgtttgtttttacaaagtgtatcgttgttttcctcaaaaacaatagggcaaggacccttttgtttcaaaatcttatctcttgtttatctgatatattctttttgttttgtttgtttgtttttgagacagggtcttactctttgcccaggctggagtgcagtggcgcgatcatggctcgttgcaacctcgaccacctgggctcaagtgatcctcccacctcagcctctcaagtagctgagattataggtacatgccaccacacctagctaattttttaatttcttttatagagatggggtcttgctgttgttgctcaggctggtctcaaactcctggtctcaagccatcctcccacatcagcctcccaaagtgctggtattacaggcatgagtcactgtatccagcatctctctctctctctctctctgttcctctctctcattcgtgtgtgtatatatatatacatatatatatataacattttgaatatttgggatgatcaaactttaaataaattgaaattcagctttacctgtgacagcacaaacacatgtactatgaggaacgaaaaacccacctaatcacaatggctttgtgaaccattttaaggtcatttattatgaataaatgacatgcactacagttgtgtgactcacaatctttttttttctgaaaattagtaatatatctgcctgccttcaccctcaccaaaagaaaagaataaggatagaaatttattgtgtgtatatcacagaagacagtgatatttctctaataagtttctggaaaaatcaagcaaaagaactgcttccctgtgctgtgtaggattgtaattgttatatttattctggtctgaaccattactaagtcttttttaaatgtctcgaatgactaattaaggataaaaggttggaaacaccatttttccctctattattttcacattcaaacaagataaacattgtgggtctacacttgaaatatgaataaaatgaattctttctctggtgaaatgcacattttcaagttgcactgaaggtccctggccccatggcactctctaggcctgagctgtcaccctcatcctactgggtcctcccagcccacctgtgtactttccttccaccatagataaggcaggacacactcatgacttgcttgctgggagaataaatgtcgttgaagcccttggtaacctaggagtggaatacaacagaaagcgtggaatgactatcgttagagaaaacaattgtggaatatctacacgcagaatggaaactaaggggccccatttttgtcagactccctcacccttggtaactcctgcagcttggatacaatcgcatatctctttccttagtgatttgagattgagtctgtggtgtagaggagaggctcttagccataggttcctggcctttgaaggccaccctaggaattgcttccctcgtagcatcagaggcagctgaagcggtcacttccagactctgcagctgacacacctccccggacttggggactccaaaactagcagtggcacaaactccctgcaaagccctgactgacaaatagctgtcatcccagcattgagtgatagttcgggagcagccagggcaggagaagcagcttcctcctgtcccacctgcacctggaatgagcaaaatgatttcaaggaactgaacacttggattactgggattcaggagaaagagtttgccatgtgttcaaaagcagcagagatgcgggtgggggctaagcctcattccaaagcagatccattttaaatcacacggaacgaacagcctgatctcacaatagactgttccttctaagtacaccgtgctgtgattttggaaaactcagggcccaagagaacactctgtatataatagatcaagaaagagagtccccgacttgtcatctttcttgtaactgtgattcacttacttttgtttactctgttattcctttattttaggttatttttcatcggctccaatctgggacttggtatttttgtacagttgccactgcttttaaaactccgcaagatcgtgtaaaaatcttgcatgtttgtgtctcctaataagcattcagagaaaatgcctagactgtgtaggacttttcgggaaattgcagagaagtaactggcctctttgtgtgtttgcatgcaccagtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgtctgtttcttagattacaatagtgtactgtgcttatttgttctaagagaagaattgcttctttatacagctccgacagaagcaggagtccgagttaaaccttcagttgtatagacaataaactataattttcatatgcaattcagcaattgctgttctgtgtgtgcctgccctgggggtgatgtcagaggttgtaagggaagagtttatgctgactgcttactaggtgtttgtcatggaagagaagcatgggttcagcagtgcctctctagcagctgtgcggaataatgtgctttgacattcaataaaactgttgaatcta

SEQ ID NO: 367 - DNA, 588361 bp, Homo sapiens; identical to SEQ ID NO: 366

SEQ ID NO: 368 - DNA, 587523 bp, Homo sapiens
agtcgcttagcaaccgggaggcttacctttggaagcttgttgcagctctagccaaggtcctgccctcttcccgccccgcccctagggtccagctcccttcacctaggagctgccaaacatctggatcaacctgggcactacgaggggttgaatttctaccattatcgcgccttttgatatttttttccagacctcctgctcacatccgtaaagcccactgattcttttactacactttttatgagaacaagacattttctaggaagatggtggcagaaaaagagaccctgagcttaaacaaatgcccagacaagatgccgaagaggaccaagctgctggcacaacagccgctcccggtgcaccagcctcactctctggtttctgagggtttcacagtcaaagccatgatgaaaaactcagtcgtaagtgatcttcctgaattaaatgcactcgctctgaatcaggggacacgagatttacagaggttggccagccttaggatggactctgagccatgtcctgggtggtctttgccaaaaaaggcagttacttggcaagtagcaaacggtgccccacagtgtgtggggggcaggctaggttgttagaatcttgggcaagtgatgtactctgcccatttataagcaccttcctgataacttatggtttctggaccgcccaaaattactcttaagctatttacacgaggaaaaaagatcccctttacttactaattcctaactagccccactcagcaaagggccttatagaaggtgagttcttagaaatcataaactcttgcaaaatttaacatgagctgatatacaaccgggaacataaactcatgaaataatctataatgagaaatttcttcacttcaacctaggaaattttagaatatcctagcatttgctctaacaacacttgtctcttacaaaatgatgtcatcttcttagagtactgaaagccaacttaatatgaacactgtttcctgacaggccttttaagatgatgtgctttaaacaatacaagctttagctcatatatctctgctactaatacaattcatatttcatctctattatttgtagtaataaaaataaaatattctaagtatcattagagaaaaaagattaaaaatatatacaaatattttagctgtctgcatgatagtatatattttttaaaccttcctatttgttaaatagctttacacttggtatgctaagacagattttgctactgagtaagcaactgtctgggaatgaggcattaaataataaatgcatctttcaaatttgtgtaatttacaccctgggaagatctgagttattacatggcaattcattatgttaaatgaatagtgttgttttccagtgtcacattatttcctttgcttataggttgcaaacctgataacttattcctaaacgacatacttaaaatacatgaatgaaacagattacctatagacctctaggccaggttcccatgtggctatgcaaaacgatatcctaattattgggaagtgtgtcaggtgatttacagtagttaaaattcttggaaatggactaaaattctgcttgttgtaactaattctttttcatggaatttcacataaattggttctcctaggagtcaagatgatgcatttatcagcaataccataaccattcaggttaatcatttagtttttcttctacacaatatttacaattttgatgttttttaatgttatactttaattttttttttactggttggggttcttttctgttttttcctaaacctgtattcataattcttgtatcatattaattctttaatataatcttacacctaaagagatagttctgcaaaatctgatgtttctgtattgccaaatgtaataagtatgcctacatgacttaaaaaaaacattgattatgaagcaggcttctttataaacaacttaattgagatccattatcttctctttttatgttctaaaggaaaatcttgtactagcaatacctctcttgccattggaaatcgtaattcttaaatgcaaacattatttatccattcatctatttattcagtcaacaactgtctctcttttttttttttttaatacccagtgtttgctaagcacagttctggggatttgggatcagcaaagcaaagtccctgcccttagtactccgaggaaaaccaaaataacaacattcaaatcttgataaaagaaggctggacaataccgtttatacaaaataacttcagtggtacaggaaataaaaattttcaatttcataaccaatatttacatttcaccatttttatctttagcagtatagacttctcagcattataaggtgaaaatgtcctcatctctttctgaaggtgtattttgattcaggacgtgtatgccaatttccagcttttcttaattgcaacctcatgctccaagagccaacaccctccaaaccacttttccagttagataagtcaacattccaatgctcttccacctaaaacatgaagaactgtatatatcataaggagttatacagagactcctgatatttctctgagtgcgatagtgatacaagtacataaacttgataataaatatgtttcatcaaatgggctgtgcaagcagaaatgcttatttaaacaatctggatatgagagtgcaagattattgaaaaaataatgataaatgtaaatggcaaaatttttaaaatctcaatgtcaaatatttttcttcaatagaaactagactttctttccatgaaatttttgttgcattctataagaaaacaagcatcacaaaagccctgcaatgaaataatattcaaattcacatttttatagtgcttgcctataaagagatatgagatacacaacttgaagatttcatagttcattttcctttaaaagtcttgtttggggtgtgatagagcccatgaccagaaactagtaacccagtattttgttgtctttatcttgtcagatactttctgtgctgaacaagcttatcacgaagcaagttagaaaatcgacccagggttatggtgacagagaagttgagttcagcctaagctttctattacagctttccttctcaaaagactatagatgctttatgctcaaagtttaggggaatggaataaataatttttttaatattaaaggttgagtattcctattccaaaagtctgaaacctgaagtggtccaaaatacaaaactttttgagtgttgacattacactcaaagaaaactcttttgagcattttggatttcagattttcagaactggcgtgaccatcagtatataatacagatatagtcagctctttgtacagattctgcctccatggattcaactaaccttggattgaaatgtttgggataaaaattttatctgtattgaacatgtacagacttttttttttgagtcattattccctaaacaatagagcatagcaactatttatggagcatttatattgttttagatattataagtaatatagacatgatttaaagtatataggtagaaatgtgtaggttacatacaaatactacgccatgttatatcagggacttgagcatctgaagattttggtatctgcaggaggtcctggaaacaattcctcatggagactgagggatgactgtattccaaatttgaacaaaaaacaaaaacaaatccaaaacacttctggtcccaagcatttcagataagggatagttcaacctatactttacatgtatagtgtgttttatatttaccaatcatgtgctcatttaacacgtagtggtaatcatcaatatttataaattatatattaaaatattaatttggcttctgtaacactgaccaaataacaatagcttaattaagatggaagttgtttctctcataatagaagttcaattttgtaggcaatcccaggaggttgggcagcattccccatgaggcaggtgcaggggcataggagcatgtttgttctttgcatcctgtaaaatgacacctgagacaaggggggctcgagaccaccagggtcaaatacctgccctcaagaaggaggaaagtggaagcagagagcttcccattatgtgcatgacccagacacagcaccccactttcattctcatccaactggccagaacctagtaataaatacacctacattttccctttttgcaaaagcctatgaaagcttgacccatgaagcaactcccaagcccacgtacctgtctcctcaggaaaaggatgaaggaagctatgtagttccaaaagggcatcatctccaacacctacttcaggtggaggagagaaaaatgggtatggagcaatctgcaagaatgaggcaggaagaaatgaagagcaaacagcttcactatgagggcatgtcccagaaacagcaatcctcactcctgctcaaatccattgccaaaacctagtcttatggccacagctagttgcaagagaggctgggacatgtagtctttaactggtagctctgtgtccggctcaaactcacaatgttttattactgtagccaaggaatattgggggataattagaagtgtctagctccagtgctaaatgtgctacattattagtgaagaaaaggagagagacaagtaaaataattacaatacaaataaacagatgtctctggcagagaagtactaatgatgaagggaccaagtggcgatgaactaatgggtgccctcatcaccttttgtctaggcttgtacaatatcatccacctatcaattggttgactccctcaatcaattatcagtacaattacactaatctttctggtacaatgttctgctcctatcactattcagagcttttggagcttcccaattcttatagaaaaaaagtcaagatacttccccagggccagcaaggtcttgtgtgatctaatcccattctgtgttctaaaatttcatctcccactgttctcatttgcttcagtcaatctgaaccaaggaaataaactcatattctttatttttgtgtttctgtttatgttgttccctttgctcgaacacccttctccctacatatctgcatatacaaattcattctatcatcaggtaacacatatctattgatcacagactatgtgcaaagcactgttttaaatgctaggaatttagcagtcagcaaaagacagaacacatgctgtcaagaagcttatatttttgtggccagcaaaatgccaactgctttaagaagacttctttaattctcccttcctgtcacccacatagaaagttatcctttattcattgtgttctactttgtattatggtcatttctgctcatgttttatctccttatgtaaattctccgtgagggcagtatccacatctaagtcactttttaatcttaaccagaacctaacagtgtattcaataaatatttgatgaatgaaggaaagcaattctaccctttcttcttatctcatattctcctactttcttattataattgttatttgtctctattttgaatttttttaagccatcctctctaattgtggagcccagaagctccctttaaaacttgagaaggccgaatcatggcattcgtcacctcaacccctcaggtggctccctgcctcactcagagtaaaagctaagcttcctctattgggaaggccctgtgtgatctgcccacccttgctgctttatgcaactctgctggccctgcctccggaactcagttagtgccacgcctttgcccttcctgtttcctctgcctgaaatgcattttaccctgtgtgtcctcatctcttgatgcttcaaatttctgtttaaaaattagctatttagtgagcctcttcctgaccactctattttaaacttcagacccttaacaatcccttccatccctgctccagcactcccatctcccttccctgttttatatttttccctctaatattaatttagttgagcctgtgtttttcttctaccagagagtaagccccagaagggcaggaatttgtttatttcacccattgctgcatcctcacctcaagaaaaatttatggcacatagtagctgccatttatcttattttgatcagttgaattaatgaaagactatattttatactataattagacaatcatcttcaaatcagtggctccaaagaaaatgccaatgatgttatatagatattaaatctagaaatgagaataatttgcagctgttttatgcagtatcataaaagttacacatgttcattgaaaaaagttaaagtggtttggcttagaaaagctttttcctgtctaagatgatgagaaaaaattcagtctttttttcctggattctgttttacttttaattttttattttgaaagtttgcttcaccttaagtcattttgattttggaaggtataaattttgacttattttccctaaatggccagagaattgttacattaccctttatatacttaaattaaattatatcaaacatcttcctatcaaatttaggaattcctatccaatttaaataatatatcagtgctgtttttattatttcaagtaactttattaataattgattacttaatgtcatatatttattctttcatatataatagggctagtgatcttcattccatttggcttttccaaccaatcttatgaaaaggcagagtagactgtgtttttccacttaatgtataaatctcaaacaatttactattttgtggttgtttagagatacttattaaaggatagagcaaggactggaacctagatttctaggtttttcttacaacagttctctcacatattgtaagtgaatcacttggtgaatatcaaaccaaacacactgatacaaccaacacccaaatccagaaacattgtcaacaccacagaaccccatctgtctctttgtagtcactacccaacattcccacatgctaaccttcttctgactttggccaacagactagtttcacctgtttttgtacttctatacatggaatcataaagtatgtaattgttttgtgtccagtttctttcatcaacattctgtttgtgagattcacccacattattgcatacaactatagttgtaagtaaatccttcatgtttatccctgtctagtattttcttggatataccataatttatttatccatcgcttcctcgatgggtatttgtgtgacctccaatttagaactgttacaaatagcactgctaggaaaatttttacactttttttggagaaagtatctacgcatgaccaaggacatatttctgggagtggaattgctggaccctaagtcatgcttgtttggctttagtaactaaactaaagctgttttcccaactgatttttcaaatttaaactctttccagtgctatatgagagtgctgtttgtgctacagtctcaccaataattaatattttctttattttgcattttaagtattccagtaggtatgtaatgttatatccttgtcatttgaatattaattttattgtgactaatgaagttaacaacttcttcatatatttactgtccatttggatatactctttattgaagtgtctttttaagacttttgactgtttttctcttggcttgatttggttttttatttatttgtagtacttttttccatctatattctaaatgatatgaggcacttgtctagtattgtatgtattgcaactacagttacccactctgtgagtttcctttccattctcaataatggcttttattgctctttttaaagttacatactttgtgaagaaaaatgtttacctcaaacatacttgtgtatttcttcataatgtttcctcaaccagtttcaactagctcacagtgaaatacatatacattaagacacatgacttggaaaataaattggagcgattggaaatgaaatagaataaacaacagagaaataataaaataaagtgtaattaaagtagaaagcttgggctcaagaaaagaagcatcaattttgtcattcataagagtcagtatatttatcaatggatgttcaaatttaattctgagcttcttggcatctgttgctgaaaggagaacattatacacatctcattatcacaaaaggagaagcccatcaatccctatagggaactgaagctttctctacactgaactctctgagaaattggtcatgtcacattttaaatacatgcaacataccatatctacatttttatcttttgcaagaaatgcagtgaaaatatcatccacaaaagatttcagtgagagctaagtacacgttattaaaatgtatcttggcaaattggattttgcctgatattaaattgttgtagtacatgtacgtagactttcggtggtccaatttgatctggaaatggaatttacagtgctcacagaaatgtgtagattgtatatattttagttattgttctcagttcatttcatgatgggagcaagatagctgcgtttttgtagttggcagggagaaaatgtgtaatatgataagagcacagagctgaacgacctgagagggtctgagtccaggaaagtttcctgaagggaatcatgtttggtgaaatataacagttgagaaggacctaggggagtgtgcaaaggctgagagagaccaggctcccagctactgtggttttcaatcttattttctgcctttttttttttgccataaataattatgttgtaagttctattcattatatacatgttaaaaattatttagattgcatatatattttatatattttgagagcatatagagtgtatatacctacctgtatgtttgtatagattgcaatgtacataattataataccttatatggaattttatggattccttctaatatgctaatattttacatgttgttgaaagctcataagcatttaaaaggcttcataaaattctatgctttgaatttgtcataatttactttgtctttcacttaggttgttttcaagtatttactattagtgtatacatagggttgaaattagtatctttctataaaaagttttttctgtattttacagtatttccttgaaatacaatttctgaagtagatgtactgggtcagagagcttatcaatcttaaaaccccaatcaaggttttattaatactgccacctgctgtgcttgaatgtgcctattctagctcctcctgtggcctgcctaaggggcttttgacttcccggaccttgcctgctgtctacctcctcatctgccagtgttgagggtcaggatctcagcacctctgaaacctattcatgatacaaatgagggggttgcaaacatctaaggctgtagttctcagattgcaaattgtaatcacttgaaagattcccatttaattcttctaagtgttctggggttgatttaattagtctttaattaggggttgagaacatctgggtacatagtatgatggggaagatctcagaaaactattttctagatggctactcaattttcccaaagacatttattatgtaatattttattccccattgctttgtgtgttctttttctttttgtgtgtttcataattctacataatagagatatttgagaggaatttttaacgaatgtccacagttttaattattgtggtaattaaaccacaacttggtaatatgttttagaaattggtggggctaatttatcctgttaattcccagaatgtttattttaaattttaacattttaccggtttaatcttccaaatgaccttttaataagatgtaaagtcgaacatcattttgagttggaaatgatcatataactcactagcaaataatgatcattgtataacagtcttcacttatagtaatataatttatcattccatgcttataggtatacattttcctaataaatatttttatatttattttataccaagccatctcactaaccaatgttttcactgaattgcatgtattttattttaatcatgttcttctacattttgaaaaatttaaatctacaaataaatatagaaatagaaaaagaggcatttattcaccatctagatttaataaacaatatttttaattgtaacattatattcttataagtaaaacaataacctcactaagagagccacagcttaatttgtactctgtcctttcattcctagaggcaagcaggatcctgaaatttgtatacattattcctaaatatgcataatgaatatatatgtattcgtatatcctatagatagatggatacagagatagatgcagagatatagagataatagaaattcaagaactgttcttcaggttactttttcatctgagctatttggttacagtgcaggtttctgtaatgccttcaggtcatattcagttcattaatagcagaatgctatcagtgtacgtaagacgttcagatgtgactttccccatcttgttagtattttgtgtcacaaagtaacagcaactgggtacaaattatactaacacagctaaatgcagagtgacacagagtaatagtgtcatagattatacctgtttgctatgggttcttcttcctagttctgtttgtgcacttgctcttggaagcatctaatgtgaggcaagcccaatctttgtagatccttacaatgtccctatcattttttcaaaaggcatagcactatactgtatttactccaatatttcatttttaaaggtaaggaatgtaatattttaactgtggtagttcattttaattagaatgattattaaatgctctggttacaaagttgcatgtatgtatagagctttgtaaacattattttccccataggtttccccatacactttgatatttctagttagccattttgttaaatggtggttctccaggaatgcatgtcctgttaatagcaaatttgtttacctgctatgtcatattccattgtgtgaataaaccagctttttagttcattctcatactgagggtccgttaggtttctacattgcagtatcataacatcctattgtaggattccttgtgcatgaaggccaaagttcaccagatttggaattgctgaaagatgaggtataacttcaactttaatagagtttgtcaaatttctcttcaaagtagtatataaatatttatattgtgaccaacagctaatgagaattcttttttccaaatgcttgtttccaagatcataaattgttggtatcagactaaaattgtaccaatctgaagtatatgaaataatatcttgttttaattttgcatttctctgattactagtggtcatgtttcctttttataggagttttatcatgtagatttcttcctctttagtgtgcatattcatagcctttgcccattttttctgttacattgtcagtccttttgttattgacatatagctgtacttaacatactctagatatggatatgttctggatatggtatgtacatattttcttgcagttagcgacttgtctttatacttatttttacatctttttaatacataaattttaaatttaactttaggtatttatacttatcacattcttcctttatggttttggtgtttttaaaaaatttttgtcggccaggcgtggttgctcacgcctgtaatcccagcactttgggaggctgacgcaggtgaatcacgaggtcaggagattgagaccatcccggctaacatggtgaaactccatctctactaaaatacaaaaaattagctgcatgtggtggcaggtgtctgtagtcccagctactcaggaggctgaggcaggggactcacttgaacccgggagccagagattgcagtgagctgagatagtgccactgcactccagcctggcaacagagtgaggctccatctttaaaaaaaaaaaaaaaaaaaaaaattgcctagtttcaaaagaatttttttgatcctaatattgtaaggtttcttctatgtgttttattcttataatgttcacacatacattgttaattatttaactgcaaatttacttttaagatgggaggtaaggctttcttttgatcttttccatatggagagccaccaagacagtaccatctatgaatactaactgagtactctgtattatgtcccattagtctctttgtctgtctctgaaccagtatcacactgcctttattgttgtagctttacaaattttgtatttagcgagatgagttcccccaatttgtttatatcctagttgacgtcgttgctttcttactatctataggaattttagaataagcggtcaagtttcatgaaaatttccttggagattttaactagaattttattcaaggtgcaatttgtgggacaatatcaatcatcttttttttttttgagacggagtcttgctctgtcacccaggctggagtgcagtggcgtgatctcagctcactgcaagctccaccttccgggttcacgccattatcctgcctcagcctcctgaatagctgggactacaggcgcccaccaccacccccagctaattttttgtatttttagtacaaaaaatttagtaacacccctgtgttagccaggatggtcttgatctcctgacctcgcgatccacctgcctttggcctcccaaagtgctgggattacaggcatgagccacttttttttttttttgagatggactcgctcagccacccaggctggagtgcagtggcataatctcagctcactgcaacctctgccccctgggttcaagtgattctcctgcctcagcctccaaagtagctgggactacaggcccgcgccaccacgcccagctaatttttgtatttttagtagaaacgggggtttcaccatgttagccaggatggtcttgatctcctgacctcatgatctgccctcctcagcctcccaaagttctgggattacatgcatgagccaccacgcccagccatttcaattttttatattcttaatttgctaagggtgtttttcttaattggaagtagtattgaattttatcagacacttgctgcatctgttgtgatgattataagatttgttcctcttcagtctgttaacgttaattatgtgaatacatatattctaatgctgaattatccttatattcttttacattatttaatcatgatgtatttagcttaaaaaaacaagcataaattattggtgtctctgatttaccaggcagcaaagtccttcctagtgatccaccacaaggtgcttttgtcatatcattccaagatgaggtactattgctagggtagtcttttcaaaactgtgtgttattgctagggtagttagtgtcttcaagatcaggtattattgctagggtagtgtcttagtaggctgggtctgtcataacacaataccatagactgggtggcttaaacatttatttctcatggttctggagactgggaagttcaaggtcaaggtgccaccattttggctcttggtgagggctctcttccgtgcttgcagatagccaccttcttgctgtgtcctcacatggctttcctccatacatgtttgtgaggagagcatctctctctctctctctctctctttcttgtagagccactaatcctggcctaaaggccccattctcaagacctattctaaccctaattactacccccaaagccccatcttaaaatacttcacattagggattagagcttcaacacattaattttggggaacacaaacagtcagtatcaggtaagagatgggattgctgtgtttggctcatctgtcaagactggaagaaggaccatctcttggagttcttggctgccagaatgaaacaatatttctataaactaaaagaaatcaaaaaccttcctttggaaagaaaactaaatgtgtgtaccacatttgcattctacaaaaaatatttattagattttaatgatttttttacatactcataatttttttgcagtgagaacagttaaatctactctcagtgattttcaagaatgcaattcattgtgattaactatagtcaccatgttgtacaatagatctcttgaatctatttctcctatttaactaaaattttatgtcctatcaccaacatcatcccaactccctcatctcccagcttctggtaagtacccttctactctttgcttctgtgagtctggcttttctagattccacgtatgatatggtttggctgtgtcctcacccgaatctcatcttgaattttagcttccataattctcacatgttgtgggagggacccagcaggacataattgaatcatggggagtggtttccctcatactattctcgtggtagtgaataagtctcacaatatctgatggttttataaggggtttcccctttcatttggctctcattctctctttgttgccaccatgtaagacatacctttcgccttccaccatgattgcgaggcttcttcagtcacgtggaactgtgagtctattaaacttctttttctttataaattacccagtctcaggtatgtctttattaccaataggagaatggactaatacaacatgtaagtgagattgtgtggtatttgtctttctgtgtctggcttatttcacatgcataaatattctccaggttcatcatagtgtcataaatgacaggatttctttttttttctcattccctcaagcacttactctttgtgttacaatactcttgtagtagttttaatccttctctttttaaggctgaatagtattccattgtctatatatgctacactttctttaactattcatccattggtggatgcttaggttgtttccataccttggctcttgtgaataatgctgtaataaacatgagagtgaagctatctctttgaatactgattcaaagagaatagaaagaagatattcaaagaatatcttctttgaatacaggttcaaagaagaaaagtggaattgctggattatatggtagtttaaattttaattttttgagggacctccgtactgttttttatagcagctgcaccattttgcattcctgccaacagtgtgcaagggttcccatttttccacatccccacaaacactagttatcttttgtctttttgatgataacggttctaacaagtgtgaatatctcattatgcttttaaattacagtgccctgatgattagtggtactgagcattttttcatatatctgctgggcatctgaatgtcttattttgacaaatgtctattcagtccctttgcccactttaaaaaatttgttcttttgctattgagttatttgagttcatgtttttcttttactattttgggtaattttaaacaattattttcattgtaaaagagaaaaattcttatgtagagtcttaagaaaatacataaaagagaaaagataaatctcaaatctcattttttagtgttaatcactcttgaattattcccacatctctacatgccttttttgtttgtagaattggagtcatatcatacatatatcatactatattttacattttagtatgaccaatatattctcattgctaatttattaatgttttttccttgattggatttatttatgctttggttttctttgtatgctatctctcgaactgacataccaattcttccagttttgataatggatttcttatttctactctcacatatttttttcttttgctttccattattaaacttttttactgagtttttgaattatttatttaatgcctctttttaacagttttattgagatgtaattcatatacatataattcactcagttacagtgtaacatacagtggcttttagtatattctcagagttgcacgtatatcaccacaatcaattttgaaacattttcctcatgctaaggaaaaaaaacccttaattatcatccaccaaatggcttattggtcccagctctaggaaattgttaagctattgtctctagaaatttgcctattctagacatttgtcttttgaaatacttttgtttgtaatagaaattattgttcttgttatttaaaagatatgtaattgtatttttgcttccctcttttatatggttgttacttatgaggaattatttttcctattggttggggctttctgattatggtttgattatgattttaaaaaatacaattgttgcttgatggttatttagtttctacagtctaagctgcttgaagtttattagagttttggtctagaataggatcattttctagaaatgttcctatgaaaacttgaaaaaaagactttttttgtctgtagttattctggatcattaaatgcagatcatttgtttcagtgggaaagatatcagagacatctatataaagatattattcctggctgggtgtggtggctcacgcctataatcccagcactttgggaggctgaggtgggaggattgcttgaggctacagttcaaaaccagcctgggaaacatagccagacccccgtctaaaacattttttaaataagccaggcattgtggcacataactgtaatcccagcttcttgggaggccgaggttggaggattgcttgagcacaggagaccaaggctgcagtgagctgtgatcatcactgcactccagcctcagtgacacagcgagaccccatctctttatatatatatatttcataaatataagttgtgtatagtaagaatttggtcagtcttaggcatatttgaaataggtacataagttttggtattcccttctgtttattttctatatccctatttagtaatccataaaaaattgtttaaagattttaaaaacatgactcactgctaaaaatcaaatgatatcatgtaatgtttatggcttttgtgattttgatcagtaagtagaaaatgcaaaagaaaacaagttataaacaataatcagaaaacaatggagaaaatgtcatcaaaatgtattttttcgtctttttttaaccatatcacagaacctagcaaattcatgtttcaggagctctgaaaatgacctgacaataggtaacaatatttatttatacttccttttgggcccagcattctagactttttctatgttatttatttcctggaaaatatatatttatacattcaatggataactttcatatttaatggccttaaaatgaaattttttaaaaagattcaggaagatatatatcattttgcttctgcttccttagtaagaattgacttaaaaatccatgtgccatatatacactactgaatagccataaaaaggaatgagattgtatcctttgcaaggacacagatgaagctggaagccatcatcctcagcaaaccaacacagacacggaaaaccaaacactgcatgttctcactcataagtgggagttgaacaatgagaacacgtggacacagggaggggaacaacacacacaggggcctttcgggggatgtggggtgaggggagggagagcatcaggacaaatagctaatgcatacggggcttaaaatctagattttgattgataggtgcagcaaatcaccatgacacacatatacctatataacaaacctgcttgttctgcacatgtatcctggaactttaaaataaaaataaaaataaaataaaaatctctatgcgacattgagggagttgtgaggacacatacttgaccagacagtggtcttatattggtgaaaagcacatcaaggtttaataactaggatgactgctgattttgtagtacctagaaaataagacaagagacattgagatttaatacttgaggtccaacaactgaaactttcaagcctgtgtgaggtaattagttagtctgtggtagtgaagaagtgttctgcttagggagagatttatttttaagttttttgtgtatatggaagaatcatagcctaaacacaaatttaagatattattattcatgaatttgcttctttttcaaagttactgtcattttgggaaaaaagtgtaaactgataatatcatacataataattatgttgtataaataataatttatattttagaattatcttcctaaaccagttcaagttagccattgatgtgacatagattagagaaagtaatactataaaaaaattatgtaataaatgccaaataaaataataaatacaagatagatcatggctaactaccttacttttgtggtttttgcttagaagaaaatctacagagaaatatatttcacaggttgtctattctaaattaaagtagctatgaataaatagtcccagagataagcagtaaatcctttaccaaattttctgtgtcctgcaatttatattttaaggttattttgcatgataaaactgtaacattgttttaaaattgagtaaaatgacacagtgttaaatattttcacttgagcacaaaaattttttgaatataacacggtatttaaatatagtttagaattttatatgatgtagtgattatagacagaacagtaacagttgtataaggtaaatactagtaactttaaacggtaatgatggatgcctctgtttatggtttatttcccattgaaatttcttaaggaaatgttatatttgctgatgatttcactagatggtacacacattcacacaaaattatcttctgtcattattaggagtaaatatgaagacgttttaggcagtcatcaaatataacttttacatacaaagaatgaagcataaatagccagtgtcttggtctcccctcccctcggtgctttgcacagtgtcatagacataggagatgctcagtaagaagtgttctggattttttaattctagcttagtgtgtgaaagtgattccgctcagaatgtccatcccctgttttacatttctttcatattcataacttacaggaaaaaagaggtaattaattgactaggatcttgcagatatataaaaggacccttctctgtatcacacttggccttcttatttatgtgcagaatttgattgatttgaaacttatcaacacttgatactgcaacaaattgacaagaatgatgttttagtaaaaccaaagaaaccagaaatgttgggaggtgtgatgtttaatactgagtgctaattggattgaaggatgtaaagtattgatcctgggtgtgtctgttgctaaaggagattaacatttgaatcagtgggctgggagaggcagacccatccttaacctgagtggcacgggttaatcagctgccagcacggctagaatataagcaggcagaaaaatgtgaacagagagactggcctagcctcccagcctacgtctttctcccatgctggatgcttcttgctctagaacaacatcggactctaagttcttcagttttggaactcagactggctctccttgctcatatatatatatatatatatatatatatatatatatatacacatacatatatatgtatatatatgtatatatatatgtatatatatatataactataaatatatatgtaaaactatatatatatataactataaatatatatgtaaaactatatatatatatatatattccattagttctgtccctccagagacccctgactaatacaggaggttatcaaaagcatgtatcagcaccagtacactgggtatattagacaaaattgaaatgcttctagtgacctacgtagtacaaacaccaagtttacccagagctaatgcagggaaagccagaatcaaccaatcaaccagattgagcgagccaggataggacttaagctgaccaagacagaggagacagtttaaggtgatttcacatagacaataattttactcagaatccagacctagatcccaaggtaaactaagatccagccaagagtattagtaatgggagacggggctcaggaaatgtagagattcatcttaatccacaaatatccttaaaattcttagtctcccattaggagacacctgggctaacatcatattttctggaaagaagggagaacattctggagtgcagatgataagtgggctaaaaaatgatttcagactgctgtgctgatgttagcacttttcataacaatttaagttttactattctaaaataattaattcaacctattaattttactctatggttttttaaccatagatctcacctctctaactctagtcaatcactcagtgataagtggcatttgtcattaaagaaagtgggttggagtgaatctgctgaaacgtattaaaatattggaaaaccaagtcagaacttgtattcagggccggggctgtggctcacgcctgtaattccagcactttgggaggccgaggcaggcagatcacctgaggtcaggagtttgaaaccagtctggccatcgtggtgaaaccccgtctctaataaaaatacaaaaaaattagccaggcgtggtggcacctgcctgttatcccagctactcgggaggctgaggcatgagaatcgcttgaaccccaggaggcggaggttgcagtgactgagatcggaccactgcactccagcctgcgcgacagagtgagactccatctcaaaaaaacaaaaccaaaccaaacaaaccaaaaaacttgtattcagtttatagtggaaaatccatatcatcaattttccattgtcagatttgaaaatctcttctcaaatcaataattattttctaaagtatcaatgagattcacgcacacagttaacaggtaaagtatagaaaatggcttttctgaacctatcaatccctgaccgcagcctactcccctcccccaggttcacatcccttcacctctaccacatttaacccttttttatttcaaatattaaaataaaaccatttcaaatctctacgtattatgcttatactactacttttttcaaaagcttaattgaagtatcaacaataaaccatatatattatagaatgtgataagccttgacagcaatcaagataatgaatatattcatcccctctttttaatccctcacactcactccttccccccttctccagttagccaatgatctgctttcttttactatcaatgagtttgcattttgtagagtttacataaatcaaattatacaggatgtattttctatggatctttttagtcatcagaattattttgagatgcattcatttgtatgtaatactttattcctttttattgctggaaaggattccatttatatggatatagcatactttgtttaaccacctgctgttgacttgggtggtgtccagtgcatgattgttaaaaacaagtacatactctgaacattgttgtacaagtatttgcatggatgtatgtttatctcatttggctaaatatctgaaagtggactagctgcaccgactgtcaagaaggtgagaggatcaaaactccaccatgtcagcttttcctcggctggcacatgaagttattaatggcaataacaagaatatccttgccatccctgagacatacgaaagatcttacagggatatagtttatacttattacagagtatgtataatcctgcttattacatgaagatcattctcctggggcacaaaataaaaggaaacatatttctttttttatttttttgagacggggtcttgctctgtcgcccaggctggagtgcaatggcgtgatctcagctcactgcaacctccacctcccgggttcaagggattctcctgcctcagtcccctgagtatctgggactacaggcatgcaccaccatgcccaactgattttgtattttcagtagagatggggtttcgccatgttggccaggctggtctcgaactcctgacctcagatgatctgcccgcctcggcctcccaaagtgctggcattatagacgtgagccaccgcacccagccaaggaaacatatttcttactgtaataagtgtaaactgtatcactgaatatagtaatactttcatattatgggaacattcaccattgatttatatatgctattaaatacatagtttctatagaagctttattgaaatgtcatcagattatgaaaaccaaatccccataatttttccactcatgtatatttacatttgcattcactgtctccattgttgattacccaatgtgtactgatgtttctccttacaaactatgatagtacttaacattttgcttcatttgttgatactgatttgttccgtgtacataaaacttaaatttatgtctgccttcacttattttctttcaaagataccttaggagtctttcacattttataagaaaccataaattttatttcagccttaggccaaccgctggctttcttgccaacctagatgcatatatgcaatttagtctgtgagttttgaaaatttgaatgatagcacattaaactggaataatgaaccaataaaagtttttatggcatttggaaaaattacttctcaaacattcacactgtcattttactcattaaaattattctaggatcataagttagaccatgtattcctaaggcttgaaaaatcaacagattatttctaatgatcattgatttgacctgactgcaggatgataaaatcttattttggaaagctagactaggcatttgtaattatattttccatcttcaactaatagagtaaaattattggaaactctttaagatagtgtccacaatgctgtttacagtttaagtgctatgatttgccacagttattatcttcatatagtcactgccagtgtgtgacattgggtttcatcagtaaataagactactgccacaacttcagagggttttcagagagattaaattaaatgttattgtgaagtacaaggtacttgctcagcaatatggaagtcacaggtattatgtgctcagatggtaggtagttttgtatttttcacaaatctattaacatataattgtcctgtcctataaaccagacctttagggattttataggattctaatctttttcttgatgctttagccactagtggtcgtgagttacgtgctcaggaaggcatgtgaatgcttatgagtgagtaaggtactattcatgtttgtctaatgacttcattggcctttaccttcgtttacaaatgcacttaattcaataaggaagagtccttctcctgaaggttttacactagtcaaagatgtttccaagccatatacattatttttatttgtgtttatgcatatgatacaagccattttagaaatgatttttttttttactctttagaaagcacttcagagttagcataacatctaaccatattggtatttctgttttctgttataatgagtgaggatgatccttatttttaaaagaagtaataaaaaatcaaagaagaaaaaatttcatatctaagcattttagattataatttggcaactgtgcattaatccaaacaaatagagcctactgagattattcatgttcccattagtcactcacatattggtgtctaattgtcatttgtttctgctgtaattcagttcaactgatgtaattaaataccattcatctagcagcagttctgaaatcttttttttttgtaagacatgataaaaagtatgagttttctataaaatcaagtttacattcagttggaaattttccttttaagttcttattctcaaacttaattgtcaatatcaaatagagcttctcagatgagggatataggctaatttcaaattttctctgaactacaaatatgctcttcattttctctagtctaggcctaaattgctgtgcttgcatttgtaatcagaaattgattgtgttactgtggaaactggaagagtgtattgctggttaaagaaaaatgtggtagaagaactgctgttattataattgtctgccatcttaaatgcctatcattttgaacaatacattgataacattttcacactccaaccccaaaatgcttctctccagaacactgctttgtggtcagtattagtcttctgtatcgatctgacataaaatgccttggtcacatttctaatttgtttctatgttgaactataatttttacatggaatgaaattagtttccattttattcatacttacatggcacatcttagggaaaaaacatgaagtatggtaaaatatcagttatttagaagccagtcatctgaaacatttcaacttctgaccaagaagacacgaaacaagttccaaaaattcagatgaagaatttttaacatctgatgctaaagacagcctcgaagaagcaaagctctattttacacacatacacacacatgcacacacacgcaaagcaatattatgcattttactgtgtgaaagcaaagatgaactctgtttttaaaaagtttgccttttgtatatgagaggcaagtatgtgaagactgaccaaaagaatgaagaggaaatcaaaaccaggaagaggaaaatgaccctcagtagaggcaagagttgggggagttaggattggagatttccagcacatattctgttggaccagtatccagtaacatcaagttcctggaattttctggaggtttccattgctttcctgattgtgacaaggacaaatgcagaaaattatctgtgactttatagtttaattaaaatattcccaaagccccacaagtcttgtcttaggaaaccaatgtttcccaaaaggcatcaacctgctgaaaaaggttaacagaacatagcatctatgtactttaaaccctggctgaaaagagactgaatgtggtggcacactttagctctagagtgttgaggacgagaataatgttgtagttactttagtttgattttcgtatgtagtaccagacactaaacaaatctgctttagcagaaaaatattaaaatacataataatatgtgtgacatagtctaaataatgcattgcctgtttaatgtattgttgagatttgtatgctagctctttggatcctcctggcttgggttcttcattccaccatatactttatttttctttaggcttttatgtatttatgtatttatttatttttatttaaaacttattaatgttattttgattcacaaaccataattctatcattttgggggcacaatgtgatgttttgatatatgtatacaatgtggcatgattaaatcaagctaattacatattcatcatcttgctcaccatttcttatggggagacacttgaaatttactctcttactttgaaatacataacacattattattgattatagtcatcctgctgtgcagtagatctcaaaatatgtttcttctttctacctgagactttgcacccttcgatcaacaactcctcattccctccctctccacccccaccccacctcagcctttagtagccatgatacttcctacttctatgagttcaactttgttatagtctacataaacctgagagcatgtggtatttttctttctatgccctgataatttcatgtagcatagtgtcctccacattcatccatgttgttgcaaatgacagcattttgctctttcttaaggctgaatagtattacatttaatttatatcgcaattttttatccatttgtccattgatgaacacttaggttgattccatgtcttgactattgtgaatgatatggtttggctctgtgtccccacccaaattcatctcgaattgtaatctccatgtgtcagaggaggaacctagtgggagatgattggatcatgggagataattcgatcattcccccatgctgttctcatgatagtgagtgagttctcatgagatctgatggcttaaaagtgtgtagcttttttcactctctctctctctgtctctttcctgccactatgtaagacatgccttgcttccccttcaccttctgccatgattgtaattttcctgaggccttcccagccatgcaggagtgtgagttaattaaacctcttttctttataaattacccagtctcaggtagttctttatagcagtgtgaaaatagactactacagtgaataatcctgctatgaacatgggagtgcagatatctctttgacatattgatttcagttccttatgatgtatactcagaagtgggattactgggtcatatggtagttctgtttttagtttatggcagaatcttcataccatttctcataatggcaatactaatttacattcccctcatcaatatgtaagagctcctttttctctgcatcttccccagaatttgctttctttcattttttgatacaagccattctaacaaatgtaaggtgatatctttttgtttttaatatgcattttccaaatgattagtgatgctgagaattttttcatatacttgtcagccatttgtatctctttttttgagaaatgtctgttcaggccctttgtccaatttttaatcaggttatttgttttcttgctttgagttgtttgagttccatataccatcagatgtatggtttgcaaatattgtctcccattctgtgggttgtctcttcggtttgttattgtttcctttgctgtgcagaaactttttagtttgatgccatccatttgtctattttgcttttccttttattgcctgtgcttttggagttatatccaaaaaataactgcccagaccaatgttgtggagcttcctcccagtgttttcttctagttgtcttaccctttcaggtcttatagttaagtttttttttttatctcttttgagtgatttttacatatgatataagagcctaattttattcttctgcatgtgaatattcagtggtctcaacaccatttattgaagagattgtattttccccattgtgtgttcttggtacctatttcagaaatcagttcgccataaatgcatgggttttcatgtctgtttttatggcagtacaatgtcattacgtcaattttttggaagagttggagaagtattggtgttagttctttaattgttttgtagaattccacagtaaagccatccagtgctgggctttcctttggtgggggacttttacaggcatgtaaaagtcttattcaatctctttacttactactggtctgttcagatattctatttcttcatgattcagtcttggaaagttctatgtgtctaggaatttatccgtttcttctagattatacagtgtgttggcatataatttttcatactggtttcttatgatcctttgtatttttgtagtatcattcgtgatgtctcctctttcacttgtgatcttatttatttgagaaagctttcttttttttctaattcatctaactaagggtttgtcaattttgtgtatctttgcaaaaacctgttagtttggttgtttttaaattatcttttagtttctaatttgtttattatttattctctgatctttgtcattttctttcttctgctaatttagtggttggtttgtatttctctttttagctccttgaggtatgacattagattgtttatttcttctttttcttcttcctcctcctcctccttcttcttccttttcctcttcttctattttttgagacagagtcttgctctgttgcccaggttggagtgcagtggtgcaatctcggctcactgcaacctctgcctccctggttcaagtgattctcctgcctcagcctcctgagtagctgggattacaggcacccgccaccatgcccggctaatttttatatttttaagtagagacggggtttcaccatgttggtcaggctggtcttgaattcctgacctcaaatggtccacccaccttggcctcccaaagttctgggattacaggcatgagccatggcacctagccctttcttctttttttgatatgaacacttatcactataaatttccctttcgggactgcttttgcttcattccatacgttttggtgtgttgtatttccatttgcatttgtctcaaacatttgtcacaaaatgtttttttttaatttcctttttttatttcttctgtgacccagtggtgttcaaggagcatattgtttaatttctgcatatttgtgtatttttcaagattttttctcatccatttcttgtttcatgccattgtgatctgaaaaaaatacttaatattatttcagtcctcttaaatttgttaagtttggttttgtggcctaacatggtctatcctgaagaatgttagatgatcacttgagaaaaatgtatattctgctcttgttggatggaatgttctgtttatgtctgttagatccatttgttttaaagtttaattcaagtccaatgtttctttattgatattctgtttagataatctattcattgttgaaagtggcgtattaaggtcctctactattatagtattgcagtctttcttttccgattatttaataattgctttctgtatataggtgctctaatattgggtgcaaatatatttataattgttaggtcttcatggtgaactaacccctttatcattatgtaataatcttctcgtcccttttaataattttttttacttaacgtctactttgtgtgttataagtgtagctacttctgctcactttcagtttatatttgcatgaaatatctttttccaggcctacattttcagtctatgtgtgtcatgactagtgaagtgaccctcttataggcagcatgtggttggatctttttttaaaaatttatttagattctctgagtctttctattgggtaatttaatccatttacatttaaggtaattattgcaaggtaagggcttgctattgccattttgtaaattttttttattgttgttttgtagttccctttttactttctctcttgctatctttctttgtggtttgatagttttctgtggttgtatgctttgagtcctttttaaaagtaatttgtagaattattctatttgcttcgtagtcaccatgagacttacataaatatcttttccttataagaggccactttaagctgagaacaactttcctataattgcatgtaaaaactctaaaacactctttacaatacaacctttatcatagattaaatactcatatattcttggatttttttttctggactcacgattctgttctactgtctatttttctatttctgcaacaatactattttgccttgcttattgtgaatttatgttctatgttgctatttattataaatatcaaaattttgttatagttttactttatattttcttaatatgatcaatgcaatgttctatttccagtttatttgaagtttaaatcttaactaggtgttaactgttgaggtgatcatcagtttgctaatattttgtttgtgaattttatatttgtgttcataattgatactgatctataatttttatttgtatattattctttttgaatatcactgtctactgtgaaaataaaactggcattagaagattaaagaaacattatataaatataacatgggggccacacactgtggctcacgcctgtaatcccagcactttgggaggctgacatgggtggatcacctgaagtcaggagtttgagaccagcctgactaacatggtgaaagatgagcagatcacctgaggtcaggagttcgagaccagcctgactaacacagtgaaaccctgtctctactaaaaatacaaaaattagccgggcgtgttggtgcacacatgtaatcccagctacttgggaggctgaggcaggagaatcgcttgaacctgggaagtggagtttcagtgagctgagatggtgccactgcactccagcctggatggcagagcgagactctgtctaaaaaataaataaataaataaataaaattaaaataaaacatggttgctacacatgcatgaggaagtaagatacattggcttgactaatgcataaaatacactggatatcaataataaaaagaccaatattctgtagaaaaatatgagaaagagatatgaataggcaatttacagaaatgaaaacaagaatggcccccaaaaatatgagggtgaaaaataccatgtcaaatgaaatgaaaattatactcgaattattctctcctatgaggttgtcaatagtacgaaagtctgaaaacttactttaatggcaatgctgtaggaaatcaggcactctcatacatttctggtgggagtgcaagttggtattaattttatggatggaaaatgttgaacatcaattaaatataaaccaaattaaaaagatatagtggcttgggtgtccaaatactacagttttattattagctttcttatctgacagccgtgtaagattttacatgtcattatttttcttgatctattaccttttttaaaatgaactatttgaaatgtgtaatttttatagactttacaagctctagactctagtgatatatatatgtcacacagctgatatctgcacatgaccctaaatatgcataaatttatgttatccatgaatgaaagaacggctctttttcttaatttcttttttcttgactatagcatattttcatcctgtgtataggatttacaaatcagtttttacctgattttgaactgttccatcttcaaccagttgccatatgactacttggttcattatttgtggtaccatttttgtagataaaaatatgtagatgataatatgggtttgttgtgcatattcagaagcactgtactgtaatcattaagaacatggacaagagagccagattacctggcttggaaatcccagatatactatccatgtgctgagtgcattggttcatctctttcacagttttctcacctataaaagaggttaataagagtgtatgcctcctggggctatgaggattaaataatctattcaaaacactaagaccattacctgctaaatatacatttgctatttttattcatatgaggatatagatgtctatatcatgaattgaaaataagccatttttttgaaaagcagtatacatttctgaagtcttgaacatgaataatatttaagcatatttcactaaaaaatgacatgattttgacccactatataaaaaattataagattttggaaagttcttcatattgtagtgtttaaagacttgaaacccagtgtttctagccattgaagaaaacttagactacttctgcataaattgacatggaattgcctttattattgatctgaataaagtgggtggaggaacattcatctgatgaggagaagcagctccctagaacacagagatattcagatgttttccactatttacaattcatcttgtttattaacctttaaaagcagattccgttgaagaaaacaaattggcactacaaggagtaagaatgcttttgttagtgagggactcacagtgcctttccaattcatacattgtcttctgatgagtgtgggtattgggctagaattttggcatctgaaagtacatctatgtgagccgtggctcacataaccatggctgtaggttatgtgagctgtgagaattttcaaattacctcagacttctgagaatattcttggtcattgagaaaataagcagtaataaatgctccagattcacatccacatctcacaatgttgaaagaatagtgggtatcatttatttaaatgaattttacaatatgcttactccattatttcattttcttaggaattattctcccagctttactaatagttgtggtgactcatatctttctcactactttgaccaggtctgaatatactttggggtacaagagatgtgtattcgttggctatataaaggtggtcgatctgctaaggaatcttagatggccagagttactggaaattcactcaatagaatgggtgattatataggaactattatttttgctgttaatataaatgcatcttcaggtatattatttgtgtttgacacactgttctaaaagtccgatattaggactgtttttcttaaaaataaatattcaaatatttatgattgtgccttagctatggttgccagaaatagagcctgaagcaggaattgtgtgcatagatttgtgcaaggagcaagtgaagcaagagggcagagagaagatgagcaaggatatggcttcaagtaaagttgagcctcaacttgatcccacaaacagattataccaaagtttcattcctgattgatttgaggcaaaggagggaggcttggtacacgagagctcttcttgcagcagtcagtcgtcggctactgatctgactactccaagtgcggtgtatgactcccaggtgcctctaggcaaggctactccagtatgctaagcacgatccttcagaaaaggttacaggtgtcagctgtcagccatggcacacacaggagtccctgggatctacatgggacatcaacatccaaacataaacaaaggcagcactttcatcacatcacatgtggactactgcagatggagtcagctctgtggtgatcagcagaaggggatttcaggctgactgaagcaccaggccacgctgtcagaggcaggagtgagtgtctaatgtttaaggagcattgtgagaggatccttgtgagagaagggggacagtggcagatgaggagctcagggaaataggaaagaaccagggtaccaagagacttgtgagccaaactaggcgcttatgttttatgtgtcaggcaaagccgatgggggtgtgtgatggtttgatgtgatggaggaaccacacggaggtcagtgtggctggaggaaagtgagccaggtagagctgagatggtaggaactgagatgagatagtgggacgtttagaaagtgtgaggctgtagaggtcttgggaaggcctttggcttttacctctttttccccaggtgggacgggccgttgaaggattttagggtggcagtgacatggtgaaaggatcactccagatactccgcccagagtataccattgtgctctgtggtgaaacagggagaccagttaggaggatttttgcagtggttgaggcaaaaagagatggggactcagatgagggttgtcatagtggagatgtggaaatgtgaataaattcagggtagatggtctaactgccagcacttactgatggcttggccgggcagggtctagggatttgtgggatcacatagcagagtagaatcttctggccttctttctggccactcttcaccacagggcccagtgtcctcatggtggctgatgccccagcccgcctcgtgtgattagataggatagatcagatttccctaccacatgtgcccctagaaactcagattcctctgtttaacccaagcaaagccatttagctccccaccttatccctgagtccaactctgcttatccagaaatgaattatttgttggcagtgctaaacaaaatgccatctgtggttgggtcttaaccctgtagcaatatagatgagctgagctggtagaagttgtaaaaattatatttcttttttatttcttactacaattctttttaaatataaaggcgcaggatcacgatttatttgcttgtcagtatggagtattctattccctttagaaagcataggaagttttggttttgcatgtctcagtctgctctactgtctgtgctatgcagtgtgccagttatatctcttttaatattagagtcccatgtattagatgataatattctaatcttataggtggagaatttgagtcacaagggttaagtgacttgctgaagataaaacacccagtagagtgaatttcaaaacctgagtgaggctgggcacggtggctcacgcctgtaatcccagcactttgggaggctgaggcaggcagatcacgaggtcaagagaccaagaccatcttggacaacatgatgaaaccccgtctctactaaaagtgcaaaaatcagctgggcatggtggttcacgcctgtaatcccagcttctcgagaggctggggcaggagaattgcttgaaccagggagatggaggttgcagtgagccgagatagcaccactgcactccagcctggtgacacagcgagactccatctcaaaaaaaaaaaaaaaaagaaacccccccccaaaaaaaaacccctgagtgacactaaatttacatgttataaagtctctaaacattcaaagaaacaagcagatctaatgccaagttccacgtgggcagggagctctgctgtcatgttcattgtatcaccatccttgatgacattaactggactttagtaggttctcaataaataataaatcaagtgaatgaggcattgtccgtgtggcactggaaacatggaggaaggagaacttaatcctgatggggagctttggtagatgtggtatttcaagggctctctaaaaccaagaaagagttcagcaggttgagaatggaaatccttttactccaaggtaagaatacacagtgaaaaaagccaaagagttatgtaaggcatgtttctcttctgtggaacaaacattgggaattgacattagagagctcatctatgatggatggcttaggaccttgacctccttgttaaggagtttgtacttcatctctgtccacacaggtgagcctttgggggtgttaaggagtgaggatcatgaggtacctgggattccttttctttagtgttgtactcgtgatttttagcttaaaaggccagaagtgtatagggatttttaaaaaaggctttagaaaacgatgtctattttggtcataacagcacttaatatggcagggataaccatggatgttgactttgcgttctttcattatgcatgctatttcacattatgtgaataggtggttatttgtatcttgttgcatgctaaatatatcagatttaaaaatcaattttacatatagaacactgactaatcaatttaggaagcagattagttttgcgtttttcagagctctattgatttgattataatgttgttttacaacaaagtataactttgatttatgttcagatgttaagtatttatactagtttaccatatatgtgcactatgttgtttctttaatgacactgaatgggccaggttttcactttaatggcatttaggaatacatttaactaaaaacatccactcaaatgcacgtgggttatgtttgcatgaaatcaattaatgatcctggcaggttctgtgtttttctaaattttaggacttgcctcacacaaatcagaagtatccagactttcaaatttacaatatccattcaaacttgaaatgcccttgattaataaaaatacatgtgacaggagagtatagctctgcttttaagctgttagagagaacataaaatgattatggcttgcagtaaatgttattatggacctgagatgtttcctcagggattcagcaatctcctgcactttctttaagactgaccctctctccttgagaagcagcaggaaggagggatgtggaggcaagaccgctgtcaggtcacctgtcacaacgctgacaaggctctgatataaaacctaatttacagttgaagaagcacatccattatccttctgattttaaaatagaacatacatcagcaaaatgataaaagaaagtgcttaagaattatgaatgtcaaggactatttcctatcataaagtcacaaccctttttgaatattaccttaaattatagcagagtttaacgatattcacaggctctgttctctgaaaatgagtatcacagtatttcaactattgataagctaataattgtgtattaactatcgactgtctttgagatcaagatctaggtagatggtggcatcagtatttagatatttctttatgaaatagatgtgcaccagaactttgctacaaggacttaaataatgaattattttctgttgacttatattaaaagtacagcgttgttttatcttcatttataattaaccttcagtcggccatgtttcttccttattcctgattcatctttttcctgttattctcaactaaagacggatatcaaacaaatcctggaatgtatttttaaaaactcgactatcttcttgaagtgaaaataaactgttaaagtgtctgctctaagaccttggattttcttttaaaatggggtgctccaggcccggcatggtggctcacgcctgtaattccagtattttgggagggcgatgtgggcagatcacgaggtcaggagatcgagaccatcctggctaacatggtgaaaccccgtctctactaaaaatacaaaaaattagccagttgtggtggcacacacctgcagtcccagctactccggaggctgaggcaggagaattgcttgaacccaggaggcggaggttgcagggagccaggattgtgccactgcactgcatcctgggtgacagagcgagactccatcacaaaaaaaggggggagggggagttgctccatattattgtcatcataaatttcattgcaaaaattatgtattttaataattggtgttatggattagataattttaatctttttagcattgttttaatattttcttataactgaatcaacacaaatttaaatgatttataatgggctaatttattagaataatatttgagatttcacaatttagaagcagaaatgttgaaatagcctattctagcaaaaactcagcattatccttaaattacccatgtccatatttagagatagaagatataatttcttatctattaactattttctgcttttaaaactaattgttcttcccatctctgctatatttgaatggactatccttagattgtcttcttcatgtctgagaattttatatttaaatatatgtttaatatacaagtaagaacagacattaaaaaaacctctggaatccaaacttttttttttttttgagacagagtcttgctctgttgcccaggctggagtgcagtggcatgatctcggctcagtgcaacctctgcttcctgggttcaagcgtttctcctgcctcagcctccctagtagctgggattacaggcacctgccaccacacccggctattttttttgtatttttagtagagacggggtttcaccatgttggtcaggctggtcttgaacccctgacctcgtgatctacccacctcagactcccaaagtgctgggattacaggcgtgagccaccgtgcccggcctggaaaccaaacttttacatttatattcatatatacatacctatttatcatcatcatcatcatcatcttgttctctctacctatctattcataaatctattatctatctttgtatctacttacctacctacctgcttgcctgaatattagtcctatctgagccaacaaggctaagatgcattttgaatttgactcttggccttttgtaagtctgccaattgtagaataaatgtccagcacgcatgctaaggcctccttattcaagggagagggaaacccttgaaaacattttactctactctgactcagtacccagtactattttccagtgcaactctaccccctttcctcgcccccaactaaaccctccaggtccataaaactgtgggagccttttgtttatggctctctcaacagtgagaccacgtctacatctgctgatccacttgaccggtgacctgtgtccattccatgtgggaacatggaaaagggagagtcagagctttcttgattttagcctcttgtttgtaccattatcgtaagtgatggtaacatagtggtaccagtttggatgtattttagatttttctcttctagaagagctattaagattaaaataatctctttttctcaaaattttgtagaacatttctggagcatttcggggggcatttctttagataaacatgtataactatttaatattttatacagtgattggattctttaaatgctaattttgtagaacatttctggagcatttttgggcatttctttagataaacacatataactatttaatattttatacaatgattgaattctttaaatgctatgggagtattcaatcttggtgtttcttcttttttcttttttaagaagttttattttatttttagttgacaaataatatttgtgtatacttacagagtacaatgtcatgtgtcaagatatgtggatacactggaatgatcaaatcaggctcattagcatatctgtcactcaactatttatcatttctttgtggtgaaaacatttaaaattctctctttagctatttaaaaatatgtaatacattatgattaactatagtcacagtgctgtgcagtaggacaccagaaattactcctgctacctatctgaaactttgtccccattgaccaacgcctcctctttccctgcccagcctctggtaaccaccattctactctctagttctatgagcttgacatttttagatttcacatgcaagtgagtgcatatggtatttgtttctctgtgcctggcttatttcgcttgatgttttctaggtttacctttctcatgttgtcgcaaatgatagaatttcctgtttattttaaaaatggaatagcattccattgtgtatttataccacatttaaaaaaatctattgatggacccttaggttgcttccatatcttagatcttgtgaataattctgcaatgaacagaggagtgcaaacaccttttcaatgtactgatttgagatcctttgtgtttatacccagaagtgggattgccagatcatacgataattctgtttttgtttcttgaatctattttgtttcttgaatctccataatgttttcaaaatggctgtacgaattttgatatttcttcttgagtcagttttctaagttatatttttctaaagatttttaatctgaattttcaaattggttgcataaaattatttaatatgttcatattttaaatttctgatctatctgtgatagaaattaagtcgggcatctaactcagtagtttttcttttctaaaaaatgtaaatataaaaggctataaatttccttctaagtactgattctcacactttttttctatagtatgttctttactgttcagtttgtgaaatttttaaatttgcattttcgtttattctttggcccgtgtgttattttgaagcatttaataatttttaaatatatacagtttttaaattattgacttaattgcaacatggaaaaacacacggagtctatgatattgtgaagacatactttatggtgtaatacatgatacagttttataaggttttcaggagtactacagaagaatgtaacgttattgaattgtccatatgttctatattttatatgtgtgtatgtatgaatttgttcatttaagagttttttttgttctacttaactatttgacttagtaaaggagagagctgggctaaagttttccactgttatgatagatgtgcttatttctttcagttgttatatatttttatttctatatttacataaagttcagaatcattatatccttctggtgactataatttttatcattatgcattgacccttttttctcttaaagtgtttcttcttccttaaagcctatttgccttatatatctatttcagctttcttttgtttaacgtttacttggaatatatttttcatcttttacttcaatattttcatatccttaggtgtttttttttgtttttgtgattttttttggtggctgtcttaaaaatagaaaataagttgggtttcatttatcttatacattctgacaatttggggagaatttaacatatttacatttattgtgatcattgatatgtttagatttatttctgccttatcagtaaagaattttgttttcttattctatgactatttttaaaaattattatttttaactgattactttgttacttattatatggggtttccccctcctttttgaggattaatacatgctatttctattcttttagccattatttttgaatttttactacacatattttccttaataaaatctaaatttaaactagttttatttatttttcaaacagtgtaggaaatgttagaataatcaaactgcaatcaccactcccctgaattaatctgtgtttttcactattttagttttttcctttttaaaaatcccacaaattagatgttatgtttattactttaaataggtgattggagagatgtacaagatgtttagcattgtatttgcataccattatttttgcatcttattcttctgaaatcattttccttcttaaagagcatgatttaccattgcctttaatgaatatctcctggtgattaactgtttatgctcaggtgaatgttttcattttactgtcatttctgaaagataaatattctgggtatgtaattagaggataatagtgattgtctctcagtacttcaaatatattattcaacaaccttgtggtttctgttgttgagaagtctgctgtttttctaattattgttctttttttgatgatttgccttttttctctggatgtttttctaatttcctctgagtcttttttatcagacagttttgctttgatctcttggcattgatttcacttattgtgctttcaatacattagaaacattatttattgcatttggggaatttggaaaatcacagccattttattttcaagtattatatctcctatatttctctaggacttaggtaactgttaggctttctcattctctgctctagatattttatattttaatttttaaaatatttcaacataatttgttcagctatattttctatattatggattctctcttcagccaagaaagtctaagttgatcaaagtttttatggactttttcactgaattctgaaatactaatatatggggggtgttacctgtccttctaaaatgcctttgaacctttcttattttcttaaagcagattttctaactataacctaaatccacacatttgactgacaatgctcactttaagtccaaattattttgggaatttaaactcagaagtgagcttaaactttgatatttgtgggaagactctcttggctacctttcatggctgttataaacacttcctgtttgtatagcactctgtgcttaaccctgttgattaacttcctgtgtcttacaattgcccatttttctgtcttaatccaactctatattgcaaactgagggctcccttttcccaccatggtaaatgtggaggcagcttcctggaagaggccttgaggtcacatcacaaacagtaaaacagcatatgggggagaatctcctcggaagaggacagactaaacttgtaatctgcacaccttttatttaaaccctctcagtatattaaagtcctccaagaaagacagttgtcatagggagtggtctagacatagccaacttttcctccatgaaaagaataagcctttattttgttcagccactgggagtttcgaggtggttttttactgctctaaaacctaacttatcctaataccggggacaaacgttatttactctggtgacaaacattatttctattttacaagtgaggataaactgttagggaggttaaattacttgttcaaagctcatacgtgttgtagcaaggactaagtagtcttaggcatagggctcagctttttaaacctaccttgatggtttttgtgcctcgtctatagggatagtattttctactccaaagtatatgccatgatgatccagaggatattgatcatgcactggtaagaagaatgtctctgtataaacaaatgttggtataatataaacattgataaattgtgagcagcgatctttaccttagctctgaatgtctaaatttcacttggaatttttcagtagatttatatgaactcaagcattatcctacttaaaagaaggttagcaaaaaaaaaaaagaaaagaaaacttatcaaaagacttttttaaatccaaaatgacactatataagtgtcatataatttataggttaaggaagctatagataatgatatcattatgactgattcttattgattacattaaagtgatattaggcatttcggatttttcagatgtttttcttgaggcctcctagattttaaaaatgataaacttatagcagttttagtggccctcattatttttatgagtgacttcagggctatcacaaataaatgaaaagtctatgcaatttcaaggcaaaccaattaatgcccccttccacctaaattatctcaatatttcctacagataggtcctagagtaatgctgctaaggctttttaaacttgaattccacagatgcaatcctttcagactttaaaaatgtttattctcctcagtgttatatattccaccaggtatccttttccaagataattctatttcaattgaaaatcttttaattcattgcacaattatagttgagcatttcttggcacaactacccagatttgcaaggccatagctcttaggtgcctatctgactgaaccttgaacctatggcatccattgtagctggtgataaaagttatatcagctccattttccacagttcttaactgttaagaacaaccctctctagctttctcataaatcaactttgggattattggcatatgagctttgttcaatttttcaagccacataaaatagattttttccatttcatcaatcacatttcctcaacttttgctcttgatggccaactgcaggggcagttttcagaggctctgtcactcatttggtctcctcatttctgtttgattattgttatatacacctgcattttcattgcaggcatcctcctcttctcagtagggctttgattactcacactactttttgcttaacagacttgattttaatgagctaaataataagaaatctgacaaaataagcataaatatagcaaccattttctggactaataaacaacttggtgccctagtaattccattggtaatgtaaagatgtgactgcatgttggtaagataaagatttgactacctgtataattttatattgattaggtttgataggcttaagtttataaatttaggtattttttgttgtcacggttttatataagggattttttttagttctaggggacaatccctaccataaaggagtttataatcagggcactttttcaaatattcctgttataactcaaaataaaattacaatgaaatacattagtattcttaatattcatagaatacaaactctgaaagtaagattagaaatatttcttacttatgatgaaataaccttgttattaccattttagttactttatgatgaaataaccttgttattgccattcaagttacatcataacttaaattcttgggtagaatgtcttttcagagtgctccaagtaaagactatttgaattatctatgcaagtacctactaatatttaaacttttgatgatcttttcacataatggaggacaacgggttctatagataaacacccacatcagtggtccaccattcctcttccagggttatatttcattgtgttctgattttaaagcaaattagggagtctgtttttgccaattttcccatgttgctgtggttctgagtgctgtgattatcaagacgatagaagtggaaggcgggagtggaggtggcttctacagtcttcagtgcagcatccactacagagttaatggcatttttacgaagaccaggtgtattttgtacttttttttttggtacacgtttctcaaactatgttaaaattaaccatcaatatcaaagtatactgtcaagaaaaaaagaaatgcttatgatgaatattcatagctgttagtatctttggaaaaggtgggtaatcatttttaaaaatagagtaattttctttggaatacataactctcaagaacattttgatagctatatacatctaagaaaagtgtattccatttattattctgttaattaaatatttgttgatcattactgtgcatgaaacattctctcggatggaggtaagtggagctcctccttgttaaggagaatagtagggagatgtgacggctgcacaaatgactacatttccaagcaggataaaataccctgctctgggggaccaggagaaggggaaatcacttctaatggaagttgatgatagaaagaatttgtgaaaggcttttgcatgatattttaaatttgataaaaagataagatggaagggcatgtgcaaagtcacaaagagggagaaaacagaaaatgctttccatgaataatgagttaacctgggttgttaaaaatgtatggaaatactgtgtaggcatgacagatgaaatccaaaggatttgtttccagtccatcattagcaccactaaaataatagaaattatttttaaaaagcatacatctaaaatagcatgagaataactacgagagcaacaaagtgttggatgcggtaaagcttccaggggtgtaactgaggcaataatcaaagaaacctgaaaatcgatgtgcaataaagggttacaagatatttaaagaaagcctctaacacaaagagaaagaccaaagcaaacaaaagttttaaaaatccttgcaaagagtaaaataaaatttgggaaacaattttcttggagaaataaggaaaaagaaattatccttaaagcaggaaaaggaggttagaacacattttgaaaagtcaataggagggagagtcctaagagacaacaatgaaaaggcccacagggctcaccttaccctgacccatgaattccaagtattgagagaccatggaggcatttgagcaagtggtgaatgatgaggagttttgtcttaggatcattaacctggcagcaatacaaagagtaggctagagaaaagaggcagagagctaggacaaaagttactaaggaaaggaaccaggggtataaattccaaaagaggtggcaggaatagaggacagatttagtttttacagaggaaagaatatgagggaatgaaaaagaattggatatgtagacagaagaagtacagggaattaaagtgttgagagttaataagactcaaacttcagttttaagcctttgcatttgagatattggtggaattgcagatagaaattattatcaagtattatagagactattggtttctaaagactgagagatgaagaatggatttagaatcacggaggtcaatggtgatcttgcagggaacagtgtggctggtatggtaggggtgaaagcctactggaataggtttaagaggctttgcaaagagaaactagagataataggaatactacttgcaaggaatggtgccacagaaggttgatagctggctgagaatgagttcaagagcagactttattaagaaagaggggagaatttctatcttatttgtgttttccagttgggcagcagagaatatcctaatattagaaaattttacaaaattctgtcatggttttcataaatgattatagcttgcttttcaaaatgcacaaactgattgcaatacaaaataagtagcacgaatactttaaaaatagatgtagatattaataatactagataatttctggttagtatttacatcatggaagaaaatataaatttagatatttggtatttttacagcttgtcatttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatttttttgtatttttagtagagacggggtttcaccttgttagccaggatggtctcgatctcctgacctcatgatccacccgcctcggcctcccaaagtgtcattttttttaattaaatagaaaccttattttaggtctttacaggaatcagcatataaatgtaaagacaaatcctggcttcttgctggaaaatcctttaagaaacataattttcatggcatcttgtggtcttaatccaggtaaagctctgcttttaaaaaaatgaacaaaaaatataaactgcaccaaaattcaatattttgttactttgctgtctccatctttaagtgctcaattttattcataaaacaattgaagtaatttaatttcaaaccatttgggttttgtcatatttactcccacattacatgcacgtggtagatatggatggaaagcttttgacgaatggtatttttttcaattgactgactaaatctagaaacaagatctcctactgccccagtgccagatgggcccaccccactctctccgactctgaagtgatcaaatgctgtatgcaggaagctgtacagctttgccaattaatagctgcagactcaattatgaacaaaagggcagccagcctttagtagggaaaatcaacttagtagggaaaatcaaaatgtttagccaaaaagcatttaattgtgtttctttaataatgaagtcccctttagatatgttcataaatcaggaatagttaacaggaaaaatgatagatatgtttgtaatgctacgtagttatggaattgctttcccatagatcttttctgattgatcattatgttgggaattttttgcatgtgtgatagtcaaataatggtatgggagaaaagtcaggatattctattaacaagataatcattttatcctattcttgtgtttacatcttctctgttgccatttaattccccacttcaaggctgtttcattgtctccatctctactgtatttagttaggcttttttattcttaatgtttttttctagctttcttgtagtctgtgattagaaacacataaaatttatctgattagttagtgggaattaatcactcttctactactgaagcaccctgctttgttgtattcttttattattccagacatcagaatgtaatattttaattctatatgaccatctgccctacccgactagaaatccctgaagactggagctgcctctcacctatctttgttttgctggtagtcagtgagcacggtgctctgcatataacaggactcagggtttacccaacgatggcctcagtgtttatgttccccatcacaatcctaacccccaaggcaatgatattaaaaggtgcggccttggagaggtgatgaggtcatgagtatggaggcctcatgaatagcattagtgctcttctaaaagaggccccagagaatttgttctccccttccaccatgtggggacccagtgagaaggtataacatatgaaccagaaagtggacccgcagcagacaccaagtctgctggtgcctaaatcttggacttcttagcttctgaaacgatgagaaataaatttctattgtttaagtgacccagtttatagtattttgttatgacagcctaaacagattaagaccctaatcaagagtctacatttgacctctgtgcttacctgttactagtaatcaaaacattttagactttgacaaagataattgcgtaagtgttagaggtatatacttatccattgttaattttaatcaattttacataatacaaatgcattattacatatgcttttcacagaacttaaatgccctttgataactatgtacttgagtcataagtaattatgtaatttgtctgaaatgcttataataaatagcataagagagatttaaccataaaatgtaacatttatttacatatctatttttcaaattatgtgcacatccaattttgatatgtgtaatgttttctagtgtctatcatggttcagtgatgttttatcttcacttctgaatcattttgaagcagattctgtatatcagcttcttttccttgcctattgaactttctgccatgtagttagtcttagctaacacttacgtattttaacatttaaaaaatccttagaaatcaccttgtccacccattttcattttaaacgatgaggaaacaggtacagagaagttatagggcttatataaagttagtataagtttgtcttatgataactctaagctcaaaggtagatataggttttgtggggcttgaagctgatataacttgggaagccctttttaagaaagggaatataaaattaggtgagaaacttaatattgactaagaatgagaaaaaaaataagagcctggcagataccacaaataaaatccatccagaaaataacactgttacattgtccccgacatctttgcaatatttttctctgtatttattagctacatattccttggtctttacttcgtgacagcaattacataatgtcattttctgtggaaaacaaagacagatgatcagattctcctgtagcattgtcaatggaaacttgctttttactattgacagttaagtttctttcagcttcacaacttattattgctgttgccacatcttcgactcccatctgcctgtcctcattcaggtcacacaagccctggagcaacctgctccctggttgttttccagcaaacaagactccagaccctcactgtcaacaatgagctggctataaacctgggtctttgtgctcctcaaagcagggagcagagcagcaaccccctcagatccttctctgggattaaagatagcgtccagattctgaggcacaagccaacaggggatagtgctggccgcccattctcctgccctgggcctcaacatcagaattgaaaggtgacccaggctccaacctgctagcaggtggctgatactgggtctcctgagaagagcatttggtaggagcccatacaagtgaggggcttggagcttaagcttggttaatttcatagtcagtctgcttctgcctatggcaaatccttgcaaaaggccagacactgtttttctctttactaagaatttacagtattgtaactgacccgctaagtactcaggtaaaaatatttgtgattctcctgtgtctccctaagccacatctctctctgggtttttaataagctagcattaaaaggcataagaatgatacgttggactttggggaaagggtggcagggggatgagggataaaagactacacattgggtacagtgcacactgctcaggtgctgggtgcacctgaatctccgaaatcaccactaaagaacttattcatgtaaccaaacaccacctgctccctaaaaacctattgaaataaaaaataaagttgaaaaatagctagcattaaatcaaccaactatttctctgggtgaatgttctgtcgcacacttgcacaaaccctgatctctcttcaggggcctcttcaaaagttcagtatcagactcacttggctccctcgtgccggctgtgtgacgttgtttttctccacttcgggacatgcagttggccatgtgctcacaggcctctgctgtgttccctgtggcaccttcgcagactgagtggcttggcatttggctgatgtaggccatgtgggcacacactcagcttattgataacatccctcagacactgccatttccaacattttcattccggatttcagaattcccatcacaccatcccaaattctactaagtgtcagaccaggccatgctaccctgtcctttcagggcttacagagactttggtgagatgttggatttggtcatggtgctatttattgttattattaattattagttttttaatcacagcctcctatcctcaagttctaggtaaaattgccaaagtagactcctttgagttttgggatttttttaatttggtgcctgtgatttcataaggaaatattttattttatacttttactgtagagatgcatttaaagtttaatattaacatattctggagcatcttaaggaagacagccttataactgaatcctgccatatggttcaaatgcagctgatttgaacaacatttactgcacttgctttgaactaataaaagaaaaaacctccctaccttctttctttccttccttcccaccctccttccttctttccttccttctttcattccttccttccatctcctttctcccaaaacatatttgtagtgaacacatcctttgggccaaacactgttttggcccgtaagtatgtagttgtgagctaaccgacactattcaggcctcacagagcacacagtctgaatgtgtaaaatacgcatttgcaacaactgcaggtgaatagtgtcatcgtttgccatatgaatgaaggtttttcggtgttttggggggaggaaacaggtgtgagaattgcacgatgcacggtggcagagcagcgctgaggctaaaggaaaagtgagtcagcacggtgattgtggcgttggttctgactcagtggcagtggagcagcttctgccccatcaaaagagtattatgtgatgggaagggggctttgtgctttttcctgttttaaatacaagatctgggaatttgatttgttcctgtggttgtataagtgctataagcgtaagaggtattgccttgtttttatatggtttgtttatttttatttatttaacaaacacgtttaaagcacatataacctgtcaggggctatactaggtgttttacaaatttcagctcattttatttacacatattttaggtaaaagcaaccaatacaaacttagaggttgcggagaatatatatatgtatatattttttacctttatgtactcactcaagtttaaaataccttgttgaagatgaagtccctggtgaaaatgtagagactcagggaaatctaagtggcaaatattcaaatgcattaactttccccaacaaaaagcatttccttgcctcagtctctgaaccaagactcttgatttccttctggagaagctccttagttcctaatacagaccggcaggtggagcagcacgccctgaaccctccagcaagcctgggcctgtgtggcgctcagagcgagcctagcggggttgacccctgaggttccaacactactttatttttatttatcaacttttattttaagttctggggtacatgcgcaggatgtgcaggtttgtttcataggtaaacgtgtgccatggcggtttgctgcacagatggatccatcccctaggtattaagttcagcacccattagcggttcttcctgatgcgttccctccctctgctccactgacaggcccaattgtatgttgttcccccaccccatgtgtccatgtgttctcatcattcggctccgacttataagcaagaacacgcggtgtttggttttctgttcctgcgttagtttgttaaggataccaacttccagctccatccgtttccctgcaaaggacatactctcattcctttttatagctgcatagtattccacggtgtatatgtaccacattttctttatccagtctgtcgtcaacgagcattcgggttgatttcatgtctttgctattgccaacactatattttaaaagaaaatatttctacttcttgaagggcatgggccttatctacagtgctgggttgacctggttacaagaaatccacagaaaacataatctgatatttactcccattacaatatggtacacctgtcatacttcagcaagcaaactgtaaagggagagaaaattcacttttatttgaactgctctttactcctctgaggcttccctggtttgtggcaaacaaacattgtaacagcttcacctagaattcaaaattttaaaccatctaacaatgttataacagatgagtcttggagcttggaggccagggaaaagatagtcatgagcaaaaccagtcttccttctcttagaataagtattgagagtatttatttgtgcatgtcaattcaataatgaatacgaatgtgacctcgaaatagtatgtagtccatttctaatcaagatggaacagcagttcttctgacctgaaacaactttagacaagacgtatgaaacaatgacactcaagccattaaacatcaggcaatgaaggacagtaatcctcaagagatgggaaacagatgaggtgagacctacaattgcctcaacttactgcctgggaaaagttttcagagggtggaagcctagctgtctccttgagttcagaagatgaagcttagaattcaaggaagttaagtcggctagaattcacaggacagtatgacacaggaatgagatgtacaaagagaactcaagatctgcagagggtccccctcagtgcatgtgtgtgaggaaactaacagaggcaggggaaagaagcacctaaaatagtaaggtggaacaggggtcaaggctcaacaaagtaagaaatagttccttttcccaatagccagagtggaaaacttaatatttcaaggggcattgagtagagttctaaaaaggatcctcccacactaagagggaaaaatgaaccttggtaaaaatgctaatttaggaccacctaacaaagcttaaaggcaagactttaatatttgggctcacattaatcccaaatattctaaataagttaaccatgttccagagaaatttcaaaaatatttatagctataaattaaccatgatccaaagaaatttcaaaaatatttatagctatactaaaattcttagcctgtaaaaagtaatatccaaaatgtctggcaaccaattaaaaattatcagacatacaaagaaggaaataaatacagcctaaaataaagagaaaaatcaatatattgaaactgacccagaatttacagataatagaaataggacattaaaatagttcttatgactatacttcatatattcaaggagctagaagatacatcttacattttaatagagacatagaaaatataaaaagatccaaatcaatttttagagttgggaactacaatatctaagatgaaaagcacactggatgggatcaaaggcacgttagatattgcagaagaaaagatttgtgaacttgagaacagccatagaaaatatccaaaaggaagcagatagaaaaaaaattaagaaaaaaagaacattttttcagcagtgagacaactagaattgacctaatatacatgtaattcaagtcactgaatgagagaggagtgggagataaaataattgaaaagataatgaccaaaaaatgtccaaagttggtaaaaactatgaacccacagatctaagaagctcagtaaaacgcaaacacaagaaagatgaagaaaatgacaccaaggcccattataatccaattgcttaaaataagtaataaggagaacatcttaacagacatagaaaaaatgacacaatgtaaataaaggaaagatgaaacctatgacaccttgggaaagaaatgcaggctaaaagactgtggaagagcatctttaaagtatgcaaaaaattatgaacctataattctttattctgaagaaatatttttttaaatcaaggtgaaataacaagttgttttcagatatacataagtcaaaacaaattctcaccagcaggcattcactaaagaaatgttaaaagaagtccctccagcagaaggaaaatggaaatagaagaaaccctgtgtctacacagaggaaagaagggaccagaaatggaaactataagagtaaacatactttatttttcttattattttaatatccaatattttctgattatttaagtctttaaaattaatctactgtttagataaaaattacaatgtaataaggttcataacatacgtaggattaaaatctatgactacactagcataaaggcctgaaggaaaaaaaaagtatattgttgtaaggtttttatatgtgtgtgtgaggtatagtatactatcacttgaaagtagacagtgataagtttaaaatgtttactctaaaccctaagtgaaccgcgaaaataaccataaataattatagctagtaagccaaaaaaggatataaaacacaataataaaaaattcttgagtaatccaaaggaaggcaagaaaaggagagaaaaggaacaaagaacaaatgaaacaaaaacaaaaaaaagcaatatgtatatttaaacccaataatattaataattatattaaatgtaaatggtttaaaaacaccaatgaaaaggaagcaattgctagattgaatttaaaagcaagacctaactgtattctgcctacaagaaacccacatcaactataaaggcgcatacaggttaaaatttacatggaaaaagataaaatatgtgaacactaatcaaaagacaactgcgatagctaatgagtatcaaacagtggatttcagaacagagaatattgctaggaatgaaaaggatcattacatcggaataaaggaatcagtttatcaagaagatgtaacaattctaaatactaagcagaaactgacacaatttcatggggaaatatataaatccacaatgatagagatttcaacacctattcctcaagaacagatggaacaagtagatagaaacttagtaaggatgtaggcaattattataacaaacattttttattacaaaagatgtgaaatatttttggaattgaacaattttatctgagttacattttatttaaatgagacataaataaggccacattgtagagagcaaaatttaagagtgtgaattagtcagctattagtttaggaaattcaaattttagatgattttttctttttaaaacatagcactttctctagaagtcaatttttaaacatcaaatgctttattacaaagttaaaataattatagaaatgattaatttaactgtcactctttacatacttctctggtttatttacattatttggttggggaactttgctgagttacctaaaggagatttcagagaaaatttgttatggaaaaatggaccatattaacttaattcagagtttcctatcccaaagtttgcataaatcaagaaattacttagtcaaaagcttttatggaagcaaagttttaggaaaaatattttaaatattaactttaatggtaatactaagagattttaaatattctaacataattcttacaacttggtgagaataggattattatctcaattttatagttgaggaaactgaaactcgtatgttttaacaacctgtcagaagtcacacaaagcagcagaaaaagttcttctaaatctatgtccacttttttctccactaacttcatgataaaaataacacaaaacaaaaatcacttaaattaacatccagaaataaccgctcatcctttttttgtgattgatgaaatattgccttaatttgataacatgaaatgaatatgtagagggtaaaaggaaggaatgtgtattttgcttagaaactataggtaaatagatatttgcatatttttaatagaaaatatatttgtttaaagtaaaagtgaggacatttgagctaatctaattcacaattctaaaatagcaccatctcactacaataaaatacattcaagtgttagttaaccattgactgaaaaaatgaatgatatttttagactacacaaaaatgtactaaacattttttaagcattcttactcattctcttcctcctttctttctcctctccacatatgcatatatatgctactggcaaaatgaaattataactgctgtttttcatttatcattatgtattggcacctctttctctgctaataattagtttacattataattttttagtgatgttttgaaatctatatttaagggcataatttatttaaccaaatctctatgtggaaagcatttaatagttttcctctattttaaaatatgctatgataattattcttgtacttacatctctgcagactttctaattatctcattagtataaattcctggaagtataattgttggatcaaggggtattaacattataaattttgagacctattgttaaacttccctctaaaagtattgtacttgatttggagtccctctaacagcatataagtgtatttcttttatattcttgtcaacagttgatattatcaatgcatttttgtcaactggttaacagaaaacttcatctccttgcttttgtgtatattgaacataaggatactatcttttcatataccttgttgccatttttaatacattttactcttatgaattggaaacaattggtcacatttctcaaatattttattagttttcttataatcatattgactttacagattaattaggagaaaattacaaatttagaatattgagtcttccctaagaacaagatgaaatcttgtggaaccagaaatttttatttcttcaagtaatcctttatgtccttcagtagagctttattattttctttgtttaacaatgtgacaggaacttaccaaacctcttttctttttgaatagttttctatcttcccctgtagttaattaagcatggccatttaactaagtcctagctagtgaacaccagtttcagtccttgttctaatacccccagcccatggtcatcttatcttaatttctcgatctcccttgtctgcgtggaaaggactgtgaggacctagaggaagatagagctgcaagatggaaagatgacattcaaggctatgcagcaagaaagaacatcagtgtgggactttgtgtgatccaaaaataagcttgtactattttcagacactgaaggttttttttgtttgttgtttgtttgttttattgttgtttgtcatagcaaattctgtttttctaagacagaaatgcaggagttggttctaagagtggtgtgatataaaaatctgaagcaactggtcagtagggctatgagaaaacagatacagaagactgagaagctgaaaaatattgatattctatgaaataaacatttttaaatgtcaactgtgacaattcggaaggcagactcagtgctcactgagactgtggctctagagcaatacttgaaaaggctcagaatgatagtgtatgtttgctactcttggtgctttcagcaagacattacaagaaagaggtgagatcggataagaattggttagttttcaagcacagaaaaatgggaatggagatgtttcagtgatcaaaatccttacaggtttggaaaatccaactgcttctgaactcaaatagcattagtaacaagtaaatgtgcttgagaaagttcttagctacaaaggcccaatgaaacttctcattgggaaaacagactcatccctgcagcctaaagcagattttatatatatggctttcccagctaattttttttcagttagctttagggtaggcacaattacattgacaaagaaagagagaatgagggaggcagagagagagagagagagagagagagagagagagggagagaaaggcaggtgcatgagggcaaggaagcaatgaaacaaaccaatttgagaaggaaatcaatttaggtgtggttattaggacataaaactgcacagaaagaaatagataagtctgcaatattttggggttatcatattgccaaagaaaccatgagttaagactaaaaaagccttcccttaatttcctatacaaacccttggatctttaaacttgcaaagcaagaagcgaactgtgaaaatggtacaactcccaagggcctgcacacccagttctgatggaatacacccaagatcagtggtctgcaacctatttggtgccggggactggtttcatggaagacagtttttgcacagacggccagggggtgaaggggtgcgggggttgggggaggatggcttcaggatgaaaccgttctacctttgatcatcaggcattagttagattctcataagagcatgcaagctagatcccttgcatgtgcagtttacaatgggctgtgcgttcctaagagaatctaatgctaccactgatctaacaggaggcggagctcaggcggtaatgctggcttgcccactgctcacctgctatgcggcccagttcctagcaggccacggaccactagcggtgagcagcccagggattggggacccctaccatgtaggataacaaacaagtaagagactgcttgagggcagggccaggacccgtggaggacagtgcacaaggctgccccctccagagagctgcattaggtcctaagcaaggaatttctcccatcacaacagagtaattgcgcaaggtcttcctggcagggcctgccatatctctagtttttcctttcctaaagggaagtgtttgttgtggttaccttgtcctgttccaccatagtgtgttgacacacagaggggcagataaggtgcccactgaattcctgtgtcaccagagcatatctgaactaatgaagaggattgattacagatggctcagagagagcctcagctttgaggtataaacagtgcctgggtgggattgtgggtcttctgtgaagactgactataatctacatgtaaaaagaggagtaaaatggagatttggttaagagattggtggactctagcagagactaattactcttaacgaaacccgttttctcctattcctgaatacacagctagactacatttcccagcctcccttacagttagatatatctattttattcagttgtagccaatagaacatgtgtggaattaatgtatgctattcgtggtgtggttcataaaagccttatatgggcaaccatctattatctcattcccataagttaacttcatggagagaacgcctaggacctagagaagggtagagccatagtgtagaggaggctggttcccagaatgcccaagtagaaggcagaaaggtctgctttggacttcaatcagaagaaacacaatcttaacgagtttagcctaatgaaagttgactggggcttttgattgtttgaatagcaagtggtttttttttttacagtaatacaatttttattatgttgttaaatctcttcctctcactttttaatgttttgaaggttgttattgtgaattgttcaagaatccaggatgaatagagtcataaattttttcagttgtattggatcacttaggctgaacttagacttcatttacaaaatcaaatgcactgttaatgcaaagtaaatctaatatagcgcacgataaactatatattgatcaaaatttccaaataacattttaaattatacgaaagagtagcagttttgccagtagaaatactgaaatttctgccatgagtaatagtttatactaggaagaaaaataaatatgtgatctgccctcagcttttgcatgatagcagagaagtgattgatattaggttattcatttatgggtagctcctctgtgctttatttctcaccctgtcagactgagaagagctaccaattttattaggactgctgatgtactctgtacttatagttttattacctattggagaagctacaaaatattggcactctttaacaatgagccttttatgcttccttgtgtcagcaagtattttagattaataccctatgtttgattgatggaattgtactgagctcttttttaaggttctaatttctccaaacatgtaaaaaaactagcagggggtctcacatatatgtgtaggcatatatatatacacacacatatacacacatgataactctattatgtatatagttatatatgtatatggtatatatatgtatatggctattgtgtgtgtatatgtgtgtgtgtgtgtttgtgtatatatatatggttattgtgtgtgtgtgtgtgtgtgtgtgtatatatatatatatatatatatatatatatatatatatggttgtcctctctcttttgctaggcagacatatgtctgaagctgatattatatatttgtctattattataaataaccaacataatggtatccatgttattaggtttgcaaaatattttttgaacagaaaacaccaatttagaaggaatacaaacttatattctgaagttcaagtggggagacataagaatgcctgtcctctaatttttttttgaaaaattattaaagctagtccaatgccagtgttggactagtaacctggattttttaaattaatagactttattttttagagcagtttcaggttcacagcaaaattgggcaacaaaaggtacagggagttcccgtgtgctccctgcaccagtgtggtacgtttgttacaactgatgaacctgcactgacacatcattgtccaccatgttcatagtttacattgggtcattcttgaatagtctgagttttgacagataaataacgacattttccaccattacgtatcatacagagttttttgagtgccataaaatacttccgtgaccccctatttatttctccctcctctgaatccccagcaaccactatctttttactgtatccatagttttttcttttccagaatgtcatgcagttggaatcatacagtttgtagcctttgaagatgagcatctttcagctagtcatatgcatttaagatctctccatgtcttttcatggcttgatagctcatttgttttttagtgctgaataatattccattatttggatataccacagtttatttatccattcacccactgaaggacatcttggttccttccaagttttgggaattatgaatgaagatgtaaacatctgtgtgcagattttcatgtggacataagtttttaattcatttgggcaaattccaaggagtgtgattgctggatgatagggaacagtatgtttagttttgtaagaaacttgcaaactgtcttccaaagtgatggcaccatttgtcattcttaccagcagtgtatgagagttcctgttgctccatatcttctccagcatttgtggttgttagtgttctgaattttggctattttaatagatgtgtcatgatacctcattttttaaattggcatttctttatggcatataatgcggagcatctttttgtatgtttacctgccatctttatatctttgggaggtctcttttcaggtcttttgaccatttcaaaataaggttgttcattttcttattttgagtttgaagagttgtttttatattagaataacaggcttttattatgtgtatcatttgtaaatattttcttccagtccgtggcttgtcttctcattctcttgaagaagaaaagcttccctgattggaaattgaactcaggccacagccatgaaaataataaatcctaaccactagaccagggagtgcatgctctagatttttaaaatcttgtaataagaatattaaaggattaattaaagtaaatatttggtcttttattttgttgtaaaactaaagatatgtcaattatctccaagagatctaaaagaatggaaaatatgtttcttccctgttttgatcattgagtgaggaggcaactaactgactcttaaaagcttggaacaattttcagaataattgaaccttggcagagctttgctataatcatttttaataatatttctatcaaacagttgtgagtccctataatgctaggtaacaaagttttgttgaaatatataaatttcttttatttagtttttgtagcataaccatattggtacatcaagtatttgaacatgcttacttttatagggaactaacaactcatcttctaaggcaaaaatcaaagaaggttactataaaaatccacaatcatgttaactttcaaagtcttagtttcactaaggatcattttttctttacagagatgaaaaggagtgcttactatttcaattaactcttggtttcttcatattatatttagctatttgagattaaatagattcatttaggtatcatggattaatttacatatatgactttaattatctttcaatatattatcaggtattgatttagactgttttcataagtcttttggtcttcctcaatagaaactgatttcctgtggatttacatgattgccctctaaataaccagggtgagataactgtgccaaaatgattggctggagagagtataagttcatttagaccacttttaaaaatatcaaagtattgtagtagatctctgttgtactttagcatgatttgaatcatgtcgtccaggtctgcatatctacctgcatatggagtaacacctgatcataaaatcacatttagcactattggtttaccatttccaagtactgattttagaactagatctcaaatagtaggcaatttttgtgttgtatctgtggggagagagagtctgctttcacatgactttctaaaagtagcaaattatatctaaatgatgtttaagtgttttaaaatgtaaacacttagattttaaatctaaaaacacttattggaaaaaaatctttatttcccttgcataatgttggcatgaatgcagcgtggctggattggcagttctgttactgcaggaagtggatttaaaaatgtataatttcaaagccaaataattcaggcaggcatgctcataggatggataggttcagtggatacatttgctctccccgcactcaccccactcaccccaccaaccctgactcctcctttgttttgtgctttgtctttcttttctgtagattgggatccaggttcaaaaatcttagcatagtttacccttctgtagtccaattttaaatactctaatggagtgttctattgttttgtagcaagtcaaatagttttctccatatatatatatatattgcttagccattccatacatagttaattcttttaatcttacctcataaatcaatatttctaggtcattaatcacccgtactgccctttacacatcttactgtatatatcccttttcccaatcccttgtaaacctgattttccctctgcacaaaatttattatataatcctaagtaggctgaagatataaatttctttttggaagaagagtgctttaacattaaaacgtctctaagactggtcttatctagatctgcgttgatcccgctatgtatcaaaggacaacctaaagccggaagataactgaataagtcttttaacttacttgccacttctaaaatattgagttacatttgaccagatagctccaataaagggacaagatttattgcttaggaaacttcaaccctgtattattgtgctttgtttagcagatttttctaaaggagaaacatatgtatttaaagaggtagaattttttattattgtaaatgaacaaaagatatttctagccagttgtgtctcctagaatgtactgtagttaggtagaattaggatgttgctttcaatttatgtatgtgatgcttatagtttcacacaactcaaggtatgtcttaaagtgagtgtgacatatagagagagaagcagcctccctattacatagatacttaacttagattgtatatgtgcttgcaaggattggaagccaagctgaaaatgggggtttttgtgggtatatttgctctcttttccccactctgactcctagtttgtttgtttgttttttttttttttgctttgcgctaactttcctttttctgtagattgggttccaggttcaaaatcttagtgtcacctttgattctcctttccttctctaccccataggtaattttaaaatatgtcagaacaatggcttcttttatctgctattttcttgttatttcaaacaatgtatttatagattgcctgatccttctaaagtgaaaactgcaggagagtaggattcctatttgccttgttcactcctaaatgcctggaacttagaacagcaagtgctcggtaaatatgtgtgtaatgaattaatgaatgtcacttgtcttagtcttccctttccatttgtactagctccacgtgggcgcttttgcttcatatctagattatttaaaatatatagcatcccatcaatttgaatttcaccattcagtacttactgcattctagaaggaggatggggaatgcagaaggtaatgtgtagttttaaacagggcagtcatggaacgctttagaagggacaagttctaatgacacctgggggtcaatcccagcaggacacagaagcaagcgtacatcctctcctgcaggaggctcctgtgtgatgtttcacatgctgacgggtgtgtagatgtggtggtagcagccttccgaagtcccctttatgttatttctattcaatgactaggagcaagaacattagctgtgaatgaggctggagaagaggtgttggaggtttgaggagagaatgaaatatataaaatagccatctgtgtgcatggccaattgaatggagtagagaagtgtggtgaaatcgcttgttctgcaccagctacattgggctgctgaggcctcagcatacggttgacagagagcttgatctaggcagcatctgcaaagcacagcaaactaagggtgggttaagggagttcagggtgagtgcaagggagagattgtaccgactgaccatgactttaaactgggtcaggcaggagggcagaaataggagtaaggggcagggaagagaagggaaataattggattttcaggattttatagcgaaagtttcagggttagggttgcagagggattgagctagaaagataagaaatggtagtcttagagtgggatatatgaagtctggaattttggagtggctgcaattatttgtcagaaacctggctggccaggatgcaggtcaagaccgtgatagaacaggccaaggaactagagaggctgaagcactggtccaactatctacacaggccctgaaatgggatagaacagtctgaaagaggaggcagacacttcgtctctagtcccagtgttataaaatggattttagagagaaaacaaccaacactgctggggagacagcatccttagggaaaagtcaggcttctgttagagcaagaagaggtgaaaaaggcaatctgagacagggaagggtatgcaaaagaggttttcctgatgaccgactgtgagcagcaggggcacagtgcaatggttttagcagttgatgaggtggcagagatgatttcagaaaaggagatgtgtagagccattcaggagccagaatgcaaaatgagaggtgacctagtgtttacactttattgggactaaagggcatggtgagtttggtctggagagtgctgaggtattggttggccatgagtataggaggaacagtaggctggggctcagctggaccttgagtcctgcaatagagggagggcagtccaagggcaggtgattttcctcctggcacgagagctcccttaagacacttttccactggtaaatttgtagtttattcatttcaccaccattttacagtccattttcaaaaaatgctgtgagtattcactcattctacttattcaggattgttgtgttgttgttcttttttgttgtcttttacaaatactgctgccatgaacattctcataaacataagtatagtttcttattgagaaagacaataatcatggataagggattctctagggaacatgcctaggaatgcaatcgcttggccacagaatatgtacatttttattttatttttatttttcagaagtaaagagtaaaaacattgaatgatctcatataacaaagtatctggaggaaacagctccttgatttcttcagggacccatatcttttgcatctttctgctgtagcatccttggaatattgtcttgttgcttcatggttggaacatggtgcccattgttctaggcatcctttcaccatctatctggacaagaagaaggaagaaaggaattgacatgtgcatctgcatttagcaggcatcattagtataaagctgtttgacaaatattaattgaaccatcatttgggtggcaatgtgtcaggctatggaatttaataattagtcaaaaatgtacaatttggactctttagcaaatcttacaggtccaaatacaagacttcttcctagaaatttattttacatgtctgattacgcagagaagggtcattccccaactccagcacactcttaacaattcttgtgttctgactctgaggagggaaaggatcaggaaaaataactaatggatactgggcttaatacctgggtgatgaaagaatctatacaacagactcccatgacacaagtttacctatgtaacaaacctgcacatgtacccttgaacttaaaataaaagttaaatttaaaaagtatgcatttttatatatgcagctttactaggcaatggtaaatggtttccaaagtgtatccatttacactcaaactagcaggaatgagacttcccatccctccatatcctcaccaacacttcacagtaccagaatttttttgtcatctagtaacataaagatgttttattagtgttctatttgcacccctgtgattattaatgaaattgagcatttttaatttgttttattggctattcagttatactcttctgttgttactatatatttcctgcttttctgtggggttgtgtttctttttcttgttgatctgttggagtactaatatgttttgaatactaatttttattgattatgcttgtatatatctatttggagtttatggcttaccttttaattttttaaatggcatctcttgatgagcaatcattgttaatgtggacaaatttatcaatttttatactttatggtgtgtccttttagctatctttcttaagaaatcgttgtctatcccaaaataataaagatttttttctgcatttttgttaattttcatatggtttggcctccaatatttcttttaatcacacagaattgaatttcatatatggtgtgagacagagatacagtttttctttttgcatgaatatgcagttgtcccgcaccatatatcgaaaactaccttccccattcatcagcaatgtcacctttcccatatgatcaagtttatgcaatcactcaagaaatatttattgaacacctgttctgtaccatgtactattaatctaacaaggaacaaaacaaacaatgattcctcatggagcttataattcagctcaggtaggaaggtaataaacaataagcattacagatgcattctatggtacattagaaaggaatgaatactatggaaaaaagagaaagtgaatgaatactatgaatattgtggaaaaaaagatctggataagggggtttggagttcttggtggggagaccgttattttaaatggggtggttgtggtaggtcgcattaagaaagggagaccgagacacttaaaagagatgaggtaatgaaacagacatctggaagaacactccaggcagacacaacacctagagcaagttccctccactgggaatttgcctgatatgttcaagggaagccagtgtggttagtgcagagtaaactgtggtgaaaatagatgaggagatcagagaagaggggtggggggcagagtaggtaaggctgtgctggccgctgtatgactctttttaggacacttattctttcttttttcttttcattgactatatgcgcctgttggaactaattctgttgtaaattgaaagacattgatccaattttattctacctggatggctaaccagatgtcccaacaccagttaatgaatcgtccatgtttccccactgatttgaggtctaactttgtgatttattgaatatgcaaaattatttgaactataactagatccctgctccagtgaccttatgttatacctgtacacactgattttttttttggagatttcctgactaattttttaaaataattcagtgtaaactacagaatcatcttctcaatttctaaaaagaaaaacctagttgtatttttattgcgatagtattatgtttataaattaattttgcaaaattaaccattttgtgatgtgtaatgatgtgcaatccttctatcacaaaatagtgtgttttctaatttttaagtcttgtttatactttaaatcatatttcaaaacttcttcaaatagatcttgtacatttattacatttttcccatgtactttattttttgttactataattgagtctcttatcaatatctcctaattgatcagcacttttgtatatgaaaactatagatttttgcatgttaattttgcatgctagtaccttactaagtttctatgttacttaccaattttcaggtggttttctctgagtaaatgatcatgtaatcttcaaagacttactgttttatctcatcattccccaatgttttaacctcattttttttctcttacctaattgtactggctagtgcctccaataagaatatttttaaaatgttaaatagtacagcaatagaggacatccatatcttcttcttgcctttagtagaagtgtgttgtattttcccgcatggttctgagattggagctttacatttgactttcttggtagatttttctttatttcttcattttcaatctctctgggtcactttgtttttagcacagacgtgtttttctttatgatcaaaactgaaagtttatttagtctttttatatttattaatagctgagatgttggtccaggttctgtgaaattattttgtaatgttttctatttttatctttctctgtgtgctcagttttctttgttcatgtgtatttgaaagagtatgtacactgtttattttgtttttatggttatctttataacggtatatcacctatagcccttattttttatgatagctattaattccctaatatgactaatgaacataattaatatactttctcttcttccctttctacagtaccacctgattttagtcaataatatcatatttcatagtgcttacctttgtctggttaaatatagttccatgctctaaatcctgtcctttgcctcccaatgataatagatgaagcaaaaaaaaaaaggatacctcacatgtttttctcatctctctctcgatttgtgttagttgtgtcatctgcatatgatatgtgttattgacattctgtactatcatcctgaagccaatgctaaatgatgagttgtgtagttatttatgtgaatgcttgacacagtcctttcaaagacattgccccagtcctttcctgagagtctcaagcttgtctccaaagagtttcctcaagagtggttcatagcaacaattatctttgaacttttgaatttcaaaaactatttatctggctgggcacagtggctcacgcctgtaatcccagcactttgggaagccaaggcaggcagatcaactgaggtcaggagttcgagaccagactggccaacatggcgaccccccgtctctactaaaaatacaaaaattaaccaggtgtggcacatgcctgtaatcccagctactggggaggctgaggcaggaggatcacttgaaccctaagaggcagaggttacagtgagccgagatcattccactgcactgggtgacagagcaagactccatctcaaaaaccaaaccaaacaaaaaaaacaacaacaacagaaaaaaacctatttatctgtagattttatacctaaagggcacttttcctggaaatatataccttggcaaaccttttcttatgaatcttgcaggtgcttatctattgtcttctgggatgagacattgaactggaaacacgaagtcaacctgactcttacaagtgacttgatagttttaaataactacacaaaagacttttaaataaatttttgataagttcactaatatatgtcattgggcaatgtttgctttaatttttcctggcccacaggtaataatttcttcagcaataaataagtagctcttgtatttcaaaacatttttataaccacatttaaaaatatttgtttttttctcattgttttgaatttttttgggggggacttcaattatgataaggtagcactcccttgccagactttacgtctctttcacattattcatttttctcatttctgtcctttctctcctctttgtatttttgcaatgctatttttcccttttacttcttccagtttcatttttatatattgagtttcttatttctacttgctttccgaattctggtgccttatgcttcatcttctcctattacatcaccatttcttccctgtcataattcttggtctcctttcatgtaagtgagggattcaccaagttttaaaaattcctggcaagctatttggtcatagtgtttaactctgtatggtatttttcatcaattagtaagttttgctgctcttttaaatattgtttttcttatagtaactttgatattgtgctaggtcccactttaatacttactgctgaattgaattgatttttcctaaatgcttatttaaagtgggcttctgggtctaggcttcttgatccaaccttttccctctctattctgtcggaaagaatgatggttgcaagtgtcatttgtttatgtatttatttgtgtttgtgggtccctcttctgcctctttgatccacaaatggatgtgaagggacttttactgggagccttatttatactcatttttgcaaacaagaaacaaatgttgtccctcatgagttctccctcaccagaaatacatttttttctggtgttttctagaatccctcaatgatctccatcactcaccatatttcctctctctccttcctcccacatagcttgtgccttatgttagctgcttttggtggtcagtttttctcctaattttacagcaagtgaggcttatggttcctttttatttttattcatcttatttcattcatatgatttccaaaataagaagaagaaaggagaaatgttcacactagaaattatattaacttttgagatttagtacttgttaggtaccaaggcactaaaggaggctgtgaagtggggcatttgctcaacacctcctctatttccttttgaaagtgaaagcttcttgtctgtggttactcatatgtcatcgtatatttaaaaatcaaaaatacagtaacatatttcaaaggaaagatgtattaggaaacccctcactgagtcagattgtgtgtgtgtgttgtgtgaattacttatacaagtatatggaatgcctatataaaattttagtatctaacatatttcaaattctgcttaccaattctattcaaatcatgtaatcgtatgcatgcatcaaagtaaataacgctatgcaaaaaagaataacttctgaatgtaaagaaagctattaacaaagcttctggattggtgaattgcgagtgtctggctgttactgggtagataaatggccaagtcagacttgttgatggagagtggtcaggagttcaatctgcatgtggattagttggctttattttggaaacaagctgaccaaacttcagccagctttcacaaatgaagattttggctcagggaaaaaaatgcatatttactaaaaaataataaaatgtaaatgaaaataaaaatactttgcatctgaatagtgaaagatgcattactatctttatttagggcagacaacatgctgtttaggtacatgttcatcttttctccttttatattcttaatatttctttcatggtcgaatagactgtggtggaaactgtggtggaaaaaacctaggttgataggactccaatctagtgtttcttattaaattatcttccagttaagttgtagtaagtgtgctttatgtgtgtgatatatatttcgtacatttcttgctttctttattattggagtttctaaatcataatcagagtatttcatagctctgtaaattgtgttaacttcctaagtattttattttagagggagccagtgcgatgatgggaaagtgggacccttttttttttcttactactataaatatcttttattgtagacagttctaagaattgttttctattaaatagctatagttttttcttctggagaatttcagtttgcatcattagacacaaggattttcaaattttctattaaaatattcatgatatgtaagatgtgaatggtaatagtctcttaatagatacaaaaataacattttttactctaattattcagtaagaaataactcttgcaagacacagaagatatatgtttagatataaactgtttaccacctttcaacattaaaggtattaggagagtagaatatattttacactcttgcccatttatattctcctttcacatttggctcactcattcctttggccttagagttaggtgtgacagtgtattagctaagctgtctcagtcattcaggccttttatcagttctacaagacagatgctaaatagcatagtctaaattgaagtctctgatgactctcggagacaagttgaaggcaagaactgcacttgggcacttaaatatgtggcctttttctatatttaactgcaagaagaaggcagcttttaagtaaactttttagcctttaactgtcaagaatttttttaatcatttgattgttgcatctcattttgttaagaaaggctattaaccttttctttttctcctacaatggagaattttaaagatcactgctgcctattattttaaacaaaaataatttaaaacaaattttgttgtttaaccattgctttcaggacaattgtagactatagagacatttttgaaatgaaatattgcttccaaatgtgccacagtttatctataaattttgaatgacatactcacaatttacttagcaatctttgggacctccttatgtcatacagttattacagaagcatttttaaaatcaagtggacctgaaagaatctggtatctatgaaatggagatagatgttaagtaatagagctgaagaaaatatgctttgaaatgtcgactgggatatgtttccatagcctgtttgaatttcagttcaccaagaggaaaacaaggagttgatgtgttctttgcagttcctcttagctccaaaagtgtgtgaatgctctgataatattgtatgtcctcagtatgtgttgaattaatacattgaagttttccctgccagcccttgttgcctgtagtgccttatttttaaagactccgtaggatgctcactcaacatgttaagttagaaaggtgtagaaggaatcgtagaggtcagccaggaacattttacaggaggctgaggctgcaagggtccaatccccacacctggcagttcctccacgtgcgctgagccgtcttctgaactgcctgcgtcttcgtggacctccttaaatctttctggaaacaaggccgcttacaatgtgtggtcaagctgaaaaaccagctgtagtaccaaactgtgctaaatcttttagctgaaatatttgtcaattttctttttttttgaggcagagtctcgctctgttgcccaggctgggggatatcttgcctcactgcaactccacttcctgagttcaagcaattctcctgcctcagcctcccgagtagctgggattacatgtgtgtaccaccatgcccggctaatttttgtatttttagtagacatggggtttcaccatgttggccaggctggtctcaaactcctgacctcaggtgatccgccccccttggcctcccaaaatgctgggattataggcgtaagccaccatgcctggctaattttctacatattactatcttatactgatagcattgcatctttctcatagcaccgattagaaaaaaaaatgcatcataagttatttgtttttctgtgatcatcaaaaggcaatggtaatttaaatgtaatttattataatatgcacatgttaattttggtttttatttatgttcatcatatttaaactagtctctgcaagtactttagactaatttagattatttcctttaagtctaacagaaaccttagattttcaaccagatttttcatttggacaaatgaatttcaaaacaggaaatatgaattttattgcaagagatttcacctagaaagtgtattgatctcatcaatagtgaatttttggttataagattgtagtaataattaataactacttaaatttataaaatttatagaaaattcagacaaattaattctgatttaactgttaactacaaaagttgtaaatggacaaatacagggaatagcaaacataattttctaataattatttctaattaaaattgtacagaattcaggttcataggaaattataatacgtttttgtctggatccactgaaacctgtaggtactctgtaaaggctaagtaacattttctaatgaaaaggaacaatgccttcagatcgaagaggtttatcttctgagtttgcagaattctatatattttttgtgacatttctcatattcttatttcaagtgcagattgtgggtggtatttttatctcttctcctaataatatatatcttggagctaatgtatttgagttgtatttttccccgctcgtactaaacctagtaacttgtgaaaattaagtagtcaatatatttttaatgaataaatgatataggtaaaagtctaatttagagctattttcttaactctgtttctagtaaataatttagtttatgtgaccatagatccccaaattcatatttatgagctcctaacattgaaaaacttactctgcactttacatgtttctctggccattttatgtaagtgcattggttatacatatagcttgttttctaaaatccactgcggttccataagtggttatataatttatgaattccagtgtaatagtccattaatttacctctcttttcctatttccagttaccattggttttgacctccttcagcaatcacaccttgctaacatctcagatcttgacatcccacagggtagaaaggctcctatagaatacagatccttcttcatatttctcacccattcctcagtgcactacagtctggcttccacctcatcatgtcactactgcttttagattttcagatggatactttcagtcctcctcttaatgatctccctttattattaaaaaacaaaaacaaaaaaaatggtctctctcacttgttgaattttatggtatcatcccttttccattttcttgctactattctgactattctttctattctcctatagaatcctcttgttgttaaatattcaggtactgtcttggggcctcagcctttttctcactatacactctctctttgggaaaagttgcccgtttccatagattgaacctaccacttggtcacagccaaacataaccaacagcttagacctctctaataaggactcttcagatgtccagttgttcagtgaccccccaagttgtttaccccacaggtattgcaagcttaatgtgaagaaggatcaaaccccacttcacagtagggatgtggtttgttaggaaaggtttgtgctgagtcttgaaggtgattaatggttattcaggagaaaaggaaggagaaaagaaaagagtgagggcacgagggagaattacaggctgatggaaaatcatggagaccaaggaggagcaggatatatttgagactgccagcattttggtgtgactaatgcttgaagggcctgtgcaggaacaacctgagagactgacagtcagcttgcaaatgtctttgtgtagtgtgtcaatgggaaatcattgatggattttaagtagatgagagatatgatttaattagtctattagaatattcattgtgcagcacacagaggaatcaactagaaaaagcaaagctggaggcaaaaagagcaaataaagaaaagacagagactttcttacacaaaatttaaaacttttaaatgctaaataaataaaatgggaaacaaagatgataagatattttcagtcaatacaaccagtatttaatatattccagtataaagatctcatacaaattaacattaatgaggaaaagacatgaacacgcattcacaatgcatgcatattgtatttatacaaaatgagaaaatgctcatcctcctttgttaaatgtagtaatctaaattgaacaggaagactcatctattttttaattagaaaataatattatcaagatcataaaatatacaaaaaatttacctcattatctcactttggagactctgtctgaaggaaataatataaaacatcatatgcctggaatatttatacaatgtaattacaataggcaaaaaattgaaataatataaattccaaatataatggcaaatagtaggtggaatattacttagctattaaatacaaaattttgatagaaatggcaacatcgaaacatattaaactaagtttaaaagtacactaaatggaaaggacataaaaatgtaaaaatatggtatctgcagtgctatgtttttgaaaagtttaaagggaaaagcacaaagttattaataggtggtaggattacaagtgatttaataagattttcttgcaagctttctacagtttcttattatttatatgatttaaacaaatagacaatttgtaactttgtagtcttgaaatctaaattccatctctgcctgtagctctcctcatccaatcggtcaggtgccccgaataatcctttagatttttgcttgaatttaataatctaggacagtgactgagggacatgtcctgtagagacaaagagattgggggttaaagtctttttctgactgtgtgctgacatggtgatttccagccggttattttctctcttcaatttccttgtctgtgaaataattttcatacggttttgttgcaaattgataccagtaatgttcataaagcaatgaacacagtatgaggggttttgttcttattcttgatgccaccttaatttaaggcttttgccatcccatgcttggaccactgcattgaaatgcagaccattcaccttgactctatattctcctgacctcaggccattctgttagaccttgactgaaaacccttcgggaagttgatggctcaaatcacttgaagttttccctgccagccattgttgcctatagtgccttatttttaaagactctataggatgcttaccaatatattgaatatttattgaaatacagtcatgtattccttaaatgtggggatccattcatgcgttgttaggcaatttcatcattgcatgaacatcatacagtgtacttacacaaacttagatggtattgcctactacacacctagactatgtgttgtagcctattgctcctgggcttcagacctgtacaagatgttactgtattgaatgctgtaggtaaatgtaagaagatggtaagtacttgtgtatcttaaacatatctaaagatagaaaaggtatggtaaaaatatggtgttataatcttctgggactacaatggtatatgtggtccgttgtttactgaaacattgttctgcaacacatgactatatataaagggcgaccttggagatatcacagattcagtttcagaccactgcaatgaagcaaatatctcagttcagagagtcacgtggtttttttgtttcccagtgcatataaattatatttatactatattatagtctaataaggtacaatagcattatgtctaaaaacaatgagcctaccataattaaaaatactgctaaaatatgctaacaatcatctgagccttcagtgagtcttagtctttttgctggtggagggtcttgctttgaggctgatggctgctgactgatcagtgtggtggttgctgaaagctggtgtggctgtgatgatttcttaaaataagacaacaatgaaatttgctgcattgattgatttttcttttcatgaaagatttctctgtagcatgtgatgctgtttaataccatttgatgcacagtaaaacttctttcaaaattggagtcaatcttctcaaattgtgcccatgctttatcaattaagtttatgtttgctgtcattgtccttttttatcattttgataatgttcaaagtatcttcaccaggagtagattctgcctcaagaaactactttctttgctcatccataagaagcagctcctcattaaagttttttatgaggttgcagcaatttggtcacatcttcacttctaattctagactttttgctatttctgctacatctccagttactccactgcagtcttgaacccttcaaagttattcatgaggattggaatcatccttccttttaatgttgatattttgacctcttcctatgaatcagaaaggttcttaatggcatttagaatggtaaatcctgaatcttttgcagaatatttaaatttacattgcccagatacatcagaggaatcaccatctatggcagctagagccttacaaaaatgtatttctttctttcctttttttttttttagatcgagtttcactcttgttgcccaggctggagtgcaatagcacaatctcagcttactgcaacctctgcctcccgggttcaagcgattctcctgcctcagtctcccaagtatctgggatcacaggcatgcaccaccacgcccagctaattttgtatttttagtagagccagggtttcaccatgttggtcaggctggtcttgaactcctgacctcaggtgatccacccccacctcaggcttccaaagtgctgggattacaggtgtgagccaccacacctggcctaaaatgtatttcttaagtaaaaaaaaaaaaaaagctgaaagtcaaaattaccccttgatgcatgggctgcagaatgggtgttgtgtaagcagggatgaaaacaacattcatctccttgtacatctccatcagagctctagggataccaagagctttgtcaatgaggagaatactttgaaagaaatctttttttctgagcagtagatctcaacagtgggctgaaaatattcaataaaccatgctatatacagatgtgttgtcatccaggctttgttgttccatttacagagtacaggaagcatagattttgcctcattattaagggctctagaactttttaagtgctcagtgaccactggcttcaacttagagtcaccagctgcgttagcccctaacaagagagtcagcctgtcttttgaaacttcaaagccaagcattgaattatcctcagtagctttagcagcccagtgtcctcttccaatagaaggctgtttattctacattaaaaatctgttgtttactgtagccactttcatcatttatcttaggtagatcttctggaaaatttgctgcagcttctccatcagcacttgctgcctcaccttgcactttaatttatggagatggtttctttccatacatctcacaaatcaacctctactagcttcacacttttcttctgaagcttcctcacctctctcagccttcacagaattgaagacagttagggccttcctctggattaggctttggcttgagagaatgttgtggctggtttgatcttctatccagaccactcaaactttttccgtatcagcaataagcctgtttcactttctcattattcatgtgttcactgggatagcactttttatttccttcaagaacttttcctttgcattcacaacttggctaactatttggtacaagaggtcttccagcctgtcctggtgtccaatatgccttcttcactgagcttaattatttctagcttttgattcagaggaagagatgtgtgactcttcccttcattcgaacacttaggagccatgtagagttattaattggactcatttcaatattgttctgtctcgggaaatagggaggcctgaggaagggagagagataggggaatggccaattggtggagcagttagaacacaaacatttatggattaaatttgttgccttatatgagagttgtttgtggtactcccccaaaatcacaatagtaacattgaagattactgatcacaggtcaccataacagatataataatgatgaaaaattgaaatagtaccaggattaccaaaacatgatgcagagacatgaagtgagccgatgctgttggaaaaatggcactgatagtcttacacaatgctaggttgccacagaccttcaatttactaaataaacacaatatctgtgaagcacaataaaccaaagtgcaataaaatgaatgtctctacgtatccgtaacaaataagactcatatcttttctgactatcatgatcataatatattgttaaattcttaaattgttatattgttataacttattataatcattttacttggtattatgagctcatttttgctatcattgagacacctatcttctattacaatacaattttcttattgtaataattttgtaagcattgtcctggtcatttggtgaccttgagtattgtaaaatttctgatgtagtgaagcaattacagttggcaaatgaggcagatactgaattacagaacttctcactcaggagcctacgctgaaggtaaccgatttaccattcctgagactaacagtccagtcctgacagaactcaagtcaacaggtcttgcccacccgtttataacaatggcgttttcatgaatcagaatttcagattgaacctgatgaaaacaagtaatcaatatctttgcatcctattgtttcagtgttctagtgggttggctaaatgggccaattagaataacacaatgcaaatttcctgcttgatataaaagtcttttttaaacagcttcagtttatgctaaataataaaaatagtgaaaaggaaattttcaaactatatgatgaagacttcaagagccttacattccttccttattattattagttttgtgaccatatgatggacactgtgatctaagtcctaaatccattatgccacattccgtaaatgtaggcatataaagtattctgtcatctgtagttatttcaaactgcattcaatatcttggttcccaagtgcattggattttattaaaagcattctgctgtaacatccattcttcccaattggtttacagattgcccctaccattcaggcaaaccctaattgcattttcccacaaatctcgtttgatttatggtctcttgtttgctttatattatttataataaattgaggtaaaattcttaaaacatgaaataaaatttataatattttctcttctacaaatatggaacttacctaaggattttcagagtcgttttgcttgttttaaaagttgtttagacaagctacaaccatctgcatggtttccaataataagttctttattaccatcccagaattaattatatttcgcttgattttttttatgtacagatgtttaggattatatggaataaattatgtatagaatataaaaatggtatgtccttctataaagcttaggtggttacacatgtcatatgtacctggaacagaaaaaaatattatttcagcagtagtgacaaagcatctgcataaaattcagtgccactgatgcaccgagacagctaattgagaacattcttgcttctgttacaagttccggcttttgagatgccaagagttagtttagaatggatctatagcagatcccaaaaagtataaagtgtttaaaaataagtaaatagcagaaatataaagacagaggataccagagacttaagaagagaatttctcactgtcaagtgattacatatcaccatggattattttgtaaagttctcttctaaataaaggctttccatggaagtgcaggcatggaatcatttctgtagggtacatgaaaatttattgaaaggaagaagtataagttatctatatcgatttatgaatagccttctaagctttgttagaaatgtgtctattcagtcaaaagtttgaacattaagaattttgagctgagaatcagaaagattggagtatattcagtataagagacaaaaagaaaagagaaattgattttttgagaagtgcaaagacaaaagggggaaagatggatgatctcaacaaattttagaccaactcagtaagtgggaggcttattatcaacagtaaaaataactatgtgacttctagaaaaactcagaaagggtggttagtggatgattagcaaacaaaatatctaaataatggttgtagttgagtttcttaaatggggctttgggactttcctcttcactagaatagtaaagaggccccaacatctgcagtgccagtggagacctcacgaggagcttgggcttgttccccacttagtgacgaaagagttgtctccttcccattggagttaagtcagaggactgcctagagagtcaggaatttcaccactgcccagggtaatgaggccacactgtttatgatgtcagtgtggacaatgggggagcagtaatgagtcactcctgccccttccagccaggagggcatcagtggaggcctagtgggttctggaatctccatccccacccagtattaataaggcactccctcctctggggtcacccagtattaatgaagcattctctcctctggggtcagcagacgccaagtagagtaatgagacctctaccccaacttggcagtaataaggtagcacccttcccccaacctttgccagagaaatgtcagaataagcaagctaaaacggaagctttaagatctcataatataatgtatcaaacatactggtttcacaagaaaatcagtaatgacaccaagaatcaggaagatctcagagtgaatgtaaaaatataatcaacaggtgccaacaacaagataacagaaatgttagaaatgtctagggaagaattttaaattagttacttccaaaaatgcttttatgaatattatgacacccttgagacaatgaaagagtggaaagtctcagaaaagaaatagacgatataaagatgaaccaaatagaaattgtagaactgaaaatacaactcaaattaaataaaagcatatttgggctcaacagcagaatgcagtaggcagaaggaagaatccacaaacttgaagatagagcagtagaagttacccaatatgaacgacagagaaaacaggctggaaaaagaaaaagtttcagggatctgtggcactgtaacaaaagatctaacattaatgtcattggagtctacaaggaaaggaaaaagaagccaggccaaagaagtactcaaagaaataatgactgaaaactttctaaatttggcaagagacatgaacctacagattcacaaagttgaacaaacttcaaacaggataaaaagcaaagaaatgcatgcaaaggcacatcgtaattaaacttctgaaaattaaagacagagaaaaatcgtggcataactaaaaaaaagtggcaccttataaataagggaaagcaatgtgaatgagagtggatttatcatccaaagccttgaagggtagatggaagtggcacactatttttcaagtgctaaaagatagaaccatgaaccttaaatcctacatccagttaaaatgtagttttggaaatgcagaagaaatcaataaaattggccaacttctagtaagacagacaaaggagaaaccgaagacacaaattaccaaatatcagaaatgaagaatggatatcttgagagaccctccagacatcagaaggataatacagaaaaaacacaagcaattctacacttgtaagtttaactacttaaataaaacgggccaattcctcagaaaatacatgttactgcaagtcatccaataggaagcagattctttgagtagctctataactttaaaggctattacatttgtaatagaaaactccatatcaaaaggtgacagaataaaaatcacagaagcatattgactgacgcagaaaaaaattgaaaaaattgaacatttagttataatgaaaaactatcagaaaaataagaatagagggggaaaggtcatcaacttgttaaagagcatctacaaaaaattttgcaactttattcataatagccaaacccaggaagtaatccatatgacctttaaaggtggatgggtagacaaactgatgtatccatgccatggaataccattcaccattaaacagcaatgaactgttgatataggttgacaaccccttatctgaaatgcttgggattcaaagtgttttggatttttgattttttcagctccaataagcatttcctgtgaacaaccatgtcagcgctcaaaaagtttcagattttggagcttttcagattttgatactcaatctgtacacacaacaacttatatgattctacagagatttatgtggagtgaaaaaggccaattccaaagggttacatgttgtatgattcttgaaataacaaaattatagaaatgaagaggacatagttgttgctaggggacgaaggttaaggggaagaaagagtgtggctgtataagggcaaattgagggaactttgtggtggtagaaatgttcttgtctgtatcaatgtcaataacctattgtgatatagtatcacagtttgtaggatattcccattcgggaaagcaactaaaggctatgtgtgttctctgtgtgttatttcttacaactgcatatggatctatgattatcttaacaaaaagttaaacaagaaaaataaaataaaataaatgaggcttttgctgaccagtaatcagtgttctacaataacaatacacacacacatgcacatacatatttgcactatacactggcactattgcacataatttactataaatatttgttcacacatttatgctcatttaacttggtcaaattttctttctttagattgtattatatcacttttttgagggtgttaaaatggtgccatattggtagatgttaccatctaccttttctaaaaaaaaataactttttggcaacataaaaatttgtcaatcatttatcatttccaaaaaatgtgattcaagatttactcctccatgaatttcagaagtccaggaatcacagttctacagtttccatgatagtaatatagctaaaactgttctttttatgtagcctccagcttaaagagctgaacaaaatagttgttaaatacatgtggttatttgataattgaatgaatttgactgaaaatggtggctattaattctaattccagaacaaattcctaatcttcaataagtaaaaggaaatcttccttcctactggtaatacccaatgctgcctcaattactcatataatcatatactgggagtaatgtgctatgtagtggagtaaattctaaactctaataaatgtgtgttacctcactcttcaactccacttcagcatttaatcattgtaataaggtatttcttaataccacacttaatttcaaatataatccttttatatatgtattagatacaatgtatttttcatatctaatatgtgtattgtatgtttatttattgtatgttatttagatatgttaatatattcattaaaattggagtttttaacaaaaatattacaaattaacatataaaataactaaaaatattaggttatattattttgtctatagttagtattagcaaagtaataatgaatttattaagctaatatataaaatgactagtatttaccttttttcagtaagcagggaaaaataatcgtgtttagactatatgtaaggaacagaatagtacatttattttctaaatagtttacttactactttcaattttgtaatctaatgaattagttccaatgtaaatacagatttaaaagatgtattcattgtaaataactctatagggaatatttcttcttcaatgaaaatttcagttttggagatggaagtttctcatcagttctaatttctcacctattctaatgttactttcttgtgaattcatgttaccaaatgtatgctgtacacacacatagtaggccacctttttctctttctacactaatttattattagttttatatcattttagtagttttattgttaatattcataatgtgagaacatattccactattttccatatatatagaaagattgaaatgttttaaattacttcagtattccataaagtatatcagacccaagattagaatttataagtatttgaaattgtaaaagttttaacattctaagcgtaagacacctctattaaaatgtttttcacaaacataatatcagttttctcttccctctaaagtgatattttaagagacattttctaggaatgctttctaaagtagcttgaaataaagtagacttttaatagtgattataaaataattttctttcccaggtgtttgtattaacagatttctgttgtcccttatttgataatgtgtttttatcttccaacatatttatacaaactgaaatctttaaaaacagaaagttcttttattatgaatttttttagtatgtcttaaaacctgatccctatttttttttttccaattaaggtgagaggccctccagctgcaggggcatttaaagaaagaccaaccaagcccacagcatttcgaaaattctatgagcgaggtgacttcccaattgcccttgagcatgattcgaaaggaaacaaaatcgcctggaaggtaagtcagggcacagctgtgccggccagctgcacccgctgaagtgacatctcccaatgccaaacacacttggctgcttaagtaaataaactggagtcatttctcagcacatggaagatggtgggaaagctcttagagaaagcccccctgtgtcagccatccaccttgactaacaattaaattatagcctgcaaagaagaaaatgacagagttgctttgccttagagagttgtctgctgcccaattcatctctatttttatgagaacctggcagcccggcctgtttcaggcagtccatcaaatgatggaactggtggctggatacggagagcaacagccatttatctcccccagatttcaccttcctgcaggacacttccaaatggaagctttaattacctaaatggataggtcaagattgtctgctccctggaaatgcagagtagaatacaaaagcaggccgatcccaatcctggctctcctctccgtccccgcctgtgtcagcaagcgcgatggctgtcacacgtgccctgttagaggctgacctccaccgccaaagccattacagcacggacatttttctgacaaaaggttaattggcttcaaaataaatgtattgcctaatgactccattctaatgtggttgtgttcctttgtaaaaggctcactgatgttatttgtaaaaacttgccaatctcttaaccggagaaggcttttacatttaatctgagaaaaataaatgctggtctctaaccagcttctgctatttaattattgttgttatcaaagactttgcttttggtgatatttatcaactaaaagggcttctctgcctacagacagcaaagcagttgtgcacacttatgagtatcacatcaggttaaggacaagaaaaggttttggccaactattagttaaattaagcaattgacacatttaactgggaagtccagcagtcgtgaccaaaagcaaatcaggaattgtttttaattagtaacaaataaatttatgttaaaaataaaagtacaaatcagagaaatcaaagtaaatagcttaaaaaggtgcattaaaattaaatttttccttcctgtatagacacattgaaaggattattgcattatatctagtatgtcttttgaaatattttcatattgttatcaaacatttctaattcttgagcagtcatccaatatcagttattgaacttagaattattccaacttatattacaagaggaacttggtagtatccttattaggaaaccttactataaaattttgggggggtgggaaagaggtgagtaacattattatctcctttataatagtgtctgttagaatgtgaacttgttatgtgaaaatgtacgtatgatgagaaaaaatttatagcgtgtataactaactttcatactttagtcttaatataagcatatatttccaaagttttgtttggatttttggattcatatatttgattggttgcatggattttgtgtttgcctgtctatgtactggctcatagatatgtactggctccaagataatacaatggagtttcttcaaaacctgattcctgttgagtaaaataatatgtcataattctttataaaaagggagtggcttttggtgttttaggtaattataacctacacataaattgtattaatgaaaataaattatatagatttactatgattcaaataattttatgagcaacctttagaagtgtagagactagaaaaaatcattttgaaaataaattattaataaaaatatgagatgaatcattttctttatctttgataatccaacagtcagcagggatataaaatgcttttcttttttatggatatattaattctcttaagctactattgattatagtactgattcagcaagctaaaaagtaataaaaagaagaaacaatttctttgctgtcactggtagtataatagcataaatttaggaaaacatcttattccggaagctgtggacttcttttagacagtagctactacattttaattgcattactgtaacactgaagataagacattaagattattttttattttatttatttattttttgagacggagtctcgctctgtcccccaggctagagcgcagtgacacgatcttggctcactgcaacctccgcctcctgggttcacgccattctcctgcctcagcctcccgagtagctgggactacaggctcccgccaccacgcccggctaattttttgtatttttagtagagacggggtttcactgtgttagccaggatggtctcgatctcctgacctcgtgatccgcctgtctcagcttcccaaagtgctgggattacaggcgtgagccaccgcgcccagccaagacattaagattgttaaacataggcttgggaaccatctgtccatagtttcatatttatttcgtggcacatttgatgaaaggacaatctggtgctaagtaggaggagggacttgttttaggatgccattcttaaggaagaactcttgagtgttgaaggaagcagggcgatccgtcccccacaaaaaactaaaagcaagaggccaagaccctgcactcttctcttgtgtgtgggcagagcaccggtttctggtcatgcaaacctctggtctcaatgtcatagctcatccctcactgaggactgctgaggagcagtgcttccctccgaggataccggccctctctcaactctcctcagacaccctagagactccaagtggacttgtgagcacctgaaatgatgcacataactaagtgagaagcaggtctgttgcttttatcagtgtttccagagcctgtggctccgaaggacttaggatgcactggctgtaaaccccggcacaggctgccccagcctctcacggtcattccagtctgtgaatgtgctggtctggggatccctccccaggtcctcagactcctcttctatttgttctggattagctgacctgatcttcaccaggttaggaaccattgtgtgttcttgaaataacaaaggcactctatggtaacatcagaaagtagaagcaagagttagagacagacagatgtctttgcatgcttaggtttctcagcccacgccctgctctcagtaccagtttcatgcacatggaagtggtcattagttccagatgccaaaacaacgtggcaggctgcgtgtcatcgtctctgcagcttcgtctctttcttgtggcatctctgaagattgcagcagtgtctgatccaacagtctgcagtggtggaaatgttctacatctgcaccgtctaatatggtacaattggccatatgtggtgattaagcacttgaaatgtgcctacggagactgaggaactcaatttttaattttatttaattttaattaattttaatttaaatagccacgtggttaccatattagaccatgcagctacagattaagataatggcagtcaaaaataaatgcctgaatctgctacccagatagatagaaggctatcactgtgttagaatttttattattaaagtgaaaaaacgggactcatctgtggattttttgtcatggttttctatgcatatcataaatttattagtaaatgtgagaaacgttttgcaaaatgtttgtagtgaaaatttctatatacttatcaatggcaagttcatgagctatgaaagttgaataaatctcatctcgaatatgaaatctaccggcaagcccaggaatagctttttttttaatttttaaatatgcattttctaaatatcactaaagaattcttgattatcaatggttgtagttataaaaaagcataaggaatacttaaacaaaaaaaatgttaatctgtttcttttgctacattttccttgacccctctaacatttgggaaatacgactgttgattcttttgctgtcttcaatatccacattattggcaacaagtgagaaaagagctaagctgtctggataagttacaaagcagataatcagatgaacgatggaattttaaaaattgtgtttgagttttctcatcttaaattgccatcctttaattttctgtccttctgtaatataaatcgcacacttctaatgatggtgatcggggtggggacggggctctttgtaaaggttttccatatgggcacctggggagggaagaaatgctatatgaattggtaaaatacatggcccattgtctctacctctgctgtgtaaataaagagcgaagagaagcatacaagtggttttgaaacggtctcttcaatagagacctcgagagaaagagatgaagataaatacctgaggcactgttaatttttagaaataactatatcatattataaaccattcatttattttgaagatggaaacagctacacctacataaaggtgtctctaaaatctttcactttctaggcattttgatgtagtagatattgatacaggtcatctttctccatgataacgtgctacgtgacagaatatgacatgcactaagacggtcttgttttccactaaatttctaataaccaggcgtaagaatgtcccaggtatcagagatatttgaataggacgtagataaacctgtaatcctctaggaaaatcaggatagaataccacccttttatgcatgcaacaaaatcacaaacctctcaaatttgaaagggagaaactcaaaatggacttgtattttgtccaaaatccttccccactgcccgcacagcacccgatcaacccacacccggcaatgtcatgatggtccttgtccagagtagcagacatgccagaggcctttctgcgttcttgttttttcttctttgacacgtaaatgatattccatagccacctatattgaaatgaataaaaccagaactgatacatatgagcaggtatatgtgagaatggacttaggtggcctctactcactgccaaaaatgtatcttcctcactgccctattagagaatatgaaatctcaccatggaggcaaatttccccttaggttaatatagtaattttacctgttgattaaaatttagatctccagactttgttttgtattaaaaaatgacttattaatcaggtaactatacacatttaatactttttataaataaatgttgacatacatatgtcatttatatatttataccccacattatttcaaaacggatttaaattgtcttacaaaaaaactataaagtcagcaaaaataagagatgagagaaatgaaaaccatagggacccaaaatggatccagtaacaatgttagtaaaaacaggcatatcctgaaatcctataaggcgagatctttgtctgtatttctggtttattcactcactttcctggtacctagaacagtactgtcacagggcaggtgcccagggatatttgttgaatgcaagtaaagcatacaggagctgattgtttttaagttttatttctcttgcttcgtaggcctcactttccttatctgtaagtgacaacaatataccaggtgatttctatggcccttttaaattatgagcattcaaataagttttgtttcataattattaaaataattgtattttgatatgttggtggaatacttcaaagaacaaatattgagtacaaatttgccacagagatcaattcttctggtagcaaaatggaaatattagcagcagcacatttaatttgaatccatagcactttaggttccagaatgatatgcaacggtcttgagggggttgaacttttaccaggaggatgctctttaggttatacacgaatgctttccaatgactactcatcccttaaagtttgctttcaaaatgacaaattcgcttccctttctaaaggactgaaaatatatgttgcacttgaacacccaagtaaaggaaatgctgtgaataaattaattagatgcataaatcagcctttataatttccactgatggtgtctcagacaacacctttaattatgtgttgactgacaattccattcagtatttcttctctggcattttctcctttttttctagttctttttatttctcagcagcattggtattcaggaactataaaaatctctgtcaatgtgactgttttcattgacataactgataatttcctagtaggaaaaacagttattgcatataattattataaaaatatgcacacattttcttacaattaaaatcagcccaactgaggatagctcattatctgtaaatattactgcattttaaagtaaatcacactgtgatgtgatactcgatccatttgctatcagaatattcacaagattccgtaattttgagttataatttagtcccttggtaccttcaatttcttaatgtttcaatttcttaaggattttaaaaaaataatgctatatctgttgcccctaaggtaaaactgatattgacttttgaaatcttgtaggcaaatttatttgagctgaataatttgtttcacatcaaggagaatgaatgttctcttggaattgtcctgggtttctatttcttttgataactgccaaagcttgagtttggataataggacttagtagaatttgcaaggcaaattttacaagagaagtgacaatttacctgatttttgtacaagagatctgccacgttcccacaattatttcctttgtgattaattaatagacagagcttattccagaagttttgaaaaaaaaaatcctctggcaatgagtgtactattcttaatgccattcttttatttgatgtaaattgttacatcttaaaagtgtatagcatgaaaatacagccatgtattagaaataacttttatttaaattggttagatgacctctgaaaaccagatgaaagattttctgctgaatgggctggtgctccctgctgcctatataatttatgtgagaaattagtgcaaatggttcacttttatgtagcagagctgcttgtagcaagcctgcagaaacaattttcccccaagcctccatctgttcttcaaactagggcatacgccatctcatcgagcttgaaagtcaactgatttataactcctggaaagtgtatagattgaaaagaaaggtcgactgctgctctgtgacagtgatttgtttggcattggctaaagacaattcacattaccagggacccaagggaaacaagaaatgttgtaagtttcagatctcagtagactgacaactagaagaaaaacaaatcactcctgctttttaagtcagacgaccaccagggttgaaaagtaggtcttggtagtgttaagggtgccaaagctaagctgccacccatattgtcacttagcacctcatgaagaaatgtgtcactgcccaccctctcagtggtaaatgttgacgttgtagaagtatcaatactctaatttttaaacacaaaatatgtgtcactgcttgtcagaatgttctgtttggagacacaaattggtctttgatgaattttctgtatctacccaaggataatctccagttgtattccaattagtaatttaatgaacagttcgctcctgtcttatcactcgtcacacgtctcttctctttactgaagcactattgagatcaaaagtcctttgacagatgacaaatggaatcagattggcagtatgcttgtaaacaacaacaagaaaatcattctttgtttgatgttttcctttgagtagtcaaagtatcatcctcccagataacaacttttagtctattgaagtttttgttgtcttttttctacatgtatgtatgttttttattttgtcgaaactgtgtttcacatgataatttttaaggaactcaaaggaacattcatggtcctaattaagacaggagattgatagtggacatactgccacaggaattctaatagttttttccagtttaatgacaacgaaaaagacaatcatcttttaatgtgcaggtttaagttttcagcggtcattactaagacctttggaaaggagatacccaaacatgtttctatgcaaagctccatgttagcagggatgcacatacatggcttttcctgtagtaattctcatggtatggtgcccaaccacgtaagcaggcttgcctttgtgagcatgtcattaccatgtttttgaagagcagagtaactactattttcacaaagttcattatgtatgaagcacatttcttgctattgggaaaagtatagaaatggacagagttgacagaatcattttaaagccaacctctgcccctactctaagagactgtctttacaacaaatactcctacagaatttccaagattgggttctaatctgagtaaaagaaaacccatcaacctttgtagccataaattctcaaattttgagttcttatttagattgatctctctctgttcattcatagttttaagcacttaaaaaaaacaggtatatggtttgaatatttctgaattcttgaatatcttgaaaatataaaatttcaactttcatgtacataaaacacaatttaattgaaattagcattcttaaattacaattgcttcccttcatatctctttagaagataacatctttgtattctattaatgacatatgttatgttaggtatattataacacatgtattataacatgtattataacatatatgtatatgtataacatataacatatgttattatgttatgtatatccaattccattgatctcattttctgtagaaattccctttattttctgcctgcacatttgttattatactgatttgccgttgcatgttacattttcctttttctgtatcttcacagataattttgtggtatgtggagagatactgtgtcagagatttgtgtcaagatgctatgtatatatgctgaaaaattaagactagcctgattttattcctttaatgtcaatgtattgtttgtttgtttgttttgtttaacagccttggtaaatgcactatttttgtgtaattaaaaattgcttccatgtatttttcttttccttttgtgtattcttccattagtacagtaagcttattgtctacttacttgaaactttctcaactgaggaaagttttcttttgtaatattacttattgttactctgtcccaattttctgttttctttcttagaacaaatattacatgtagattatacatttatattctgttctattatttctatcattatctccctcaatatttttatctctttatccttgttttaacttctggcagagctttcttttctcttctttttttttttttgagacagagtcttgctctgttgcccaggctggagtgcagtggtgcaatctcggctcactgcaagctccacctcctgggttcaagcgattctcctgcctcagcctcccgagtagctgggactacaggcgcccgccaccacacccggctaattttttctatttttttagtagagatgggatttcaccgtgttagccaagatggtctcgatctcctgacctcgtgatccgcctgcctaggcctcccaaagtgctgggattacaggcctgaaccaccgcgcctggccagagctttcttatgttttctatttttgttggtatggatctatccattactgccaccagttcaaattttagctgtgcttaggtaaactgccctgcacctggccaatacccagtgtctagcatgagcatgtttcacctggtcttattctgttggcctaaaaggggactttgtaacttctgacactgagatagctggagtacacaaacacctataatccctaaaaggcacaggtacccagctctgtctttgcctgcctttacctatagcattttgcttgtgggacacactgctttctaggacagaatgcaatgtggtaccagaaatctctgtccctacagagatttgttgttgtttcttgagttgactgtgaatggatgtaggaagggtgaatggaagtggatagtgctttgtcttgaaaggcaactacttcaaggtagcaggctggtggcctagtccctcccgcccccaccatcacccttttattctagaccttatgtttctgaccgggccaggaagggggatcagaaagtgtgggagagatgaaaaagctgactacctacctttggattggtgcctctggttgcaaaacataagttgactatgaattgtggttttccaatccaattccattgatctcattttctgtagaaattccttttattttctgcctgcacatttgttattatacagatttgccgttgcattttcctctttttctgtatcttcatagataattttgtggtatgttgggagatactgtgtcagagattcgtgtcaagatgctatttaaaaacactgagtccaattcatttttgtgcattaatggactatattcctttgcagagaagtaatgtgatctcattaacaggctacagtgacttgtctattcataaaggaattgagtacttataatgggaaagacatggtgctgagctctgtaacctgcataatatgagttctggtcttaagaagcttattgactagaatagatcactattcaaggaagaaaccgaaagtcctttcaaagagtatatatcaagtcttaagacagattgcttccgcttgcatagatcataattcttaatcctttatgcagtatgtgttaaacatttgctgcttcagtgatctggttcaaataatttctgtagacaaacttttcaaattgagagtctctataaaacttttgccagttcataaatggttatctatttcagggagtgcagcttgctgacacttttgtttttcttgtatttcagtttttttaattgccatattaagaaataataaattttacctttaaaatgacctttaggtagtcaatccacatacctatgtatctacatattgtggcaatcccaagtatcaataagatattactgacttcagtgttctactctgtactttgaaataaacactttgaaaaaaattatgtttttacctatttgtgaattttaaaggtttatcgtgcttgggattcagtctgatttaagtctgaagacttctggagtcatgattaaatacgagctgggctttctcattccagctttcacatctctgcatctccgttctcttattttctatctttttaaatcaccgtgtttcattcactttttaattcactgtgtgttgtaggtgatttcctcaactctgtcttccaacttaataatttactagtttaatctactgtataatttgttgaaattttttcaaatttactttcagtgaatatcaattctggaatttatatttgtttcttaaaaagatctgcctactcttatatttttctcactttatggtttctcttactatctttattagattgtatttttaagtcactcatttgaggttctttttcacactcatctattatcttgagctcctggggtgtgacttggaatctgccttctgtgggaggccctcgcggcctgggttgtgaaggcacccgtgtgctgtgctttcaggttcgtctctgcaggacacacattctgaacctcttttgatgtgaatcagccttcacgtttcctcactgggctcctgctcactgctctagatttgagtttccctttcatttctggggacttagtatttgcctatcttacttttgagaatggctatgcatttatttattttattttattttattttatttttcttcccgtatttatagttttggccatattgaccagaggtctattaattctgtaaaattgttttctcaattaactgaatatcttcgcttacatgcagattaaagtaccatcttgagatgtaatctttcctcaatgtcagaccaattctaatacttcctcaagtacaaaaaaaatcaatagaataaaatatgttttgtatttcccatggaagtccctttatgtaagcaagttacctttatgtaagctaatgtgtattgcatgattgtgtatgtgtgtgtgtaatcaaacacacataaattaaaactctgttgaacatagcaaaacttgggtttggaaaaatcacaaggaaaagacataaaaattttgtgccaacccacaactctcatttttgtatgtatatagtacgtgcatgtgtatgtgtgtatttacatgtatatgcaaatatgtgtagacattttgttcctatttcagtactggagtaaagatttttcttttttcttttttcttttttttttttttgagatggagtttcactcttgttgcccaggctggagtgcaatggtgcaatctcggctcatcgcaacctctatcacctgggttcaagctattctcctgcctcagcctcccaagtagctggaattacaggcatgcgccaccacacccagctaattttgtatttttagtagagacggggtttctccacgttggtcaggctggtctcgaactcctgacctcaggtgatctgcctgcctcagcctcccaaagtgctgggattagcgacgtgagccaccgcacccagccaagattttaattgtcatactgtaaaattaaggtgggtggggttatcctaaggagacctttatcttctcaatattcatatctattactatgaatctcttgagaagcattaacccttccaatggaaaacatctttcaaatgctttccatttgcagtaagttgcataacattttactaaacatcattcaatactttttaaaaatcaacaaattatagcattggattggaggtaatttagtgtttagaaatcatcttcatagaaataatcactgtagacttgttattaatttttatttttgaagagttgcttgggtaatgattaagtaatttatatatgcacaaaaagacttcatttacataaatttttatttatatattttaaatgcattatgagaagtgctagtgtattagattggtaatattaaaaccacaagtcaaaaaatacaaaagttaagatttttataattctatttgggaatctctagctttttctgttggtgtgggctataatttcaacactgcattattctaacttattacatttaataaactaacaattgggactagcttcaaatctcaagcagcaatttagtagatggttcatttcatgagaaagaaatatggactatggtgactatgactgtactattgcagaaatggaagaaagtgaaagtaaaatgtattggttagttgcaatattaccagtaatattttgtctggccaataatattagaatgtagatcaatttgcacaaataatgagctccacgaccaaatgaataatcctctatggaatatactagtattgcagaaaacctttttggtaagaaattttgcatgctattactgtaaagcatcattatttggcttcttaaataatcactttgttcttctcatcacttgatgtcttgtactttatacatcagacatctctgtgcatgtagattaccaaccatgctgcctccctttttgtctctgaacctgtaccatgctggcctctcttgaatgcctccattgcctccatatccacctcctctgctcagcctctaactgctcatctgcttgcacctggctcagctcttacagtctcctaaaagtctttcctgactttcccaggccagattgagtacccttcttggggaaaccagcatatgctattactggtctcatcactgagtaagatagtgatctgttttcacatctcccctcaagatgggggactgcagaagaactggagcagggttatttaactttgacctgccttagcccctgatacaacatgagtaaatattttaaggctgatgtttcaaatgattcattaaaatacatttttatacttttcatatatttttgtttgttgaatacagtagcaatttgaattttcatctacttgcaaaccaagaatgagggtggttatctgtgacttttaaattttctttacaggtcccatagatcttttggtagctctatttatttttgttttcttatagaatgtagtttgcagtacttttaaaacctgtatagtatcagctcactgaatattgctgattgctgaagaaaagtgtttgttcatttaaaccccagtgatctgatcatatttaaattgcattcttatctatgtgttgtctttaaatatgtgctgtccaattggtgctcatgtaacttgtaagaagcatcattcatttgctaggcattacctgagtacttactgggtgtcagaccctgctctgctctggaaatacagcagtgaatgaagcagcgaaattctcagggctcatggagcttccactacagtaggaaaactgaaacaaccaaacaaataaatatagagactgataaatggtaatagtatgaagcaaaataaagcagggtgaaagagagagttgtgagaggatatagcacccttttgtggggtggtcagaggaaattttccaaataaggtgacattaatgtgtaggctatttggtaatattgtctaaattatttttaaaaataagagtcctaacttaataatttgccctgtttaaaatgcagtgatatcaaaaagaataaagtgttaaagagaatgcaatgaaaataatctagtaaattgtgcaatttcaggacctagtactaaaaatcagtgtaagagttataacccgacactaatgaattaacaaattatattttaattaaatttttattccactaaaaccctaattgaggaatcatgaatgactgtgttttgtacatttcaacataaatattttgtgagtttatgcaaatatatatttcctttgtgaaaagtacttttcacatttcaaaaataagaaaaacctaaatagccaagcaaatccattttttgtgtcccctttctctcttcttttgaaagtaaaatcgttactagtgagcagatttagaaaaacaaacaggaaatgatgagacacatgtgagcagataaagtgtcatatctagattgtctttagagagggcacacgaaagcaagccccaaatgcaggcaaggcctggcctgcagggaagacacattcagatggagtcacagctcatgaacttttttgggatacaaatatataaaagtttctgctatggcagttgtataacaggatgtatctgagaaattaatggaattaaatgaaaagagatgaaactgagtattaaagacgtgcactattcatttgtttgttctgagcattctttcatccatcacacatttcagaaggttgcaatttattaagtgcagtgaaaatcactggtgatataggcctttgtgcagtgtatacaattagtcataagtacagtcatgagctgcataatgtggttttggtgaacgatgaactgcatattcgatggtgggaccgtaagattataacagatctgaaaaattcatattacctagcaatgacatagccattggaacgttcagcaacatatgttgccttttctcttcagagataaggatgttctttttctccgggtataggaagggcacccctcacatatgagggtcttatgaccggctttaggaaaacaaggtgggagaatgtgtgagagaacttcctgcttcttccatttttaaagatgtggcatatttggggatcgctgtcctgaccctgtcatcactcaatccctactttggactttagattatcttgcaatgccttctcattattatttattcaaatgggaccctaacacaaaaccaatgtggtatagaaagttaacagcaagaagggctagtgtctctgaggctgcagtaaacaggaggaagggcgtggtccactctcagaatgctgtcatggttcagagctgagggatttaatattgtttgggtatttttttctcttctctcaccctcttgccccattcctcactttatagcaacaccgatgtatttaccaacctcaagtgtactaacttgagcagtttggggaatcggggattaagatcttgtgcttcttggggccctggggacaatggttgaactgtgtcaggcagccagactggaatcaggtggagtcactggcaggttagaagcccttaattttgtcatgcctctcacttcctgtgaccctgacctgcccctacccactcacccacatggctccagccatactggcttccttgattttccaagaaaacaaaactcccaggtctcccgctggccttcatcaggaatgagtttctccaactcttggccaacttcccctcttcagggctgtgctccgatatatcaaacagccatccttggcacccattctcatccccctctccccagggacacagtgatgtttctccagagctcaataccatgcctgtcccaggcaaaacactgggataagaaagacattttgtctgtggctctcgctaccatccagtaatagctccaaatgattttagacagcaaggattaaaggatggtgatctagttgaaagtgtgcaggcatggtggggggtagacgtcttacattaaaacgatgtttacttatcaagcatttagttatttgggcggctttggtggagggctcagttgaaggagacgaagttggggagagaggactgagacatcctgagacatcccttctagctgctgctggaaccttcttacttttcttactttcaacaaacacgttctcagctctcctttatttagtcatgaatttactcatttattcaagaaacatgcgttgagcatctttgttactgccattagttccaataatatcttctatttctaatctgcttcattttgtcctattctgcctgctattaaaacccacctcttctgtgagaatcccatagattattgttattcttctaacataccgttcattctttaaacccagaagagtgcaactttcatgatggtatttggagcacggaggcaggcaggtagggtttagagggtaagagggagacaagcagagctgaagggttttgaaactgccttcaaagccaacgcatacaccaccacttattcattctaagataggtctttgtgattaaaatttagtgatgttcaatttatatttattgcttttcattgttttattaaatatttcattcgacaagtacttattgagcatttatgataagccagacattgattagatgctgtacatacagcatctaaattcttgccctggtagtgcttgagatcttgaataaggtgaaatcataagaatgccatattatttcttggcattagtgaaacttgatacatttattttgtttctttgattaaacttccttttgtaagttccaggatacatggcaggatgtgcagatttgttacataggtaaatgtgtgccatggtggtttgcggcacctatcaacccagcacctaggaattcagcccagcaagcattagttatttatcctgatgctctccctccccatgcacctccaccccacaagaggccccagtgtgtgttgtttccctccctgtgtccacgtgttctcattgttcagctccaacttgtaagtgagaatatacggtgtttaggttttctgttcctgagttagttttccaaggttaatggcttccagctccatccatgttcctgcaaaggacgtaatcttgctcctttttatggctgcatagtattccttggtatatatgtaccacattttctttatcaagtttatcattgatgggcatttgggttgattccatgtctttgctatcatgaatagcactgaagtgaatgtacacatgcatgtatctttataatagaatgatttatattcctttgtgtatatacccaggaatgggattgctgggtcaaatgtatgtctggctctaggtctttgaggaatcaccacactgtcttccacaatggttgaactaaattacattcccataaacagtgtaaaagcgttcctatttctccatagcctctccagaatctattgcttcttgacttttcaatactcgtcattctgacttgtgtgagatgatatctcattgtggttttgatttgcatttctctaatgatcgtgatgatgatgatgttgagcttttttcatgtttcttggccacataaatgtcttcttttgagaaatgtctgttcatgtcttttgcccacttcttaatggggttgtttgtttttttaagaaaagacattttttaatcaattatttttcatgaaatctaaatatgccttatcagtgctccaatctgtgtgggctggttgtttctaaattttatttttaataattgagtgatattaaataaaattcttgctatatttggtttaaaatggttttgatgtttagcttttgttagtggcatttacaaattctaaacaacttgtaccacatctattatattctttagcttctgctgggatttgctgtgtaaaagagagtgggaacaatgtagctcacattattctgataattaacatctgtgaaggacaagcttctgcataaatttttcccataatgggaggaagtgaatagaaacagaatgagcattgtgagctatggttttaatatttaaaatatttttctcttaggaactgaacctctagcttctgcacataaaagcagtctttttttttttttcatttttttgcccaaataaagatgattccaaataaactattatattttgtttgatgtcttcctttctactcaacaaaaccaatgatttgcaatttgaataacttttcaagcaatttctctttgttttttaaaaatcttttttatataatttatgaaatgaagatttaatcaacatttgaaaggagtgatgccatctcgatatttttacttaaatttcttttactagacctttcacagtggattcaggcataagtgcagggttttaaactttttcccctatcaactaataatgaggtgagttatgaaaaataataatttgtcataatttccaaaagaaattattacagccttcctattactagtgtcaaaagatgaattaactttcttttgttacctaaccatagccatgttgctaacttgatctcagctctcttggaaaaatgagaatacttccatatttaggcaatattccttctagctgttaagatgacttcagtttaatttggttgtctttcttctagtaactgcctcattcagagaagatattaccaacactttttgtcacttttgattcccctctggagctcttttattccccttgccttgataacttgtttgtgcagacttttctggaattggagcattgtttgtatcttttaaaaaacaatatgctaattattttgaaaaaacaatatgttgtttcttgactttttagtaattgccattctgactggcatgagatggtatttcattgtggttttcatttgcatttctgtaatcatcagtgatgttgaaccttttttcatatgtttgttggctgcataagtgtcttcttttgagaattgtttgttcatgtcttttgcccactttttaatgggactgcaattaaaaaaatatgtacttaaaaaaaccaatatgttaattaatttgaatttttaggacttttttcagtataacagttttacttttactgatgatatttttataagtattgatgcaatcttatttcttttctttcctaaaattgtggtaaaggcccatgatgtaaagtttaacatcataaccatttgtaactgtacagttcaagttgtggtaagtggtaagtgcattaacgttgtgcaaccaattttccaaacgttttttcatcttgcaagactgaaactctatgcccattaaacagctcctcactccctgctccccacatcccctgctaaccaccgctttactttctgtctctctgaaatggacataatgaatttcataagagatttttcatgtacgttaggtgcacagtgaagtgtatttgtttttgtatagattattggcaatatggcctccaaatgttaaaaaagagaagaaagttaagtcagttatgttttctacttggaatgtttagcagccacagagagttaagtaagaaaactgtacctgtactaaaaaattatcacaacatatgaaatacatataatttaattagacattaaaatatcagggtaaaaaggtgtttttaaaccctgtctaaaacattatatacattgtataacattgcatacattgtataatgaatgcatacataaaaggttataaaacctttaaaaatgatataagttgttttaggccagttgaattagctacatgccatttcccaaatatgctgtttaatatcccttaaaccaatgggcacatgtacgtgtgtatttttgtattcaattcacttttacctgcaaagaccctgattctgacatccttattaaaacttggaattgtttgatttttttaaaagatttgataattgcaaagggtatctagttatgcctcaagatcactggcctctctctatagcattttgccaaaaatactccttaaagcaactgtcctgtatctgaatgtagattctattatatttccatccaagcatttttgctaatatcatttgtatgttactttgatgtaatgaaacccagaaggtgcaatttcatgttaaagagcataatcagggcttatcatgtcctaatgccaaaccaaaatttggttctaatgtaaaacttgataataaaatttgaaaccaaaggggttttcctgatttacgtaaactattaaatcccctttattttggcatattaagttaaaataaactataagagtaacttaaacgaatatgcttacttacatttttattattctacttggcctcattgagccctgtttcaaggacttaactcaatgctcatttggttactctttttcattttcccatttccttccattgtttgaagcttggaataaattatacaagctaaactatattattttttcattatcttagtctttcttttctgatgatgaatatgctttagaaatggcttcttcagtaaaacattgtttcatcagtcattgctatctgatttaatatgcaaagtatacatgaagtattacaaaggagaatctttacattaaattttattctgtttgccatttgtcatcctttgagaattatttataaagcaaattccatttctaaaaagaagatataatatgatctggtccttctccctactctttttattgctatttgtaattaatagtgagggaagcactgtcttgagtcattggaacatgctaggaaatcattctgtgatgcacaccttcaagtataagaagataaatcacaaacagtaaattggatatcatgttaaaatatctgcaaacaattttttagccataaatgcattttataaatatgtatttaattatacatcttaaaatataggtttgatcatgcatctcgacaatgaaaaaccgaagggtttgtgaaattctatcctaagcagagaaaatctgtggttttttttgttgtgtggtgttatatattacacaagtagcatgtgctttttaattacctgccgtcatctatatgaacttgttgaggaaatgaaaattagcttaggtcttacaatctaccattggacacatttcaacaaaaagtaataactcactccaacttttcaactcttttaaggtcttctgttacaaattgtaatgaaaagaatcatacgatttgtgtgaaattcataagtaaaattgttctttccagtaggaaaaaagtggttaaaaataccctacttttttcttcctctcttttcctttgttttggtcagttttccgtcccacatcctgttctgtcttcttttgctttattgttattaaatactttcctgtcctaaatcttgaattctgacatatttttgcatggctttaaggttatatttgactttaacatgatttttatatattttttacttatttttggtaatacttcatacattcattgtgcagcattttgaatgggaaaaagagataatcactttttctcttctttattccttcgaattttcattatttccctcaatttataaatctttataacttaggctttctcccctttctttttcgcaattgggttatgttttcacatcctgggtctagcttggtacaggggtagtcagagggctgtgacttcagggaagcagaagcctcctcctcttcgcattctcctcaatatccataactgttgcttggcgcgttggcccagaggggtgaggtaggaacacctatctgaacacttccctttctttcctcttctgccttccatgatcgctcaagctgagggattcagctttcaggtttccaccacttttacatcataccgtcctttctgctactcaaaagtaccaaagagtggaggtggagggaagagccctatgtcatttagaaagaagttccattatcttttgcttctctctgcttcatttccctcgatttgattattttttataccttcaatcttgctcttttagtcacatcccttcttgttttttgtatttttcatttgatttaaaagagtgttttcttagcatattcttacaacttgtgctgtaaaattttattcaaagattatcatgaatattaggaagaaaaccagataaattctaaaccatttttctgtcttcaagtataaaactaatattcagatattagtttggggatttttcacaatgttacaaagctagtgagtagccctaatggagctagaacctaggtctgctatatccagtcctttctttctattatagcactaaaactcttgcagctgaatgttagagaagactcatatgcttctttacagaaaatttaagtatttttttttaacaatggttgacctgattcagagatggaaatgtaaataattggatgtaataagtagggaataatgtgggataagattaagtggaaaggcggaagctggattgtgaggggccctgaatgacaatctgaggtagcgcattgtcctgcgtagatagtgggggagatgataaagaaggaaattagtgttattaaagtctatgtttcaggcactaactattgtgaatcaagtattttattaaagaacaccgagtatatatgtaacacgcggtgctgataaagagtatttgggttgtcaccagcatgcatgttgaattggactctagcagctgtttcaacagtccacacattaaatgataaggagttggagtggaaagatggtggaagaggagatagaattggcaaataatagaatactagtgatcaagaggagggagacataaagggtgaattcacaatgttagcagcagaggatgagatgcaagtaatctatttcttttaagcaagagcaaaataaaaatctcataatttttagttggatttgacagaataatcctcacaacttatctggaaaaattaacaagcaaggaaatcaaatgacattttccaataagttaataaaaggtagacttatctcaattaagtttcaacaaattttagaaaggaaatagaactgagacaaccttaaattatctctgaaggagtacatacacaccgaccagtcatacacctcagcacatgttttaaaaactagaggggcctcacacaacagcaaggaaaggtaaacagtcatcaaaggcatctggaaacaggattaatgacttggaaggaaacaagaaattgttagcattcctgttgccatatatttaaataaattataggtgattttgaaaataaatacaaagaatcaaggtagagaaaataaagagcatttccttattgaaatgatacatcatatttattttagaaaaattagataatatagaaaaatgtaggcaaggaggaaaaaaagtttctaccagaaggaaccagtgttaatgttttggcagattttcttccatattattctttcctatcttagttgacttattattacatatcattttatattcaacgtaagtattttttcaggtataggagtttatgccaactgccgtagaaaataatcctctgaatctccgtggcttgacatagtaaggccatctgtcactcatctgtcagtccagtgggtcatggacaggcctctgctccaggcagtcactcagggacctaagttactttgattcttttcctgaatcctctcctgtatccttttcccatacatgtgggaggagaacatgtaggctaatcattatgagggacgtttatggtcccagactagaggttccattcttcactttcatctactttttgttgatcggaaatcagccaatcacatagccatgaataacttcaaagaaggctgggaaatacagtccagctgtgtacctcaaaggaaaagggaaatggtctgaacagtgagtctttcccacactagttattagaacccccttattaacatcatttttttttattattatactttaagttttagggtacatgtgcacattgtgcaggttagttacatatgtatacatatgccatgctggtgtgctgcacccactaactggtcatctagcattacgtatatctcccaatgctatccctcccccctccccccaccccaccacagtccccagagtgtgatattccccttcctgtgtccatgtgatctcattgttcaattcccacctatgagtgagaatatgtggtgtttggttttttgttcttgcgatagtttactgagaatgatgatttgcaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttgggtatatacccagtaatgcgatggctgggtcaaatggtatttctagttctagatccctgaggaatcgccacactgacttccacaatggttgaactagtttacaatcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcttgttcactctgatggtagtttcttttgctgtgcagaagctcttgagttgaattagatcccatttgtcaattttgtcttttgttgccattgcttttggtgttttagacatgaagtccttgcccatgcctatgtcctgaatggtattgcctaggttttcttctagggtttttatggtttgaggtctagcatttaagtctttaatccatcttgaattgatttttgtataaggtataaggaagggatccagtttcagctttctacatatggctagccagctttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtatggccattttcatgatattgattcttcctacctatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctagcctcataaaatgagttagggaggattccctctttttctgttgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattatctagtttatttgcatagaggtgtttgtagtattctctgatggtagtttgtatttctgtgggatcggtggtgatatcccctttatcatattttattgcatctattagatttttctctctttttttctttattagtcttgctagcagtctatcaattttgttgaacctttcaaaaaaccagctcctggattcattaattttttgaaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtatctttgttctcgttggtttcaaagaacatctttatttctgccttcatttcgttatgtatccagtagtcattcaggagcaggttgttcagtttccatgtagttgagcggttttgagtgagattcttaattctgagttctagtttgattgcactgtggtctgagagatagtttgttataatctctgttcttttacatttgctgaggagagctttacttccaagtatgtggtcaattttagaataggtgtggtgtggtgctgaaaaaaatgtatattctgttgatttggggtggagagttctgtagatgtctattaggtccgcttggtgcagagctgagttcaattcctgggtatccttgttgactttctatctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcagcccctgcctttttttgttttccatttgcttggtagatcttcctccatccttttattttgagcctgtgtgtgtctctggacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccagttgttcctttccatgtttagtgcttccttcaggagctcttttagggcagtcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttggctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttctagttgatcgcattggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggtgctctgcgttttagagtttcccgtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgctgccgccttgcagtttgatctcagactgctgtgctagcaaccagcgagactccgtgggcgtaggaccctccgagccaggtgcgggatataatctcatggtgcgccgttttttaagccggtccgaaaagcgcaatattcgggtgggagtgaccccattttccaggtgagtccgtcacccctctctgactccgaaggggaactccctgaccccttgcgcttcccaagtgaggcaatgcctcgccctgcttcggctcgcgcatggtgcgcgcacccactgacctgtgcccactttctggcactccctagtgagatgaacccggtacctccgatggaaatgcagaaatcacccgtcttctgcgtcgctcacgctgggagctgtagaccggagctgttcctattgcgccatcttggctcctcccttaacatcatttttgaggctacataacattcagtgacctgggtgaatcttcaattacataagcattcccttttgttgaatgtaatatttttataagctgtcaccattacaaattagtggttttcatttcttattgatcacaatccttcattgtctgctgttaaacatcttaaaatggttatttcttatattttctccagtattatagttatttatataacatgaaggctagttctgtaccagttactccatcatggctagaagcagaagtccactatgcttttattattattttttagggtactgttttacctcatccttgtgtaagtagttttgtttattaatccaatgtgagtctgcctagtattagagagtcataaagctgatgtgctttttgtcaaataatctcgtatcttaggttctagaggaaatgatgtaaataaaggtaaactatgtgaaaagtttcatttttataatgaaatgtcgaaagcagcccaaatagccacaataggtaatagttaattaaataataataaattcacttgatgagatataattttgcagactagcaatgcagtaaaaatacttcagacaaaatactaggttaaaaaacaaacaaacaaaaccccactgaccccattgtatatgcaacggtacgttccaaaattaaacctaaataaaacatactcacatgtccaaaccgtgagcaagaatcccccaggcttgcaaaattcattgcagtgtggcaacaagtatcatcaatttttttttcttttttttttttggtgggaaggattttcataccttttggtaaagtttgttgtatatataattaaaactcgtgtttactggacagataaaatatttgctaaaaaatttcaagtatacacagttttagacatttcttgtatatattggtcattagaacctcctgtgatcaatgtccatttagctaaactttgacttttcttcattgtctcaagaaaatgttgcttgctgtcacctttaatatttctaacaccacatcactgcagacgtcatgccagttctcctgctcagaagcttaggactttagcctatatgatctgcttagcttcattaaaagtattttcttgaatcacatgtttacagtttcatagaaatgttttaatttacctccagctgttaaaattaattgccagtttgcatcattcaatctctgaattttcatttgtatgttatcatacactacctaatgttttgtatcctgtgttttactaaatatcaccttatgatcatttcccagcatcattagagagttgctgtgtttaacattagtgttctcagggtagcaaatgccaagacaagattaaacatgcaggaaaagtaggagggtaaggcggagaggaggaagggagccagtgacagggtgggggagccggcagacctaggtgcgggtctgaccccagcgaaggggagggaaggaaggaagctggacggaaacactgtggcctgcactgcgtctctaaggggagctgggcagggctgtcaggggcccttagagccacagtggcctgtcagaggatcctgcatctccaggagggggcctgctttcctagccctgccagactcagtcaccgctgggagcagccccagggagcacaacttcacaggaacacggtagattttacagtgcagagcttggtccagggtcagttacattccctgcagtcagagatacgggaagtgcattctcatagcccccacactttgtaaaaatctttagtgcacctatgcacctaccattctatcttaaagctataccatattacaagtaattcttctgagtaagccagaaactcagaatcttccttgacaacattctgtctctcttacctccatagccaaaccatcaccaggccaaatgaatttggtctctcccatctctcttagctctgacactttatattcatctttagtaggagactctaataatcacccatccccacatcgtatcctgcctttttagatcacccgtgccaccctccagtggctgttttatcatattgccagagtaatttaggacagaaggcaccaccatatttatccctacccctttcatccacttttggctttttgtagccttttgggtggtgtgaaataatcttggcaattcctgtagtgcttcagttcacattatgctccccactgttgtctgtgctccgcacactgtccactgtgctccccacactgtgatgctccccatgctgaccgctgctctccacactgaccactgtgctccccacactgtccactgtgctccccacattgctgtgctccccacactgactgccgtgctcctcatgctgactgccatgctccccacactgcccactgtgctccccacactgtgatgccccccacactgccgtgctcctcacgctgactgccgtgctcctcatgctgactgccatgctccccacactgcccactgtgctccccacactgtccactgtgctccccacactgtgatgctccccacactgactccagagcttcacacactgaccaccttacgggtccacactagccagctatatcctcccacttcagccatactttcaacacacttccttcttcctagactggtccttcacaccctcttcatcaaagtcatttacacacagctttaaggccacagcttgagagaactttattcaaggatccttccttgacactctgttgaagtcatattccttgcatgtgacctcttgcaggcccacatttctcatcttttagtgtttattgtaacttcagtttccccttttttgggatttttatgttactatagtttgtaatactcgatactttgctatgaggacagtgccttctgtttatttttgctcagcaataacatctagtatgtgtgtattgttgaatggataaggggcctcagtataaaggtgtaagctgagatacaggtatgggaacagttacagttggaggtatacgaatggacgtggtccccaaggtaaaaagggcaggaaggaagcatcacccgaggtgaacacatgtgtcctgcattcacttagggaagatagagcatgtttgaaggcacaaaggggccaacagcagcatgcattgcaagattcacagtagttctgaataacctgaacaaggagctactaggggcagggctcaggaggaggatagaagtggaaagaaacctgaccatcaagtattttatatacatgttgagtgatctggactttatatcaaaggctagtgagaagccctgaaaggttttaaggaggaagaggcctgagcagatttgcctttcagaaagatcattccatcaggaatagggaagagaaattggagggggcagaccagagccaagaagcccccaagttgctccttagtgaccccggcaggagtgaggacagcgggagctacagtgtcgggaaagggaagctctagagggtgcagcggcagagttatcaccgagctggaggctgcggcccaggagaggacagaacgcaggaggcacagctccaagggatggagcccaagaggggcctctggatttggcaagcattcaaatctcaactttctctgtgagcaacagacaaacttcaccttcttcaaaatagcaccagcaaggaaacacaatgacttctttaccttttaccgaaatgtgtccttcagctttaggagcagcagtcaggaaaggaaaagagaacatctatctgactagctggccaggaaaacacagcctctgatcagtgcaccatggtgggcacagacaatagactcatgttcaaaatatcacacgaggtcttgcacactccttctagatgaacagatgaaatcggatccagaaatctactatgggcttagaataagcactttgccctgtgacaagatatcaagtaaagctttatcaaactacatagaattctttccagttttgaaattaaggtagctacctttattctttcaaagacttccttaagcccatttttatgaagaagagggaacttttgaaacaccttatttccattctttgtgattttacttaggattcatggatggtagttctgttgccttagtataatttaaggcttatttcatgtgaaatcaattggataataatcacttactgagtgatctgaatatacactatatgccaggcactggcctagatgacagaaatgcagatacttcatacaaaattgtctttgccttctgaatttcagtgatttggggaaaagaatgcacatgtgaggtctgtgtatataaaatacacaatcagagcagatctagaaatccaagtgctatggaaacacaaaggagagagcaactttaggggaaagcgagagatttgcaacagagatgttgaaaactgaattgatgccaaatggtaactaaaggtttaccagagaaacacaagagaagggctgggggcagaggaagcagggtttcaggcaagagaaacagtgtttaccgtaacacgaaaagaccaaagaagttgacattattggggaacaagtgagcaatttagtacattggcgtgcaaaaagagtgaagggatggttaaaaagaaaaaaggaccctttaagacagtcgttaagctttaattaatcacacacatgtaaaggagtggggaatatcacacaagcagacaagtccgtgtgcaataagacgagcacggagacaggggagagagaaaagaacaggaaaggtgaaagcatcttgagcttctgcagctatagtcagctccctgtttgctccactgatgtgaagaatgcatgccccattcccagtgcctgctgctgagaaagtcacgtgcagtgcagtgagcaggctgaccaattgccaaacagtgcaccccccaggggaatgctgcagagccctaaatgataaccagctgatatgggtgatctgctcaggctttttgtgcttgtctgagattggaggacttataacagaatagttcctgtctgtatccattttgaggcttactcttcttgaattgctgtatttactttttatatctttctaaaagtacagagattattgaaaactacaatttagtatttgcaattattaaaatcatagtggcaaattagactataacttgtaagttttcgatttttgaaatatctaaatattaagatagatttaaaatatctcaaagagaaaaggcatgctgtttgccatttgacagtaaatagtcgctaatcaatattctcacattttaatgctcagcagattctgacaacttgactagtaatgagttaatatattgttttttataacttcattaataagaagtttgtagggtagcatatttctatctcaactatccccaaaatgctgtttctaaggtcatgctcagttctaagaatccataaatgtgcatgtgaatagaatcacaaagcagcagcatgaaaacttatatttaggggaaatgtttgctgattccaactttcaatgagttttatttgggaattttacagataatatctttaatcaagtgcatggtctatgatctgtcaatctcatgtgtgtaagtaaaatcaaagttcatcagatctgtattaaacaacttatttgtgttcataaaatatgtgtagctttatagtgagtcttgttggctttctaatgtgatagagtaggcatgcatagattaaaactatgatatagtgaaatatataattggtcttcagcccatttcctggcatagggctcctaaaatccttagaatctccaaaatgatatccttttttatgcaaataaatcaacagatggcagaggtagcttcagaaaggagctggtcactagaaagaccaaagcatgactagagtgttggaactttcagccctacccctgaacccagggaggggagaggggctgagggttaagttgatggccaatgcacaatggtttaatcaatcatgactatgtaatgaagccttcataaacccacaaaaggacagggctcagggagctcggaatagctcagcatgtgtaggttcctggagggtggatcacctggagagggcggggaagctccacaccctttcccccatatcttgccctatccatctcttcatctgtattttgtgtaatatccttgataataaaccagtaaacttaagtgtttcccttagtgctgtgagctactctagcaaattaaccaaactaaagagggagttgaggaaactccagcttgaagctggttggtcagaaattctggaggccgagacttgcaaatggtgtctgggggagggaggagacagtcttgcgggcctgagcccccagcccaagggatcggatgccatctccaggtgaacagtgtcaggactgaatcctaggacacccagctggcatttactacagaattgattgttgcctattggtggggaaatcccccacacatttggccacagcattttctgtgttgactgcggcggcagtggggtgagagcggaggaaaatgctttgatttttccctaacaaggaccaatctgatagatccccacctgccactgaacctcctggtgagcacgtgtccagctgcggctggtagattgtgattcacagggaggtccacttaataaatgcccagctctctctcctgtcctctcctgtctccttgcctcccttctgcaccctggccacagcttccccagctcggctcctgctgtctcttcacccacactatgatctccttcattcccacacacgttctcttctctagaggactgaccttcaaaataactcattcacatttatcccaaaagaattctgaaaaatggtagtctcttagagatctttattctggcatctaaaatgcatgtttatcatagttgcaagcaatgtaatttctagtgaaatacaaatattgacatttaaaaataaaattatttttttcactctgttaattgtatccagccagttcttagtaccattagggatctgattctcaccatcagtcattttaaaaatacatgaatttgcttttctttaattgccagatttttatgttgttcttttatcccccttgaaactgtattttcatttcactctcctctcagaatgttttcctaatgtaactttttattctgaaaattattattgattattatatgatatgtaaattaatttaaacattaaaaaatttcccataaccatgtgtccaagaatttaaatatatttaaaatgtgtatttatacatagacaccactttgaaatggtgtccatctacctatcttatgtaagagagtgaaaagtatagaaggaaaaagaaagaaaagagaaaagaaaagaaaggaagggagaaaggaagggaggaaggaaggaagggaaaagagaaaagaaaagggagggagggagggagggaggaaggaaggaaggaaggaaggaaggaaggaaagatggaaagctccatcctggataaattttgtcattagaagtattactaatgcataactttcagaacacctgttgttaaccagcaggcttgtccacaagtaaatctgaaccatgatgactctagaacccagggcttgatccttctccgtctcagaggggctacaattcaatccagtttttttgtgatcagcttcccccagaactggtgattgcctccatctgactagagtagggtggggtttaagtattcctatgcgtccagggtcctcaattctgggcatctttctcagacaactcccagaaggaactggcaccagcactactgacccccgggggccagggtgctgccagcagcagaacccccagcgcaggctgagaggctaagacgcgcttctgtgggatggggagcctccttctcctgcgggactgtggaatttgtcctgaaccctggcaggtagagaccacaaagggacctaccttgcatgaaaaacatagatgtattacaaattgtgataggtgatttttaagcataaaagtaacattttgtatgaaattcatctcttgatagtccaggcttttgttttcaattggtccatacatgtggctgaatactaatttattgttagataaaatgaggcccagcattaatttcgagcctatgttttattttatagaaggaagcacaagaaagccctgttataataaagcagatgtgaatgaaaggaattttaacaatgtgactcaattctttgaacttatcctgagaattatatgccaacaatcacatagcaattcattaatcaataattctttttagtgatctcatcactgataaactgtcgggtctgccttcaattttcttgaaagccaaaaactagaaactgcctgacttacaacaggatttgctgcccagccgtcaaagccattccccttctcaacaccgtcaccaacatgatttcaaacggagcctgtggcctggtgacctggggccttgcagccagagacagtgaactgtcaggtttgggatggatgagagatttccttcttttgtaaagcggcagaactattgtgaaaggggagtagagaaaagagaacaccaggggctttcctgagcagatcatcactttcagaaaagagtacactgaacgtttaaaatctggaaattgaactccttaaaattatttgcatttgggtgctccttggaaagcctttgtatgccaaagctttgtgtacccagtataaaaatctctgctccagaatggcttgatctccttggagatcaggcagaaaattctgtcttttgcttttctttgcaatacctggttgaaccactgacttaccgtacgttttaactttcctgatatcctaccattatgtgttactatcagcctcgaatcatcctttcttattattttattcacagaactgtggtgttctcagtccttgtagccaatcttcttgtttttatcacagccttaataagacagaaagaaatatgcatacaaagctatactaccagataacacaggaacagaaaaccaaataccacatgttctcccttataagtgggagctaaatgataagaacttatgatcacaaaggcggaaacaacacacactgaacttagcatctgggggatgtaacagtatgtacaacaaacgcccatgatgcgtgtttgtctatgtaacaaaccttcacatgtacccctaaacctaaaataaacattttttaaaaagctatactaccagatatgaaaccttgggcaaagtacttaacctctttctaagtcttggtttccttgtttgtatctatgtatctacctcatagggttgtcatttattataaagatgaaataagaccatatattcttgaacttagaatattgttgggtccatgctaggtataaatattaactattattattaatatcattagtatcattatacatttaaaatctctaacatattctatggtcaacagttgaaggaaatatattactaatctatgtccataaattttacttcccacatattttgacttaaactatagtttttattttgtatttgccttatatatttagttctcattaacctgctagttctgggagaaggagaccattttctttctgttttttttttttttaattgaatgattttgttttattcatctttattttcttgactatatatagtatcctgcgcatagtaagcattcagtaatgtttgtggaattaaattttgtcaaagcacacattttttatttgtgaaagtccatgagtagctaatgatctattaaactgggaacagaaacttctacctgcatagttccacaaaagaaaaccatctgtgtgtttgtttaaccagtagaattgaaagatgttttgactttgctccaggaattagagttccatgtgacctccagataatgctgtctgacacataatcaggcctcatagagaaggaattaaaaagcaagcattacagatcctacattattattattattttttggtttgagactgactttatttctctccaaaaagaaattaaagcaaatatttgtgtatgcagttttaaaacctatatttgttttgatagatggtgtaactgacattcattggtatgtacgcatgagagtatgactaaaaaggcctctgtacggctagttataaacctttcagtttagtctgtggctgtaccagctaggcctactatgaattgtgtttgattctgacttcacctaaatgagcctgatgacacgtgtgaaaagccccacttcgctggttttagcacagctgtcccttcagcagaccgtgacttgccattgaatttcacatgggtagtccctttggaggtgcacagagtccgaaaagcgtttcttccgcccttcctcttatcaccgtatccttgcgctcttcctagagcagccgctgcagcagcatcgcttctacgctgtgccctgcgagcgcgcctggcttggtcgctgctgaagtggctgaatcttaggagcagaggactccccacgcagtctcatgtgaaccatgattccttcgttcactcccagccctgctgttaactagctgtgtgatcttgagcaagctgttgctgccttctcagactcggcgtaagctggagataatgcccagcgctgacacctggtagagctgttgtaaggattaggtggaggagtgcctgtaaaacacttagcaccctatctggcacacaaaaagaacacagtacatgatgatcgtgttataattgtgatttatgacactgatgaaattagtaggaaaagtggtctctgtcagcccttcaggacttcagtttagactaattcctaatcttatagacactcttcttttttgcgtatcagagatgtaagtattgtaaatgtgtcttaaattatatcttattatctgatgaaggaattattatagccatctgtcttaaactgttattctaagaaaaaaaaatggagaaagaagaaatacagagtgagggacttaaaaatattgaaatggctttcaaaataaaataatcccaaaatatggtacgagacaacagagagatcagagaagcaaatagccaggaagaagctctcctgtcaatttgaatgtaacttatgacaagggacatgggaatagatacccccaatcgtcccagcggtgtgtgttcccaccccagcttcccagcgccccaactccctgcttctgggacgtttagtcatgttttctccactggagatgcctccatagggcgtagcagttcctggagcacagtggacactgggtgggagacaggtgatttaactggccttccttgggcaccagtgaacagatgttgttgctagtcagttatggccccttctcacggagtccgggttcaggttctgcccctcatttctcagacagcgtcccaggccacctccacccatgccggactttatgccttccttgaccgggagggccacttatccttgttcaggtccaaagctgcgagttttggttttgttgttgttgttgttattgttgtgtttagagacttggtctggctctgtcacccaggctggagtgcagtggtgtgattacagctcaatgcggcctcgaacttctaggatcaaaagagatcctcccacctcagcctcccgagtagctgggactacagtagtgtgccaccatgcctggtaattttttaaattttttgtagagatagggtctcactcttttgtccagtctggtcttgaactcctggcctcaagctatcttcccacttcggcctcccaaagtgctgggattataggcatgagccaccgcacctggcctaaaactgcattgtgcatatagccgtggaagtgctgaattgtattgttatcgggtactttaatagtgatacattcaaccggctgtgtggccttgggagagtcatttcaacatgatgaaggtccaagcccaggagatgatcagagaatcatcccgagtctcctgcagccctggagcatcttctggtagcaaataatctaaacaggtatcttaataggtgagcggcacgtctcgaagaaaaaaatctctccacacaaatggtaaaggtcttgaaggagcaccagatctgtagcgtgtgcagcaccacacttttcatatatgatgtgattagtgtaaataagtagttgattttgcttcataagtcaaatgatgattcttttacaaatagccgtttgaataattctttacacctgctacttagccatagttttgctggaaggattgagttttcttctgaagacacagcactactctgaagcttatttccccctgaattttgtttttcccatttttggctgagaaggcatctggagtgactccagcgggtttacctaggttttccctgaagaggtttaggtgattagacaataacagaaggaaaagtagagttgccagtaggtggctcactatgaatgtgcttgggacgggatcagacatgtcacccctcctccacttagcctttgttttcaatccctgctgctttgagcctttttctataatgtctgagtcatttgcagcggggtgggtaaagaggggagaaagaagaaagcaagcaagcaacagcctttgagctccggaatagcaaaggcccccatcttgctccgagagttcacagagtatagcccagtccgagttctcttttccacgcacacttgcttgttcttttgttccttgtgtccttggcaaagactgaaagaactaagcctggaatacttgggccctcccgtgtcacttaagaaataataagccattgtcctcattaagccacccttgttttagcaaatagaatccagataccggagagggaacattttgaagggaggcagaattagagtagagatgctttacaaaattccctagagaaactgctttgtttctcctattttattgctccttactgagaagattcatattcaaatgggttggggttgtgaatagcggcttgcacattctcatgcacccaggaaggctatgattatggctaattacaatgaagaatgaagctctaacaagagtgttccatcagattgtcattcatgcatgaagtaacttaggctggccaatggaggtgtgattttggtaattacaaacaatgtggctatttgaaaaatgcttagtaaatctgttcaagacaaaataaggtctaattaatcactttagctctgaattctccagatgatccatttgctctgtttttttttttttaatttaaggtctctttaataaactagatctaagatataaaatatgttctcgttgcccacacttaaatgcaactgtgttacctgtttcaaaggcttcttaattctgccaatcatgttgcaacctgcttttaatgcaacttgacagaaggcttttaaaaataaatgtgtgtatattcttgttgttacctgacaagaaaatggtttatgaaaagttactgtaaaacattaactattaatttagaagccatattggtatcatcattgtgctgacatatattaactcttgaatattcggtgaatgttgtgtttagcacttaagtaatgtctaactatatgtattagtttgttttcacactgctataaagaactacctgagactgcataatttctaaacaaaagagttttaatttactcacagttccacatggcgggggaggcctcaggaaacttaacaatcacggtggaaggcaaaggggaagcaaggcatatcttacatggcagcaggagagagatagagaaggcggaagtgccacacttttaaaccatcagatctcatgagaactcactcgctattatgagaacagcatgggggagctgcccccatgatccagtcatctcccaccaagtccctcctttgacccatgggtataacaattcaagatgagatttgggtggggacacagagccaaaccaatcactatattataggggagaaaaagtaatatattttccttacctatcacaaggttcgtggctgagaaccttagagcaaaggacagagtaacaagagaaaaacatcacatttatttaatagaggttatgtgacatgggagccttcagaaatggagacccaaagaaacagagatgtgtgtacttttatggacaggcatgcagaagtaagactggaggatgaaatggcatgctccaatcggtacaaactgggggcaactcagggagacctgattgcccagtttcttctccgtgttcctgagtgacattccttccctcctggtatagggcagtactcctgtcacatgaggtcttcagggaagaagtgaggccgcaggtcaaagagtggccttccctgcggtcatggcctgtttcagggaagaaggggtggagggaattctagtttccatgcctacttcaggagacagaggacaggaaaagtcacagagaccctcctgcttctgcggcgttttccattttcttgagcttaaaacagtacacaaaggtgctatattttggagtatcatgttctgaaccccaaaaatattctaccttaaataattggaggcctccatgaaggcacaatgatgacataggaacttatgcctctctatcattttttttttcagtagatgattgaagcgaagctgttttatgcttgtctcttttcccgtttgccatttttgtacctttgttctctcacctaaaaatagactaataaatggccagagttgttgcaagaaatgtacaatgataaaaacatctaattattggttttaaatgcatcaatcttcaatttcttttaaatgtctactagaatgaaatctgcccaactatctgaggagctttgttatttttaacttatttggtttctatacatgaacccaaaggaactaccttttcctaattgaattagcagggctagaaattcaactcagcacacgtttaactgaggagtatcagggttcagaacacgctaccccaaaatgtgacacctcggaggtcactctctcaccttctccctccctcctttccttcatcttcctttctcccctgaggaggttcatagaaaccaaaatttctctttgccaaagcaaaccataaaacctagaaaggccactttctgaccttctcctttctcccctgaagaccctcaagtgataggtgtcttgccctgaacagaaaggccaagaagaagctaaacaaataagccttgcagagtcccctcagtttagtacattaggtcgtaccccctttttgtccagtcacatttctatacaactgtacatttttcctggaacctatgcaaaaaaattacatagtttttcctgggtctttgggtcttaatttcagaaggcaccttcctgtgtcacagaaaacttttgttacataaatttttttatgcttttctcttgttaatccgccttctgttatagtagtctccgccatgactcttgtagctggtgaggaaaaggtattattttttctcccctacaagagtaatggattttacaactttgactgttatactttctaaaaaatgggtttagcagggaggtgggggtgggggagagagaaggaagacacaaaaaaagactagtttttatacagatattttcttattttaactaatttatatcatctataaagggaagcaaatattaacgttattagtttcctcaagaggataactaaagaaaacattcttgtaacaggggaagaagtaattccatacctattgtatctatagagctgtgcatttcatgtctctaaaatggagtaatttaaagttaaaaggcctcttctagtagttttcaccaaatgaattttatatatactgaagacagataaaataaaaatggtacagaaaaacgggagttttagagtcttgtttcaattctttagaaagtaagttgtctagcagaacatgccaacttggttgcctaagagcaatgtaaacttgagtcccactcgccatgttgaattattcttgtttctatttagcaagtggtctggagtctttgatctgcaatgtgtgtagttaaaatcattgtggctattattttatctgcccaaaatacagattttctaggatttgacagtataaagcatttgctttaataagttgagatttaatatttaatggtttctctcaaattcctgattggtcaatgtattgttgccaatttgtaaatttttatcaaaggtacaaatttgaaatgttttgctgtatatcatggaagagaagccatgattatgttccctaagcaagttacggaggcttagagtggataattattctctccttgtcctggtactgcctttgaagaatttccatgttgagggtaagagaagatggtttaaaaacctgatgaatttaggtagttgcttgagagaatgagtaaagtccattttttccctgattaaaattaagtctgttagttgcttttttgctcaccaaacacatcaatacagatgcagataaggtgaggcctcttcctgtaaatcagctgtcaaggcctatcggggagaaaaacaatggacaaggaggcaaactgcttctcatgaaggctgtgcgcttcttgtttgcaagaagaatatttatgggcttcacagctggcagcaaagaacatttaaatatataacttcatacacatgcaaagcattttgtagattaaatcagctcgaagtgtagaacctgagagggttaatagaatttcttggtaaccatttaataaaattaatgtgctattagtctgatgtcttaattcaattggctgatatatattcccagttttcactcataggtgagccttagaaaaagttagtaaagattgttttaagattgccaattttctaagaatgggaatacaataaaatgtaggtaatcaaaatattgaatctttgatctaggatctgttaggatagcaataataggtgcatatataatgtcttgtatattcctcaaatttttattatttcctttaacttccaaaattaagaaactgccagaaaagtatggcaggtgttcttagctacctatcaaagcgaaagcaactgagaccctgagtgaagtcgtcaacacaaggagcaccacagagggaacgtggaagctctaagcaaaacccacctccctctgcctcaccacccacctctcattatacacatctatttccatcgcatcgtggagatgcagaggtgctggcagaaagtcttgggtacttaactgttggataaatcttttactgaatctcttaaagttatgctcactataattgttggtgaaatcactttagatctctgttgtaaagctctctaaatttcctcttccattggtgttcatagtttatgacctgtcccactgagatgctactaagggagtctgcacagagtgggatttctgtatctgctacggtctgggtatttctgtatccactagggtctgggtatttctgtgtctgctaaggtctcagcatttttgtatccactaaggtcttggcatttctgtgtcagctgagatctttggttttaggcgacagaactcctctctgtctggcttgaccacacgttggtcagaaagaggctgtactgtgctccctctaggacagtccacgggaactcagaggactgaggaggtgactcaaaagtttggaaggtgtttcaagatttagaaggcaggattcaggtagccccagagagtcttgggaatgaattccaattcccccttgtaccacctttcacgagactccggattataggggcgaaggagaaagacgggcaaagcttctgtcatgtcattacactgggaagtgagagggaagtgctggctgaacctcttgggaccccctgtatactctgtggtgggggagaggggaagcgtctttgtttaccccctcaatactttatacagcagaagaaaggagatgcctgaaaaggcaacggggatgcatttaggaagaagcaattgatgctaggcacacaagaaatgctgcaacatctaagttgtacctgaagcagaatttcaatttaatgtgccatgtcaaggtggccacagagccatctttataaactgggagtatccacatattccagactcagagagcaaagatccaggactagtacagaaagtcactccgtataactggaaaagcttgcttgtctgctttcagatacgtttctcaaccctcatccataacacgatgctgtaaaccctagagtaagacagagataaagcatgtgctgggatgaagagagccactttggggaagtgccaccacatcccaggctgcaaggcatctctctctgctgcttgtgcagactggctggggtgagctttggagctggtctcatctcgaaggcaggcgctgctgaggcctctgtgcccttttgcctgggttagatttggcttcaaaattaatttgaaatcatttaatcttgctactctcagcaggtcagtgattaacaggaaattcagtgcccatgttggtcctgtttatgagcccaagtctatgtcataagtaaaaacaggcttaaacacatcaggaaactactcagtatagagtggaaaaagcctgggctgggcttccactcaagggccctgcacacactgcatccacaggccctgagggcagcccctgggcttcagccgtctgcgtgcactcttgtctagtaccgtgcctgatgtgggctatgtgctctactggtatttgttgagcacatcatcaagttactacgtgaataaacatcacttatctgggtcttggtttcccccatttgtaaaaccagagagttgggctaggaaacttttgagtccctccagcgcagtgattgatgtataacataatcagcaatgttgaactttgaagagaatacaagccttatgttgtcactgatatatttcagaacaccttgttactatttgtaaggatgtttgagaacatgtgggcaaatgcatctattttttcttccctaaaaggtaaacttgtctcctttacaaccaaacaaaagaggatggcactgcatagcagaggctaagctacaggctgggtaccactgagcagtggagtaacccaagtttaaacttgaaaccacatttgtgcaataagcaaaagcttcacatttatagaacatcgatgctgcggcacagcaggctactttcatatgtgttatttcattaaatccttaaaacttcaatgtcgtatgtatgtattatttaataaataaggaaccacagactcagagagtttacttaatttgcctaaggtcacagaggtaataaatggataaaaccaagatttgaatataggtctgaataaattattcatgctctcatacctacctatttaatgttatggagttgtctacctttctgcttcatttttctttatatttttactctacatgatccttattttgaggccttccattgcttgttctccttctcttgattcctgcattatttcctttccaacatgtgctttgatgcatctgttttctctatggagccaaggaattttccatcctctcagttttatgggaagatacagaaattctctactcattgagtcccaatgacaatctaattatttctaaatctcaccgtccaataattatctttttaagctcttcctctccctctgaattgtgtggtgtgttccctgttgacatttgattaaggctttgcccatgctgcttgaataaaaatatttatatttcaaaatttctgactgccaattatccatattttgatgcttaatgtccataatatcacaatttgacatgaaagatattcttaaaaatcattttattatagccacagagtagagttggaaaaataactctaggataaacaaatacatacttattcattccatacctgcttgatgacctactatgtgccaggccttattctaggtgctcacacatagcacctagaattctgttgatcctgggagtttaacgataggcaaatagaagtacaatgagacagatgacagatgttctttcttcctgcctgtctacctacttgtccatccatcaatcttcatgagaaaatggactcaagattttgaaaacctcaaaatgcttccttttgttctagcccttgctttcacgtttaaatgaactctcagtgttgtatatatattttagaaagtttaattttcactaaaataaactttcagtctctacaagtgttgacatttaactccaagaatactttagttggttggaaaatcatttctggtaaagacttcattgtagagaggagacttctccacctctgattactcctacaccttgactgagtactgactacatgtactagacgtttgttgtgagcaagtttcatatactattttattgtgttcccactactgacctataaagtatgtgctattatattttgtttcatttcctgtccaaagaatatttttttaaccaaagaatccagtagaaatgcctttagacttacatagtgattgttaggagaatgatctatagctgttcggagtttgcagaacctcgagtgaatctttcaccaattactaaatgttaaccgaacatttgtgaacatgtgtaatatactccctctaggacgggataaaacctcaagaaacctaggaaaatggccaaattcttgctctggactgcggctctcaatgataattggcatatactggttatttaagacctcacagctgctctggtctgaatgctatttgagatataaaattgtgggctatgtatgcaatctgccttggctcccataaaattaagaagtttaattattaatgtatatgagtatgttgagaaaatgatatagttccactgactatgatagtcttgctgtattacctgctgttttaggatatagggatacagcatcttaatataattgacagtaagccttctcattgtaaattaatctgagtgcttcacattgaaacatgattcttttttaatgtatatattaagtttcgactacatggatgccttttaaactttctaaagaagattttaaaaagcttagactgtagctattcagatttataattccactcaactctgctatatgatcctgaaaatgtttaagtacattacatataacttaaattatttaaaagtttattttacacttcttgaagactaagaactccttgaatttatttcacaaaaggcttatcttctccagaataaatttaacttgcctcatgtaattagcattcagaaaggctcgaattaactggaacatagctaaatagaacctttaatttactagattttttttttctttttgctctacttttagagcttgaaatcattggaaaacaaacaaaatagcaaagatttgttttaaaaatcagcctccaaggttagtgctagggtcagtaaatagctagccaagttttcatattacaaacctatatagttatgatttatttaaaatgatgaaccagagatacccatgttttctaatgcatgaaagaaatattacagaaatattaaatatgttatttgctggggtgaaaaaataagctaatagatgttgagaatattttcagcaatgaaagattgaagcagaattgatttcctagttatcactctgaaaaccaagaaattaaatgaacccaaactcatttttaccagagcattctaattaatcaaatggattaacaaatgcatgagtgagggatgaaaaatacttgtgggagaaaaacagaggtgatacttttggtgagagaaattgctcatgtaaaataattttaaaggaagttacacatttattgaatgcagcatatagagtcctgtgcttccggtctttaccaactaatctcccctaggccctaccgtcacccatcccttttccagaaatcttctaaaaacatctccttcttctccaattactctttattataatatttatgattaaagtctggcaacatttatgtgccaggtactatccttactgacatagaaaccctatgagccatagagctcgctcttttgctataacttcttagagttttctgcacttcagatttcgccacttcagatatttcattattccatgtttatttcaagagaggtttaccaaatacacagaagaaaaaaaaaaatctctaaactagaatgctgatttccaattcccctgtttcaactagttactgactttcctacttccaaaacagtttgagggaacttaaaagacacagttacaataaaagcctaaacagaaaagaaagcaggatggagaaagagaattctatcagagtaatcatgctaagaaaagcaaagtgcacccaaccgaaccaaaagataccagagatactcatgacaggaaacttgacaagctccactgtgcatgtttgattaaaggaagtaaatcagtgcatcaggaaagccaaacattttctcttgactaaacttcaagaggtgtttcctctgtggttctttgtctcagagtttgtccatgataggcatggagaaatatttgttgcatggtaaataataaatataagtgatacttagctgataaccagggtccacagcgggaaagactgggcaataggtctccactccttgtcctgcttccactgtgaagttacctttgccagcggctcagtaccaaatgctcaattgcccctgagaagtgtcacctgaatgctccccagtcttctagcccactgaccttggcacccaattaaaacagcttgatccctcctctcacatactatcagaagcctcaggaccctaccttgtgttttgttattttgggttttgttttattctatttttgtttttattccaaactcttgctgtgggaccttcttggatatctctccatccctgttgccatttctccctccacatctctggtaacagatgtgagacttcttggacatcactgtgggaaacacagtggccttcatcccctgcaccctggcttcctgaagggctgtgctggcttctcctccagggtccctaccttgaagccgcttcaggttcctctgtattatgcagagcaaggggactctcctctctccgctcccagactattcaaaaggcccgccatctttgccttattaaaatgtgcattgagatattttccaaacgaaaagaactatccgcaagaaaaatgtatttctcctccagcaactggcccgaactgaaatgagattttaaaatattttctccctgtgacacagacacaccttgatgaaccaggtggctaccctctagggtcctgggaacatctcccagtcagaacaggcccggttttctccagcaagagaagatggttctctaaggagccctcgtcctagaaggcagcgtcgtagagggaaagaaccaggcctggagccaggccgacgttggtttaattcttttctctataacccattactttgctgctggctcttggacgattctcagaacttttcagagcctcacttttctcatcaataaaagggagagaagaaagcttagctttgtattgcaggcgccatttacccttcagggtgacttctcttatgacttttcttattccagacccttttgcattttaagctggatctctcactgaataaggagagggttgcttcaaaggattttcagacacctttgaacaggcagcagagatgcctttgcacatggccttggtgactaggataggatacacggtgttcctagatccagcctggaactagaggcgataggccgccctgaaaggccaatgggctttcaaggtggacagccgtggttttaaatcctggccttttccccgctattactagagcgaccatcagacttttttgacctcagttttgtctctttaaaatggaacaagaattatctaacagacagaattacatcttttagattgtcgtgaggaaagcgcttcccatagtgctgggtagactgggagcgctgggagctgtggcaggccagccgccgcagcacagtggtgagatgcgcggtccacagtcgttcccccttgggagttgttctcccctgaggaacagaggatagggactctgtctgagtgcctggagaggaccccttgctctggcattgagtttcttccagccccgccccatgcaggtgagatccctactcacagcctagggcgcacccgagccgccagagcacagcctcctttccggctcatcacctgcttcctgcgggaggagaatacgcaactccttcgccatgcacatgcgcacagggtctgccgcgggatgccctgtctttcctgtagatggggaattgtttgggattgttacacaatcacaaaccaacactgaatcctactgaaaaaggacacaggctctttgaactctgcactagaacctaaaaccaaattccttttagacctgttctaggaggactacgttaacctgatagctgctgacacagggcagcatgcctaaagctcctaagttagactggtaggtaccgttaattattcctcgttacatcacgcaggtacacagagggacgatgacatgtgcatcctctgctcagaattgcttctgtgctgctggtgacgatggcttcatgggtctttacagaatgtagaggaagagaacagcaaagatttgctggggtttgccactgaatagcagcaaaggcaaatcccaaataacagtggatgtatttcattatcagtaaaatgaaggggctgggctagggcggctccaagatccctctggctcagaacgttccttgatactttgattccatctatgtaacatagcctgaaagtcttagcatgttttctgagattatcccagtagaataccttgtctgcaaaaggctgaaatttattatttgggaataataaatcagaacaaaaaaagatgtagagtccacggtatattattagttttgagtgtactaatccttattttatgagatttaatttttgaaatgtttacctttccattcagactattgtcaggaaaaaaagcgtgatttttgtgttcagggaagaggtaggcaagggactaatgaatatgtgctttgcccttgctctgataaatgctgtagttataaaaagtcgtggcaggttatgggggcccttttgtttaccatgataaaattaataccttacaagttttcaaaggagtttgtaagacgttacagatttatttttaatataatttcagagttggaaagctagacagttggaagtagtgcttggaaagcctgattcttgataaattcattatcaataataccatgtgcagaataaaattacaatttcagcaaagaatattcttccataacattttattattactgtgaaactaattaaacattgtaatctgcaagtaattaaaaatttacctgaaaatatactatgagccctgttgacagtacatggagcattttgtgcgattatttaatgtctgctattttttcttggttgctctattaggaaattgtagtctatatggttttataaaaaggaggcaaattatagactaatggagctagaagactcattaaaagatgatctgcccctgggagattgggtgtcctctttgaaaggcttctgagatggaatggagacattcctgggagcccctcctgggtttggtaccgtggaaatccaggtgactgtcactctattcactattatgtgtccctgcgttccttaagcacattttcacagatgtatttttcacatgcagggaatgcatacaaagcaactagcacactgcttaatgattaccaagcgttcaatgaagagaatcattctactagtattattctttgtgcatggattattacaatactctaacttttttaacttttcactcagagggatattccaatgagactttttattataactcctcattcacttaccagtgtgatttcttgctaccacacgtacatttcttcttttttaaaattcttatttccataggtttttggggaacaggtggtgtttggctacatgagtaaggtctttagtggtgatttgtgagattttggtgcacccatcacccaagcagtacacactgaacccagttcgtagtctgttattcctgacccccttcccatgctttcctcctgagtccccaaagtccactgtggcattcttatgcctttgcgtcctcatagcttagctcccacttatgaatgagaacatatacatttcttctaaatgtgctctggtttatccatatattattggaaataaagccaccacaactgatatcttactttatgagtgtttcttatggggtagaaatttctgatataataaaggccaaagttgtaacatatttattacctttacttcagccagactcacaaaaatagctgcgttgatagctctctcctgatctctaatctcttccttcctccctccttctcttgtttcttttctttcatgcattgaaaattgactggggcaccattttcaatgctggaatatgactgtgaacaaaagtaaaggcctgtggtatcatagaatgttaagttttgggagtgggaaatgacaattagttatttaatcaaggaaaggcataattccaaaaaatgtcaattgctatgagaaaattaaaacgaggtgatgtgggggtggtaacatactctagatgggttagtcagaaaaggctttgtaaacattgtaactgtgctccttttaggaatttcttaatatttatcaataaaagtatgcaatcatacttttgtattttatttttattaagtttgataaataggtgatgtttatataaggcacatatattttatgaagttatagtttgaatgtgattaccattttaaatagcaaagatctgttagttctggtacaaggtatttccccaaggtcttacagaaatgtaaagggttgatactattctgagtgcatataaaacttttaaaactgaagaacattgtttagcactatacaaactatagcaataatttaagatctgccatagtggccttcttctgtgcctcagagaacttggaaatcatcagtagcttatgctaacataaaaatacattaaccatgagttacacattctcatatatatgttttcaaataccagcaatcatttcattaaaaataaaacaagcacttccacttatcttaaagactacttctcggctgggcgcggtggctcacgcctgtaatcccagcactttgggaggccgaggcgggcggatcacgaggtcaggaaatcgagaccatcctggctaacatggtgaaaccctgtctctactaaaaatacaaaaaattagctgggcgtggtagcaggcgcctgtagtcccagctactcgggaggctgaggcaggagaatggcgtgaacctgggaggcggagcttgcagtgagctgagatgtgccactgcactccagcctgggtgacagagccagactccgtctcaaaaaaaaacaaaaacaaaaacaaaacaaaacaaaaaaaaacaaaagactactttctcaatagaatattttaaattcttccaaacactgtaagatatgttttaagattaactaccattttttagctgaattaattttgattctaacaataactacaaaatgtgacattatgttttccatcttatagataaggaggctcaagaacagagagggaagttcagagcttgccaaaaccacagtcatgagagattttaaggaggtggactcatagccagggcttctaactccagatgccctaagttctctatgagagctcagtgctcagtgtcattggaagacagtagacagcggtattgttaggttgactaaaatctggaggaaattggtcacttgataaatgtaattttaaaatatcttcattctgtaaatagattaatacttctaaataaatcttatctctagcagttgagtattagaatgctgtattataaacttacgccaacaaaaattaatgatgttgaattgagaaacaagaaagaagatatttaaatgtatcattaccccacttacttttgtctataagaaattgctcatttccagatttttctttcctactcaagccagccttttggctttctaaaaaataaatacataattagaaaattagaaattagaaacttccctaaaaattgtaataaaacttgtacagattatagaaaacgttcacaggaaagaagagggagggagggaggtaatttctataattggattatttttgtaaaaccttttcaagaaaaattgcaggtccagacacccacattgtcctagcaactaccttggttcccaccatcccaccgctgctcaaggcacccccacctttattctgaactgagtgatttccaagcacagtttgcataaagagacatgaatagagtttcagggaatgagcgctcataggtagtgcaatactttattatctcttataattatactgattttagcttcaaggcctgactgatatcactaggtatcagaatctcaattttattagtacattaaaaaaattactcagttaagaagtaaaagttacaaaaaccagtttaatgtgtaatacagccatttacagtgcacatgtaagcctaacccagatgccagagatgaacgcttagcttgggctttctgcctaatatgtttttccctggaactacaggtattatttatacgtatgagatgtggttatcaagaaataaataagaatactaaattccaagagtagtttggtttttctgtttgtgtgtgtgtgtgtgtgtgtttaggtaactggggtacgtttctggcttgccacatcttcctcagtacctacaatagtgccctgtccatcatagattcctaataaaatacagattgactcattaatggtaggtcacatgtcattattttctcaattttagtggtaggagttatttctttctaaacctttactttcatttactcaacacatatgtgtctgtcttagcactgaatctattgctgtaggtcagcaagacattttaaaattgttcttgaaagaatgctatgaaattatgtaatctggtcaaagtaggaaagcataaaattggcaaaatgtccaaagcaaagcccatactgtaaaaatcatgtcctgatgtcactggaagttgttttgggcatgaaaccagcaatgaagcaaaccaggatgaccctcttagagcccaactagatcctaaatgtcattaaagtcactaaagcactttaccactaaatgtggtaaagattcctttggaaactagctagcttgaaaaaccaattcggcaccaaaactttcagtgactcacatcttatcatcaggccagcttaaaattaatttgatatgctaccctgacactaggcatgaaaagaaaataagattagccagtacatttttgcctaccattcagcaacaaatggaagagccaaataactgcgcattcactcttagattccttgtaactcaagttatcttcttttcaataaacgaaaccaagctacaaacagattttattgcttacaagtgagcagcgcttctgattgtgcacttccatgtcagacctcacattaacaatagtgattatttcagaaatgtgcataaactcaatattggaatgaattgttttacaattgttttgtattccaaaccagacagatcaggcaaaaacatgagggagttaaaaaaaaaaaaatatatatatatatatgtatatatatgctcagatgaaggctagggtatcaaatagttgagtttttttgtaactttacttcctcccctccaaattctgagatggcttaaagaacttttattaataagacaaactattttaatctttcccttcaaactttagctgccgatttgcctaccagtttgtgacttggaatgtccttattttttttatatcatttagggttttgggctagggcttaggtgcctggatccacactcatccatcttccttcttagagtgatagccaggggtctgttcacaggagggcaagaaaccagtggcaaacagaatgccagccaattcaccagactgggaaatgcctagtcagcttcaaagccagatctcctgggaggtcgcagatggaagcacgtgacctgcaccacaaggctgtttgcctctttccctcaaatctctgcctgatggacaccccccaatgtggcgattagattttatcacatcagtgtggggggaggccagtcagaatcatccacaagtaccagggcacagagagaggaaatgaggcatggctcctacatgcatagacacacatgcattcacacacttacatatacattcacacactcgcacacacttattcccacatcacacacaaagtcacattcatacgactcgcacacattcacactcacattcacatcattcacacagattctcacactcacacacccattaacacacttacataaacattcacacagttacacattcatatacacacacacatacactcacacagtcacatgcctccggtcacacacatttacacacattcatacgcccacatacattcatacacatgtatgtattcacacatatgtatattcacacatgctttcacactcacacatgcattcacaccctcacacattcattcatgtgctcacacacatttgcacactcacacatacatagtcatgcacattcacacgcagacattcacacacagatgcacacacagacattcatacacattcacacacacatccacgcacattcacacacacacatgcacacacagacatgcacagacattcacacacagacatgcacacacagtcatccacacacattcacacacacacatgcacacacagacatgcacagacattcacacacagacatgcacacacagtcatgcacacacattcacacacattcatacacagacattcacacacagaaattcacacacagacattcccacacagtcatgcacacacattcacacacaggcattcatacacagacattcacacacacatgcttccttcacctgcaccatctgtgtagtatggtgtttagacatcctccatcttttctcgttaaacattttaaaaactcttagccaaaagtggctgaaagaaatatcatctttattattctgtaagtttttgtttcacataggttgtacattaaccacttgtccttttcctctaagtaacatacagtctatgtccaaggctggttttcccccaaaaattctgctgcaataattgtgtccttgacttggggtcacattacaacattaaatgcatggagttatcaacctggcattccactaatgctccaagttttatgtttaaatagtcttcattagttgtatttccagggaggtcttcttcctccagtatgatcttctaaatgcttactgaccattcagtcttggaaataatttttctttctatttccctggagcttgaactcatgtgtctatctccagttgttctacatcatgcttgtctgaagtgaacagagatgagaaggaaaatgtttatacatttccttccctagatagagccgaagattacaaaaggcctcccagctctgttccttcaccaccccctcctccatgctaaaaccatgcatgcttcccgggtatcactgttctcatgtgggtgcagccatctggagggtagcgtttcaatattcatggtcaccatcatagggggttcctctccaaagaaagcaatgacaagtggaacctcattgtaggtggatttgagggagactttacactactgtgaagctttcttctgacaaggaggaggtcaagagtgggaagggaggccaaggccacaagattccactggaaaccatcactctcttcctgctgtcctctaataatacaggagagaatatggcatcagcaactgccagcaggatccctgggagatcttttctctctttattgtttacatgatatcactttaatattcaggaggctttgatttgcatttctctaattaccagtgatgatgagcttttcttcatgtttgatggccgcataaatgccttcttttgagaagtgtctgttcatatcttttgcccactttttgttggggttgtttgtttcttcttgtaaatttgtttaagtaccttgtagattctggatattagtcctttgtcagatggatagattgcaaaaattttctcccattctgtaggttgcctgttcactctgatgatagtttcttttgctgtgcagaagctctttagtttaattaaatcccatttgtcaactttggcttttgttgccattgcttttggtgttttagtcatgaagtctttgcccacacctttgtcctgaatggtattgcctaggttttcctctagggattttatggttttaagtcttacatttaagtctttaatccatcttgagttaatttttgtataaggtgtaaggaaggggtccacgccagttagaataaagtcaggaaacaacagaggctggagaggatgtggagaaataggaacacttttacactgttggtgggagtgtaaattagttcaactgtggtgaaagacagtgtggcgattcctcaaggatctagaaccagaaataccatttgacccagcaatcccattactggatatatacacaagaattataaatcattctactataaagacacatgcacacgtaagtttattgcagcactatttacaatagcaaagacttggaaccaacccaactgcccatcagcgatagactagataaagaaaatgtggcacatatacactgtggaatactatgcagccataaaaaagaatgagttcatgtcctttgcagggacatggatgaagccagaaaccatcattctcagcaaactaacacaggaacagaaaaccaagcaccacatgttctcactcagaagtgggagttgaacaatgagaacaaatggatacagggagaagaacatcacacaccagggcctgttgggaggttgggggctaggggagggatagcattgggagaaatacctaatgtagatgatgggttgatgggtgcagcaaaccaccatgacacatgtatacctatgtaacaaacctgcacgttctgcacatgtatcccagaacttaaaatataataataaaaaaaagaaaaaaaaaaggaaaatattttccaaaataaaaaaatgtttaagaagaggaaaaaaaattcaggaggcttcagtcagatgtggacttactgggaccaaatatataagacatgttttatatctgatagaaatgttttagggaagacatagtgcaacgttccttggttcagaaatggcatccctcttcttgtcctgcccagaagagtcaatatgcctataacatatcagaagggattttgctttccattaaaaaagtagattcatggtctttccctttatagaattatagttaccaatgaacaagttcctatccccaaactattagatagcaacggtcaccatggtaactaagttgagtgctatgaattatttcttacaacattatttttggagctttacctaaggttatagatagtttcacttaactgggtaaatactaaatttagaatatacctgtgaattataaatagtatgagcaaaaagcataataatattagtagattaaaattctgagacttttttatattaggggaattggaataataactttaaatgtttgtaagatgcaagtgtaagtgtgagatgcaagtgtaaagtgtaagatgcaatatcacaattcacatttttacaacataattaaaaattgacattatgacacagaaatgagatattaaattataacaacagtttttaaaagtcatgtatgtgaataagaaaattattttaaacttaatttttaatgtttcttcactaagtaaaaaaacacaccaatgtagctgtcttgataatgaattcttttttgaataaagtaataatgagaaacattttaacaaataaaatctattttacttttttagagtgtttgatgctgttacaaatattgaatagactgaatctttttctcatctgtgcctgcctatctctgtgtataatgagattgttacttggattcaaagagtgacatcagcaagatggccaactagagccacctgatgctcattcccccaacaaaaggagaccaaaacaacagatggttacccatgttatacattaagcttttaaaaaatagtactagggaaatttgagattgttctaggcctttgagtttggaaatagagctgacacataagggacaaatttaaaaatcctctgatttccccaatatgttgtttctagcggtagtttaccgtgatttgtagtatgttaagatgaatgtatatgcataagccccatgttattctaaatctgaatggagtgaataactatggtgacaagtttaaagatgtcttgcttttcttagtttatcttctagaaatattattgctattatagaatggctctttgtatgtaataatacaatttcagtactacttaaatttttattcactaaatattaccttttctgtaatatgtattgtaattgcatacaaaggaggaatctcatggtgtttcaatacagtctaaatgccttccttgcctttaaaaagcttctcagtttatatgatggtcctcaaaaattaaccccccatgtaattctctatcaaatcacaagaacaatatcaagcttcatgtaaaatatattataaaatccatactttattgccaattgtgcacgaagagacatagcccactttaaccttcattaacagtctatagttctctgttctatagaaatcgtcctttaatgaagggaaaaaatagcacaaaaggtaacacagtaaaactatccatgtaactccccttcttgctcaagaaattcagttttaaaagttaattatctattgggcaaaaagtaacattgccaccatgtgatttttggcccagttggcctggtattcatgactctgtctagacacccagactcttatgtttaggaatcattgaggggggcaggggacagttggtgctaaaactgatctattctgttcatctacactgatatagatgtaccatatacagatttttaaatcaatccaatgtaggacataagaagttaatctagcaaaggttttactcagtggttagggtaaataggaggcttcattcattaattcattccttcaacaagtatttattgaacacctgctgtgggccaggccccgagctggccgtgcagataggacagtgagtaagacagagagcaggtttcagtcttccaggagatgaggctgactgtgggtgcccaagcagccttccagggctgtccagtgaattcaagagggcagggaacgtgagggagttactccttcttcaaggagaagtagctggtatatctataaggatttcctgatatatctacaaaacacctctctcaaaaagcatctgtgagaatgtgtgaggggatatattttttaggtacttagcagagcacctggcatgtggtaagtaccgggcagtctccttttacttctgtgtcgaggtcaaaccacaccttggaaccagagagaggctgagcacaggggagaaaacagacatgtaaatgggggtcctccaacacccccttctgtggaaatgaatttcagccagcaggcctgtactggaaagaggaaaggtctgatcttctgccctttagttgcagctcggtttgttgtccctgtataaaatgtagcaacggtaagaaatgtcggatttcaatacagtatggcaaacatttatttaacatctgtcacataaaagactgttgcttacttgggaatttgtggatgatgttgccaggcccctcactggaatctacatgagagaatgatcacttacgtggcattggtttttgatagattcacttaggacctttgttagatgtattgcaactctagcatgtatttctgcttattatagaaagagcaaaggaacaacaacaacaaaacagggcctatcacaaaatatactgcagaagaatgagttccttgtagtgttttgaatatctgaggtagatggtggcatgcagtcaaggttctgtgtatttgtgaacaaaaatagaaaaatataacgcttcatatctttcaggcaacactaagttatatatagtaagatcagccatgactattaaacaagaatgctttagaaaagataaaatgaaaatttatattccttttagaataaaacatatcttaaatttctataaactgttgtgcctcatacgtattacaaaaataagcagtaaaaaataaattgcacctacctgaaatcatcttccgagataccctaaaactacacatcgctttcatctgactgtggctgcacgtgggcaaggctacattgcacaccagccagatccaccttgtgtagcaaagcatgcgccaggggtgcatcgttcagggcgtggcagctgcactgcattagatgtgctggatgtgtgcacagagccacgctctgtctgtacatttacatctacagaaagacacagatcgtcacgatcttctgtagatgtgcatgtcattgtcctggtcttggtagttgctaacagtgatgctggcaatggtatcagggaataaaactggactgaatgagcctgtgtatggaccacaggctcagccagcctcagtgcatatacttcattctttggattttgcctattggaagtgtttataaactttaaacgacctggcagttttggctgagagccttactccaggggctgcctgatggttgtcttcaaaatgagcaaactttcaatgatgactgctccttaatgaacctgttttcctttggggctgtaaatgaggcctagctttcatgtctaagtcctacatgcacccacgcaaaaggtagatgtttatttttttaaaactgtattaatgtccccaatccggtgggaaatttaaattagaagggcagagagatgagtgtcaatgctccagcaactacatgtgaataaggtattaaagtgtgtttccaatcatcatgttcaagagatttgcaaagaggtgcacttgtggatgttcacatggctgaagaaacacagggagcactcttcaccaaactggagacccgggggcactctccaccaagaccagagacccaggggtgctctccaccaagaccagagacctgggggaattcttcaccaagaccagagacccagggacactctccaacaataccagagactgggggtgggggggtgcactctccaccaagaccagagacagtggggtgctctccacaaagaacagagatccgggaggctctccccaccaaggttagagaccctggggtgctttccaccaagaccagagactggggcagggtgcgctctccaccaagaccagagaccagggggcgctctccaccaagaacagagatctgaggcctctctccaccaagatcggagaccacagggtcctctccaccaagaccagagatgggtgggggggggcactcttccactaaggacagagaccctggggcactctccaccaagaacagagaccaaggggtgatctctaccaagaccagagacccgggggcgctctccaccaagaccagagactcggggtgggggggcgcactctccaccaagaacagagaccaaggggtgatctctaccaagaccagagacccgggggcgctctccaccaagaccagagactgggggtgggggggcgcactctccaccaagaccagagacagtggggtgctttccaccaagaatacagatccagggggctctctccaccaaggttggagaccctggggtgctctccaccaagaccagagacccgggggccctctccaccatgaccagagacccggaggcactgtccaccaataccagagacctggggcaccgtccaccaagatcagtgacccaagggtgctctccaccaagaacagagacccaggggctctctctaccaagactatagatggatggagtcagtggcaagtctgtggtaaattcttggatgtaagaattacaaaatgccttggacatgtgggaaaattataagaggaagagtgtgtagacctcaggggctctttacatttgtcaccttgagtgaacaaagctcacctcctgggtatggaccctgaggagtaggcaagctgggttctgatgagactcgactctgaacatcacacctggagaaaaccattctctgcatccagggccttgtccaggtcatttctatgcatcccccaactccatcccaccaacatgtctttggatttcaaactaacccgactgtccaggaagccttttctgaccttcgtgaattatttccattgtgctcactcgcgtcttccccactttagcaggcttaccctgaagtgttatttcccaaaccttcagaaaccctgactagatcattttgaagatggggcattagcatttgtgtgaatgcttagcaaacaatggaaaccctcagccaggcttgagctgtgctctctgcgctctgaccctcactggcaggggcacctcgagttccactccctgttgcatcatcagccttggagcagtgtctgacaatatgtattcagttattatttactaaatgaaactaatttttaaatgattaaaaatcagaattaaagtctatgtttcattctgtcactaccaggtttttttttttagctgactaccaatttgttagatttttttaaaaatgtgatttcacataattataaaggcatatttactgatgttacgtaaactgtctggcacatgaaatatccaggaaagagttttcctttcagctctcatgacacagcttgttggggcccgctgcctatttagctggcctctaattaatttattagatttttaaagtgtgatttcacataattacaaagacatatttgctgatgacgtaccaaatatctggtacattacaaatgtccaataaatgtaagttcccctttcattcctctcatggcatggatcattcagtctgcttatttacatagtgttcacaatgttaacaagtttagacagtggttttatatttattaccctctttttaatcacatctttaattttatcggtttttaaaatattttccagtctcagggcaagtccagtacatatgatttatattcagcaggagcaaacatcaagtggttcagaaggcatcaaacgatttttcaaaaactgtgtgtgtgtgtgtgtgtgtgtgtgtgtgtatgtatgtatatatctgcatacacacatacagttgactcttgaacaatgcaggggttaggggcacacagtcagaaatccacattccacatagaacttttgagtcccccaaaatttaactactaataccctactgttgcctgaaagtttcaccaataacataggcaggtgattgacacatagactgctctctacatatatgcattcataacatatttaacttttgttttgtttcgttattttgagacagggtctcactctgtcacccaagctggagtgtaatgtgcaatcgtagcttaccgaagccttgacctcctgggctcaagcgatcctcccacctcaacctcccgcctaagtcccccaagtagctgagactacgggcctgccaccacacctggctaatttttgtagagatggtgtttcaccacgttgcccagactgtccttgaaatcctgggctcaagtgatctgcctgccttggcctcccaaagtgctgggatgacaggagtgagccattgcaccctgcactttttgttatttttttccccaatatttctaggctagaaggttcatctataagttttttcaaactgtaacaaatcaccaagaaattttccagtatgtttattgaaaaaaatccttgtataagtggaccagggcagttcaaatttgtgttgttcaagggtccactgtctgcataaaaatacatatatacatgcacacaagtgtaaatgatagatatagacagtaaattacaaagcaaattgggtaaaatgttaacagtaggtaaatctgggtaaagggtgaatgggatatggatattatctcaactatttttgtaaatatgaaattatttcctaacaaatttttttaaaaaaattaagcaacttatgactacttcatgaattttagttacaagcagtatgtggagtaaatgctttgtactaaatttgaacacaatggtgtttatggtgaacctgaaatataaaataacagtgttaacatgtcaccgtctcttctgtggagtgatacatgtatgcctgtgtatggtggttggcatttatgtgtattttcccagctccccaatgataaacctaaaaacctctaaacctaaaagtctcagcgctaaaaatccagcaaggtcaaacaaagatttcaggggcccaagctcatctattagcataatatgaacccagcccgtgtaacgtactgaaattgtgccatgccacttacacttaaacagacagaagttctctgctctgggtctctcaatatacattttttcagcaccctgcttcactttagaggtgaagttgtgggctcaatgttacccacatcacttgcccattaaaaaagccaccatcgtcataataccataattttctgcatgaaattttggtctccttacccttgtagaggttcctctatgtacaagtttgcacaaaacactgcagggattataaaccatgaagaaaacatggtttcctttcaatgctctgcagagtttggccttttgagtaacctttttttttttttctgggagctttctttctcttttttttttaattattttttgagatggagtcttgctctgttgcccaggctggagtgcagtggcacgaccttagctcactgcaaactctgccacctgggttcaagcgattctcctgcctcagcctcccaagtagctgggattataggagcgtgccacaacacctggatagtttttgtattttttggtagagataaggttttaccatgttggccatgttgatctcgaactcctgacctcaagccatctgccttcctcggcctcccaaagtgctgggattacaggtgtgagccaccgtgcctggcctaaataaggtgtctttgaacagaaacatgtataaaactgaattatgtattgatcgttgatgaaaatgtgatcagaggtttttgggaaccaaccctgtatttccttgaggagcagtattggctaattcagtgttcctggtgactttaccacaaataatgagagttgacttgcatgtgtgtgtgtgtgcgtgcacacgtgcatgtgtgtgtgtgtgtgtgtatatatataaaataattattactgtttgctgaatcatttgagagcaacttgcagacattatgatccttcatccctgtcttagagtgcatttcctaaaaccaaggacattcttttacataaagttactttatcaaattctgaaaatttaatattgttacaatattgttatttggtggtcattctaaattcaaatttttccaatttttcattagttgtaagttctttctgatgcagaatctagtccagatcacacattacatttatttgcctcctgagtagctgggattatcatgcccaactaatttttgtatttttagtaaagatggggtttcgccattttgtgcaggctgatcttgaactcctgacctcatgatctacccgccttggcctcccaaaatgctgtgattacaggcatgagccattgcccccgggcttgcaagctcttttttaacttctcttcctggacaagtctctgttgtggctctccttcagtgtctctggccagtcattctcagactgggaaagccaggtccttctcctccttggccttctcatcatccatctccttcctcctgggccactcttctgtcctcatttattccgggtttttccttttcaaaaacctgtttcattcttatgtatcctgtggacttgatgaaatcttacatgacttcatacaatcacatggcacgcgtctcctggaaagttcagagatctgtctgttcattaaccccctccagtgggactctcattgatgtggcagcagcaacatgaggaatagaatcagaaaacatttcctgtagccatttggctcattggagtgaaggaattttttttacagttttcaagttatgctgttttctaaagttttgaccatttatttttatgtcacagagatgaaattgattttgaggtcttatttttgttacacaaatctagaggagagtgtgtcagtatctcttctaagtattagacacattcatttgctttttcctggaggaaaacatgcaggaacaagaacccaaaattctagatatcattaattttttaaatttaaataatttctaagagaaaagagacgttatccatacaataattatgcaactccagttattattattattagtattatttttgagacagagtctcaccctgttgcccaggctggagtacagtggtgtgatctcagctcactgcaacctctgcctctcaggttcaagcgattctcctgcctcagcctcccgagtagctgggattacaggcacatgctaccacacctggctaattttttgtatattcagtagagacggggtttcaccatgtctgtcttgaccatgaggcctcaccaccatgtgctcaccatcataaggccaggctggtcttgaactccctacctcaggtgatctgtccaccttggcctcccaaagtgctgcaattataggtgtgagccactgcgcatggcccccagttatgtttgaatggttgctttccatcttgtgggtgtgttctttagcaatgaccaggctgaagcaagttcctcccagatagttccatctttgcaaattaagagaaagacagctagtgtggataatggaagggtgacttccaatgtattctctggaattttagtgaaaaaattaatagtgggtacagctctgcacagatgggctcccttggttcatgtgaccacagatgttttggtatcgtattgcatgtgatttctgtagctgttaaggtattcccatagtaatacttatgtggacacgttcttgtaaaacttcccaccaaaattcagagtgaaaaaactaacatatcagggtgaaattatctcaggatgcaatatgaagtcttaagaagtataactattcatttcttgtctaaattgaacttgaatcttgagataatcccagaaagttttgacctcgccctgcctccgtccttaaatacattcccttgagttaggttgagccatcagactggtttgcagagtgcccagtcccaaaggctgggcaagagaccggtctttggtcttcatgactcagcatccagtctctgagggtgggtgaggctcagtcctcagtcttggtgactgtctttgtctgcttgtgctgctataacaaaatactgggtaatttataaacaatgaacatttatttctcccggttctgggggtggtaagtccaagatcaagttcccagcaggttcagtgtgtggtgagggctactctccgcttccaaagatggtgccttgttgcagcagcctcaggaggagatgaacgtcgtgtcctcatatgctggtgagcatgggctgcggggtctcgtcctcatctggggtgtccgtactggtgagggtgggctggggtggtctcatcctcatctagggggtttctgtagcagtgagggtgggctgcggggtgtcatcctcatctgtgggatgtccgtgctggccatcaccgagttgagcacttcccatcctggagtcttggccacaaccctcacatacagacaaaagtcgatttgggtccagcggctctttcagcacgtggtgccaacctaagacatgaggcctcctgctggagctccaggaaactctagtctctgccctcctcttgcatccgtaggatcgctgggctgctgctggggcttggcaatcctcagagaccttggacttgtctgcttggagataaggcacagtcatttcatctccaactgctgccaagccctgctggctggcaggacatttggactctctctccctgggttttcccaggacagaggttacagatccttcagctcttaggctgatgtcacttccactccttgatctcagcttacaggaaaggtggagagaaaaggcgatcagagcagagtccctttctgaagacacacttggtcctcccctgcctgggtctgcaggggtcagaagcatttccatagcagtcattttcatacaggccctggctcccattaggcaaccttcctctttggaaaacccaatagccaggaatttaaaaggcaggactcttttctcttaattttctcctgaaaaacccttccctgaggcaaccagacccagctgctgcccaaataggaaggaaggtcagaattgacaggaattcacaaggaaagagagcataggtttatatttcagggtatcagtcatgcggccatgggatcagatttggaactctgtgattaagctaatttctggcattaggctcaatccctctgtgacagagaagtgtaaaattgtcaaaaaatgagcattattttagcaacacaatcctgacactatgagagggagaaaactgggttggatcaagtattcatcttacccagtaagccattataactcaggcttttgatgcatattttgggctgttattcatcaaggtggtcaaagtcatgaagaactgtatgttattctataatatactttctatattaagtctgttcagatgataccacattttctacatcactgatccattaaaaaaaaatctttctttgaatgcctcttgccactaatcaggctatgatattcagtttttgagataggttaacaaattgaaaacccagctttaaatgttatggtagtttaaaaatagaagtgttttacttcaaactattctgagttgctgcttagagcaataaaaatgtactttatagcttgttaacctagatctcagggatatccgttctacaataatggaagtagatttgtttactgtctaaatcagccttgtcagaacaatgctctccagtgactttttaaagtcagagtaaaccaatacattctgtcttctgtgattatacagcatggcatggtgttctcttgtatacttgtgttttgaatatgagtaacagtctttagctgactttagcattttggagaaatctgtatatgtggcttctacttatataagcatctaccaaatatattaactgagttttatagtccggttattttccatttcagttacttccaagactcttcgatatgcacttacatacttcatactcattaaatgaagatattggaagctaccttattttgaggtacagcataaagcaccagcagagcttagttactacacattttagcacaatctcctgtaagttactgcatgctgcaaaagagctgaatgagtcaacagacattgtaatggtgatgtgtaactcataacctgaaataaactatgtcaaatcgattagaaaggtctgagcacatctggaaaattggcaggtaatttagaaagaaatgactagttattaagaactcaggccagttaaactgggagattaaaatgtattacattgagagactattgccatcaattgccatttgttattgaacataaaatgcagcctagttttgagactcaagtgatgaacccttcccatgggttctttctacctttctactggtcctcaaaaacaagttaaagcaaaaaagatttaagtgataaaatgtgtttatgcctcttggatgtatacttttttttaatctaaggaagaaaccttatgatatgatatgatgaaaccatcctctctggattctaatcctaagtaaatactgaccagctgcattaagaaattttctgtttttttctccagatcttcaaatgctccattaaaaaaagaaagtttgttctagtgttttcccatcagcatttacctactcttatgtaccttcaccacaatcaaaactgttttccagcccaaacttggcctccaggccctcactgctctagagccagcccctcctaatggtttcgctcacactcagcgccttagcttcccctcctcagggtcacttagagaaggaaatacttctgcctctttgtaccacctcctgccagaaaggagaccccgcactgtacctgattctttgggtcataggaacagcatgtgccccacgtgggcattctcctcagtctttatatcacataccctgtgaatcagcatgctggggtaggaccccagggtggaaactgttgaaagccgtccagcaggcaatgaggtatgctctaccctggaggcctggtaaccttcacgacccccttgagcttcaagtctctgtggctgatggttttaatgataggagcccagaaagggaggcagcttccacccagctgcacccctcgaggtcttgtgctccctgaccgggccatcagctacatccttttgcaaagcagccatcagcttatgatggggtcttgctaagctgagtgcctgctccaggaaagccttgtgatgctcatacgtggtccgatacttgtatttggggtgagccagcttaggtttaacgactaaaggacaggaagagcccggcaagccttgcttgtgaaatggacacggtatatccaggaacacacccagtctgaccccagcagcactgcactttacatggaaagttagcagctatccattattcatttcaactgcaatgctattgcagtcaggcagtgcagagagacagcagttttcccttatccaagtgatcttgagaaggggaagttgaggcactaagtagaaggaaaacccttagggaaggttggctctaaagagcaggaaatttatccctccctcatgcacctgaagcaagctggtgctcagtgggacccacaattcatagaagttccctaaatgcctgggcctggttcagtgatgatttggctgagctgagacctgggagtgctctctggcttgctgcagccattccatctcagctccaatgagacagggccaaagatggacctgattctccacccagtgggcagaactcaaggccattctcagctataactgctacttcccttggtaatccctgttacattcttcccaactcttaggctgttgccaatggcctagctatttggtttgccacctgaaaaaaccagacaagcagataaaaggcacctctttggggggctgtagaccatggaaacaaatcatgcatggaaccatgtgggtcactcaggtacaagcccacagtgtggacctgtttcgatgagaccaactggaatgagctgctgatccagatggcactggccacataaccaccaggctgcctgagtttaccttcatactgggcattgcagcacatcccccatcacaacatgagcacaaaggaaacccagtttctgacacagagctgccactcactgcatgcaggtgttttatagtccggttatcttctgtttcagttggtgtctcaggaggccacacttccctgggcaaggccccccctgctcctggaagactgactacgttggacccctgacctccactcagggctgacactgttccaggctatgttgttactgtcccagtctggtcagccaacttcagccacaccaccagtccgcttggttcttactttctgtttgcagtctgacaatggaacaccttttgtcaaggaaaccactcaggagtggacagatgaccttccatgccattgccatccacaggcaccaggcattgttgagcactggatcagtctcttcaaaaactgactcaaagacatctgactttggtctcctcctggtcacacgcttgactaagacacgttgttcactgaatgtagctgttccagaaagggaccatcttctcttggctgcttcttgagtaatgaccagaatgaaggggcaaggaatcatctagatctattttgaaaatttgataacctttcctgatcattcctggacatgaggcttctctctttaccctaacaactcccccaggcccacgtggttagtgcacccccgtgagcccagcgcgttctagtctaattctgatgcgaccacctggatgctcatgccgcattgccatggactgagataggtgggacagggaccactggctgagagctccgccccctgacccccctacagtggttcacacaggccaaaatggtggccgtgacaggcctctgtagactttattaaaatcctctgtgcctcttgcacctgactgtccagatggaaagtcgggagtgagcaggggcatggggagcaaagtaaagctccagccactgacatagggcacactaattttattccagtggagggagaagaaccacctcagcctcaggagcctcggcccacaccccagagaaccacctcagcctcaggagcctcggcccacaccccagagaagaaccacctcagcctcaagagcctcggcccacaccccggagaagaaccacctcagcctcaggagcctcggcccacatcccggagaaccacgtcagcctcaggagcctcggcccacacccctctacctccactaagaggtaagcggggtgagggctatgaatgacctttttcctttactgtcatccctggtgtctgtcttccttgtgaaggaaaataacttggtgccgctcacccaaactattacaagcaccttaactgactgctggctctcacatcgtcaccaggcagctctgaacacagctggactgccattgcccttaacttaccgagaaatttttggaaacagcaggggagggcctcggctcgactggcagtgtggacagacagggcagggtaaatggatggctctcaaacagtctctccaaagccgagaaggacttcacccagttgctcaaactgaactggaaacggtgcgttttaccagcagatcaggaggctacattgtagtgattgtcaaagtgcacttctcagttcacactggtcccaacagtcaaggaagcccaacttgggggtgccagcaattgtaacccacactctgttttcagaggcaccacgcgtgccccagatctacactccttgtatgggagggagtcaggtactaagttgcttttcttccccaaaacgtgctttcctttccccttacaccttatggattctcttgagaatggaagtcgacaccatcgatagaccgtgcagcactccgacggctatgcagatcgaaaacagagccgccgtgcttaccctcaccctgtgggcagtcagatatgatgggaatcacccagttagaaagatggcatggaatctgtccctgacttcaaatgaagtaatcaatggtattgccctggaaggcaagcaagtcagcctccactcaccagcgagagttgtcagggatggtagcattgccccagactcactcttagtggcacaatcaatcacgaactcagtcattcataccttgggacgtaaagaaatgacagtgaatggcagtaacaaaggcacaccacagcaagggacccaagctcggcgcaccattgtcctttttcattctggttttgctgagctgctgttgcttggccttgcacaaatgctgactgggagtagtctgagacctggagtgggacacacgtccttcccatgactaaaactgctgatgaatatgataatatttctacactagcctccctcaagcccagaaccatgatctggaacagcatttgcatggagcaccaaattacaggccttaatccaacaagtatttcttgattatacgacttgattccaggttagacagatggaaaaatgctgataaatataaaacatgtcttgctctctaaaaaattatagtttggttgcaaaagtaagaccaagttgactaagatataatggtcttttgtatcattatgtgatcatttgatcattgtatcattatttgatcaccaaattatatggggccaaaaataacacaaaattgggaaagagattgtaatcactgagggatgaaaaaaggcagtcaggttttgaaaaagagctctatttgggtgcacgccgagcctgcctgactgtctacaaatgaaaatcaggccaatgcctgtggcctgcaaggcttctcgatattctaaggtgacatggattgcatgttattatgcaatttttaaaaaaatggtagagcctctggatgaacgtgttataattaggtttccttttgttgatttggaactctttctgttcattgctgtgtgaaacacgcttgtggaaggaattatgccagctttgcatagtgtgcatttttagagagaacattttcattgaaacagaatcagaaatgtaacaacgagttgggtagaaatttgtcatgattcttgttggcatatattattgttgctaaaggcatttattaaacttaatgaaagtgttcattaagaacactgaagattataatgctgacaaaaacaccaaaaaaagtcattctactacattgaagattaaaaataaataagctaccccatcaaaccaaataaactataacttttaggtaattataaaatacaacttcacctgcctgggcaacatggtgagatccccgtctctacccccccgcccccaaaaaaaaatttagccatgtgtggtggcatgcgactgtgatctcagctactctggaggctgagaagggaagatggcttgagcccaggaggtcagggctgcagtgagcagtgttcgtgccaccgcactccagtctgggtgacagagtgagaccctctctctcaaaaaaaaaaaaaaaaaaaatacaacttcaaatgaatgaatactatatttcaggtgataattcctaataataaaagcaaaatattacaactacccagcataactgtctatctgtgatctttcacccaaagctcatggcctttgtaccattctgtgaatttcaaggttatcaaaatatagggaatgttaactaatggtctaacatttcttaatctttactttgtatcaaatggggctattacttaaattctttgtatgttttaacggtttcttatgaaagcataccttcttcacccagcccgatcttgacagtaatgcctaacactaaacaagtcagtgttgagttgtttgtttaatctctccaaatatgttggtttaagacctgtacaatttgaaaataaaacctgcaatactttttacatatgaatagcaatttacttatgtctgaaaccttagcaataactgcacagagagcatccaacagtcttaattggagttatctgattattactcacaggataccacaagctctaagaacatttactttacactgctggtgttctggtcacctcctcggtgaattcactgctccctttgcccaagtcgaacagtttctattatttgtaactttttctttgtagtgtttactgtgaagatagctgaatgtttcagccaggcttttttcttcttttacagaataatattgttcatgatcaacacagattctacagagtgtattaaaaaaatagtcatcaaaagcttgattgctcccagcagccttagatcaggcctgtgtagagaaggattgaccatgaagccgaaaggatcactgattgccaccacaccttcctcagccctgagaggggcctaggcagggtggtcacatggccatgtgttcttgtaaaattcacaaacgtgagatcgtttggccacagtcctttgttactgctgcctctttctaccctgacttcactccagcacattctcctgctgtttagaggaattggagtggggcttggcagcttcgggatctagctgggggaacattgatttggaaagacattgagtatgagtttagaatgacacattttgtggttcacgcttactgcggactgtgctgacttaccaggagttattatgtgaaggtccagggataatttctccgtaagaacgcatcccacggtgctggcagcagacccacgagggtggtagaggagaaacaagattggaaatgtctggagtcacaggcaaatccgtggtaaaatcttggatgtgtaagaattataaaatgtataggctacctgggaaaactatgataggaaggttgtgttctcatcaataatgcagggtatattataaacgtatccatgtgttcatttattttttcatgtgaattatatgaaacatgtatcagaattttttcctttgtatgacacaatctgtagcaatttagtaagcaagcggtctgtgtgtgaaggtgaatgtcttatgccttttaatatattggaacaggtcttagtatatttgattattttgtttcaaagccatctggcaggtccaaacagcacatgtgtcattccaaaaccaataatttattatgagaaggaaatacattttaaatagaagtaatgaataggctctcaggttattagacaacttaattaatgaagagaagtggtgcatacgaacccattgggaaaatacttgaatttcttgcttccttgacaaaagttctgacatcaatgaatataatctgatctaatctgccaatgagcccctacaacaaggaactaacgataaacttgttaatgagtgtcagcaattcaaagagagtttaagattagttcctgggcaacaaaacttgaaaaacctagtattcttattgcttgcatgtgagagaaatttggaattccccaaaaaatgtgcatgatataaccaacaacaagtcatgaagctgaaagtaactttttcaaacttcagtactaaaagagaaatttagatcaactatgctgctggaaagactggattatctttctgcttttttctttataaaatgatagtcatagtttcgtattcttttttcaaagagcacccccaattgtgcaagcctcaagcctgaggaatttgcactcatcaagtacctgtgcctgatgcgttctttccagaactgaagtctcattgataggtgaggtaatgcgatcccagctggtatagagatttattcctccagggagtagacagtgaatttatccagaaatgaatgtgtatacgtaagaaaagctgttcataccaagatttacacacctatgttccattaaatgcaaaggatgtggtttcatttgataatcgcttctggttgccatcttggtaacgttacactgaggtgctggagaggtctgtagccatttagggtcttaccttcaactattctgtgtatctgttatcagggaatttcttcatttcacgctgagcaccagtgctgtattagtgagtggggtgtatagtttgttggcatgcacggacttctggtcctataagcttcaggctgcagaaagggtttagccctggaccattctgggatgcgtcgtcaaggctggtgcttctgcgggaggcagggcactcagggctttcatgctgcaatgggggagtcccatggaagccagaacgaggtggtcaccctgatgtgaaggaatctgcagaggcaggaagagccctgaagctagctccacgttcccctgtccatgtctacattcacagacactttcccaactctccaggagaagcagtgcagaacgttctggaaagagagtgaagttttgccctcctaagactaggtttctgatgaaagtaggaccactgaactgtaggcagctacaggatagggcctgtctgttcttcaccagtgtagcctcagccgcgagcacagtgtggagctgctcacagataatgaagacagatggtgctaagcggaatctcctctctgctgagtgggttgctgtagtggaagaagcactgaagagtcccaagcgtaggttgaactccttgagtatgtcctgagagactggggcagcctgagtctctgcgcgcaccagcctttacactgaagtgagattctatgtaagaatataccttgtctaccggaatgcaccacaggactggatattgttatggtaaaatattttagtaaaggaaaaataatgcctaaatacatatagcctttcagaaattttcacacaatggaagtgctgtggtgattatgaacacaggctctggagcgatattccctgagttcaatcctggatctatctgttatcagctgtgtgaccttgggcaagttgcttaatctctctgtgtctattttttcatctgcaagtgaggataatcatagaacctacctcacagggatattgtaagaattaaatgagttcacacaaatacaggacttaaagagtgtctgtcacttaggaagcacacaataaatattagctattatcgttatggtcttcgttttactttattgatgcctaaagtaattttgaactaaaaattgtgattaaaattttgttttgtttcagagatttggaattactgtctaaatccaccaaatcttgataaaatattacagggaaaatagaagtttgggtaatgtccctatttcattatttagtatctagacacattatttaactgatgtctaatatgaacacttataaaccaaagaaagtgagtttaaatttcaccaggtgttaaatataaatacctgtttaattccgagggtggttatatcctaggacaaagagctatcaaggttatattgtagtacaccaactctgggagatgagggcttgagtaagtctctagatacttctttttgtgtgctgaggggttttgcaattctttggctgtcacagccctgtgtaaatttttgaaaattaatgacaatttgctggtagtggccaggtggtgtgccaggggagaaagaggaggttagagggagatgcagtacactctcaccaggcagtgtgaagacaggagagctggcatagatgaggcttggtaacaaccagaaaccacggggggaaagcagcctcccaggaatgagtcagggcccagaggacgtctcacctttctaggatctgtgtggctaccgcttcggcaccacctaggagctgtcaaaattgcaagatctccaagcccgtgccggaccttctgagtgagtttgtgttttattcacccccactgaggactgtgtgcaggtaggcattcgggaagcaccgggcaggaagctgtccttccatcctctcttcacctctgccctggctcctgccgtcctctctgtaaggaaggtcttcctcccagccagggtgaggctgagagctttagagccctaaacactgagaagacaatatgcagatgaaatgtaatgagggcctgagctacaggagtcacttggcatggcaagaaatcactggatacgagtaatattaagatattcacattgtgaaaccttgttgccccggggaggataagaaaaagcagcttacgtttattgaggtatttactttcattagccccatcttacaggagaggaaactgaagctggaaatgaaataacctgttccaggtctgagcgcaaggaagagggaaggccaggactcctggctttgggtctgcacccgtcaccgtcaccgctgtgcatgcagaggatgaggggaaggtcagggagctgcagggagcaaaagggtctggctgtggggaagggcgggggagagagagccagttccttatggtcagaccggaacatcgtaatgctccctcgagaactgatgctctggtatcagagcatggtcaggccggaacatcgtaatgcaccctcgagaactgatgcgctggtatccagggaggatcggtaaaggaaccaacacgcacatatgcactcacaatgctcacggatgtcacgcagcaggacctggcagggctggcctctgcttacagaggccgacgttccctcgccctgagacatcaattttactccatctcttcttgcctcaaactttccatatccgtccccattctaccctcacttcttcaacctgtgattcctaggtgattcctacaaggagacgtgatagcgtgcaagactcaactcccgtcttcaatgaacttacgtttcaatgagaatgtatgggtctatggatacttcagatagtctcatgtgaacaatcttaccacctgcaggaagagcatttggaaccatggcccattctttcttcaaacttcttttggcttccacggcatctctttctctgcatttcctctttcctcactccttggctggtgtgagggcccccgagctgccactctaagctcatctcttgccgtctttcttattcctcaggctccaaacacaccggcttccccgccatcccccaagcgtgccaagcgctctgctgcctccgggacttgctgtttgcttttctttctgccccagcgcctttcctgtggctggctccttctcagccatcggatttggctcaaatgttgcatctcctgagagcctgtttttaaacccttgattttcctcagttctattaccttgtttattttattcaaaagacttatcatgagctgaaagtatctttttgtttgctcatactctatctccctgactagaattcttcaactacgcatcccgtctatcttatttgcttcagcatctctcatgattagaacatagccttggtgagtattatagtctcattaatttttaatcaaatgaatgaatatataatatacagatacataatacaaacaatttaacctggcacataaaagaccaggagagataagacatccattttctggtatttagaggactgtcataaagaagagggatttaccctgggctacatcggctctaggagatggaaccgactaagagtgggagccgaagcaggtatatattggtgcaatttaaggaagaacttcctaccaggtagagtgttcaaagatgtaatagcctttttgggaaggtgatgagcctcttactacagtttttcccaaatagacaggtagcttctgggaagagatgatgtaaaggagattcatagctgcttgtaataagtggcttttaaggtttctttcaatcctgattgtctcttagaagttgggtgcagtgactttctctaaggcatgtactgttccaggatgatacatagataaaggtgaggttactaggaaaatggactcgattgtttagctgtatcctaatacttgttttcaaagagtaagctaaacacttacagtttttaaatttaaaaatgagatagagatcaacaacctcaaaaacaacgtattcaaatcctgtggcaccgcctttgctcagggagtctttaaagtgcttattctagaatttcctggagagtcatgtaacaggaagttgtgcaaatttgttaaacactttatttgttagatttcagtttaaaaaacttctgctttaaatccattcctagcgggtaaagatgtacctccactaatttgaaagaacaagttaaaagctctgaaaataattataaaagagtgcaccaaaaaaatatttgccacaatggcaggatcgctaaggtaattacagttccttccaaggtcattacttggtgacaaatgcctattggatatattggctgtgttgggcatagtaaagaacaatgcccaggcgtattgcctgatgggaatgtggcctgtgtgtgtccatgcgtacatgcagattacaataccaaatctcttcttcttaatcgttttttgtttgttttgacaagaagattcttactctatggtttcacacgttgcatgctaaatatttcagcctttgcaaatgtgataagtatgggttctgacattttgaagatcttttcagaatattttagaaatgtattatgtttattctacatatgcatgatcagtgttttacatgtgattatagctttgcatttacaaagaaaataactgttaagtaggaagcaatccatttggatgctctaaagagtaatttgagtggcttgtaaaccttttactgttttgtcttaaatatatggctgatgatatacctttaagtagccttaaaatactatagtttactttctatgaatgactgcagaaatttcaagcatacacacagtgcataacattctacattatatttttacttttaagaaacaaaatgtttttcctgtctagttctaatttatcactttgtagttatgcccagtgaactgataggccattatcccatcttattaaaacactcagggcttgctatcccgacaatatatcaaaagaaaagcaaaacaagaagatgtatacagaatacttaagtcaattttatcttcagagtgcggttttcaggtagagacgttgtaattgttaacaataaaggtaaaatgtagtctggttttgcttgagttttcagatcaattttttagacaaaaatcatcctatagtttagtatttggccaaattattttcttctgaatctcccaaaaaggaaataaagtattcctcttatcaatttgaccccataacaaatgctgccctttgggctttttttcttcaattccaaaagcattttaacaaccataatccaagacaagaagataatatatttatcatctgatcatttttacaacttctgtttttctgctataataatataccttactgttaatccttcccagctgttggagtaaagcacttagattgaactatgtctgggttttaaagatccaaagctggaatgttttattgttgctaccttttaattaaaggaaaactaaaggttagctaggtcctgataaaattggaatcagattaaggtgaatttttctcccatactacagtttgttgtcaggttttaggtagtaatactagaatcagacccacccccgaccatctgactgtgcaggtgagaactgtcactttgtcttcaagaagcttcaggaaaggaggatgggagatatttgggaatatatttttctctaggggaaaaataataatatgttaataatttaaatacccaagtttttaatattggggaatgtattagtctgttttcacgctgctgatatatacatacccaagactgggtaatttataaagaaaaagaggtttaatggactcacagttccatgtggctggggaggcctcacaatcatggcagaaggtgaaagacacatcttacatggcggcaggcaagagagaatgagaaccaagtgaaaggggtttccccttataaaaccatcagatctcatgagactgattcactaccacaagaacagtatgggggaaactgcccccatgagtcagttatctcccactgggtccctccctcaacatgtggaaattatgggagcaattgaagatgagattcgggtggagacacagccaaaccgtatcagggaatatatacttatgactgtctcttacttttttgtctgcctacttctcttaatttgggaaactgcccccaaatacccctttatgtgatcgtgaggggtttgtcaaccaaagactacattcaccctgcctcagggtgggcccctgtatcagttgggacattccagagaaacagaaccaataggttaacacataatagggagatttatcttagggaattgacttgtgtgattgcaggggctggcgagtctgaaatccacagggcaggccagcagcctggaaataagtgttgatgctgcactcttgagtccgaaatccgcagggcagactgataggcaggaaactcaggcaagggttctatgttacagccttgaagctagattccttcctcctccttcagaacctcagcttttcctctgaaggttttcacccagccagatgaggctatatagggagggtaatttcctttacataaagtcaactgattttaagtgttaatgacatctacagaataccttcacagaaacatctacatgaatgacgcaacagctgggcaacatggcgcagccacagcaacaaataaaagtaaccattgcagccagtgagtcccacagggcccttctgtgaaactcacacagactcaggaaaaccactgggcattttctctcaagtcggggaacagcccctgctggttgaagggcctgctagagaatgcagctgacctgggagcacgtggagtgagggagcgagggaggccatcctggtggcagtgtccgattcctggatacagccgtgctgccgcccaactcaaccctggaattccctctcttgcttgagcaactaagactcttgatgaatgaagaagacttttagaaacctattaatacttaaggttaggatgcagcttacatgttaaatgacgttcagaaatccattcagtcattttttcaccagtgttttagtgcctgcattttacctttatggaaatgttaggcattgagattaaagtagtgagcaagagaaacccagtgcctgacctgtttagtggaataagcaacattgaatgataaatgacaaggaaaaaagcttacaaaagagtaaggagatgatatggcatgagaataatgcaggagtggccgactatctttgggtgaagattaggcttctttgaggaaatgcatttgtgatgcaacccccgaaggtgaggatgagttagctgggaggggaagagtgatctagtccaagggaagtatgggaatgaaagagcaaggactatacatggagttgaaagggcacaatgcctgggacagagacagagatgagaagagagacagggggaattcatgaattgggcatcaggaaaagcctcctggtcccctgtaagccttgcctacattggagcaacaaggtggtggtggcctcgttgcctgacgcaggaggactggagaaggaaatgtctgcaagaggtaagatagtcattcagttgaggatgcattaggcttgggaggagatgtttaagaagcaccatgagcatttagggctcaggagagctgcctgtactatcacctgtcatctgtgtgaatggagtgggaagggaactgaagatggaaaggatgctttctgaaggtaataataattatgagacagtgctttagcttattgccagtaaaataagcttaccaattttaaaagggagaaaccgtttctgtttgctgaccagactggcagcatttacagtcactaagtgggagctggaaagaatcccgcagctcgtctaattccaccctttaatttcaaaaataaagagattgaagccgagagagacagtcaggaggaccaaaacccaaaccttctgacgtctgctactttgctgtttctactacagttttgtggaaagggagagagggagacagggaaaaagaacactttaatgtaataaacatttccatcttttcactttccctttaattttatttatatagccatgcacctaatttagcttccaattaatgttgagctgtggtggattggtgggagctgcccgaagcactctatctgaagccactttggttttcagtgtttagtatgagtaaggcatgtatctaatgtccaaaccagtccaatggagagtgaaatggtggttattcctcatgcagagacagcaggcatgaaccagaactgtccccagcaaactagaacccgtggtctccctaaccacgaggactataggaagaaaatgcagcatgggagccattttgcaattcctggtttatatggttttcctatcgaagttagaatttgttaagattttgatacagaaaaaaagggggggaaagctgaggaaaaattgattccaactgcggcaaggttttcaaattttttactattgtcttcttcatggagatgtattaattattcatcttgaattttaataatgattttttgtgtgtgttccaaaaaaaggaattaaaataattactttgtataagtctaccttgatccaaaataagtatttcaaaataggaaacatgtaaatgtcaatttaatgcaaagctctttctcctttaagtcaatcctcttcctctgaaataaaatcttctgtaaaggtaatagtatttgtctctccttgtgatgagcatttttagagttttagaaatttctttgacactggaaggaaattttcttttcttggtaaaaactaaataatcagtagagaatagtgcttccaaaacaattttaaatgccagaccgtatttcaaacaaccgtctaatttgagttaagtacatttgggaaatatagttatcaccaatgttgacagaaaacttaatattggtgatcacgacaggcatagatcaagcactgatgaatatgcctttgatggagttttctcacgatcttcttcatgtgcaggtgatgacagctctttcttccgtggtgtttacctgtacatcaatactacaggcatctcaaaagacgttacaagtattgaagatctttatgcctctgcctgtgggatttctttagggaactgacatattgctaaagaatagactcaacatccattactagctttcattcaaatctctgtacctcacagaaaatttcactgaaaacaatgatcgtataccttgtatatcagagagatgttcatgttatgggaaatgtggaataagttctggaatatagtgcatatgaaaaccagtgagttttaggaaaatatttaaatgtggagaaatgcaaattatactcaaatgtgggcttcatcagtgtgaggagctaaggttgctagggtattgaaagttaatactctatgaaatgcatcttaagcagaagccttaaattaaaaatctacacaaatcaaactaagtgtcattattgaaaagcattttgttcatataccatgagttctttatatgaatgatttgcatgtatcagatcttttttttattccagacattttgtcctggaaaatatgaacttgtttatggaaattttgccctttaaatgttgcagctttaaaatacggctgctccctgttctatagtttaaaaatggcttagattcagtagtttatttgtaaatattatcaatacatgcctattttatgtatttagtaggtggatatctgaactcattcataaggaaaaattgaaattaaacaatttttctttcaattgggcatttctaatattttttacatgatctgaaaattaattcctaggatcatttgaaaagacttctgggtaaggggaagggaagagagtagaaaaatgcttcctacacatttagccattagattttagtcctcagcaggcaggtttttctggtgtgacttcatcaagcataacttaatagagaaaaggatgatttcatttattttaatctacaacctcaaataacataaagacctatgaagtatgcgtgactctttcttaagactcttaagaaagattcacacataaaaagagctacattattttatatatattatttcttaaaaaatgcgtttacacttgaaatagactcataaatactatggaagctataaaacatattttgaaagcaagtcctaaagtcttcagggtacgtctgtcctcatagcaaactagtgatttgagagttccctctatctttcagaatttatgtagctgaatcttaaggaccagacttatgacacttatgacactgccatcttcaaggtatttgccatataatttcagtgactgaaatctcatatgccttgaaaacctaagagctgtgatattgcaacaaaaggacaaccaagtgacatttcctgcaaattttgagagttatacatacgcctctcaaataaattgaaactgcaatttgggtatgtaaccaccagatgtcactgtcttgtgatttttaagtcataggcatatattaatacttacataaagtcatataccaattttacacttttcctattgaataaattataactctttatacagaaacaataaaaagactacattaatgtttggttttgaaactcaaacttcagccaagttgtcttaattcacatacatacctgctaagtagtggatatctctcatttcaaaagcatgcatttctgcaaaactggattatcataatcgtgtttaggactctttaggttgcatcttaaagaagcccaacctagcctaagcacaaaacaggaaatccattggcacacatacagaagcccagtggtgtactgccttcaggcatggcctattccagaggctataatccattttatcacaatgcatcactcagtaggctctccaccaaatagcacatgatatggccctgcagctgaagacccacattctacaacctcagtagagacaggccattccgagacattccatgtctctgctcttttcaggttctgtaaccacagtagagataggccattttccccaatagctggcagaaatgagctgaaataagttttgattagccagtcttgggtttcataaaccttcaggatccagtcattatggacaggggcatggcatacttggattagccagaatcaggggcccactgcttggctgtggcagtggctaggccatcagcctgacttaacaatatgggatggatctccacaggaagcatggcaccattagtacagcacagggagatggaagctgggtgggcatatcaaattattggactgtcattccatgtctctgctcttctcaggagcaagcagtcatgtccatggctgccagagtgacccctctagaacaaaatctcgaaatgctactcttctctcaagagggcaagatgcagtacaaactgtgtagtatacacgactcctcttgacctaacttcttccttttcctgctttagtctcatctcccatcactgctgaatccaaccacatgaactctttgcaattctaacaaatgatcatactctttcaggtactactttccacttcacaagccttactctttctcataacaaaggcttttcccaagttatttccgtctggaagtccttccataccgttgtctttatgcatcatttaaaaatcatccttggccaggcgcgggggctcatgcctgtaatcccagcactttgggaggccgacgtgggcgaatcaagaggtcaggagatcgagaccatcctggctaacacggtgaaacctcatctctactaaaaatacaaaaaattagccaggcgtggtggagggcacctgtagtcccagctacttgggaggctgaggcaggagaatggcgtgaacccaggaggcggagcttgcagtgagccaagatcgcgccactgcactccagcctgggtgacagagcgagactccatctcaaaaaaaaaaaaaaaaaaaaaatcatccttaagcatttctttcttgaaatttccttgtccccacttcctaccccttcccagacagatttagatatgtattttctacatgtccacagtatctggcacacgagtatcattagcatttgtcacactgcattataatatttgatggtggggttattggccattaaacagaacttcttaagagtaagggccatgaattatctgaattatcctccatgaattatcccccaatacctggtacagtgattggcacatgatggggattgaatgaatggttgatgaatgaaggaaggaatgcatgaacaaattagtagatttgaatcggttttacactagaataatttcctctttgctctctgcaaacacgtatatgaagaagcacttgagtgtcagtatgtatagtgttaaaatcagtgtaagctttagagctagaatgcctgggctcagattcttgcgtcttcacttaccagttgtgtaactgtgggcaaagcacctaaccttctgtgcctctgttttctcatatgtaaaaagatagtggtaatagtttccactttgctaagtgtttacttctttaatcttcaccaactctgtcataaacataattattcttatttcttaggtaagtgaactgagactcagaatgcttaaataacttcctcaaggtcacacgggttctaaaatggggagctactattctaattaaagattatctgatgctaaagccctcacagtttcagctgcactgagatttcacaattggttcttactggctggaagaaggatacagggaaatattttccttcccttagctaatttttgtcctaatgattactttctgtataagattgtaacatgaaccatgtagctttgagatattgctataattgtgctcactactgctaagctgtattgtttataccttcagatagttgaacatagatagttgagaaataaatgccaacattttcatttgaattgaaaaaaaaccacaaaaaccattatattaaacctttctatttgtgtagatattagcaattttccccaaaacaaaacaagatacattcaaattgtaaatagctcaaaatggcagaagtttattcaggatgaatttgttcaggatgtagttaaatggattctcttctccattcttgtgtgtcagattacctaaatagaggcagtggggtctccaaaactctaagagggcaacatggaagcagtagcagttcattgcccataattttctctgcagattagttcagagagcccacttagaaaggaggaaaaatgaatcaaaccaaaagttaaagcaactttctcaccttccggctctccacagatgctgctggctacagtgattctgaggattatatataactcatttaccatcccaaagtcatgaaagtagactttgtattaaaggacaattgaacaaactctggtatactaagaagcattaggagaatattagacaattgttgagtaggatatttgatatatgttctaagtcatgatgcgcatctgcatcgatatcaatttgttttcattaacttagacaattaaaatcaagaactaagttattttaagcaaacagcttcattttacattcatttatttctgctttgcatgaagcacagctgcattataatgtgatcaagcacaataaattgtgctctgttgtttatagatggaagattgtaccactcaggtacatgtacaattttaccacaagtgttttgaaagtacaagtgtgtgagattttcttctcttctgaaaataattcttactcagactttagaaactatggattttctacctcctattaccaaaaataaatgcaatgttctgggccaatggcctgaagttacttaactgaagttatttaattggtagtatcttttccaatgtttttgaaaaatatattgagtgaaatagctactgcatttaggatacttacagaatatagatatggatatatagatagatatgcagtgaacaactttgtaggtctcccctggggcacatgcatgacaattctctaggtttataaccagaagtagagggtctgtgttatagtaaatgcccatctttagatttacttgttactggcaaattgctctctacccaaattcaggataattcattcaaagagggtttatttacaaagattttcaaaggtgtagggagagggtaaaccaagtgataatgctgtgacctagggctagtggcagctgagctttggacactgctaggcccaaaaggatgataggagggaaagattccttaactctgaaagtcctgtagaaaaagttgccttcagaagagaagtaacctataattgagaaaacctggcagagagggagcctgggaaacaaattcctctttccagtctctcctctctacttccgctcttctgccaaagtccctcactggccaaacaaaatggtggccagaagacactggggtccattggtgttgaccatacaggttactttctcatagcagagagcacagaggatctggaaaggaaaactgagtatgtccagccacaaggtcaatccaagttgttagaagtatattttgtctgttgctaatgcctgctatagagtagtactccctagtatatttccatcatttaaaaaaatctatcctgtttccttgtgatcaacttccaggttgcctccaattcccttctgccactaatagtgctgtaaggcactttttttgtatatgctctcttatgaacttgaagtcttcttaggggtctaaatccagtagcagaatcaactggtcttcgggtgcatgtgtatgcttaacttgaatgagggtcctctaccctcccagaagcagtgcacaagtattgcggtatcaccacatccttgccagcatgtagcagctttgtaacttctgccactgtagtaagtgtaagtgaagtttcctgtatacactatgatacattcatgtaaatgttaaacacataagtcacatattatattctttttttttttttttttgagatggagtcttactctatcacccaggctggagtgcagtggcgcaatctcagctcagtgcaacctctgacttcctggttcaagcaattctcctgcctcagcctcccaagtagctgggattacaggcacgtgccaccacattcatctaatttttgtctttttagtagagatggggtttcacaatgttggccgggatgctcttgatctcctgacctcatgatctgcctgcctcggcttcccaaagtgctgggattacaggcatgagccactgcacccggcccacacattatattcttataaatacatgtgtagtaaaatccaaaacaaacaaacaaaaaaaaaaaaaacaaaattggattggaaagctaccattggggataagctcaaaggatatttcgacttcatataaaattttatgtatataaaatgtttaaagaagtatggcaaaatatcaacatttatgcctattgttccaatgtaagcctttaggcttatttgtgtgttcacattatgatttttacaacttcactgaagtataaatgaaatacggtaaatcacactaattcaaggtgtacaatctgctaaatgttggcctctgtatacacccatgaaccatctcaggaagcacgataatcaacatcccatggtcccaagcctttcctctgtccccaggtaaccactgacctagctttctacatagaggtaatcatacaacatgtactgtgtttgtgggggacgtatgtggctgctgttactaagcgtatgcctttgatgttcattcttgttgcctgtatcaatagttcattcttttttattgctgagtagtgttttattgtatagaaatagcatgatttctctattcacttgtcagtaggcatttgagctgtttccagtttcagggatcttaaacataaagctactaaaagcattcatgtacaattttttgttgggacacatgttttcatttctcttggggaaatacttaggagtataacggctgagttgcgtggaaagtgctatttatttacctttctaagacattgtcaagtaaatttccaagcctgttatatcactttatatttccactagcagcgtttgagagtctcagtttctctacatcctcaccaaccacttggtatagtcaatccttttaatttcagccagtctaatggatacacagtgactgagcatgtccttgatgactaacaatattgagcatattttgtgtactttttaatgtgcttctatatcttctttttatgtactttttagtgtgcttatatatcttcttttgtgaagtgtctgctcaaatattttgtccatttttattaggttaattgttttattgttaagttgtaagcattctttatatattttataaacatgctttgtctatgtgtttcaaataatttttctcagtcagtggttagcttttccattttcttaaggctctgcaaaagagaaaatgtatttaattttgatgaaatccagcttatcatttttttcttttatggttttacttttggtatgctaatctaataaatgtttgcctcctccaagatctcctatgctttgtttgtcacaggttttatattttagggtttacatctagtcctatgatcaatttttagttagtttgtgtatgtgttatgaggtataaattgtctatttttttccatacagatataagttgattcagtatcatttgttagaaagattattctttccccatcaattgctttgataatttgtcaaaaataaattgaccgtatacatatggaatagaatagacggtccagaagtagactgaacagtctgagctgtacttctttatcttttgccaacctcaaactgcaactttatagccagtcctgaaatcaggtagcgtacataaggtctcaaagttttgtacttttttgttttttttttttttttttttttagttgtttgggctttcctaagccctttgcattgactataaatttaaaaaatcaacttgcccatttttaccaaaaaaaaaaaaacctgctggaattttgtttaggattgcattgaatctatagatcaacctggggagaattaccagttccaatccatgattctggcatatctttcaattacttaggtccttagtttctctcagcaatgttttgtaattttttagtgcagagtcataaataccttttattagatttcttcctattttataacttgacattaatgtaaatgaaatgttttaagaattctatttttcaatattttcagctagtatataagaatataaataattttgtaaaaatcttgcatcttgcagattatatattatttctagttgtaattctatagattccttgagatttttgtataaacaataaaatatctgagataggaacagttttacttcatcctttctgatccttttgccttatatttaactttttttaactttagtaaaatgtttaatagacttgatgaaagagtgaatcttcttcaccttgtcctccatctcaagggaaagtaattcagtttttcaccattaagtatgatattggctatgagtttttcataaataaccattatctacttgaggaatttcttactattcctaatttgctagctttttaaaaattatgaatgagcattaattttgtcaaattatttttctgccaatattaaaataatctttttttttttagaccaggggtaggcaaactttttttaaaggccagaataaatatgttcaggtttgcaacctaggaggcaaattcaaggatattatgtaggtatttatataaccatttaaaatgtaaccatttagaaatacaaaattattcctagcttgtaagcataataaaaaacaccaggagcctggccatttttggtctatagactacagcttgacagtgtctgttttgtactattaatacctattgtgatatttttatatagttggatttagatctgtcattttattatgcgttttctctttgtaccatgtttttgttgctctgttcctctctctgtctctctttcctgcctttttaggattatttgaatatgtttgtattgcatgtgaatgtatctcttagctatcagctattcttttgtattgtttttgtggttgctttatgtattacaatatatatacctaacctttcacagtctacttggagttattattgtaccacttgacatctaatgtagaaaccttggaaccatagaggtctctttgccacctcctacctttattttatagttgtgatatgggctatatctgtattcattgaaaacttcacagacactggtataattttagtgctaatgagctatacatatttaaagaacttaagaggaaagcacagtttttacattacccagataggaatcatttctattgcttatccttcatcttgaagttacaggtttcctcttgtatcatttttcttccatctgcagaacttccttcagcatttctggtagagcaggtataagataatgaattttcttaattttttttaaatctggaaatgtcattttgacttcattcttgaaggatattttcattgaacatagaattctaagttgacagttcttatccttgagcactctaaagatgctattctactgtcttatgaccttcatagtttctggtgagaaatttgtgataatttgaatcattgtttctatggatgtaaggtattttttcctagctgttttaagtatttcttctttattattggctttcaacagttggactatgatgtgtttggtcatggtttctttgaagttatcctctgtgtgatatgttgagattctagaatctatgacttctactaaatttggaaagtttttgtcccttatttcttcaaatatattttctgttttaatctttttctccttcccttctggaacctaaagctcacatttcttatgttatgcagtaccttctgcattttgttctgtttcctttttttccttaaccatctttcttatgacattatcctattttatacaagccatgttctattgtgatgcattaaagagttgagtttcatgaaattttgtgctgcaacatacaagtacacaaatttcataaatctgtgctgtctctgagtctactccagatgctatcttctccttgtttgtagttcttttttattggctccaggtggcatttttaattgtttcttatcctcaaacaaagcaagatctcacaagagtcagtgtcagtcaagagacgcaatgatgaatggagctggcccagtgtcctgtgcacagatctagtggccacattctttctcagatcagcagtggttaatgtgtggcactcccagccaaacttacggtttctagtggtggatactttcttctccccagactgtccggtcttctaattttcccaaaagttggaacatccggatcacatttctttttgtctcttccctagagtatgttaattttggagtctgggccttgcaagttgtgctgtagctttgcttcgagtctcacatatgcctgagttcaaggctggcctccaattatccatgttattttgagaaactcgcttaatctgtcttagagtcttctttggtaaattcaggccaataatgtctccattatacagtgaggtaatatgaagaaattctgaaataatgcaagtggagcatttatcctggagcagtgaagttcacggtaactcaaactgtggctgctgtggtctccagcctcagcaatatggccatccttagtgcattttgccaccaccaatctctaactctgtctaaaattttgggagatttacattcttaggaagtggtcctgcttctgggctggaaaatacaacaccttctgcaggaagtagggctctcagggttcagtagggtcagcactctggacttctgccttgtagtcaggggacagctgtctccatatccattttagagaaaaattagaagagatagatttgggttcaggtagccagatataattttaaatcagaatgcataccccatagccacatttttgagcagagaaagcattatgtacatctatcttctttagctatctttggtctttttgttttaaaatccaggttgacatctggcttttgttaagtgtggcactgccggagttctgattattcatatcctgtccacccactcctgcacatctcctctgtttggcctaacctctctctctcactatgatatttgttgagcaaaagagctttgagagaataaaattttctgaaaaataaggaaaaactgaaatatgtttatatttataggctttcactcatgtctatgtcatcattcttgtcatttttagactgatgtaccattctgtgaacagcaaatgtgtttacaaggtgcaaactgtgtgctcatctaacttagttaaattatctaaaatgaccaacctcttcagacatagacaaattattacttttccttgtcattttgttagtagattctatatagcatttttagaccactgcagtgttcaagataataatattcaataaattataaatcaattttctcctcgttgtagaaggaagctaattgtcagaggtaatatctattaagcttcctggattaaattcatttaaaatgtgttctgttagaaaatgtgataacactttatttttagtgaccattagctaatactaaattacagcataacgcctctggaagtgcatgtgacgtccatatgaataccaaatgaactcataattatctatactataataatgaatatcaaaccaatttataatgatatactgaaaatcaaatacttctgaaattttatgttctcatcaattttaaggacgagacatgaatctagcttgttagagcaattgctggcagtcaggaagctgcgctgtgcccagtctgcaattttgttttctggtatttctggcaccagcacaatgattccaaaaactgaaaaatgtaacaacagtatgctggggaggagcataggtattcaagaaagggggtgcgtgtttctaggtatgataatgagagatttttaaaggatagaatgaaatgactatcatgtttcaaaagaagttacaacacatatgtattagttcattactaagcaactgaagaatataatacaaaatgttcagttgattaatttggaaaagtatgccaccccaaagcaggcttggccaatgacttaggaagtaaagtcttctttttttatttcaaatataaagtcattttctaagttcccctcttgtattataaaagagtaattttattgggttcataggttgtctaacttgatgtaataattaatagttatttaatattaactgattgatatttaataaaaatattgtagtgattggggtgtaaggctgccattgcaaagatgagagagactagggagtgattaggacaagtaactgggtcagcttgacctagaggggatgaagccctacagaagctcaaaaggcagaaaggagttagaggtagaccactcccactaccaaaagaaataccatttgggatgagctttctagaatataaagttgtaacaagtagcagtttacgaggcatattttagacgaagaacatagcatgaacaaattcatggagacaaaatagtactgtatgcttctagaaaaacaatatctttttgattaagaaaatattttgtgggtttgtagagttcatgcctgtgatttatgggaaggaactacaaagagacagtatgggattcccaatgtccagggtccagatacgaagttgggtgttaatttccctggtactgagcaaaggagggagtgagtgccccaaaagagaaaaggatcaaaagttcttgttacgaatgatttgagccatgctccagaaaaacgtttctcgtagcaccatgcaaaatggaatagatctagttatagaaactagtagagttcccagctaagaggccagtacaattattagaggcaagtagcaacccatggtggcactgggaagaggaagaaaagatacagatgtaacagacaagggtctgtgatattgtcaggctgcgggttcaaaatgagagtccttccacaaagtactgttgtagttgaatgaatcaatattaattgaatgaaagcattgtgctgaattttactaaattaggtttgtatagaaaaatgtaacctcatgtatatgtattaccctagtgaatatgactcattaaaattcatttaaaatgataaacatttaaaatgtaaaatgtgttacatgatgtaagtagtacaaatagctgtataacagggtcaatatattaaatatatataagatttaaacatataactattttattaaaataatctgtgaatatctagatcttctaaaaagatgatctctctgccatgcccagagcacagtaggtccactgacccccatgtagtcttggccagagcggactcttccagtctcagctcttgatacttttccctcttcactcacaatctcatcattccgcttgccaagcattgatcttggcgcatagaaggtgttcactgttatttacagaatgaagagctaatgggaggaggaaagggaaaaagcaacaaaggaggaagggaggaaagaaaggaggaagtgagggaggaagggaatgagagaggaagagaggtgctctgtatctactatctttaggaccttgcacaattaattaaactccccgaagcctgaatgcttttgtctgacaaaagaaacaataggattgctatgaaaatttaaaaaatactgtattatggcatctgcactctattgggctgatagcagcagctggaagattgctccccatcgaatcacgccacagtttaccatagacacagcacctcccctcttcctctggtctattatgagaactctgtgatggcagagatttccatgggacttgagaagttatggatggatgagtgtaagggatgaaatcactactttttagttttttatttctagcattttccagtggatttttattaatccatctgcattcccttacctgatgactgggtatgcaatgtggaaaagaataatctaacacttcactgtataaaaattgtagcttggcctcctaagtacagttctctgagcaatcagctacataccaggtcactatcacatactagtaaataaggcactctgtcactttcagtagagtactactaatttggctatcaaaattgtgtttttaggcagctgaacagaaggtagagttcattagttcatgtttaaattagagcttgttttcattctagataatagggagaacaaatgctattatttttaaattctatggaaatgtgaaaataaatgctgttcatattatatctgcctaaggctttcataaaaacagttaatttccaaaataatgtatctattatattttatgtttatgaggataatttgaaatatatatttctactcagggacttttgaactaagcagtggaacaaactgcaataattagctgaactacaaaccaaacttgaatgttaatgtgtttttacataaacaaactcttgttacaaaatattgcttgagaaacttagaaaatttttttaactttgcagctaaatcagccagccttgtcacgtagacccaggagagacagagtggggagggaagaggcggccggatcctgcacaatctcatctcctgctagaagaccggggggagcagtgagggccgccaggtggtggggcagggcagtagggaaaatcctcttcatgattccctccaatatctgtggtcagtgtaagaaggaagtcagtactgaaagcctcactatatccttatccatcttggtttcctccggaggctgtctgatttgttttctggcttcctccatttctctgacctctgggggtgttttgcttcctcttcttgacacttttgttcatcaaaattatccagggaactttgaaacatggagatgcttgggctacaccgccagagaggctgactcttgctgtggggtaagacccaggcattggtgtctttgaaaagctccatgtgaaaagtaagcaaattcttccccctacccccatttacttttagttgacatgtaataattgtatacacttattggatacagagttatatttccacacgtgtatacaatgtgtaattattactgagacatgtgggaatcctgtttcttagtcttatttgggagaaagaagtctgccaagtgactgatttagccaaaaaagagaattaattgaaggaaaacagaaagcagagagtttatttagagacacagtacactttgaaagatgaggcagagcggactgctgaaagccagaggcccccctcaccccaagagttctgcattgggttttgatgacgttgaactgtttcctgaagttcgccgctgtcttaagtctctgccatttttccttgtctagttttctggctcctgccttaagtccccgctttttccacgtctagtccccactccaggcttgtgggaccctcccttactatgagttggtgcacatgtgtgggccggtgttggatatgaattgcacccggggtctcttaggaatttccgccttatcagcatgtaggttaactgcagagggagcagtgcctggggggtcttaaggattgctccttcctgcctatgttatttcccctccgccttgctcatatctagcatgcctgtttctggtggtccctggattgtgggatcctccagacctccctttcctcaggggctccccctcctgctcatgtctagctgtctgtctactctaacacagtgatcaaaccagagtaattagcatctccatcatctcagacatttatcattgccacgtgtaaggaacattcaaattcttttaccttttgtaaatataaaataaattattgtgaattcaccctgcagtgcagtggaacatattcctcctatgtagctataatttggtatcccttaagcagcccctccttatttccccccatccccaccagccttcccagcctctagtcaccacaattccactctctacttctatgagctcatttttttaactcctatgtatgaatgagaacatgtgatatttatctttctgtgcatgacttatttcccttagcataatgtcctccaggctcatccatgttgctgtgaataataggattttattctttttttatggctgaatagtatccagctgtgtatgtacaccacattttattcatctgctgatggacattcaggttgatttcatatcttggctactgtgaatatgctgcaataaatacagagatgcagatatcttttcagtatactgatttcctttcctttggttaaatacttagtagtggaatgccggatcatgtggtgattctatttttagtttttgagaagcctccataatggttttcataatggctgtactaatttgcatttcccacatccttgccagcatttgttatttttttacttattgatgatagacattctaaccagagggagatatctcactgtggtcttgatttgcatttccctgatgattagtgatgctgagcatttaaaaaatatacttgctggccatttgtatgcctttttcttcaggaatgtttattcagatcctttgcccattctaaaagtcagatgagtttattttcctattgatttgtttgagctccttgcatattctggtgttcgtcccttgtcagatgaatagtttgtaaatattttctcctattctgcagattgtctcttcactctattgactgcctctttagtttgataaagtcccatttgtctatttttatttttgtaatctgtacttttaaggttttaggcataaaatctttgctatgccaatttcttagagcattttccctatgttttcttctagtagttttatagtttcagtttttacatttaagtctttaatccactttgaattggcttttgtatgtggtgagagataggggtctagtttctttcttctgcatatggatatccagttttcccagcacagtttagtgaagagtgtgtcatttccccaatgtatgttcttggcatctttgttgaaaattagttgattgtaaatacatgggtttatttctgggctctctattatgatgttccatttgtttatgtgtctgttttcacaccaataccatgctgttttggtaaccataggcttataatatattttgaagtcaggtagtgtgatgtctccagctttatggttttgtttttattttcttttgttttgctcaggattacttttggctcttaggggacttttttggttccatataaattttatgattgattttgctagttctgtgaagaatgccattggtattttgatagagattacattgaatatgcagattactttgatttgtatgatcatttttacaacatgaattcatcccattcataagcatgagatatcttttctttttttgggggagtggggtcttcttcaatttcttccgccagtattttgtagttttcatcatagagatcattcaccttcctggttaaatttattcctaattatgttatttttgtataactattgtaaataggattactttcttggtttctttttcagttagtttgtttttaagtgtatagaaatactactgttgtttgtatgtggatttgcatcctgtgcctttactgatttcccttatcagttctatgaattttttggtagagttttaatgtttttctatatataagatcatgctctctgtaaagaggaacattttgatttcctcttttccaatttgaatgtcctttatttctttatcttgcgtaattgctctggctaggacttccagtactctattgaatagagtggtgaaagtgggcatccttgtcttgttccagcacttaatggaaaagatttctcttttttcctttcagaatgatgctaattgtggatctgacacatatagcctttattgtgctaaggtatattcctactataccccatttgttgagagtttttattgtgaagagatgtagaattttattaaatgcttttttttctgttgtccattgggatgataatacagtttttgtccttcattctgttgatttaatatatcacatttattgacttatggtattgaaacattcttgcaaatcgataccctaacatcacaactaaaagaactagagaagcaagagcaaacaaatccaaaagctagcagaagacaagaaataactaagatcacagtggaactgaaggagatagagatacgaaaagtccttcaaaaaaatcaatcaatccaggagctgggtttttgaaaataattaataaaatagatagactgctagctagactaataaagaggaaaagagagaagaatgaaatagacacaataaaaaataataaaggagatatcaccactgaccccacagaaatacccacaatcagagaacactataaacatctctatgcaaatacactagaaaatctagaagaaatggataaattcctggacacacataccctcccaagactaaaccaggaagaagtaggatccttgaatagaccaataacaagttctgaaattgaggcagtaataaatagcctaccaaccattaaaagtccaggaccagatggattcacagccaaattctgctagaggtacaaagaggagctggtaccattccttctgaaaatattccaaacaactgaaaaggagggacttctccctaactcattttatgaggccagtatcatcctgacataaaaccctggcagagacacaacaaaaaaagaaaacttcaggccaatatccctgatgaacgttactacaaaaatcttcaataaaatactggcaaactgaatccagcagtgcatcagaaagcttatctaccacgatcaagtgagcttcatgcctggaatgcaaggctggttcaacatagcaaatcagtaaacataatctatcacataaacagaaccagtgacaaaaactacagttatctcaatagatgcaaagtccttcaataaaattcaacatcctttcatgttaaaaactctcaataaactaggtgttgatagaacgtatctcaaaataataagagctatttatgacaaactcacagccaatgtcatactgaatggacaaaagctggaagcattccctttgaaaactggaacaagacaaggatgccttctctcaccactcctattcaatatagtattggaagttctggccagggaaagcaagagaaagaaatcaaggtattcaaataggaagagaggaaataaattgtctcttttagcagacgacatgatcctcctatatctagaaaaccccaccatctcagcccaaaagtgctaagctgatatgcaacttcagcaaagtctcaggatacaaaattaatgtgcaaaaatcacaagaatttctatacaccaacagtagacaagcagagagccaaatcatgaatgaactcccattcacaactgctatgaagagaataaaatacctaggaatacagctagcaagggatgtgaaggacctcttcaaggaggactacaagccactgctcaagaaaataagagaggacacaaacaaatgcaaatatattccatcctcatggataggaagaatcaatatcatgaaaatggccatactgcccaaagtaatttatagattcaatgctattctcataaaactaccattgacattcttcaaagtattagaaaaaaaactactttaaaattcatatggaaacaagagcccatatatccaagacaatcctaagcaaaaagaacaaagctggaggcatcacactacctgacttcaaactatactgcaaggctacattaaccaaaacaacatggcactggtaccaaagcagatgcatagaccactgaaacagaatagagatctcagaaataagaccacacatctacaaccatctgatgttcaacaaacctggcaaaaacaagccatggggaaaggattccctatttaacaagtgatgctgtgagagaactggctaaccatatgcggaaaactgaaactgggtcccttccttacacattatataaaaattaactcaagatggattaaagacctaaatgtaaaacccaaaaccacagaaaccctagaagaaaacctaggcaataccattcaggacataggcatgatcaaaggttttatgatgaaatcaccaaaagcaattgcaacaaaagcaaaaattagcaaatggaatctaattaaactaaagagcttctgcacagcaaaggaaactgtcatcagagcaaacaggcaacctgcagaatgggagaaaatttttgcaatctacccatctgacaaaggtctaatatgcggaatttacaaggaacttaaacaaatttacaagaaaaaacaaacaactccatcaaaaagtagacaaaggacatgaacagatgcttctcaaaagaagatgtttatgcagccaacaaacatgcaaaaaagctcaacatcactgatcattagagaaatgcaaatcaaaaccatgatgagataccatctccaccggtcaggatggcaattattaaaaagtcaggaaacaacagatgctggcgaggctgtggagaaatagaaacacttttatactgttggtgggaatgtaaattagttcaactattgtggaagacagtgtggcttttcctcaaggacctagaaccagaagtatcatttgacccagcaatcccattgctgggtatatacccaaaggaatataaataattatattataaagatacatgcaaatgtatgtttattgcagtactattcacaatagcaaagacatggaatcaacccaaatgcgcatcaatattagactggatcaagaaaatgtggtacatatacaccatggaatactatgcagccataaaaaagaatgagattacttcctctgcagggacatggatggagctggaagccatcatcctcagtaaactaacacagcaacagaaaaccaaacaccagatattctcactcatgagtcggagctgaacaatgagaacacatggaaatggggaggggaacaaaacacaccagggtcagaggagggagagcatcagggtaaatagctaatgcatgtggggcttaatacataggtattgggttgatacgtgcagcaaaccaccatggagcatgtttacccatgtaacaaacctgcacattctgcacatgtatcctagaacttaaaattaaaaaaagcaaagcaaacaaacaaacaaacaaacaaaaaaatgaaacattcttggatccctgggatgaatgaaactggatcgtggtgtactatctttttcatgtgctgttgaatttgatttgccagtattttgttgatgaatttattgatgaatttccctatgttcattgctaatattggcttgtagtttcctttatttgttgtctttgtctggttttggtatgagggtaatgctggcctcatagaatgtgtttgggagaattctctcctcttcagtttttcagaattgagaaaaatctgtgtttggtcttttttaaaagttcggtagaatttgtcagtaaatccatttgggctttttttgaggggagactttttattatggcttcaacctctttgttcatcattggtctgttaaggttttctagctcttcttggctcaattttggtaggttatatgtgccgagaaattcatccattttctctaggtgttccaatttgttggcatatagttgttcataatagtccctaatgatcctttgtatttctgtggtctcagttgttatgtctcctttttcatttctgatttaaatgtatgtgggtcttctctatttttttctagtctagctaatggtttttttcataattttaaaatattctccaaagaaactatttttaaattttttgtattgatacataatagatttgcatattttctgggtacatgtgataattcaatacattcatgtaatttgtaaagatctaatcagtgtgactgtgatatccatcaccttaaagatttgtcttttctttatgctagaaagatttgaattattctcttcttagctattttgaaatatgcaatagatcgttgtatgctatagtcaccctacagatctatcaaactccaggccttattcttctatcatattgtatatggctatatgtatgtatgtttttattttctccccctactccccactctttccaacctctggtaacaaccaatttgttttcttcttaataaggtccacttttttttttagctcctacatataagtgagaatgtatggtatttgtctttctgtgcatggcatatattacttaacataatgaccatgagttccatccatgttgctgcaaatgacaggatttcatccttttttatgctgaataatactccattgtgtatatatgctacattttctttatccagtcatccactgatggtcacttacgttgattccattgtttgcctattgtgaatagtgctccaataaacatgacaatacagatatctctttaatatattgattccctttcttctggataaatacccagcagaggaattgctggatcatacgggagttctatttttagtattttgaggaaccttcatacagtttttcttactggctgtactaatttacattccccccaacagtgtaaagagttccccgttcttgacattcccaccggcatccttaatttcctttttggtaaaaggcatttaactggggtaagatgtttcattgtggtttgaatttgcatttctctgattatacacccattggctatttgtaagtcttctttggagaaatgtctattggatcttctgcccatttttaaattgtattatttactttttgttattgagttgagtcccttataattctggttattaatcacttgtcagatagatagtttgtgaatattttctcccattctgtgggttatctcttcacttggttgattgtttccttgctgtgcaaaagctttctagcttgatataatcccatttgtccatttttgctttgatcgtctttgcttctgaggtcttacacaaaagatgcttacctagactcatgtcctggagcattttccccaatgatctctccgggtagtttcacagtttggggtcttaaatttaagcctctaatccatttttatttgatttttgtagatggtgagaggtaggggtctaatttcattcttctgcacacacatgtccagttttcctagtaccatgtattaaagagagtgttcttttcccattgtatgttcttggcaactttttcaaaaatgagttggctgtaaatgcatggatttatatctgggttctctattctgtttcattggtctatgtgtccatttttatgccagtaccatgctcatttggttgctatagcttcgtaatatatattgaatctagtagtgtgatgtctccagctttgttttgttttggggtattttctctgctcaagatttctttgggtattttgggtctttcatgattccatataatcttcaggatttaaaaaaatatatatttctgttaagaatgtcattggtattttgataaagattgcattgaatttgtatgttgctttgggtggtaactttaacaaaattagttattccaatccatgagcatggagtatctttttatttttttctggtctctccaagtccttttatcagtgttttatagtttcccttgtatagatctttcactccttggttaaattgattcctagatattttatattctttgtaacttttgtagatgggattactttcttgatttctttttcagattgattgcttttgacatatataattatgactgatttttgtatgttgattttgtatcctgcaactctactgaatttgtttattagttctaatggtttttttgcagtaaatctttaggcttttctatatataatatgatatctttgaacaagactaatttgacttcttcctttccaatttggatgccctttgtttatttctcttacctaattgctgtagccaggacttccattattacattgaataaaagtagtaaaagtgggcatccttttcttgttccatatcgtagaggaaaggctttcaattttccctgttcagtattatattagctgtgagtctttcatatgtggcctttgttatttttaagtttatttttctataccagtgtgttgaaagtttttatcataaaggaatcttgaattttgtcaaatgctttttcagtatctacatggtttttttcttggtactgttaatatgatgtatcacatttattgagttgtatatgtggaaacctccttgcatccctgggatgcatgccacttgatcatggtgtattatctttttgaagtgcttttggattcagtttgctagtattttgttgataattttttcatatacgttcttcagtgatatgggcctatagttttctttttttgttgtgtccttgtctgattttggtatcagagtaatgctagccttacagagtttgcaagtattctttcttctacaaaaaatttttgaagagtttctgtttaattgttttaaccaatttttgattgaattgttttcttattgatttatgagagttctttttatatatctggattcaacttctttatcagatgtatgctttgcaaatattttcttccagcacacaagttgtctttttgttctcttaacagtgcctttcaaagaaaagatatttttaaaatgtttacgaggtccagttttatcaatttattctttcatggatcatgcttttgatgtcatatataaaaaaaaatttgcctaacccaaggtcacaaaattttttcctaggttttcttctagaagttttatagttttatgttttacatttaggtccatgatagtttgagttaaattttgtttatgccatgagatatggatcaatttttgcagttgatatgatatgcagttgtttcagcaccatttgttgaaaagattatccttcttccattggattgcctttgtacttttgtgaaaaatcagttgtctccaaggatatacagaaagcaaataaacatatgccaaataccacatgattagttcattaggaatgaaaattaaaataacagtgataccactacacacctattagagtggctacaatgaaaaagacttattatgtcatgtgttggtgaggatgtagaggaattggagcattcatccactgttgatgggaatgtaaaatggtacaaccaatttagagaacagtttgccagtttctcaaaaagtcaaagatacaaatgccatatgtagagccatttcacttctaggcatttatccagaaggaaagaaaatgtatgttcatacaatgacttcgacatgaatgttgataagggctttatatgtaaataccctaaactggaaataacccaaatgttcacctacagttcttgggtaagcaaatgatgatgtacgcatactacagactactactactcagcaataaaaagaaatgaattactgacacacttaacagcatggatgcatctaaaaaaagtaatgttgaataaaagaaaccaaacaaaaaggagtacgtactttatgtttccatttatataaaactctagaaaatatacgtttattacatttatagtgacagaaagcatggggtgggagaggtaagagaggaatcgtaaagaagcatgagaaaacttttggggttgatgggtatgttcttcactgaagtgatagtgtttcatgggtgtacacatctgtcaaaacttatcaaattgtatactttaatagtacatttttcaatattaattttacttcaataaagcttctaaaaacacacaatttttttttgaagagtttgagtataattggttttagttctttaaacatttggtagaatttagcagtgaagcaactgggtcctgggcttttccttgataggagacttttcattatagcttcaattttgttacttactattggtttcttgaaattttccatttcttcatggtttaatcttagtagattttatgtgtccagaagcttatcatttttttctaggtttctaatttgtagttgtatagttgtttataataatctctaattatttgtatgtctctgatcatatttgttaagtgtccttttcatttctaattttacttatttggctcttctctctttttttctttgtctagctaaaggtttgccaattttgcttatctttaaaaaacagccttttacatcttcagatttctaaaatatttttgtctttgtttatttctgctctcatctttataaacgttctaaaaattttgggtttagctttttttttcttgcttttctaattctctgagatacatcattaggttgtttatttgaattctacttttgatttaggtgtttattgctgtaaactttcctctgtgtacagagtttcctgtatctcatatgatttggtatatgtttagtgtttttattttcactagtttcaagactttttaatatttacttcttaatttcttcatagacccatttgtcattcagaagcatgttgtttactctccgtacatttgtattttcaaagttcttattatttctggttttattacattgtgatgtgagaaaacaataggactttcatttcttgaaatgtgttgagacttgttttgtggcctaatatatggtttatcctggagaatgtttcatgtgctgatgagaagaatgtgtatattacagttgatgaaatgtcttgtctcttaggtacatttgctctgtagtgcagtttaagtccagtgtttcttggtgaattttctgtctagatgatttttccaaacctaaaagtggggtattgaagtccccagcttttattgtactgaggtttatctgtctctctttagctaatatttgcattacatttgtgggtgttttggtgttgtgagcataaatatttacaattgttagattatcttgctaaatttatcattttatcagtatataatgactttctgtatctttttttttttttttttttttttacttaaagtctgttttgtttgatataattacactactcctgcacactcttggtttccatttgtgtggaatattttcttccatttgtcttagtccatttagagttgctttaaagaaatatccaaggctgggtaattttggggaaaaaaaaggttcgtttagttcatggttctactagaaagttcaggattggatttctggcaagggcctcaggctactttcatcatggtggaaggcaaaggtgaacatgtgtgtgcagagattacatagtgagaggggaaacaagagagagggaagggaggtgctaagctgtttttaacaaccagccttcacataaacgaataagaatgagaactcacaactgggcgcggtggctcacgcctgtaatcccagcagtttgggaggctgaggtgggcagattacctgatgtcaggagttcaagaccagcctggctaacatggtgaaacccagtctctactaaaaatacaaaagatagccaggcatggtggcacactcctgtaatcgcagctactcggggggctgaggcaggagaattgcttgagctgggaggcggaggttgcagtgagccgagatcatgccactgcactccagcctggccaacacagcgagactgtctcaaaaaaaaaaaataaataaatgaaaaaaagagaatgagaactcacttccctggttgggagggcgggcgttaaactcttcatgagggatctgcacccatggctcaaacaccttccattaggccccacctttaaaattggggatcaaatttatacttgaggttcagggtgacaaatatccaaactatagcaccagcccttctctttcagaaagtctgtttccttgtaggtgaaatttcttttcagcaggatatagttgtttcactgtgtttgttttgttttatttatcatgtagccagtctatatcttttaggtggggaatttaaaccctttacattcaaagttgttattgtattcattttgctaattgttttctgattattttgtatatcctttgtttctttcttcctcttttattgtttatcttttcagtcttgtggttttctgtagtgttaatgtttggctcctatctctttctcatttgtgtattgtggcagaatatgaaactctgccaatgagttttatattttcatgtgttttcatgatggtagatatcatcctttcactcacacatgcagggttcccttaaacatttcttgtagcactagtctagtggtgatgaatttccctcagtttttgcttgtctgggaaagattttatttttcatttatttatgaaggatagctttgctgggtataacattcttggctgatagttgttgttttttctttcagtactttgaagatatcatcctgttctctccaggcctgtatggtttctgttgagaaatctgctattagtctgatggggattctcttgtatgtgattggatgcttttctcttgctgttttcataattttctcattgtctttgacttttgatagtttaactataacttgccttagagaggaccgttttgggttgaatctatttggggatttgaacttcctgtatctatatgtctaaatatctttctagacttgggaaattttcagctattatttcgttaaataaattatctaggactttttctatttattgttcttctggaactcccaaaatgcaaaacttttttcacttcgtggtgtagtgatgtcccatgtgtcggataggctctcttcattctgttttattctttttttttttttttttgactacgtaattttaaagacctgtctttgagttgagaaattctttttattcctgcttgatgtagtctgttgttgaagttctcaattgtatttttttttatttccctcattatatgtttcagttacaagatttttgtttggttcttttatatgctatttcttttttaaaatttctcatttggataatgaattattttcctgatttatttcttctgtaacctgttgagttttcttaagatcattattttggatttcttttcaggcatttcatagattttcttttcttttcactgttactggagaattattgtgttcctttggaagtgtcatgttttcttgtttttcatgtttcttgtgaacaggaacatttctttctgagaaattagagatcattgaaaattgcaagatagtataacttaatgtttgttatcatatattgaatattaccaaatttaaacttcaagttcaaagactactgggagcaaaatgaaacatacttcaacattactgttcttcaaaatcaagccatcaccagtgctgtattagtctattttcatgctgctgatgaagacatacccaagactgggcaatttacaaaagaaagaggtttaatggacttacagctccacatgcctaggaaagcctcacaatcatggcagaaggcaaaaggcacttcttacatgacagctgcaagagagagaatgagagtcaagctaaaggggtttccccttataaaaccatcagatcttgtgagacttattcactaccatgaaaacagtatgagggaaaccacccccatgattcaattgtctcccatcaggtccctcccacaacacatgggaatcatgggagctacaattcaagatgagatctgggtggggacacagcgaaactctatcgagtgctcacacatgcagaagaattgcatagacttgccataagtagaatctcaagctcaattttgtttataaatgtattaacttaaacaatctttgctattcactcaacatgatatgtttttggtaaggcttagtgtgtctcaaagctattaatatagtgatatagccaattccattgagcaagcattgccttgcagtgcctaaaaatatactcagaattggtagtgagaggacattctgatactgaatcttgccaaacacactatattgcagaaaatgttactatattatccaaaaggtaaatgatcccttgccaatttattgtttccattataattttatattttaattacttaatattatatattgctttgttaagcatgcattctaaatattgcttctgttgttaatagactgctttaacaattatcatggtattaaataaaaagcaaataattcatttgaaaagtatatatctgtaattgttcagaatttttttttttttagtttggcttatagagagacccatttactttcatggtcttactaagatgtgcatttctaaaatattttagaaatcatgcatctatacaactgggttaagcattcaatagagagaggtcaaggccatcttttcagtttctgacttaaataagagaagcatttgaaaaaggatacttttctcatgagaacgagataaatgagttgaatttgaaatacactgagtttgaaagtgccagagtagaaaaggaataagttgatttgaagttcaaaagaaaggtctagactgatgtcatttgtcagaataactgaaaaggcatgggtggagcttagacaatcctgatgaaccttgaagagcagcactgttcaatagaaatataatatgaatcacgtattattttatattcttctagtagccacattttaaaaagtaaaataaaattggtaaaattaactttaatgaattaacctgatatattttaaatatcatcttaacatgtggtatcagccacatttcaaacacaaccacaggtagctgctggctgctgtgctagacagtgcaggtgtagagagagaagggagtgctaagaacaaaacctgtgggatcccaacactgaaagaatgcgggaggatgcagaagaccctcacatggaggccaagagacacctatctagatctcagcttgtccacaggcggtgagcagcatcttcacatctatgtctcgggtgttactttctagatgggtgacacttgcagggtgaattaggagatctctcattctgtcagtgacgtagacctccctccccaaaccagtttccattgtaagtatggtcgtatttgccctaggttacaaattagccagagcccttgtaatgtaaggcttgtgggtatatttaccaaccacatcttaatcaaaatagtgtaatgtggtagcatccctgtaacaatattaaccatttagtaacatattctgttgtctcggttggaccaaaacttcaaatctaggaagtgaaaatttgagaaaagtataaaacaacaataccactcccttgcttagtgctttggggtttatttgcagtcattttttaatttttttttttattttcataggttattggggcaaaggtggtatttggtcacaagagtaagttctttagtggtgatttgtgagattttggtgcacccattacccaagtagtatacattgcacacagtttatagacttttatccctcacccccttcccatccttttcccctgtgtccccaaggtccattgtgtcattcttatgcatttgcatcctcatagcttagctcctacttatgaatgagaacacacaatgtttggttttccattcctgagttacttcacatagaataatagtctccaatctcatctaggttgctgtgaatgccattaattcattccttttttatggatgaatagtattccattgtaaatatataccacagtttctttatccactcgttgattgatgggcatttgggttggttccatgtttttgcaattgggaattgtgctgctataaacatgcatgtgcaagtatctttttcgtataatgacttcttttcctctgggtagatacccagtagtgggattgctggatcaaatggtagttctacttttagctctttaaggaactgccacactgttttccagagtggctgtactagtttacactcccaccagtagtgggattgctggatcaaatggtagttctacttttagctctttaaggaactgccacactgttttccagagtggctgtactagtttacactcccaccagcagtgtagaagtgttccctgttcactgcatccatcccaacatctattattttttaatttttttgattatggccattcttgcaggagtaaggtggcattgcattgtggttttgatttgcatttccctgatcattagtgatgctgagcattttttcatatgtttgtttgccatttgtatgtctttttttgagaattgtctattcatgtacttagctcactttttattggaattgtttggttttttcttgctaattcatttgagttctttgtagattctgtatattagtcttttgtcagatgtatagattgtgaggattttctcccactctgtgggttgtctatttactctgctgactgttccttttgccgtgcaaaagctctttagtttaattaagtaccagttaggcaatagtcaccaagcagcatggtactggtataaaaatgggcacatagaccaatggaacagaatagagaacccagaaataaatctgaatacttacagccaactgatcttcaaaaaagcaaacaaaagcataaagtggggaaaggactccctattcaacaaatgataattgcccagccacatgtagtagaatgaaactggattcttacctctcaccttatgcaaaaatcaactcaagatggatcaaggacttaaatctaagacctgaaactataaaaaacctagaagataacattggaaaaacccttctgacattgacctaagcaaggatttcatgaccaagagcccaaaagcaaatgcaataaaaacaaagataaatagctgagacttaattaaactaaagagctattgcagccatttacatccagtatctcatttgggcccagagccaacctgatgaggactcaaagattatttcaagggagggaaaagcacaggtaatgaggctttcttctttttggtgtttttctttattccttactcttcttgctcttctctacttctttcatctcatctctcctatcttttttcctcctttctcctattctttgttctccttattccttttccattaattttacatctcctgtatttgacgtgtgtgtgtgtgtgtgtgtgtgtgtcacttagctgattctagcatgttctggtaatgaatgttttctatctgttatattgttgaacactgcctttggtgctgggcttttattttacttcgatttaagcaatattttaaattcataatttcatttaagttgctaatttgcaaaatttatttagcgcctgctgtcagtctttttcttaaattaagaaccatacagtaaattagttcatactggtaattatattttctaaaattattgaagcaaatcaaacccagaatgtcaaagtattttctcaaatgaagctaagccaaacccattatttaagtttgttgctaattctaactgcaaataaacactcagtataatagatttctatactttttctggatcatggatcaggagccatggactattatagtcataaagaaacatcaagagcaactttttcaaatatctcattttatagatattcatgctaacgctcagaggggtgccctgatatgctcaagatcaggcaacaaatgagaagtagaggcaggtttagaagaaaaacttaagagagaactcaaacttactgccctacactctgttctaggcaaggcagagattgaggcccctcttctccttggctctctgacttctattttgtttcctgctctttatatctgactgtcattagtgggtggttctctatgttctctctctccctctctctctctctcctgcccatttctcctatctctctctgtctgtctgtctgtatgtgtcttctttctcttcttcctttctgtgtgtgatgttttatctctgtgtgtctcttttatctctctctgtcctctctatttgagtccagaataaagcaaaaggagtaagtggaatgtttccctatgaatcagatggcagcagaaagggatttgtttttcacaagacttgaaagtcccacgtgaagctctcccgctctgctccgtgcctggaccggctgctgctgtcagcaggccttgtttctcaccagcagcaggggcaagtgacagttgctttttctgcttcgggtttgattttgtgggcattttatcattggaggggtgaaatgttatgaaggaagatgacaacaacagttttttgtcatattggcaaacagggtcattactgtacattcgtaaccttagagaaatgagtttttactggactatcagaaactacagcacaggatataatgaatgtatcagagctcagaatttgtttttaaatgaaattacgtggaaaaatgtaccaatccttaatgaatgtaatcactgtgtttttcttcctggcatgtgtgtttgtgtgtgtgcgcgtgtgtgtttgtatatgtgtgtgtttgtgcatgtgtgtgtgtgtgtgtgtttgtgtgtgtgatcatgcatacacacaatccagtatcttccaccgggtgtccccacggcttctagcctttggggttaccctcttctctaatattaaagagaaactcaagccctcatcccacggactgtgagagattgggtggcttgttttcctccttcttctctccagtagtcccaaggatttttaggaggttatttcatttcttctggctcccgccctgtgactccctgttctgttggattctcagtccttcctttgcgtcttgtatccagcacatgacgttcccttccacgtgtgccacatgctgccctggattctttcatgtcccaaagtactgcgagtgcaaggtcctgcacgccacaaaatttcactggaggtttggggacaggcctggcgagttaagcacatcacagtgaaaggaaatcagatcagagtaaaatgaaatcttagacagcaatgccttcacaattcacctgcattttcctggcaggaggagtttctgggtgattttactgtcattgttgctgttggttttgcctgctatgcctcctttaagcctcgctgattattccacactctccccatgcactttctttttttatgttaattagctttatttaatcatgctacattgtatgcatatttcaagacattgtaccccataaatacatacaattataatttgttaattaaaaacttaaaaagaaatttaaaatgtagtggctgaaaagaataaacagaaatcaaataaccatgttagagattattgttaaactccataaaagttatcagtttgaactttaaaagaaaaaaagccagttgctttcattactagtttgagctttgctctacccagctgtaaaaattcctccctttctataataaatgtccactcaccctctcactagctgccagattcaaatcccaagctgctattcttttccatgtcaagcacttgagctattcaacccttacctcagagtagaatctaagccacctttgcagaaccaaaattgaagctttgctaaataaacagtctaaaactccctgtctaacctttcgcaccaaaagaaacctctatggaattttgaaatcatagtttctttaacatgatcaaaatcttaggcaagtttctttaatcagggttagagtagagctattctctccacatactgaataagacctaggggagggaggattatttttcagtttgtgaaaattatcactggtattgctttcaatatgacttcctgtccccctctcttcttcagggactcaaataacaaagtttattagacctttctttctgtttcatgcatctcctactatgtttacttttcattctatttttttttctctgcatttacctgggtattttgtactgacacttcatccagttctttattcccctattcagtgtggataaccagctcccaaacctatatattaaatccctaatttcaaaatattatagtgtttttccattctagaatttctatttgattctttctgtatgttccagttctttggaactggacggaaactcttcacattttcctctttttgaacatatttgtcataattaaagcccatatgttataatgatacctcattcacctgttgattactctgaattatttttttcttgggtttcagtcatttggttttggcttctggcatgacttgtaatatttgattgattcagtgccagaaatcgtatatggagggggcttcaagatagctaactggaggtatctggtacttgcctcctccacaaagaagaaccaaaatagtgagtagataatcaaactttgaatagattatctaagaaagacactggaattcaacaaagaagtgacaggaaacacctaaggcaaaaaaggagagagaagcaaggcagccagctcagctgggattggccaggagcccagagaggctcccagtgcagggaaagggtaagtgagagacccccagctgaccacattcccaccatggacttctgcaatcctagtgactcaacccctgcaggctctgagactaacatggggagctgcctggaaactctgtgaccgcattgctcgagagaagctcatgctggctcccacacacacccttatgtcttaagtggctacaacaaagtgccactttgagagcccagcccccagcagaatgcatcctgttctggggacccatggccccacatctttacatccctgaggcccattgatatcccccatccatagctgccatcgctgctggctgctgttaccagggccaaagcaccagcccttggcagcactctcaccaccagcagcagtgggctgttgtgcatttataagtgccctgaggacaaggtaccctgcctgccaccaccaccaggctgaagtgcacactccccagctgcctgcgtatggctgctgccactgaaaaagcaaccctgctctcctcagtagcagggccgcagtgcagccgctggttccccaacccaggcatttcactgggggcctggggatcaccctgtcactgcctaccacagccagtgcctgcaggcaccacttggggagcctgaggacagactcacttagcctggctccaccacctccagtgcctgagctcgccgtctgggtacctgaggattctcctgccctgtgcaccataggcacctgagcatctctcccagggacctaaggacaggcttacccaacctgccactaccaccacagctggcacccacctacatgtgctaccacctgtgggcctgaggactggcccacccagctcattgcagccgccacagaccccagcatggaccacttggaaaccagaggattgtcatgctgctactactgccattgctcacaccacacctgccatccaggtgcctgaggacccacccacctgcccagcccacagctggcaccggagaaagccacctggaggcccaagaatatgcctgcctggtcctgctagcgctagtaccagcatagcctaccctgaggctgaaggatgggtattcttggcccgtcactgccaccactggggcctgtggactggcctacctgtcctccttatctcagcaaaacttcaccatagcttctagtaataactaccgtaagccactgaggaaattacagataccactgatgctgtttacagccaaataaatcatagagaaactatactactgcatatatccagaatcaaagccaaagtgcactaccaaaccaacatcataggtacatcttgaggaaaaaatccttccttagcaagaaaattcaaacaactggagaagtgactgttgtgtcagatgtgcacatatcaatgtaaggacacaagaaacataaaaaagtggggaactatgacacctcaaaagaaatacaataattttctagcaacacattccaaagaaaacaaaatttatgaaatcctgggaaaagaatttaaaatagttatttgaaaggaattctgtgagatgtgaaagaaaacagataaataatacatataaatcagaaaagcaattcaggatatgaataagatgtttaccaaagagatagatattataaaaagcatcaaacagaaattctggaactgaacaatttattgaatgaaattttaaaatatgtttgaaagctttaacagtagactagatcaaacagaagaaacaatttcaaaatcgggagacaggtcttttgagataacccagtcagacaaaaaaaaggaaaaaggattaaaaaaatgaacaaggactttctgacatataagacaccataaagtgtccaaatatttgaaattttggtgtaccagaaggtgaagaaaaaaacaaacaaaaaaagggatagaaaacttatttagccaaataatagctgaaaacctcccaagtttagaaagatatttagacatacagatgaaggacatttactgatccccaaatagaaagtgtaaaacctatgggtaaaaataaatagaagactgaaatgttaccactacagaaagccaccaaacaacaatgctaaacattaacagagaaaaaaaaagatatagaaaacaagcagaaatcaattaataaagtgacagcaataagccttcacatatcaatgataaccttgaatgtaaactgattaaacttttcacttaaaagttatagactgactgaatggataaaatacataacccaactgtatgttgcctacaagaaactaatctcacctgtaaagacacatatagactgccagtaagtgatggaaaaaaatattccatgcaaatggaaaccaaaaacgggcagaagtagctatacttatatcagataaaataagctttaaataaaaaacagcaaaaaatgaaggttattatataataataaagggatcaattcaacaagaggggtaacaattttaaacatatgtgcacccaccaacagaacactcagatatgtaaagcaagtattagttttaaagggagagttagagtccagtacaataatagttgagggtttcaacaccccagtctcagcattagacaaattgtatagacagaaaatcaacagagaaacattgaatttaaactgcagtttagaccaaaaggacctttggtatttatagaatatttgaactgacagctgcagaatacacattcttctcatcagcacatggaacattctccaggatagttcatatgttaaacctcaaaacaagtctcaacaaattttttaaaaattgaaatcatgtcaagtattttcttagaccacaatgaaatcaaactagaaatcagtaatgatgaactagaaatcaataacaatggaaactcttcaaacacatggaaattaaacaacatgttcctgaatgaccactgggtcatggaagaagttaaggaggaaattaaaaaatatcttgaaacaaatgaaagtcaaaatgcaacataccaaaagctatgggatacagcaaaagcactgttcaaaggaaagtttatagtgataaatgcctgtgtcaaaaaaatagatttcaagtaaacaatctaatgatgtatctcaaggaaatagaaagtcaagaacaagccaaaccccaaactagtagaaggaaagaaataataaaggccagagcagaactaaataaaatagagacaaaaaaaggatcatcaaaacattgttttaaagatcaacaaaatcaataaaccactagctagagtaaccaaggaaaaaaaaatgaaaagaaaacctcaaataaaatcagaaatgaaaatggagacattacaactgataaccaccaaaatgcaaaagatcatcagaaactattatgaacaattatacacttacaaactggaaaacctagaggaaatagaaaaattcctggacacatacaggctacaaaaattgaatcagaaagaaatacaaaacctgaacagactggtaataagattagattgaaacagtaaaaaaaagtctcccaacaaagcaaagttctgcacctgaggctttactgccaaattctacaaaatttacaaagaagaactaacaccaattctcaaactattccaaaaaatcaaagaggagagaattctcattaactcattctaagaagccagcattacgtttattccaaaaccagtcaaagatggaacaaaaaagaaaactacagaccggatgaacatagacacaaaaatccccaacaaaatactagcaaaccaaattcaactgcatatcaaaaagataatataccatatcaagtgggatttatcccggggatgaaaggatggttcaacatatgcaaatcaataaacatgatacatcaaatcaacagagtgaaggacaaaaaccatatgatcatctcaatagatgtagaagaagcattggataaaattcaacaactttttatgttaaaaatttctgggaaagtaggcatagaaggaacataccttaaaataataaaggccatatatgacaaacacacagctaacatcatactaaatgggcaaaagctggaagcattccccttgagaacaggacaaggataccactctcaccactcctattcaacatgctactgaaagtcgtagccagatcgtcaggcaagagaaagaaataaaagacatccaaatgggagaagaagccaaatcatccctctttccagatgacatgtatgtgtgtgggtgtgtatgtatatctatatataatatagatatataaacatatatcatatataatctatatataaccatatataatcatacatataatcatataatatatataatcatatataatacatataatcatatatataatgattacatatatataatgtaatcatatataatcatatatataatcatatataatatataatcatatataatcatacataaaatcatatatataaaatatatataatcatatatataatcatatataatatatatataatcatatatatactcatatatatataatctatatatataatcatatatatactcatatataatcatatatatataatcatatatatatactcatatataatcatatatataatcatatatatatataatcatatatatatatatatatatatatatatatatatatacacccaaagattccaccaaaaatctcctagatctgataataaattcagtaaagttgcaggatacaaaatcaacatgcaaacatcagcagtgtttccattcaccaataataaactaactgagaaagaaatcaagaaggtaatccatttacaatagctacaaaaataaataaataaaatctagagataaatttaaccaaggaggtgaaacacctctacaaagaaaactacataacactgatttaaaaaattaaagaggacacaaacaaaggtcacccatgctcatggattggaataattaatattgttaaaatgaccttattacccaaagcaatctacaaattgaatgaaatccctatcaaaataccaatgtcatttttcacagaaagaaaatataattataaaatgtgtatggaactgaaaaagagcctgaatagccgaagcaatcctgagcaaaaagaaccaagctggaggcatcacactacctgacttcaaaataaactacaaagctttagtaaccagaacaggatggtattgatataaacacagactcatagaccagtggaacagaatagagaatgcagaaataaatctatgtgtttacaaccagatgatttttgacataggtgccaacaacatacatagggggaaaacacactcctcatcaaattgtgctgggaaaactggatccgtgttcagaagaacgaaactagacccttatttctcaccatatataaaaaccaatccagaatgaattgaacacttaaatgtaagacctgaaactaaaaactagaagaaaacagaaggggcaatgcttcaggagattggtctaggaaacgattttatggctaagaccttaaaaccataggcaaaaaaccaaaaatagacaaattggactatatcaaactaaaaccttctacacagcaaaggacacaatcaacagaatgaagagacagccttaaaaatgagagaaaatatttgcaaactattcatctgacaaagaactaatatttagaacatgcaagaaactcacaagtcaacagcaaaaaaccctaataatccaattttaaaatgggcaaaaaatccaaatgaacattcctcaaaaaaggacaaacaaatggccaagaagtatataaaaatgctcaacgtcactaagtattggggaaatgcaaatcaaaaccacaataaaaatatcatcttactccagtgaaaaagaccattatcaaaatgtcaaaaaataaatgccggtgagcatgtgggaatgtaaattattatagccagtatggaaaacagtatggaaatgactcaaaattttaaaaacagaactgccatatgatatggcaattttactactcggtgtttatccaaaaaaaaggaaatcagtatatcaaaaagatatctgcaccccatctttattgcagcactactcacaacagctatgaatcagcctaattattcctcagtatatgaatgcattttaaaaatgtagtacatatacatggaatacagtggaatactattcagccttaaaaaaattgaaatcatgtcatttgcagcaacatggaggactaggaggtcattatgttaagtgaaataagccagtcacagaaaaattaatagtgcatgttctccctcatatgtgggagcttaaaaaatgttggttttatggaggtaaagagtagaattatagataccagagactgggaaggatgtgcaggtagttgggcaggaatgaaggggttgtttaatgggtctgtacaattacacaggaagaatacagtgtaatgttcaatagcagagtagggtgactatagttaataacggtgtattgtatatctcaaaggagctagaagggagcagttgaaatactctcaactcatagaaatgatgtatctctgaggtgctagatactataaataccctagcttgatcacaagtgcctgataaataggtacacatattatgtgtcaagttttaaaaagaaaataaataaactgtgtatgaaaaaatttaatgacattttatttccccagtgatacatacttttgagtgaaaaatagagtgagggcagaaactaagtcagattcttggaggctgtgatttaagttttgtgagggtttgttgtatttccaatttctcttactcctagggcccagctctgaagagggctgaactggcaggtgtttaccaggtactaaaatgtcttaatttctgcttagatttttagccttttaacagatgctgtctgcatggtttctgggcctctctcctaggatgtggaactgaaagactggcaaatgtctctaagggaaattgcattagatgaaacataaaaactctgagcaactttgatcctgaaagaagttttgattttgcaatggtacatattttacacctgtttttaaataatttttagtgttttttaaaaaattaagaaatcacattatgaatccttgtgaaaaaaattatctttttctaagtttttgtttccattttttctttgaacattttgatttttatgtattaacttttactgatatgatgcagtaattattaaaagtagtcgaacaggctgggcacggtggctcacgcctataatcccagcactttgggaggccgagacgggtggatcgtgaggtcaggagatcgagaccatcctgactaacacggtgaaaccccgtctctactaaaaatacaaaaaagaaaaaaaaaattagccgggcgtggtggcgagcgcctgtattcccagctacttgggaggctgaggcaggagaatggcatgaacccgggaggcggagcttgcagtgagccaagatcatgccactgcactccagcctgggctacagagcaagactccatctcaataaataaataaataaattaattaataataaaagtagttgaacagatcatattttgtacagtgaatttcatgccttctcatctccaaattaaaatatggttttggatatacgttcatgattcaaaatttgtttcagtatttaaagcatattaatcctttcaagtctatttttcttggtaaatgaattaaaggaaaaaatactacaaatatctaattgttcctgaattcaatacaaactgatattttaaacttgtaaaatgtatatgggaaaaattcaatataaacattgaaaaagctctttcagtgtagaaagggctaatagttaaaaagaaaagcctagacagagtggacaagataaaccagttgatgaaaataagcttgttctagcacttagtgaaacaagtgaacaaagattggggactgcagtacagcttttaattaatataaaaaatttaaaacagacggagtgtttaatttgtctctgaatatgagatgaaggattttaccctcttcaggtgaaattgaatcttgtatgtaacacagatggtttgtgggtgtgtattttccctgtaagttgggtattatttgtttcatgaatgaaagttccctgaaaaggaagtaggaggaaagcaactttgttccagtgaacagtttgcaaactggggagacacagcttttgttgtaatgcaatgatgttctacagaataaagaaagggtttgggctttatagcaaaagttccctcccaggttttctatcaagtctatttatgcaaatgaaagattgaaactcgcttagttcttattggtcagcacagctgagctatgactgatcaatatagctgagccctgattggttgatacagctgagcccagattgacacaggcaggaaggctctgattgattggcctccaagccccaaaccagaattctctgtcagatatttctttcaaacagcagttggcggggagggattctcagccacagtctgttttatcaccaaacataggaactggtttggcttcattgtagaaagggaggtcctgtgatacgtccacaacatctttctgagaacagagtacctgaccactccctctcacagctattgctgcctgtttctgtatttactttgagcacctcagttggccatgcagagtctgttttgtctttcagctgggggcatactttaacggtttatgttttaatttctttttattttaaagatttcatcagttacagggtgcaaacattccagggatggcaattcagtatttctttcagctgatggttttttaaaagggccagtctgttcagttttttgctctcgttgtagtcttactggggaggggagcactagcaagagagctgggagcttcctctagcagccaacatagctttcctggtcttaacccatcagctttgcttgtgcctccaagaattcccttctgctttccaggtttctgctgctgaatcttaggagagaaatgctctgtgcatttctcaagcacagaaatgagatttgtccttaaacaaaaatgtcaatagttcctacgtagctgaaactgaaatgacaggggtaatgatcctttatctctacctctccgtcatgaaagagagagactcatcttctagtaaattagctcttccctccgtttattgtaagaaattatttatttagttgctaacccagtctcttcttataagacagtgctaaaggaaaaatggaactttaaaaacattacacagcacactattgtaggtcatgaaatagtctgaacctatttacatctagtttttttgcctttcagcagctaggtattaaaacttaggaaccccttgttgtatatagattactaaattttcatattataaccctttcctctttaatgtaaaatagcctaaaagaatcttccatcagaaaccacttcaacaaaacctaaggaattgggtggttcaatagataaatagtactgttccacagggagtgaggttcacgtccagcctcaagtctaaattaaatgagcttgatcgtatctcttcagtctcttgtgagcagcagtccagaatactgaactgtatgaataattccacagtttggcgtgattgatagtcttggctcaggagagtcccagaattgaactaacaaccacactaaattgtatcacatctttaaaggagatagccctgtttagtgagggctcagttacacgaaagggccatgggaagtagcatgcatcatccttagtctgggaagaggtagagaatggcttccagctctgctcctgggctcataattgaatcaggttttgcagctcaaatggcaccaaatgatttattttcttctcttgggctacctctagcttcgacgtttttgcatgtgatatggttttatatctactgataaatatgtgaatttttcttgctaaataatttgtctctagcagtgataagaaatatctgtatttcaaatatataaaaaaatctccatggctgtagtctgtgtacattctttggcgtacaaaaattcattgcatttatctacctattatttagctattttttaaatattttgtgtggtgaaacctgggaattcaggggagtgtgttgctttaatttaaagaaccacaagtgtcataactgcattaaaattttactctccttataacctatatttaatcaatcatattcattgacttttaggctctgtagtcacggtagttaaggaggagttcaaacagaaatatataaaaggtatagctttagcaatctgtattatttaatattttaaaatttttattaagctttaactgaacgacagctacttgcaatgttcaagcttattaattcagttatttaaatgacatagaaaacttcttttaatgtatgtagatcagtctctggaagaaaacttagaagataatactgtaaactaatgattattaaataaaatcaacctttttttctgaaaggcaacatgaacaaagcaatacattttatctagtaaaagtagaaaatgtaagattaattgcttccaaaaatgttagggttcacatgaccttgagattattctctgactgactatcaagctaacatatgagatagcagagatttttccttggaactgtctagaactgccatagtacttgactgacagagcttgctgtcctcccgctctctctccctaacccccccacactttctcccacccccatttctctctcttattgttccactagcaaatgttaagcatccatgataacacaagaaagaacagtggcatattctgttcttaaatgtaaattcactttttctctaactctgtagacttcagagtgtacatttaggctgtggtttggttttgcaaaaaagcagaaatgaaaaatactatatgaacttatcaatactgccttttaaaaatctattaactatcaagatggaatattaatgtagaataccaattttttatttttacaaaattctaatatataatgaaatacctataacctcaatattttccacatagtttttatttgctaattgagtagtaaataaaacaatgtaaaataattgttttgcctgtggataggcttatttaaaagtaatatcatctttacaaagtgtgcattcttattgtatgttagagtatcatctaccacttcagagactgatgaaatgtttcagtttgtatgtgttgctactaagcagctcaaagcaattgtctagtttaatgtatttccaattaatttttagttgcattagaaaacagaatgatgctttggttatttagctgtgaaaataatgaagcaggtgttttgaaatccctgaccttcatgttcaacatgaaaaacatgggtaatgtatataagtttgtctttagcttccctcacttagacttacagactagaaaaacagttacaaaatttcctgagttgcttttttttttttaatggcctaaaggttctcaatttagaattggttgctctaaatatttaaacattatttttttactgcacaaccctttagcctaaaatattattatcattgtatcagtatttctggtgtccagagctgcaattacacttcccactaattaatttggagtgatttttttctccaccttattagcattcattcattaaccgaataagttttgaggcttactgtgtactagacatgtgctggttgaagaaactgtactgatgaatgaaaacctcatgtcaagtagcttttggtgagtatagggaaacaaaaagagtaagcaaataaatgcagtgttatagcaagtgtatttttttgtctcttcactctgtacattggttcatatagtactttttagagatcagtgttgattattcctgtcagctggttttacctttttataaattaagtattagcctgatattagtagctgagaatactagcaaaatgagcttaggatggtaattaatccatcgtgacaaaccagttgcagaccaacagcatctgctactgctgggtaactagacgtatatcagatattatgtagacataaccattactccctgtttcatgttaacgtacctgggtttgaaattaaattattttgacattgtctgtagttgctcacacttacaagaagggaacctgcaggcaagtgagatgaagagagaaagaaaaggaagaagaaaaagcaaaaggggagagcgggctgaccaggtgaggtgggtagggttcataagcaggagagaggggaagcatttcaaattcccctaatggttttgaaatctatttttgttgttgttgttgttgtttgtttttgtttttgtttttttgagacggagtctctctctgttgcccaagctggagtgcagtggtgtggtcttggctcactgcaagctctgcctcccgggttcaagcaattctcctgcctcagcctcccgagtagctgggattacaggcacctgccaccacacccggctaattttttgtatttttagtagataccgggtttgcccatgttggccaggctggtcttgaactcctgacctcgttatccacccaccttggcctcccaaagtgctgggattacaggtgtgagccaccacgcccagcccaaaatctgttttaatgttccatttgtgttttcaggggagacatagaaatagcgtatgatttattgatgatactgatcctgcctcaacgttttgatattctctttgtttggcagaaaggaggctgaaggcccttctgatcctagtcagcagcagctggggtgttacagtcttggtgtccaagggcccaggtctggcactggaaatggatgtgtggggcccagcctgaatcacaccccaggtcctttccgtactgcttccatttcctttttggacttctttctccggggctggcaacagccttgtacgtgtacacatgcctggggggacagctgggctccattggcaggtgggagcagcctggcgacatggtggtggtgggagaggagcctctggacatggtgggaagcacaggagcctggaggcttttctcctgctgttttctctttgctccccagggcaagcacataccctgttgcttgcactgagtctactctccaaagcaaccatgactcgtgttaaggtggaagatcaagtgcaaggcggtgccagttaaatagtcgggaatatttactggtgcaaaactgaggatcaaagagaacaagagcattcggttttagagaaagtcagaaaccccagagaccagccacagacttgcatcctgatgcatcaagagccccaaaaggtggagattattttcttttgtcagcaggttttgctgttagtctacggtgacagtttccttttaagtagtttaagttgtcaaattacccttaatcagcttcaccacgatcagcagctttgccccgctttacctggatattaataaatgttggtcaggtcaatgttatgttatttgtttcccagggctgctgtgacacagtaccacaagaaagggaggctcaaaacagcagaaattggctgtctcaaagctctggaggccagaagtctcagatgagagtgttggcagggccgtgctccctctgaactctgcggggcagaatccctcctcgcctcttccagcttctggtggtctcagtcagtccttggcttggggcagcattgctcctgcagccgcatggccttctccctgtgtctcctcacacagccctcccctggatgtgtctctgtttccaacctcctctgtttggaaggacatcagtcatactaggttaggacctgtctaaagacctccagtcaacttgactacatctgcaaacaagctcacatcacgaggccctgggggttaagagttcaacttggctttttctggaggggagggacacagtgtaacctattatcagttttctggggtgttcaagttggagtatatttctttgtatcattcatgacgtttactgcatttttaatgtaggtagtgggtaaatctcacctgatctttttagaaacacaaatacttacctttttgtcagtaaagcgtttaaaaaaaaaaaaccaagcaaacataagaactagtgatttagaggtaggcagtagagtgagacagacttgagctccagcctcatgtctgagactcactagaaaatgaatttgggcttagcctccctggtctcagggtcctcacctggagaatggatgtgtggggcccagcttatgccttcaacactttcacagcttcaacacttttgaagtgcttatgctgtcaacactttcacaatgattttctgctcctcgataaagaaagcacgcttgatcctgtcctgaacacatttagcactcatggaaccaccacaggccctgctgacatgtttttttgttttggacaatctcataagaactttaggtctcacagcacggacccctcaaagtctgcctgggcacacaccacatgcagagttttggtgttttccacaccttcttgggataaaggtagtcaattctattacaaggggctcgggacagcctagttttgctagagctgtattgtaggaagcctaaggcagtatgtctaagaccattctgagtgcatgtagacaacgacgtccatggaagaggctgtgcgtttcctagggcaaaggaacattttgtttgttttatttttatttcactgtttacttttttttttgtctcacatgcatataaaaaaggatcatttggaatggttttccttttaaaattaagaagcccagaactcgaatttaatctgagttaggaaatctaacttgaattttaaaactccataaaggacatatatctagccccaaccccagtacctagagacacaaatagaaataagctggacttagactctcagccatttgctggagagacaggccaggtatgttactttgggtgcaaagcaaggctagatgaaatttagttggaatttctatcgatgatacttgaatttcatgtttaaaggtattaacattttttcactaatgatataaaacatgcttatgctttagtgagaagggaaagccattgaaatcctgagaataataagatgtttgactacatgcatcacctagccatccttcagaactttaagcaaaagaaaataaattactaaaaacaaagagccattaattagaccagtgtggcttatgaaacgtttggagctttggaggtagtgctttgcaaatctagctggcaaaaggtttggaaaactatgccagccttaagattaactctattttatgaaaaataatgaatttcaaatattcatattctatattaatatttaaatattcatttaaaaacccatttttaaaatagctcagataaggattttttacagcctatctcgtttgtatgacagactgttgcacacaatggctcatatacaattcttgaaactgagattcccaagcataccagacatatttttatgtctttagacttctaaatcaatcatatttggtagctcctcttaattacctgacctatggtggtcattttagttgtagcatctgttccatttatccatgtgtaaaagtatgctttgcttttaacattaatttattcacttgacaaatatttatcaagtatttataatatgttggacattgacttgacactaaggataaagcagcaatcaaaacacttaggatcctttgtttatggagcttagattcaggtatgtggaggcagacaataaaaatgggtacacatatgcgtgtgtgtgtgtgtgtgtgtatatatatacacatacacataaatatacatatacacacacatatatatagcatatagagcatatatagagtgtatatatagagcatatatagagcatatatatatatatatatatatatatatatatatagagagagagagagagagagagagagagagagagagagagagagagagagagagatgaaatctcactccatcacccaggctggaatgtagtggtgtgatcatggctccctgaatcctagaactcctgactcaagcaatcctgcctcagcctccggagtagctgagactacaggtgcacgacaccatgcctggctaacttttttttttttttgtagtggagatggggttctcattatgttgacaaggctagtcttgaattcctatcctcaagcaatcctcctgccttagcctaccaaagctctgggattacaggtgttagccaccgtgcctggccaacacatggatattatagcgggtgtattggaagacaataattgttaaaagatggatctgggaagggggataaggagtagggccggggatgggaacttgtataactagaggggtcagggtgagcttgctgagaaggcgacatttaagtgaagacctgaaagagatgaaggtccaccacacgcactctgtggaggagacctgccgtgcatggaggggtgggtctggtattttctgcaaagaacaaggaggtcagtgtccccagcatggagtcactgctggggcaatggccagcatggttatggggccagaagctttaggctatacagaccatggtaaggactttggcttttactctgagtgataaggcgaggcagtctagggtttcagcattggaataacatgatctgacttacatttttgaaggatcccttgggctcctgagttgagaagaaattggagaggagcaagtgtaggaaaaaggaggccatttgggacataagtgcattcatccaggagagagatggttctggcttggaccaaggtgcagatggtacagatggtggaatgtggttggatcctggacatatgaatgtgccagcagtatgacagaaaaaagaattctgtatatatgcactcagtcataacaaaggtctaatacccagaatctataaggaacttaaacaattgaatgagcataaaacaaataaccccattaaaaagcgggcaaaggacataaacagaaacttctcaaaagaagacatacaagcagccaacaaacatatgaaaaatgctcatcatcactaatcatcagagaaatgcaaatcaaaccacaatgaggtaccatctcacacctgtcagaatgtctgttattaaaaactcaaaaaacaacggatgctggtgaagctgtggagaaaaaagaaagcttataacactgttggtgggaatgtaaattagttcattcactgtggaaagcagtttggagatttctcaaagaacttaaaacagagctaccatttgacccaacaatcccattactgggtatataccgaaaggaaaatagattattataacaaaaagacacatgtactcatctgtttattgctgcactattgacaataccaaagacacacatcaacctaggtgcccatcaacaatggattggataaagaaaatgtggtacatatacaccacggaatactacacagccttaaaaagaatgaaactatttcctttgcagcaacatggatgcagctggaggccattatcctaagcaaattaacgcaggaacagaaaaccaaatactgcacattctcttttataagtgagagctaaacattgagcacatatggacgtaaacatggggacaactgatactgcagactactagaggagggaggaagggagaagcgtgcgggttaaaaaactacctattgggtactatgttcactacctggatgcaatatattcacgtagcaaatctgcacatgtaccccctatatctaaaataaaagtagaattaaaataaaagagagggcattggctaacataatttaaaaggatattgcttcagacccagctagatccagagacacaaacaatgtcagaacattcagcctgtttttcattattcagatgtattttctttggtgttggcttcattctcagctagtttaacagcaccatcaggaaaacattttctctttcccaatagttaagagccaaagttaagactgtaatgcgttaacctggtttaggtcatgtgcccatgccagaatcaaatattgtggccatgagaggtagaataactttttggccagatgaggattgcatacttaccttgctgtttgaatttttgctgtcactcatagccctgtgaacctattcatgacacagcacatagatgtactcaaacgaggcaagaaggaagtcactgcaaggtttgcatcagtagcccatgtgaaagctgctcataaccttactgacatattgtgtcatccctgttactttcacagtttcaggggtttccatgaaaatgctgactgttaagattgttaaggaagctgtctagaggaagaataagattcccccaaatcctgattgtctcacttgcaactgcaaagtatccagcctcactccaagggtgtcacagcatgacagcaggtgaagttgaccttgttattaaacacagtctggagtttctactatcatgtgtctatctataactccaaccttgtatttctatcagagctgcagatccatctcctcctgcatcatgacttttgtaatccagtggttgaccaggcacctggattacaaacgcaactaatctagtaccaaagtcttcatcctctcctttttcttcaccacctctgagtctaccacactccactccacatctgatcttctcatttcctcattttgaatggtggcaccaccttctgcccagtcacttaggactggaatcgatgagtcagtcctagtgtccaccttctcctccaccatcttcatttctacccgcttccctagagtcctgcctttagtctagtgtccttctaatcagatccataccccaagccaggatgatgcatctaagctgtgagcagaggcatgtattcccatatgtaaaatgctttagtgattcttccttcttggagcacctgaggctgtctgtgagctggcccctacctacctctctgtctttgctcacactctttctccttagtaaacggttagtgctccaattatatatttcttgtggttccttaatcaaccatcatttgcatcactgctaaacttttgttcctccttgaatttccttttttctctagtgtgtgtgatgaaaaccagcctgctcttctgtctaggctcaggtcaagtgccccctcttctctgaacccttttctggccctacctcatttaacctctgacacttatgggcctccaccttaccttgggaaactcttctctctgcctctgtaccaggttagggatttttgtccatctctatgcctaatgccctttaccaggctctaagccccactggaggcagagactatgtcttactcatgcttgtactccagtgactaacagttattagcatgtaatacatgtttctgaagtgaatgagtgcatttgtttttctgagaaagttgttgactccactgtttcctctgaaggtgtagttgatgtgattgggccatgttatgggctgaattaaatgcccccagattcacaccttgaagccccaaaccccaatgtgatagcatttggaagtggtgtgttttggggtaattaggtttagctgaggtcatgaaagtggggcccccatgatgggatttgtgttcttatgggaagaagaagagagacctgagctctcttaccaccaggtgaggacacagggagaaggcagctgtcatcaagccaggaagagagccctcatcaggaaccacatctgccagcatcttgatcttggactttgcagcctccagaactgtaagaaataaatgcctgttgtttaagccactagtctatggaattttgttccagcagcctgagctaagacaggtcacatgctacaaatgtgtgctgggaggttggaagacaatggatagtgactgaagaacaaggtagatagcagcttctctgaactgtattcctgacgatgaacgtgcctctgttcaggttgttatgaaagcaaattgacttggatcttgtgttcttcatctcataattaggggactttgattagaagacctctagggtcactttgagggaccacattctacatttatagatctatattagttctaatgatacttgttttgctataataagatgaagatgtctaggaaagtataggataaaaatcagaataactaaaaacttagttatgaaaaggaaggcaaggttttccataattaattgcttataaaaactaccaaagatgcttgtttgggcaggtgaaggcaggtagagtaatttaaagtataaaagatttcctttgtttaaggaatgtagttattaatgactaactctacataacaaaagatttttccaagatgtgattatattagacattaaaagctgttcacatttcaagtaggcaaatatcaaagtttgggatttctaatctcttgttatgtgatgtatttataaggtgctgataaaactctcatgggtcacaaatttattatatgaaattttcagttcaaaatcatgtgtatataatgacatagaataaaacagaagtacccagaattaacattttaatatatagtatgtctatttgtgtctatataaatatctataaatacaaataatgtgtatttatttacacattattgtgtaatacaatgtgtaaatttgtaattatacatttatttaaatataaaatgtatttaaacataaaaagtataaatttataattataaatttattgcacattttatatatacattttacatatacttttataaatttataattttatacatataaaattattttatatgtataaaataattgttactgacctcccaattcaccagtatcaggaggttgttcagtatcaacagaactctatccaggcctgcatattttcaccatttttattttgctattctatttcattgcaattgcaatatatcagttagatcatgggttgaagctacagaaacaatcacctttctagcactattttaacctagattgttattcccttgggcagaagactcttgcctaatacatctttgtcagcccataaagactagtgagatgtcttgccaggaggagctggaaatcagtaaatacttatttaatgaattggtttgaaaatgaataaacaaataaccataacagaagttgagtagggtactagtaatgctggaatacaacaccgtgaaagcagaagcagataatggattacagtggctgaaatcctgaatgtagagtcagccctgatttcacatttcagctctgccatttacaaactagataacttagggcaaattacttaatatcattaaaacttactcttcttgtctataaaacaagtgagcttctctgaaggtaaaatgagataatgctcagtaaaattttcatcacagagtaaactctgatgactttttgaactatttttatggaaagtaacaattacaaaaatagtaagttaatgaaatcataaaggccttcttttatcttcattattggcattttcactaaagatgtgattttaggaactgctttagtaagaaagagaagattcgaagtcctgaggggcagcattccagaagtaggatatggcctatgaaggctggaaggaagggcttggaatgatcaacagatgttctggacatctgagaatctccagacaagttaactgcacacagcaatctagaagagaactttaacctggacatgaatgcgttaggaggctccaagtgagctcttggaagaaggaagccatgatcaatgccttatgcaggaaagtaacctggccgccagcataaggaatgagcaaagagaaggcagtttttgaaggaaaatcctgagctaagattaggaagtgactcactaagtcactgacccccaggatcagaattatgggtttagaaagataaacaacaggaactggtatttagggagggtggcatcttttcaaggaggcttcctctgggaaattctccaagagctttgaacatctgaatgtaacgacatcactttgtactgtagttatgtatctgctgctgtctcctctagagagtgtgatgtaggacattggaactcgctgagctgttatctggaagcatgcccagtggggctgtggctgtgaagatggaagtgccttaaggactcacagctggagttgggtagggtgcgagtagacacatggacgaagggttgcatcagtgattatactttatccctgtggggagccaagaaggattgttaaagcaggagtataatatgaacataattgcatttacaagtacctcttggccagagtcttgaaggatagatagtagaagactgatggcagagacaccagaaaataagtcattaaagtctcgggtcagaggtaaggcctgcctgttgtcttagtccatttggttgctataaaaaatactgtaaactagatatttataagcaatagaaatttatttctcatagctcaggatctgggaagtccaacgttaaggcactgtcagattcagtgtctagcaaagactgctttctggttcaagatggtgccttctatctgtcttcacatagtagaaatggtgagggatctgttttgggcctcttttgtaaggggactaatcccattcatgaagggcttaatcctcatgacctaatgacctcccaaaggcactgcttcctaacaccatcacataggggttaagatttaaacatgtgaagtttgaaggaacacaatcattcagaccactgggccttggctaagaaattggtgaggggaagaagagtaaggaatggattatagtgatgctttagaagatggaattcatggaaactcacagccaatgacaggcctggattcagataaagatgtaaatttggtagaaaaaatcaaagtgagttttcacccactgacctcttcttctcattgtattttgaagtaggaagcaaaagcagctgatgagaataaggaggctaaagctggactagagggcttgagattgtgcagaaggtttgggatgggagacgaaatgcatccaagtcaactgagaggaatatcgtgcagctccgatacaccaatgtggatggtttcaggagtgaagcaagttgaaggatgagttgatgtaggtttggagatttgtttctctacaggaaaagacagggcctggctaagcaggtgtttagtatttgttgaacgaataaatgcttgcctggacactgttgagaaggaatttattagggatatggtgcaagaaaataaagatctagaaacaagtaactaatcttatttcctaagacatctttatcagagaagcctcatgtgacccagagtaggttcagcgccaccttgtatgccccatggcacttggtgccttccgttcattggattttgcttctctttcaattagaagtaggttattcatgaccatttgcgtgatgtcatcatccccaggggtctgttatttctgttttgttgacatggtatcctaagtgctgacacacagtagtcactccatcaatctacagtgctggatacaaagatgttaatggagggaatgacatgtatttttttttttttttttgaggcggagtctcactctgttgcccaggctggagtgcagtggtgtgatctcggctcactgcaagctccgcctcccgggttcatgccattctcctgcctcagtctcatgagcagctgggactacaggcgccctccaccatgcccggctaattttttgtatttttagtagagacgaggtttcaccgtgttagccaggatggtctcgatctcctgacctcgtgatccacccacctccccctcccaaagtgctgggattacaggcgtgagcccccgcacccggccccgacatgtatttttatatattttgttacttgatggtctcttgtaaggttttgtgaattgctttaattagtaagaaaactggtaagctaaatgacaaatggtactttattggaatatagtctctttctggctcataaggaagagaaatttgtgtaattacatcaaaattatatggatattacacagtgattagataaataaatataaaaccgtacagcttcagggcaacttacacctagcctctgtaataattacacttaaccttgacattatttatggtttccttttcccccttattacacgttttatcatactaagtgttttaaactgataatgctcaaaagtagcacatgatgtgtattattatagaaattaatgcttgccttaataacagatgctttctatttggggtttgaaatgaagaagcagatattttcctagaatacatctggaagtgattttattactaaaactgaaaaaaaaaacctttcaggtatcaaatgtgtctggtctgtgatacgtcagatttctgaattcttacacttttatttcctatagaaatctgaaagtgtgttattaaaagttaaactgttctgtagattgtctacctaatttcataaggtttagtgtaatagatatgaaatctatgtcacatctactgtgtggtcttcatatcttagttatatttagaattttgatcaatagattttggtagaacattattgaactttctcttttttttttttttgaagatggagtctcactcagtggcccaggctggagtgcagtgttgcgatctcggctcactgcaagctccgcctcccggtttcacgccattctcctgcctcagcctcccaagtagctgggactacaggcgcctgccaccacgcccggctaatttttttgtattttttgtagagacggggtttcaccatgttagccgggatggtctcaatctcctgacctcatgatccgcccatcttggcctcccaacgtgctaggattgaactttctcttttttaatgatattattttacatcataaaatgtgattttacttaacagcacaaatatgttcttcaaaaatgagtctatcaaacaaaacgttcataaattaaaatcagaatgaaatataaatgcaaattttgaaagctaaatcattgtttatattttaaaatattctatatttcctcaccttaaaaattggatgctattcacaaatattcctaaagaatatttttgttcagctaacatcaaactgtggattacttacatagtgagttacacactacctatcttttcctctgccaagctgtattccagactgccataattaattaagtaggtgaatgaatctctgatgggttgtatgtctgtttctatactcctcagagagtttctctcttccactgtgttagaacaccaaataaattgggtctctatcactactccaggttattatgaaagtaaacatctggttttaccttcagaaaatagcattggttgttcaaaattcaagatatgcgtgtgtacattagcctaaaatttattttttgaaattataatgggattgttatataactccttctgcaagaatattgtcaaacaaaaaaatctgtatctgtctttctcactgaaatattgtgagagttaatgagacatttgtggctagatcgtgcaatcctttcaggaatctcaaagcaagaacaaaacagcatttccttttgaaaggcatatgttttactgtcaaaccaaacttaaagcagtaggaatgatacacatttctgagttaacttcctgctttcttggacgtgtcaaaattactgatgttccagcgtgacagaagcctagtaatgaaggaaccatgtaggtggaaaaaaattattacccgacttgcaatcaaataatagaacataggtatataatattcaaagaaaagaaagtgagagtctgaagtcatgcataaagcaaaatcttcacagtaaattgataggctgggcgcggtgggtcacgcctgtaatcccagcactttgggaggctgaggtgggtggatcacaaggtcaggagtacgagatcagcctggccaacatggcgaaaccccgtctgtactaaaaatacaaaaattagctgggcgtggtggcgggcgcctgtaatcccagctactcaggaggctgaggcaggagaatcgcttgaacccaggaagcgaaggttgcagtgagccgagatcgcaccactgccctccagcctggggaacagagcgagactctatcacaaaaaaaaaaaaaaaaaaaagtaacagactggagtcttacctatgtcttactttttccctaattttaagttagacactaatagaggtccggtaactaattgtattcacttatgtagtacttggtatagattttcatcttaggaatgtcagaataatggtacttactgctgactgctgtatattactgctcaggttcaagacagaaaaccgagagttacttctatttcctccatttcacctcatcctcccgtttcaagggattggtgagaacctttgatgttatcatctccaaacatacatcaaattcctgccctctctctctcctgtccactgctaccccatcatctcttctgtccattgctaccccatcatctcttgcctgaaatactacaaccaacccccttgtcgctccactgtctctcttgccacccatctccccccactattccatagccacaagaagcaaaagtgaccttcaaatgtcactcagattgtatcactccactgcaaggacttaccattgcacttattttaaaaccctaatctctcttcctggcccctgtctgccccttgctcccaagttctgtccattttgatattctttcctttccttaaaaccctgactgtttcctcctggagggcctcggcatggtgtggtttgctctttcccgtgacttaggtctcagcttaaatgtcactatcttcaagacgttctacttgactccttttgtaaagttggctgagaccatttccctccctgctttatcctctcagttgtaatttattatgatgagtgttattcatgtagcagaaagtatctcctttcatgcatttgccgccaattgccactgtttatctgcatgtttgttgcatgtgagctctctgagcacaggaagctggcttacacacagcaccttggagtaaatgaatgaatggtcgaatgaaaagtgctgataggccgggtgcagtagaggttcatgcctagcacatttctataaaatcagttggacgtgaagtttgacagtggctttttcactctgtctgctgccatgacatgcaaatagtgccttctcatgtgagttgcattgttggtgaaatgggcctcggtttcttcacctgaagcaaaagaaatgagagcagataatcaccaaaattccagctctaaaatcccccaggctgtgcagatgccacctatccccagaaatggcttgaaatgccacgtggagctaaggagtctcttcctgaaggaaagaatgagcacagtctgaggagggtgtctggggagcgcatcgatttcggagctgctgtgggaatatacttaggttctactggagagctcatcttgcagaagctgactgcattgaacgtgccggggaccacctggtccccctcttctcgtttggcaagaatcccggctatcgatgaagaaaccagctgctttcctatgtagtgaacaagcacaataatgtttatacagtttcccagcctctcttcccccacccactttcacccttcctcacccaagaataatcgtgccaaatagatatcagattaagaaaatgcttctcattagttgtctgctcaaaacaactttggaagcaatcctagaacatcccgttgtatcttcacagccctttatctcttgaaagttgttgagagagctaaattaaagttgcctaccattaatccttgctctcaacactgtaaatcaaaggaatgaaatacttctcatcacaattcagatcccaaacaggtaaaaattacaacataaagcaaaatctaatactggcattgcccctgtcacctgagccacgtatcctgactgaagtaatcagcaaggggcaggcttgtactgcaactcaacaattgtttcagtggccatgggttgtgtaaatacattccatttttaacgtccccatactaaaaacgagatgtggtcatcttcacttggttcttaaaacggataggttagatccagtctccacagctgttttgcaatttcacgttatagtgacagcttccataatacaaattcagattgtaaagactgacctctcttcactgtcacagagcattctgggtgaaggctttttatctgcaagttgcacttgacaagcgttttagagagggaaggtagcaaaataaagaatcagacaacgagtcaaaggagctaagctctgttccgagaggccctgatattgatttgtggagccttgtgtcattttctctatctgggctccagttcttccatttacaaaatatggatcatggaccatattgtcaacctgtgtaatccacgaagtcagtttttatagatatagagccagcactgatcaaatgtgtcagcctcttacaaccacagcggcattatgaagatctgtaagtgagcacttacggagcttcctaaacaccttgggaggaaaccagtcagtgtctgaacacaaagaatttatctacaacataaaacaaaaaccactgcagagtcagagatcccagtgccctcatcatcgcctcttctaggattacacagtcacggaacgtgtgcatccgcctccagaatcgctccccaaattccatggggtaaatattttactagaaaatgtgagtcaaaaggaaagcaacctgtctctaaagtaaatcttatggaataaggtttttaatattgtgaaaaacacaaactaaccattctttcctaacaaatacccctagggatgggggaagcacaaggatctctgcgatcaagccctgccgggccgcagctttcattaggttgcagaggcagctcttcctttccctgagtgttcctgcatccttgaggcccctataaagaggactcagcgtctgtttggcaccgcctgttctcctccttccttgtgtctcttcgtccactctgtcaccacggcgctcgcagttttctcaggagacacctggatctcaggctctaaggcctgtctcactctgtgacgcatgtggtcatgagcactctgacctccgcatgaggatggtcagatggcagagggcagaacactgggtcagagatctgaaacccagcatgcagccctacctctgcctgtcacaggttttaagactttggcgagtctcaaatcttcaagacctggcttcccttatctataagacaaagagatcggcttgagtgatgtttgagatgttttccaccctgcagtgattcattataaaataatagacatcctctgactcctatggaccagtcaaggattgaagcttcttaaggccagttattcctctgccatctgactcgcacatgtagcagtctctaaagattgcctacttcagtcatctgattgcgtctgtttcacagattcttctggaatttttcttctttcagttggcttttttttatcgtggtcaaaacccccatagtcgactatgatctaaataagcagtgccctctctattaagaacagtgttgaattacctattcttgcaaccacattgaccgagcttcatctctgttataaatcataacctgaacagacaatctcagtgcatcccggcacctgcagattggatatatcagtagaagttccctcatcccccagttccacatgcacagcactcattgaagtgaaagcatgagtctcccatattgaaagacgagaagatcccataacacatctgtgaatctggacatctcaagctgcctttcaatggattttagactgtgatcatacggagggctgaagaattgtctgctctacgtcttccacagtgtactggtcttgtatgtctaacaccctataagagtaaacaatgtgctctgatagatgagaattctaaaaaaatgatatcttctataatgattctttagatttaaatgttcattatggcatttaggaatccctgttataaagcaggttttaaaaatgttttatccaccatgtcatacttttgaagaagctatgatctcaggaataagagataggttacaagagttctctatcatggagaaacttacttttaaaactgtaacatcagtaaagaaaaaaatgtagaacatggacaactaagctttgttcctagtacggtaaagtgatgctgatgttggtgattgctatggattttgagtgggacttagttgaaacacagcataagtccaacatcagtcctcaacttggccccagcactgaccagtcatgaggcagcagaggagtcactgcccctctctggcctcagtcccttgtctgtaaaattagtaaaaggcggtttgccctaaccagttcacactgctgacttgaaagccagacgatgtgaaagtctgttgcaagtgtaatgcgatctttccatctaatgcgaggcctggctccatttcatgcatgatcaccttcagctgtgactgcagcccttgctggtaggacctctctcagggactcccactcacccctaacctttagcactgaatgtcaggttggtgactcccactcttgctctgtagcaagcaaggcaattcttttacttaaatgtcattttgtctttaaagttctaagtcttcttttttgagattcccttctaccagttttttctccccaaattagatattccacaattttcaaccttttttgagcttattcagcatatttatgttgtactaagtcattgtttcaataaagaagaactaaaaaagtgctagaaataaattgtcctgctttgcataaaaccttaagagtagtgtgtgtgtatgtgtgtgtgtgtgtatgcgtgcgcacgctattacagagatagatcttttgcagaataataaaaataactatgggggtcctattatttagacagaaggggttaaatgaaccctacaagcttcttactgtcaggagagaatagatttcagaaaaaataaagacaaggaaacaagccccaaagctataaatttacccacagtgtttaaacactcctttgtgattattttctaaattttctcaggtaccctttttcatttgaaatgttagtggaaagttctggagaagaatttattgcaagtaacgtaataattataaaatagaagaaaagggccctgctgacttgccagagcttgaagcaaaagagaaagttgcctgcattgacggggctcgctcaagtatttcagtttcaacacagctgtcctttctcattgcagatggagggcggctgccaccatatgccacctctgtaataaacaaaagtagtgcaacaatataattaatagcaagccattttcatttttaaaattccaaaaaggaatatgcttttcacgaaaattcaagatgtaatgcccaagtaaattgggcaaaatacagcaatgtatcaatgagattccactttaagaaagccaatatacaaaatattgtacttgaaagttaacattactgtcatcacaaattacttgcttatatttctttatagtactttaagaattgtagtctcacctacttcattcaaaatgactcatcctgtaaccagtcttttcctgggatctgttgtatctccattatataccactgaaaatatttactaaataggttccccaaataaaaatatgatttgttacatagaattttctgcctttttcctgtttcctattgacatgcattgtttccttaaataatgatgatgatattaataattgctaacacatatcatgcttagtgtattgttaagagctttatatttaatcatgaataatcttatccgggagatattattatctccacgttacagatgataaaactgaatcatagaaagattcgtcacttgcctttcttataactcgttagtgatgagtggggcttgaacctggcaatccttctccaaatccgtggtctgagtcactgtcctgtgaattagggctcagtagcaatggctcttttgccacggcttgctatgattgactcttacagcagtgagctctctctacagtactcaagatctgactgtggtactccatctgacttttctgacttttgctgagaactttatggaaaatatgtgaatgtggaggaatttcaagagaatccctgcaataatctgagcttgttttgttgtgttctctctgccttcttgtctggacaatgcctaccaaggtatccagacaggaagtccatgttggctgagaggctgaaaatacataagccaatagatggtaactcaagctgtgcaagggacccagccaccgtcatgtaaattgctaccatgatctaagcttaattatcatagacagtactaattaaaagacaatattgtaaatataaactggccctgatatatggcaaatgattagtatgtattacaacttgctaaatcaaaaacatgtcttaaaatacaagatagtattgcaataagtactagagaatgcgacaagaaaattaatcatctgctctttaccacaaattccttgtacaggatatctgctctttgtgttttgtttcacactttaatgcaataaagtgtttacaaagcataaagcactctgttcatttgtcatgttttactttagcttttccatttttttctctctacaacacttttcactgaagataagtttgctgacatatggcataatcattttttctcttagttacccaattctgcttcacaactttaatttttatatctattcgaaattagttttaattacctcaacactttaaattgatttagctctggttttagaaaaaaattcaaataaaatctttagcaggtccttcttctctccctcccttcttctctcccttttctccctttttccttcttgccttccttcctcccttcctccctctctccctccctcccttccttccacaaatactgctcaagtcctaccataccgagtactgcactgtaaatacaaagatgaaaagttacaaacctgccccctcggaatttgcacatccagtgaggcgattgacagaatgtgctggaaagggctgggtgtgagacgggatttgagacaagagcagaaattcatggaggtgggcagggcagggaaggcttagcaaaaacaaacaaacacgaagatgaacagaataaagtgtatgtttgagaaatcctgaaacccggaggccgtgagtagtgagaaatggaagcaagagacaccagacaaggcgagaagggatgtttggctccagaataacagaggcactgagtagcgtgttttaaaacttaaattgtaagtttgagatttaaatagagaaggaaaacgattttgagttttgacaaaataactttggaaaccattcaaagagtggactgcagctgaatgatgctggcaggtgtggaacagtctagccattatgagggccgaacgaagtgaccctatcatggatggaaaggtgggagggagatagaaatctttaactaacaggactggataaaggactggagttgaggggggaagaaaggtagttgctgataccctccaggttcttataatgaatgagttggaggcagtgctgtcaagagacacaggaggaacagcaggctgtacagaaagataataagataactctggtgtatagatgtagagatggaacagcagtgtggtatccagattaagtattcaagtcatagccactgaaatttggaacgaggtacatatgcctggtttcatttttatcgtttaacttcttttagagaatctaactaatgtaataaatatctataaaacaatattttcttatagaaatatactatcacacacacaatggatgacaaatattgaaaagaagaaaaattattttgttatataattatgtcacacaacaacaaaatcaagatattctaaattctaaatactattattagaagtatcaaataaaaatgaaagtagggtgcatgaatataaaaaaatacgcaaaatgaaagtggttttctttatagtattgataaccaattggaaatgaaaacagggtaaaataccacaaaaataacaacactgtacaagtcctaagaaaaatatagcgagaaacttgcaggacttgagtaaatgagaaatatttgttaagtaagaacaaatataatggtattgcaggttaataaattgtttattatataaatatttaaaattttgtacagctaaaaatactttaaatatagatatgagttgaaggatagactcaaagaaaatatttgtaaacatttgataaataatatcactaacatacaaatagctcctttataatgacaataaaaagatccatagcgtaaatacaaatggaaaagtcttaacaggtaatagataaatgaatataaattgtcatgtaaaagtccttcttctgaactaaaagttaagaaagtgaaaattaaacatataaacaagataccattttcttttattaaaatttcaaattaaaaaaaaaaaccagcaataagtcctagcaacggctgtattgatatttacctggtaagctaagtatcaccaataaaatactaatgttccacttcataaatattcgccaccctgagccccttttttttctcctcgaaccccatcccacccttctccgactgaccaaacccttccaacttcaagagcaataattagaggattaatttgtggcacttgaatgttcctgcctagcttattattaaatatttagaatagtatttctgggtatgagtacagcacaatggggatactcagttatactgcagttgggaatatgaagtgttaaaactttttaaaagagttacattactatgtttattaaaactcagtatctgcttatttttaaacaccccaaaactaccttattttttaatcttataaaaataaaagcactgacatatgtataaagatgtttatggccaggcacagtggctcacgtctgtaatcccagcactttgggaggccgagggaggcagatcatctaaggtcaggagttcaagaccagcctggccaacatggggaaaccccatctctactaaaaatacaaaaattagccaggcatgttggcaggcgcctgtaatcccagctacttgggaggctgaggcaggagaatcacttgaacccgggagccggaggttgcagtgaaccaagattgcaccactgtactccagcctgggtgacagagtgagactccatctcaaaaaaaaaaaaaatgtttataacagcataaatagcccccaaactataaacagcatgaatgctcattacttagaatatggctgaagaaattatagtatatttctataagaaaatattgtgttttatagatatttaaaagaacagattaaatttgtgtttactgacttagaaagatgcccataatgcactgtttacaagaaaaaacacaatgtgtagggtaacatgtacttttgtttagaataccagttttattttagaaaaagaaatacatctctctctggctctatctctgtctctctatctctgtctgcctgtctgtctgtctctctcacacacacatacacacacacacacattgtagacataattctatatggtgtgaggattaaaatgtatgaacaaatacactcccagttgttggggatgggtgaaggggatatgcacaggatattaactttttcttcatataactctgtattgttagacttattttattcagcattttattcttgcccttctaaaaaaaactgtagaaactccagacaaagagaagtctagaaatgacattctccagagttgaaggaaaatagtgattataatagagcatgacaaattaaacacagactatattatttaataagaaaagaaaaataataaaaatttaaacccaccaaataatgaaatgctttgttgaactaagcaatttcctctagaacattgatttttaacatttttaagggtgactcatccttagaagaattggatgaaacacttttcccggataaaggtagctgagttctcaaatccataaattgcatagaattgtataggtttgctgaatccctgttctccagtctcctagttaattatttaattaaaagcaattgtaaataagtgcaaaacatatattcgttatataggtcctcttctcattgttttgataataacctgtctttataatgacctgctttcttaggacgaatatgtttatttcagaattaaagctttaaagctaattcaaccccactttgccagtccaagatgcctttactcttctgttaagcttgccactcccttcctcctggggtgaggtgacatctcactgtggttttgacttgcatttccctgattattagacatgttgaggattttgtcatctacctgatggccatttgtatgtcttcttctctgaagaagtctatttggatcttttgcccatttctttattggattatttttcttgcactgcgttgagttcatttatattctggatattaactccttgtcagatgcatcatttgtacatattttctctcattctgtaggttgtctcttcactttgttgagtgtcttcttggctgtgcagaagaagcttttcagttcaatgtaatctcatttgtctactttcgcttttgttgtgtgtatcttggagatcttatccaaaaaatccttgtccagactatgttgtgaagcccccttttgagtggtgctaataaattacaattatgtttaaattatttgataaaattgtatctcttacacacttgaaatgttggtataattttataatttatctgatttttttagctttactttgagctaaaatcaccttttgacttattttcctgtcagaataaataatatatgcagcaaagaatactaaagatagactaatgaaagtttaatgtgctttctatttaatagtaattcggaagtttacttaaataaaataaattcacaggtattaaaaattctccctcagagcttttagggcctaaagttggtaaataatattcagtccagaaaaaaaatgaaacttagaaattaacagaaatgaatactaaactgcaaaaatttatatttagaaagaagaaaggcctgcgagttttagaaagatatgtagtttaatggtggaatttaataaatggtcgatatgttagcttctttgttcagctaattcatactctttagaaggttcaaggttttcccagtactagttctcatcacaattatgtgaaacacacacatacacacacacacacacacgcacacacacacattttcagtgtaataattactagcataagtttttaattacactgcatacagatctcatgtcattaggcccaggtcataaatgtatgcctaatactcttcagtcagttcaccattgttttacctagtctcttaaaaataaatgtgaaaatgtttattcctctggcttttcagtaggggcagttgagatctcatgtctttcttgccatatattaagaaaaaatgttaattaggtgctaccatgatgtttttctaccaggattaagtaaggttcagaagcagataaatatggcagaattggagaattacaataatactcttgtttttggcatttgttggcttttttgcttagaatttccaagtatgtttttacattaatattctccatttaagaaacatcctatggagtagcaacagggaaatactgttttatctactcaacctacagagacaaagctaaatgcagaaggataatttgctcatttaggatctgatgttctcgaccttccatcacttatgtggaagatatttcatatttgcctgatataaatattggcaatgtatggccccgcctttaagaatctcattaaatttatctgtaataaactatactacaggaaactatggtaattactacaatacaagttaagtgtcatcgtaacaggaagcaggaatgggagccattactttctttttttttatttcaataatttttggggaacaggtggtgtttggttgcatggaaaagttctttagaggtgatttctgagatttgggtgcacccatcacccgagcagtgtctactgtacccaatgtgtagtcctttatccctcaccccctcccaaacctcccactgagtccccagtgtccattatatcattctcatgcctttgtgtcctcatagcttgactcccacttatgagtgataacatacgatgtttggttttccattcctgaattacttcacttggaataatactctccaattctatccaggttgctgcaaatgccgttatttcattccttttgatggctgagtagtattccatggtgtatatctataatatatttatatatttttatgtataaaacatatatatatatatatttacaatggcaaaaatatagaaccagcctaaattcccatcaaccaatgattggataaagaaaatgtgatatatatatgtatatatacacacacacgcacacacatatacatgctgttttcatgactatggccttataatatagtttgaagtcaggtaacgtgatgcctccagatttgtgctttttgcttagtcttgcttgctttggctatgtgggctcttttttggttccatatgaattttaggattttttttctagttctgtaaagaaagatggtggtattttgatgggaatttcattgaatttgtaagttgcttttggcagtatggtcattttcacaatattgattctatccatccatgaacatgggatgtgtttccatttgtttgtgtcatctatgatttctttcagcagtgttttgtagttttcttttagaagtctttcatgtccttgattagatatattcctaagtattttattttatttattttggagctgttgtgaaaggggttgagttcttaagctgattctcagcttggtccagtaagattggtaccaattcttttttgaatgtcagctgtgaatccatctggtcctggattttttttttttttttttggttgacaaattttttctgttagtgtttcaatattgttactattgttacttgttattggtctgttcacggtttctatttcttcttgatttaatctaggagggttgtatatttccaggaatttatctatctcctccagattttctaatttgtgtgcataaaggtgtctacagtagctttaaacaatcttttgtatttctctggtatcggttacaatatctcccattttgtttccaattgagcttatctggatcttctgtcttcttttcttcttggttaaccttgtgaattgtctatcagttttgttcatctttacaaagaaccagctttttgtttcatttatcttttatattgttttctttttgtttcaatttcatgtagttctgctgtgatctttgtcatttcttttcttctgctgggtttgggtttggtttttgtgtttgtttctctagttccttgaggtgtgatgttaaattgtctatttgtgctcttttagactttgcgacgtaggcatttcatgctatgaattttcctcttggcaacacttttgctgtatctcagtggttttcataagttgtgtcactattatcattcagttcaaagaatttttaaattttaatcttgatttcattgttgacccaaagatcattcaggagcagattatttaatttccatgtatttgtatggttttgagggttccttttggagttaatttccagttttattccactgtggcctgagagagtacttgatataaattttgattttcttaaatgtattgagacttgttttgtggcctatcatatggtctatcttggagaatgttccatgtgctgatgaatagaatgtatattctgcagttgttgggtagaatgttctataaatatctgttaagtccatttgttataagatatagtttaagtccattgtttctttgttgactgtctgtcttggtgacatgtctagtgcattcagtggagtattgaagtctcctactattatggtgttgccatatatctcatttcttaagtctagtaataattgtttagaaatttgggagttccagtgttaggtgtatatatattttggattgtgatattttcctgttgaacggatccttttatcattatatgatgtccctctttctcttttttaactgttgttgccttaaagtctgtcttgtctgacctaagaatagctcctcctgcttgcttttggtttacatttgcatggaatatcattttgcactcctttctctaggagtttatgtgagtgcttatgcattaggtgagtctcttgaagacagcagatacttggttagtggatttttatccattctgccattctgtatcttttaagtggagcatttaggccatttacattcactgttaatattgagatgtgaggtactgttttattcatcatgctaattgttgcctaaataccttatttttttttccattgtgttagtgttttataggccctgtgagatttatgcttcaggaggttctattttggggtatttcaaggttttgtttcaagatttagaactccttttaccatttcttataatgctggattggtagtggtgaattctctcagcatttgtttgtctgaaaaagactttatctctctttcatttaggaatcagttttgctggatacgatattcttggctgataattattttgtttgaggaggctaaagataggaccccaatcccttctggcttgtagggtttctgctaagaagtctgttgttagtctgatagtttttcccttagaggttacctatgctttcgcttcacagctcttaagattatttcctttgtcttgactttaggtaacctgatgactgtgtacctaggtgacaacttttttgtgacaaatttttcagctgttctttgaacttcttgtaattggatgtctagaactgaagtgaggccaaggaaggttttcttaattgttccctcaaatacgttttccaagcttttaaatttctcttcatcctcaggaataccaattattcttaggtttacctgtttaacataatcccaaatttattggaggttttgttcatttttaaaattcttttttctttaaaaattttttttatttcaataggtttttgggaaacgggtggtgtttggttacatgaataatttctttagtggtgacttatgagattttggtgcacccatcacctgagcagtgtacacagtgtccaatgtgtagtcttttattcttcaccacccccaccatttcccctgagtttccaaagtccaattatcattcttatgcctttgcatcctcatagcttacctcccacatttgaatgagaacatactatgcttggtcttccattcctgaattacttctcctagaataatagtctccaattccatccaggttgcagtgaatgccattatttcattcctgtttatggccaagtagtatttcatggtatatgcataccacattttctttatcaaccccttgatttaatgggcatatgggctggttccatatttttacaattgcaaattgtgctgctgtcaacatgcatgtgcaagtatcttttttgtataacttcttttcctttggatagatacctagtagtgggatttctggatcaaatggcagatctacttttagttctttgaggaatctccacactgtttttcatagtggttgtactagtttacattcccatcaacagtgtaatgtgttcccttttcaccacatccatgccaacatctagtatttttttattatggccattcttgcaggagtgaggtggtattgtattgtggttttgatttgcatttccacaatattagtgattttgagcaatttttcatatgcttggttttccatttgtatatcttcttttgagaattgtctattcatgtccttagcccactttttgatgcgattggttttttttttttcttgctgatttgtttgagttgtggattctggatattcatcctttgttggatgtatagattgtgaagatttcttcccactctgtgggttgtctgttaactgtgctgattacttgttttgctgtgcagaagcttaaggaaggaatagaatctctgaacaggccaataacaagcagtgagattgaaatggtcatttaaaaactgtcaccaaaaaaagttcacaaacagatggatttacagctgaattctatccgacatacaaagaagaattggtaccaatcatattgacactattccaaaagatagagaagagggaatcctcctttcagtcattctatgaagccagtaccaccctaataccaaaaccagggaaggacatttaaaaaaacgaaaactacagaccaatatccctgatgaacatagacacgaaaatcctcaacaaactactagtgaaatgaatccaacagcatatgaaaaagataatccaccatgatcaagtgggttccatatgagggatgcagggatggtttaacgtacataagtcagtaactgtgataaaccacataaacggaattaaaaacaaaaatcacatgatcatctcaatagatgcagaaaaagctttttgacaaaatccagcatccctctatgattaaaaccctcaccaaaatcagtatagaacagacatatcttaacataataaaagccatgtatgacaatcccacagccaacattatactgaatggggaaaatttgaaagcttcctcctgagaactggaacaagacaaggatgtccactttcaccactgctattcaacatagtgctggtattcctagccagagcaatcagacaagaaaaagaaatcaagggcattcaaaatggtaaagaggaagtcaaactgttgctgtttcctgataatatgattgtatacctagaaaaccctaaagactcatccataaagctcctagaactggtaaatgaattcagcaaagcttcaggatgcaaaattaatgtacacaagtcagtagctctgctatacaccaacagtgacaaatctgagaatcaaatcaagaactcaacccctttcacaatagctgcaaaaataaaataaaataaaatacttaggaatgtacctaaccaaggatataaaaaacctctacaaggaaaactacaaaacactgctgaaagaaatcatagttgacacaagcaaatggaaacacatcccatgctcatggatgggtagaatcaatgttgtgaaaatgaccatactgccaaaagtaatttacaaattcaatgcaattttcatcaaaataccaccatcattctttacagaactagaaaaaaatcccaaaattcatatagaaccaaaaaagatcccacatagccaaagcaggactaagcaaaaagaacaaatctgaaggcctcacattacttaacctcaaactatactataaggccatagtcaccaaaacagcattgtactggtataaaaaaggtacatagactgatggaacagaatagagaacccagaaataaagccaaatacttacagcctactgatcttagacaaagcaaacaaaaacataaagtggggaaaggacaccctgttcaacaaatggtgctgggaatattggcaagccacatgtagaaaaatgaagctggattcccatctctcaccttatacaaaaatcaactcaagatagatcaaagacttaaatctaagacctaaaaccataaaaattctagaagataatattggagaaacccttctagatattgggttaagcaaagacttcatgaccaagaaccttgaagcaaatgcaacaaaaatatgataattagataggactttattttttgtctttgtttttgtctgattggattaattcgaaagccttgtcttttaactctgaagttgttttttctgcttgttgtagtctattgtcgacaatttccagtgcatttcatatttctttaagtgtgtcttttatttccagaagttgtgattgttttttctttatgatatctgtttccctggataatttttcattcttatcctgtattttttttcaattttttaaagttggctttcaactttctctggtatctctttgagtagcttaataataaaccttctgaattttttatttggcaatccagatatttcttcttggtttgcattaattgctgaagagttagtctggccttttggtggtgttatagagcctgttttgtcatattaccagaatgtcttttctgatttcttcttctttgggtagactacttcagtggaaaaatctggaactcaagtctgctcttcagattcttttgtcccatgagttgatcccttgatgtgttgtgttcccacttcccctaaggttgaggctttctgagagccagattgcattgattgttattgctcttctgggtctagccactctgtggagctaccaggctccaggctggtgctgggaaatgtctgcaagcttcaggtctcccagccatggataccagcatgatatggtttggctatgtccccacccaaatctcatcttgaattgtagctcccataatctccacatgtcatgggagggaggtaattgaatcacgggggtgggtttttcccatgctgttctcatgacagtgaataagtcccacgagatctgatggttttctaaagggcaatttccctacatacactctcttgcctgctgccatgtaagacaagcctttgctcctccttcaccttccgccatgattatgaagcttcctcagccaggcggaactatgagtccattaaacctctttttctttataaattacccagtcttaggtgtgtctttattagcaacatgagaacagactaatacacaacacctgctctggtggaggtggcaggggattgaagtagatagactctgtgagagtccttgtttgtagatatgtttattgtgctgactttctcaaatgctgattatgctagcagtgaagttgtcccatggacagacccaggacctctggttatccaggatgctgcaggcagtggaattagctgttgttttctccttccttggagcagggttattatgtcatgagttgctgtaatgtcctgagttggttggcctccacccaggtggtggcacattcaagagaacaccagttttgcacccgtctcatggaatttgcagtggcatgccatttctttcaagggatctgtgaattcttttggttttcctggtacattcttgaggtggttcttggagcaaaagtccatggtatgagtctccacatgcttttctctccatccaagtgggagctgcatgttagccctgtcttctatctgccatcttcctctctgagtccaggagcaattacttttaaattgaggaagaatgttgtgaatttcactagggacacagagtgggattggagcagagatttaactgaataaagaggagaagggtcaatcgaggtagagagagcaatagatgcaggttcagcataggtgaaagctgggacgcttgagttgaggagacagtagcaatgaagccggacagatggatatgcatggggcaagccttagaagagcaagttgaggagttcagatttcatttattgggtatgaaaacagccacatagctgttttggaaagggaagttgttttggataggatcagctatgttctacagaaagctattatgtagccattctatgtagaatcgttggaaattggtaaattttaaaatgttcatagactttaatgaggtaatcctgtttctgagagtttatgctaaggaaacaactgaatctattgaaacagttttatgtgcagcatattcattaaaatgccaaacaagaaagggaatggttatataaactatggtgcaatctcttaatggaaaattaagaaaacactatgaatttaaaagtttacaaagagttcttaataatatgagaacaataacaggttatagtaaaagaaaaagcaaaactgaaaactatgagtatggtttgattacagtagttttacaaaattttgtgggggcaaataggcaggagctactgactggtgaaactattggttttctttctacattacaatgttcaatacatttctctaagcatgtattagttatgcgacgaaaaaattcaatatactttttaaatagcccaatcaagaatagacacgtccagtgctactactctggcaagacatgaaccaagcaatggcagtgagaatgtagagaagggggcagattaagatttcaggtggaacattgttctcatagacataagcataagaaagacctaaggcaaaaaggacactacagctctgacttctacagctggttagatactgatgctctaggtcacaacagcaactgcaggaggagaaacagggtcagaagaggaaacttcctaagtttgatattgaatgtgtttatttggaaggatcctgaggatacctgacagatgtatcataatggcagatggagataaaagtacggtcatgcctcagtagtggtggaaggtttgttccaggacccctttcagatgccaaaaaccatggatgctcaagtacctgacatgaaatgacatagtatttgcatataacctacacacatcctcctgtatactttaaaccatcttgagattacttataatacctaatacaatgtaaatgctatgcaaatatttgttacattgtgttgtttaggaaatcataaccaaaaaaatgtctgttcatattcagtacagacacaacaaatccatttttatgaatattttcaatccttggattgaatccacagattgaaaacccgcagatatggagggctgactgtgttcagtacttcctttttttttttttcttttctttttttttattatactttaagttttagggtacatgtgcacattgtgcaggttagttacatatgtatacatgtgccatgctggtgcgctgcacccactaactcgtcatctagccttaggtatatctcccaatgctatccctccccgctcccccgaccccaccacagtccccagagtgtgatgttccccttcatgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagcctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgagaatcgccacactgacttccacaatggttgaactagtttacaatcccaccaacagtgtaaaagtgttcctatttctccacatcctctccagcacctgttgtttcctgactttttaatgattgccattctaactggtgtgagatgatatctcagagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggctttccttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgctggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggcgtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagcctttcatcccagggatgaagcccacttgatcatggtggataagctttttgaggtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccccaatttcagctcctgttattggtctattcagagattcaacttcttcctggtttaatcttgggagagtgtatgtgtcgaggaatgtatccatttcttctagattttctagtttatttgcatagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcattcagtgctataaatttccctctacacactgctttgagtgcgtcccagagattctggtatgttgtgtctctgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttagaataggtgtggtgtggtgctgaaaagaatgtatattctgttgatttggggtggagagttctgtagatgtctattaggtccacttggtacagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctctggttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacacttaaagttaatattgttatgtgtgaatttgatcctgtcattatgatgttagctggtgattttgctcgttagttgatgcagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagtgtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattgggaaagttctcctggataatatcctgtagagtgttttccaacttggttccattctccgcatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcgcatcggctcttgaggcttctgcattcttcacgtagttctcgagccttggttttagctccatcagctcctttaagcacttctctgtattggttattctagttatacattcttctaaatttttttcaaagttttcaacttctttgcctttagtttgaatgtcctcccgtagctcagagtaatttgatcgtctgaagccttcttctctcagctcgtcaaagtcattctccatccagctttgttccgttgctggtaaggaactgcgttcctttggaggaggagaggcgctctgcgttttagagtttcccgtttttctgttctgttttttccccatctttgtggttttatctacttttggtctttgatgatggtgatgtacagatgggttttcggtgtggatgtcctttctgtttgttagttttccttctaacagacagcaccctcagctgcaggtctgttggaataccctgccgagtgaggtgtcagtgtgcccctgctggggggtgcctcccagttaggctgctcaggggtcaggggtcagggacccacttgaggaggcagtccgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagattccatgggcgtaggaccctcagagccaggtgtgggatatagtctcgtggtgcgccgttttttaagccggtctgaaaagcgcagtattcgggtgggagtgacccgattttccaggtgcgtccgtcacccctttctttgactcagaaagcgaactccctgaccccttgcgcttcccacgtgaggcaatgccttgccctgcttcggctcgcgcctggtgcgtgcacccactggcctgcgcccactgtctggcactccctagtgagatgaacccggtacctccgatggaaatgcagaaatcacccgtcttctgcgtcgctcacgctgggagctgtagaccggagctgttcctattcggccatcttggctcctagtacttccttatttttaagcctgagtaatatcctgttgtgtgtatatactacatattctttacccatccatttgttgaaagacatttaaattgtttccatatcttggctattgtgaataatgccacaatgaacatgggaggatagatatctcttcgtgatcctgatttcaattcctttgaatatatacccagaattgggattgattgctggatcatgtgatgttggtcaaagggtacaaagttttagctatgcaagaagaataatttctggagatctaatatacagtatggtgatggtagttacaatacttcatatttgtatacttgtaatttgctaagagaataaattaaatcttctcaccactcgtgtgtgtgcatgcacacacacaccacacacatgcacagagataattatgtgagataatggacatgtttattaggttgattgtggtgatcatttcacagtgtacacatatatcaagacattaagctgtataccctaaatatatacaatgtttatgtgtcaatgatatcttaaagctgttatttaaaaaggggtcattactggcaaaaatacaataaaatcatcactttcaagtcccataatggaggtgataaaagtaatttagtaatatgttcacatccttcaaatcaaatatagaaaattcgtttgtgctttgatccaaaatagacccccccaaaaccattatacacaaagatgctctaggttagagctagagaaaacagaaactgagaaaaatgaaacattccaccaaactaggggaatggctaattaaattatgatgaatccattcaatggaatattatataacaatttaaaataatatattaacaaaatgaagtactcatgccaaattttaaaaatagcatgtggaatttatacacacagtaagactttggccttatacaatattatataaataagtctagactaatcacatttcaaagtattaacagtaactgtctcaactcttgttagtaacattatgggcactctactctttcttctcttgtttttcaaattcttttctaccaagagcacacattactcttaaaactagagttttttagaaaaatagaaagaatatatgctaagtaatcagggttaaaatgtagactggagaatcctatagtggcataagtcatgggtagtcattaaactccagggagacattatgttgtctctcttaataactgtttagtactagattttataagataaactaaaacattttaatgattcagtcatttgtttaccaaaagtcaattagagccttaggcctttgtcattttgtgatgttcaatgaatgaacatagtgtttaaaattggtttgataaagataaaacttgacattaatgtacagtaatccattttcttacttttcttcagaaaatatgtcatgctcaattttaatttcaagaaaatatagagcaaatctacataaggcaaaaaccctaaagatttgtttgccctaagatatgttgtgctgactataattggattgtcggaatgcatctgacatatgctaatgaaaaagtaagaaagccaaagtatggtttatttgcttatattagtcctttttgtagtcaaaccagcaacacttatttacctccttcttagattctaggaatgaaaaattacaaaaccacatcaccttggcccttaagtaacagatgaaaactactgacagacggcagcgaatcatgtcttccaatgaatagcagaataatgctggaaattggaaaaattcaatgtcaaggtgggcccaaggattcataacagacttcataaaagaggtgacaatttgacataggtcttgaaagcaacgcagtggtaaagaagagagaccttcagataaactcactagattattcttcaaagtggtgatttcagtttccattctaatcagccaggaatgggagttcccatgttcctcctgctagccaatacttgacattgtcagacttttaatctgtgtttgtaacattggacatcttttgctatattaacttgacactatatgtcttctcttcagtgaaatgcctgaatattatgcccaatttctcttgagttgtttatctttttcttattgacttggaggagttctttttgtagtctggatgctaattccttgccaggagatacactccctcctttctcagagccagactgcctgaattgtacacgtcataacagtatgtccttaaacaagttacttagcctctctggctttagttttctcaggagttagattgggataataatagtacctaccgtaaagaattgtgaagatgaaatgggttaatatatggagcacatggaactctgttccgctggtagtgcgtcataataggggcaggctgtcaatgttgttactaacattattgcaacctcccacccaggtgaacgattttctaacccaccttttcctgaagggtgctgtcctctaggagtcctagctttaagcaggaatcttaactccaacttcgtacttgatgtggatctgaggacttgtctccagtcctcatgccgtatgcaactcaggatctccaggactgagaaagccttcaggaggcccatggtctccatcacctggcatgactttcctgcttcctcttcctttctggcccttactttttaaaggattaatgtgagcaggtatttgttattttgttctgcaatgtttctgcatctttaacaaaaattttaagagagaagttgcttgtaaactactcagtatgtcatgttgatgaacgtagaagtctttgtccattcttccctctagcatggtgttcttttctttatgagaattcattctttgttaagcatatgaaatgttttctctcatattgtgggtatatttttatatgcagtacaatttcatagtcaaatctgaccactttgactttattatttctgctctagaagcatgcttagaaagatccctcttaccccaagattacattaaaaatgtttttattatttgtatttccatcctatatgttatatgataccaaatgtcatttagaattgattctgacatgtgaagtcaattagggaatctaacccttttcttcaaaaatgtttagccagttatcacaacccctcttattgagtgatcactctttccttagtggacaaagccctagatgtgggaatttccatcgacctggctgccaactgtactttgtattccttctgcagggcatggccagcagtcacagcaccagtctgctgtttctcacacctgaataggaaagaacttgcactattccctactggacagacattcatattggcagaaagaatatgaaaaaaaagtgacattttaaattacttgtgcaatgagtccaaaaacattatgactagaaatacccaaataattatgggcagaaataaacataaataagaggatatcaagagattgctggaagccccattcttattggtaggaagcagtcagggcatcttcgttcctctcattagaactattacgtttcagaatgcaaatcctagctctggtcctcactgagtgtatagaatggtacaatttatttaacttacctttgctaattcagcagacatttttcagcacctgttatgtgcaagttgtttactggcctgtgagttttaggtaccttaatcatagcctgcattagacagatgtatgccagagccctgctcttagtagaagctcaatacaagattggatagttgctgcccacctaactcttcagaccctcaaccaatttaaattggattaaacacacacaaaaaattcagaaacaagactggcttggccttctatgtatttccttaacattttagtgacacatagaattcctttcttaaaggggattagcattctacatagtaaaacattttaattataaaaattatatttattacatgaagtctgttcttcccaggcaaggtctaatccactatacatgactcattttcttgtgagttttactttagcctcagcctttcaaaatttccgagtgaaatatcattaatcctggtgattcatggcctgcgcctggtattttgcagtctttagtgtgaaatccttcatttagaaaactgcaaatggaggtgagaacctaacatattactttggaacattaattatgaaacataattacaaacacaaatgcctacaatggtaataattttacagtttgtaattgtaccagaaacctccaactggatgtacttgtaacatcctatggttggattcgtttcaatggattgcaaaagagtgagccatcagcagggttctctgtagattagtctgatcattaagatccttgtcctgggttacacatccgaggtagcagtcaactgagtcattttagtctaggccatccaggccagattcacttttcctccctcttgaagacctggaggacagtctctaaatgcaatcaggcttcatctgtcagtgggcagtgcctagtccctgagatagtgccctcccgcaggttgtggtgcagggtactcggagggtcaaaaacttcttgctgcattttctgttttcgcgctggacagacttgcccagaagtcaccctctgagaacactgttggagatcacttcctgggctttcgagtgagggaacccccattgcactcccatcacactccccataccagtgggtcctgtgtggtccaaaggggtccctgtcgctccaaacagaagagagtgtggtggcatccttatagcatcatgttgggagcctttgcagagaaactgatctggatttaaactgtagctctggcattctctccctgtgtggccttgggcatgcatcttaacttgcttcatgtgtaaaatgggtacatcgcagggtgccatgaggactggggatgacacacatggcccagcaggaactcaacaaatggaaattcacgtgatcgtcatttcatatcacagtacacagcatttatctatctgaggcttgatattgaacactcctatgctgcaggctctgtgttagaaaaggaagacacaacaatgaaagatgcagtctctacccttggggagtttatggtttagagaggagagaattaggaaaatgtgaaattacctatgagccaaggcaggcctgaatagtaggggctcctgaaacacttagggagctcttagcccagcctcagatagctgctgaggcaaaaacctcctgagaagctgatggccatgattttgaaggagaggcaagagtctgccccgggaaggccgaaagagccctgtctgcagaggtggtggcacttgcgaggccttggggatgggttacaggtgtgcatggctcccaaggaccttggcacaaccacacagctgagtcctttgtatgctgcagtgtaagctgaagactctgaaatgggtgggttgtgaactgttcaataacctatttgatgcactgtccaaagagttaatgaaatctgaacaaggaggaaatgggtctccaggaggagaatagcagacaccacaattctccaaagagcttttgagtggtgctactggccacggggagatcagtgctctaggatccaataaacctgctctctccactgtacacacaactttcatatttatgtatctcccagtcctagctccagagaacgtcccataagaaccagggtgagccaagagttttttataatgaagtgggagtggcagccggtaaacagaaagcagaataggtttgaaagccttcaggccaaatcaaagagaacagagaaagagaaaaccacaggtctctgtgggtaacttctgatatgactcaagtctctatcttgtacactggaaatagcagcttttctaagaacatgatatcctttctcatttatacggtataattgttactttagggaattgtcttcactctatttggttcttggtggaatttgatttcattatatgatcttgtttgtgggttttggggcttaagctgtagacagcattcacttattcacacaataaaatatagaagttacgctgataagattttgctataatttttatacaaggtaattaaattccagcctaatgtgccaagacagaacattattatatacatttggcatttgtttagccccagaaaattcactcatccaagaagtccactgatagtgtacccatctaatataattaccctattatgcataaaataatgtgtttaaagagttagggaacctgctttcttcactgcagcaagttgtaaatgaaatgaaatcaccctggctataatattaaaagtattgagaacattttttactcagtctgctctaactgagtgaaggcaaatttttcagaacgacagaatattgtacacatttctttggaggtaagaatcttaagaacttctcattaaaatgttacttaggttgatctatataacacattctaggcctctctagttgacagcaaagtaatactggtgcctgtgtgttgcatgtaactgtggcagttcaggaatcagttccaatttgctgaccatcacagcattcgttcattgctagataaggtttctcgtagcacaatttcttgattgacggtcagtcagactcatctgtttatctttaaagccttccttccacttgaccttcaaaatgccttctaatgctatatatacaaatagaaggtgaagaaaaatcatttgaaccaaacaacagagtaatttcaaaactatctttttcaggttaaaaaaagagcagaaatgattaagaaaagagcaactataccttaattatcttggcattgcccacagtgccttgatcatgatatacacccaaaaagtagtcactgaataaatgaatgaatcagttaatcatttagttaatgaaagaaatgtcttcacgttttgcaaaacagtttggttaagtagttggtggaagttctgtttattgacaaatgactagaggaaaagattactgtagataatcaagagactagaaatggctactttctgtgtgtgaaagtgttttcttgcattcaaactctatttctgagataggtctacctattagtgactgccagacctcagagaaccttgactcctctgcagcaggaccataaccctgagtcctaaaggctggatgctgtcctcagatgtgtttgataaacctgtgcaattattttttgagactctcaaatattgagaattttcatgtccaaatttctggcttctttggcatactgcaatttctggcaacactagacccatattcttatgtgtcaatgaatgtctgtggttaagtaacacccaccccttctagatggcatgtcttgcctagttttcttcattctcaccagctgctgctaactccaacatggcagtctagtgccaatcgatgtttattatcttctttgcattattacttctcttaaagtaggtgaatacttctatggccccagattgcctggataagtacgtgttgtcagaaaaaatgaaagagagcaaattttcatttggaaatgggataatcatctcttgctgattaatatgcaaatgaaccatgtgtggggaaagaataccataaagcttgcttcaataattcactttacttgcataattcctgtaagcatttgaatgttaaacccttgctttacaaatatctgtgaggaagggaagaggaaattgagcctgtttgcaataccagaatcaagtcagaaaaaaaataaaatggaaaaatctgggaaagtatagacagcaggagataaaaggagaaaggaaacatttccaactcaaacttcccttttttctatatccacttcttgccaaatattgtttttaattattctctctcttttcattttcagttttaattattcttaaactcttcccatcttctccccaggaattttttggcttatcaacagctggaggtaggatgggcttataaggaaatgaagtccaacaccaacaatagtaatcatgataacaatatctgtcatttattgcccttcttctctctgcctgccaccaggttaggggatttaaatacattagccttaatcctctcgataattatttaagatagcattgcacccccattcttatagatgacatgaccaaagcttacaatgattaagtaatcttccccagctaaaaagagcagaacagagattcaaattagatccacttgatcgcactatgcatgctctttccacttggacttgcttaatagttggctaatcattccaactggatcattaactcatgcttaaaaagataatgaccatatcaatctctttcagagttcattgatcttgaattagaatttacaaaaaaaattctcttccaataatgtaaaccacagttagtctttactttcccaaacaaactcatgaaaagattttaaaatttcagagctttcattgcatagttttctaatatttgaacatatatattattatatatacagaatattagctataataaatatatatttcaaatatgtatatgaacatatatatcattatatataaagtatattagctataatattgtattagtttgttttcatactgctgtaaagaactgcctgagactgggtaatttataaaagaaagatgtttaattgactcatagttcaacatgctggggttggcctcaggaatcttacaatcatggtggaaggtgaaggggaagcaagacaccttcttcacaaggcagcaggaaggagaagtgccaagggaagggggaagagcgccttataaaaccatcagttctcatgagaactcactcactatcaggagaacagcatgggggaaaccacccccatgattcagttacccccacctgatctctcccttgacatgtggggattatggggactatgagcattacaattcaagatgagatttgggtggggacatgaagcctaaccatatcaaatgtatacaaagttctagtgtgtgtgtgtgtgtgtgtgtgtgtatatatatatacacacacacacacacacatatctgcaaatttaatctatgtatgggatttaaactattttctaatgaaaatacttatttgttcgttcattcattcagagcagcagtatagagatgaaaacggagaggcaaaatctgatcctaccatttactaactacaaggtcttgctcaaactacttgcctatctttatttcagtcttcttattttaaattaagatgaagaatgccagctttatatgaaaaataaatgagtatatagggatattcaggtcatctatttctttttgactatgcttgaatagcttgtttgtttcaagaaatttgtccatgtcatgtaagctgtattaattgtcataaagttcttaataacttctcttattatacttttaatgtggaatctgtagtggtatcacccctctcattcctctaagtggtaatttgtgtcttctctcttttttgtgatcatttttgccagaggtttattaatagtatttaccttctcaaagaaaaagttttaggtttcattgatttttccttattattcttctattttatattttactaatttccactcagatatttattattttctttgttctgattactttggtttgcatttgctattcttttactcatttcttaaggttgaacctgaggtcattgacttcagacctttcttcttcttttctaatagggattttagtgctgtttccttctaattattactttagtagtggcccacaaattttgatatgtttactcttcactcagttaaaatacttaaaaatttttcttcttatttgttctttgacacatgggttttgtttattttccatctatttagggattttcctgttactaatgctcatttaatttcatgtggtcagatagcttaccttgtgtaacttgaattatattaaatttatttgtttacaaatgtatttgtttatctctatttttaatttttatgggtacctagtatatatgttcaaatattagaaaactatgcaatgaaagctctgaaattttatatatatataaaacgtagttatacatgttatatatatacaacatagttatacgtgttatatatatacaacatagttatacgtgttatatatatacaacatagttatacgtgttatatatatacaacgtagttatacgtgttatatatataacatgtatatatataacatgtataacagttatacatgttatgtgtataacattgttcataacagttatacatgttctgtgtataacatttatatgttatatacattatatatgttatatataacatatataactatgtataacatatatataactatatatgggttttgtttatatatataatatataatatatagaaacaaaacccatatatattatatattattatatataatatattatatataatataaaacatacatatatataaacccatatatatatatatatcccatatatatatatatgtatatatatgggttacatgagatattttgatatgggcatacaatgtgtaataatcacatcagggtaaatggggtatccaaaattcttttacatttattgagtcttatgaacacgaatatgttctattttcgtaaatgttctgggtgtaaagaagatacatgtgtgatactgtgggttatagtgttctataaatgtcaatttaggtcaataagttgacaatatcatttagatcaattgatagataatgtccaatttttctatatgtttactgatttttttgtatacttgttctatcagttattgagagaatggcattgaaatatctgactatagttatagattttttaattctttttgcaattctattagtttttcttcatatattttggagctctgttattaggtgcataactctttagaattattatgtcctcttgataaattgacccccttatcaatataaaatgaccttttttattcgtggtaaatttctgtactctgaaaactactttgttgacattaatttagccattccagctttcttttcaataatgttagcattattttatcttttttcattttttaattttaacctatttgtgcctttatatttaaagtatgtttctcggaggcagcttataatgttggcttctcttttatacaatctggcaatgtctgccttttgattaattgcttctattatgattatgatgtggttgtttcataaatgtgttattttgtatttttatttgtcccatgtgtcctggttccatgtttttccttttgttaaaatcttctgttgggttaagtattttttatgattcccttgtatttcatgtatttgtttcaaatttttgttgtgtaattttagtggttgtcttaaagtttgcagcacatatttttaacttaccacactagaatgtcaaaagagattataccattttatatatagtataaaaacatggaacatttttccattttccctcttaacctttgtgctgtattatagcttttacttctatatattatagatcctacaatacattattacttttacttttaacaattatcttttggagacttaaacaataagaaaaaatttttctattttcccatatagttgacatttctgatgctcttcattcctttatgtagctccagactttcatctggtgtcattttccttctccttaaataacttcctttcatatttcttgaagtgcagattggctggttataaattcctttgtatgtatgaaatgtctttattttgtgctcccttttgaaagtgagacaccctactctgtctcctcagcttgggagaccactggactctgctgggatcccctttttgctatactgactgcagactttctccaggcagtgagctgggcagtgacacccttcccccatttgtgtcctgcttcttaggggtgactgcttccattgtcagatgtccagtgccttgagaaactattttatctcttttacctgttttttagttgtttcaggcataacaattaatcaggtcgctcttgctccattttggtcagaggtgggatctctgggctctagatggaactggattttcctgagagttcttcccagtccacccagctagaacagagcggccttctcactggacactgggcattttggtcccaggtcatagaagagcagcatcctcacagtgtgacctcagctgagccttccactgcgtacttggtttcattttaagtcccctctctcaagacttcctaaatgtcaattatctgacccacctgggcactacatagaatattcttattgttgttgtactggatttacaaactctagaagcacattagagaaaatgaagggactttgctaaattttaagctgttccttgagctgccctcaatgttattttatccttttagagtccaagtttttccatagttccccctaacgcaaatgcacactcatgctcactctctctcacgcacacactaagacacaagggagtattgctcaggccctcaaagacagatcgccacagggacttctgtgagacactttctcagcacatattttccagccataatgtcttccgaaatcaaagccaacctaacaacagaatttccccagtaaaatcacagctaattgactctgaatttgtaaacgaggcacacatccaaatccatgtgggatcttgttgtgaccagcgtgtgttttccagattctctaaactcacagagtgaaaagagggtcatctataacaaatcctctcagtaggagatcccttcctttctccaatttgagaggcccacagagtaatcattagacaaaggatcgtttgtgtcaagttttaagaaaatttggccaaagcgatttaatcaagcccaacggaaagctttctacgagagcctgggccaccaggaactttattctcgccatccgagatagcggctcagcacctcacatggtaagaggactatgtattcctttcccttcgtgaaggctctcaagttctgacctgggacctgagaaatgtttgaattgggtaacgtgaaaggagcttctaatctactaaacagaacatccatacatgtcatgtcctgaggataaatgttggcatctcctgtgattgaagcttagcactcctgacctcctgaggtgaaacttcaatgagctttagctctttcagccatgagttgtttaggcttgagctaagcacattacctgagctggtttctgtttctttatctgttggtacaaaagggaggtgacaatttgctttctaagatcctttccagatccaacagactttgattatttttgtttaggtactgggcaaaattactctgaatataatgctgtttagttcagtaaattctaagaaacagactaaaatgtgtatgaccaatatactgggtccatgtgacaacaacaacaaaatccagataactggcaaaatctaagccattgacttaattctttacaccttattgaggctaattcattaataaaacaggtcatccattgagatttcatgtgaccataaataatgagtggcagagttagaataaagtctaagatagctcaaagtttttcatcctgtgcaaagctttcactctatatattattccataaaataaaaatatgccatattaaaggaaagagagctcagaattgaaaatgtaaaacttcccatcacttcaatttatcctgttagcatctcaaattcaacgttacattaacatggttcattacacttaatgatttcaatagcaataaagacaatagttttcagaaatcacttagatcttcccatggtctttagaaaaagatttggtttactttcctgcatagatcctttccaggatttttaatctaaacatgatttctttggcaatccaaattatgaaaattattagcacagctagccactactgcatccttacagtgatgaacaataagctaattaggtgtgtagtggcatattctatcggtgattaaccagctgggatggagttatttacacctctggaagctgtgtaaatcttacacttctgaagctggcaatagaattttaaacttacacttaaaaggctgataaacactttaaatataagctttattgttgttataaaatttcattttttatgagatttgcattcctttcattgattaaatactcatatcttcatacatttatatgtttgtgtttatgtgtatatatctggtcctgtgtaggcagaaaacattaaaatgtgcagattcaaaggaaatgagaattgatgctaaactttgtggccttgttaatgttttggattcaaaatcattttgaagatctaaggtcccaatagtatttcatctagtaaaaataaaactgcgattcccttagcaacatgctacagtacagggcccataaagtacatttgaaaaccaaacgactgtaaagtgatccactataatcaaatctgtcttgctgtgctagatgatatgaactgttctttaattgttgttttgcagagataaataaagcaaaacgctagattctgatttatgtagcattttacaaaccaaaatccatttttaaaaaaattttgtatcgcattccctcagaagcaccagggagaattgaggacgtcatgctgatgacttttattagtgtgctgacatataaatgatgctacctgtgaggagtgggtaggagaatgggcctaaatgcaattatctcccacttcatgtccaatcctactcatccatcagtgcagcccctggctcctttatagacgggccctgcctgccccacctcatttagccctcctcctcctgtagtcctagcaactgttatcctacctttatttcatcatgtagccagagtctgccaaatgacaccttttcagtcattgttagacgagtcttgctatgttttatcttccaagtgtgggtctctgggagcttcataaatagcatccaccaggattctgaataaattgcaaattcggtcactcaacgagaaacactcaatgtatcaggcacggtgctgggcagaaggagaccccagggaatgacacggatataaaggtgtgttctcctggagcctgtattccaactggaggagacaaaagtaaacaataacccgagaggctgtgcagtgactgagcgcgggcccctccagagttactcagtggggcaggcactgcagggttgctgagccgggtccgggctcccttaggaggatctgctgcagtgagatgtgcggcccagaggagcagaggaaactcttttctgcacataggtgctctcaggtggaaaagggagaagctgtgccagatttatcaatcaggtgaattagctcacctcccctggaaagcagtgagtaaggggtagagaagaggaagaaaaggggctgggagggtgggcttcctgtcatggaagatttatcaggagtggagaccttcctcctgctgcagtcatgcgacacttaatgactgggataccctctaagaaatgtgttgttagatgattttgtcactgtgcaggtagtgcacttacacacacctggacgggacaaccccactacacacctaggccctgcggtgtagccgattgcccccaggaaataaacccctacagcaagtgatcgtcctgaatactgtagacaattgtaacacaatggtaagtatttgtgtatctaaacatagaaaaggtgcagtgaaaatgtagtataaaagataaaaaatggtacacctatatagggcatttgccataaggcttacaggactggaagtggctctgagtgagtcagtgagtggtaagtgattgtgagggcctagggtatcactgtacactaccagggacctcatagacactgtgcacttaggctacactccatttatacaaaatagttttcttcagtaaaaaattaaccttagctcactgtaagttttttactttataaactttccaattttttaacttttgactctttagtaaaaacagcttaaaacacaaacacattatacagctgtacaaaatattttttctttacatccttattctataagctctttatttttaaaatattttatttctttttactttttaaactttgttgctaaaaacaaagacacaaacatacacattagcctgagcccacacagggtcaggagcatccatgtcactgtcttctacccccacttcttgtcccactggaaggtcttcaggggcaatggcaggcatgaagctgtatctcctgtgatcacagtgcctttttctggatgcctcctgaaagaacaggtgtcacactaactgagctcctgtcacacggaaggaaacaccaggggtaggaaaaaagttccaccctaacatccacaaatagatgtgtttcatgaggacaaggagcaagttcttacacttcttgatatttacatgcctaagatttgttgtcctaattaacatattgtaccccttttattctaatcctaaggtccaaaagaaaataagttagatatgttttttcaatagccaaaacagaaatatgaatgcaattgttattatgacatttcacattcattcagggggaaactcagcatctgcaaagccagaagacaaagtcttgcttttcaccattcagtaagagccaatggatcttgaagtgaacagatttggaaaagtgacctgaacagccaagatcagcaaataacaaggaacacaaagaaaagctagtaagaaagtaggaaaatcaatatggaaattgaccactaatatatccataagtgtatatacgattttaaacaacagatctgaatctgctgcacaccagggctgctgtgacgcatagccctggcaggtgctttctcattgtcatctgtctgaccgactgggcagagcccagctccagtggctacattcaatgttcatgcaccctctggagctgtgccaggctgtgaacctatttacaccctataatgttctaactttactggagaaaggactgaaacagtatggttatcattctctagttatgggactacccattcatttccctgacagaagtgtaaatacttgagtgcaggcaccatctccgcttcacctttgcacccttttgaacgcacaacacactacaggtgtagagcgagtactcagtaagtgttcatttaatgatccaaagctttcacggtctgtgtaactctctatagctgaacttccaaaacagtagccaatatctatacatggttaataagcacttgaaatgaggttaacccaaattgtaaaatacaagattttgaagacttcagatgaaataatgcaaaacatctcattaataatatttatattgataatgttgaaatggtaacattttggatatattaagttaaataaaatatattattaatattatgttttcctgtttgtttttactttttactttggctttgagaaaatttaaaattatatgtgtggttggtgtttgtgatttacattagatttcttttggataaggacggccaccttagacaaaaacctggatggtaatttgacttaaagtttatttatttatttatttatttatttattttggtagccatactcataagttagcactacgccaatggagtgtaaaagttttgctgccattagaacttgcataataatttcactgtggcatataaagaatatttgtattgcaataataacatgattaagaatatcaatagtcagtattacctgtacgcctgatgaacttagaagtaaattatgctctgttcgacaatgtggattgtctttcccttctgaagttaccctcagatatagtcaaatcagttatgttttggatgtccttctaaaaatgatcactgaggtcatgcagtggaaggaattcagattttgaggagctgtgcacatctgaatgttagactctgaaagaaactcgtgggtgtggaaataagtgtttctggtgctgcattagtataaaaatccatcacatctaactttgcacactatttaaaaattataaatcaagataatgtattttacatattcacttttaaataattgctgataaaatgaaaaatattcattaagggtaaaagtaattttactttatggaattgacaaatataattgctttaaaattagtttttgaggtttttttttttttttacttgaccaaatcttggcttttggttaatttgaaaataacatgatagaagcatacctgatgaaaaattataagatgtgataaaattacttgaaccatttttgtcactgttagtcatagtcttagttaaattttgtaatatacgtcacataggaacatcttccttaaaatttttcaatattttgaaaaacatccctctcaaatatttttaacaagtgagaatatgcagtgtttagttttctgtttgtgcgtgaattcgcttaagatagtggtctccagctgcatagatgttgctgcaaaggacatgatttcattcttttttatggctgcaaagtagtctatggtgtatatgtaccacattttctttatccaattcaccactgatgggcaactaggttgattccatgtctttgctattgtgaaaagtgctgcaataagcatgtgactgtatgtgtcttgttggtaaaatgatttgttttcttttggatatgtgcccattaatgggattgcttggttgaatggtagttctgttttaaattcttggaaaaatctccaaactgttttccacagtggctgaactaatttacattctcaccaacagtgtataagtgttcccttttttctgcagtcttgccaacatgtatttttttttttttacttcttaataatagccattctgactggtatgagatggtatctcgtggttttgatttgcatttctctaataattactgacatgagcattttttcaggtttgttggctgcttgtgtatcttcttttgagaagtgtctgttcatgtattttacccattttaatgggtttacttgttttttgcttaattgtttaagttcgttataggttctaaatagtagacctttgtcagattcatagtttgcaaatatcttcttccattctgtaggctgtctgtttactctgctgatagtttcttttgctgtgcagaagctccttagtttaattagatccatttgtcagtttttgtttttgttgcaattgcttttgaggacttagtcataaattctttcccaaggcccatgtccaaaatgacatttcctacattttcttctaggattcttatagcttgaggtcttatatttaaattctcaattcatcttgagttaatttttttgtatagtgaaaagtaagggtccagttttattcttctgcatatgactagcaagctattccagcactatttattaaataggaagtcgtctatttgttgcttatttttgtcaacttcatcaaagattagatagctgtaggtgtgtggttttatttctgggttctctattgtgttccattggtctgtgtgtccagctttgtaccagtagcatgctgtttttgttactatagccttgcagtatagtttgaggtcagataatgggatgcctctgggtttgttctttttgtttaggattgctttggctattcggcctcatttctggttctatatgaattttagaatggttttgtttccaattctgtgaaaaacgacatttgtagtttgataagaatagtgttgaatctggggattgctttagacagtatggtcattttaatgataccaattctgcttctaatccatgagcacagaatgtttttcattcatttgtgtcatctatcatttttctagcagtattttgtagttctgcttgtagagatcttgcacctcctttgtcagatgtattcctaggtattttctgtatgtggctattgtaaatgggattgtgttcttcattttgctctgtttgaatgttattggtgtatagaaatgctactgatttttatacattgattttgtatcctgaaactctgctgaaatagtttatcagttccaggagctttttggtggtgtctttagggctttcaaggtatagaaaaccacaaagagcgaaagtttgacttccttccctatttggatgccttttatttctgtctgttgtgtaggcactattttaaaaggagtgttatcttcaatgtatttgagtgactagaaattacattttaattgttattaaaatcataataagtttttatgaacatttacttggctgaattagaagcaaagagagagggtatgacctgtgtaataccttgtgtttattttctttttctctgaatttctgtcttccccttttattaagtaaataagatacaaatgatgagcatcattttgttgcaggcattaggtgataatctaggaaggtctggagacaagacgaggtgttctcaaagccaccggcaggctgccctatcaccaggctagcatcgcatttcaaggggcacagtcgtctttctgaacagttaacttgtattgcctgtttcaaatgtgacagtgtgagttgggttctccctgcctgactagctttttaaaagatttttaaagagggatgggcaagatataattttttaaagagggatggacaagatataatctgatgggaaagatctactctgggaaaaatacaaaaattctgtgtgtttaattttagcagattaagaaatcactgaggaaaggaacaattccagagtcaagattttttttttttttattcctcaaatctgccactaggttcagcctgttaatttagaaaattgatgacagatctatttatagaactgcaagtatttttgtaatggtaatggttttgtataacccttgaaaaaatatttcgtctggcttcccattaattaatggttccaaagatgaatatggggtcgaaatgaatctaaatgagctagtaagtttttttatgatatgcaagcacaggaaagttacaggatgagagcattttcatctttcatatatttgacagggaaactagaatatcaaagcttttgtcattgaactctacagtagttattcagtttgatttcaacaaatgtaaaattaggagtccaatatattggaatttgatattattataaattgtaatatatttatatatactgggtaatgtgaactaattttacttatttaggtctgtctttttctcttctattatttggacagtgcttcataaaattagtaagataaggtcaaaatatatttcatattatttcatgtaaaatgtaatatacaaaattaaaatcagaaaatatatgtgatcctaaaatatatttaaaatttgtattgtctagaaatacactcatgaaggagagctgtgttctttctttgaatggctactttcagttaacttttccttagatagactcggtcaagtccatcacttgaataaactgtaaaataagatggaaaacattgtataaaagaataagctaatcacaagtcatgactgagctattttgtacataattgcatacatgaaaatgtgtacatagtgataaatataaacgtggggggagatacagctccaaggcaaggaaatattgacttcagagtatataatcggatttttactacacttacattacatgctaacaaagctattagcaacatcatttacaaaatctacaggttctaagggttgatgatgacataggtcatcgtgaagtacccttttacaaagtcacaaaaatattacgaatctcttttgcagccttcttcaattcatagttgttattaacaggagcttaaaagcaaattaaccaaaagagagagagaaactattaataattccacacttgtctcttgtaaggcatactctgggtccttttcacgtgagtataaaaagtgaatgcagagaaatagaaaaaaatgaaaatacattgtatccaggtggttgttgcagaaagttgatgtaatcttgattgagagagagagacagacagacagacggacagagatggacataaatgcagagatattcttctgaagcagaggacaatatgtaatttagagagttactactcttaaaaattcttacattttacatttttacattttatctttttctattcaacctaataaatattttattagtgagggtttttcttttttcacattcacttttaaaatctctatttgcctctccatttttatgtgacactgtatttagtgtatgagtaagactcaaattcaggcaccttcccatgatttgctatacatggcatccatttactccagtcaaatacattcttgagagggccagtgtgtttatgtcactgtgtgtgtatgtgtgtgtgtttatttttatccctttctcttagaaaaatgttagcattttctgcacacttttaggaatgctaaatgttcccccttccctccttccactacatctgatttggagtaatattcctttacttttatttagtaggcataatgcgatcagcaaacattctactttttacatgttttcctactctcctacccctcatttttactactgtagctacactaccaaagcattatagccatacttaccctccttgcttctttgtaactgtcacttcttcctagtttcataagtaaatatatacctaaccttcaccatcaatgcttaaggcaatgcctcaccagatagtttggttttctgaatcttttcctctagtagaatcctcaagaagttttcatgagaccagtattccctcatttgttaagttgtttcttaacaatttgtttgagacttcatattggaaagttattatggctgagtataaaatctttggctcaaattttttttcctcaagttgcccaatttcttctggtagaaagtattattgtcaaaaagcctgatgacaacctttatgagtgaattggtaatttcgcccagattttatttttattttcagtgaaggtcagtaactttactaaaatatgccccagtgttggtctttcaggattaaattctccagtaatacggcctatccttttagtaggtagtgtccagtcttttggggagggagttgtcttgagtttaatatgtcagcactattctgttccgttgctttgagcttcttgtttggggctatatgcatgttgagtctcttctgcctatcttcatctgtcattttctctaaaacacttcatcactcttttgattttcaatttttaaaaaatcctcttttttgtctcctgtgtttcttaaactgttgtctgttatgattactttgtcttttgttccttccaatttaggcatcatttcctgatatttattttgcattttaagttctttcattaagttctatgtttttaatgtcttctatcatttaaaaaatatgtgatcttgttttgaagcagtatcttgcaagttcttctattgaggggcatgtcttgctagcaggcttttattgtctgtagagacattatgatatttcttattctctcctttttaaaataataattttgtaagggatttgacaacactctttttctatctgcctactcttttagaagggaggattggtcaagataacttttctggttcacagctccagagcctcctcttctattgcctctacaaagtggtttttaaaatgacctcatatttctaggatctgccttctcttctgtctttccctccttttagctggattttctctttcttttactcctctggacctgggcagctccgctcgatttggattttatccctttgctttcctcagtggagagatttgtactagaagggaaatgggggattttaggcttaagatccttttcagacctcgtcaccacccgtgaactggagcgtgcacaacctctcccagcttcaaatatggcatctgttggtgacgttcccattctggaatcaggagatggctggctactctcctctgctgcctctagcaccgttgctgtggtcacatgggtcttagtggtcagaggtctgtccccattgccttatattttaaggaccatgagtgtaccttgcacacaatttcgatgtagttcttctgtatataggttttggttttgctatcctagttgctttacctgtctgtgttaatgaggggatttggagagattaaaaagcaatattgctttcttatttccttaattctccccctttcgcctatagaaacagactcccaggctaaaagcagcagataacaaatatcaagtcttaatttttccaagataaatgaaagctcagcctcttcaactaaagcaaagtgaagaccacagtcatttcccatgtctttggcgagatgtcttcgtattggcaaaaacaggaatccttagaagatcctaattacaggaaataattactcacagacaagttgcccttcatttaaactgtcagggtaacaatgtaaagaaaacataatactttcagtctctaccaatccaggaatggtgtgatcttaaggctgactgccaagagcacaggccagctgttacagaacttaattaaaacagttttgataattagcacaacttgtatatgaatgtgagagtatttctaatgtgaatacaccggtcaccttgtcagttacagggaacagaggaaaaaatcctatgacatatggagttgtgaaccagttattaaaaaacaagcaaacttagaattgctgttgaactatcctccattctttgccaccctcataaaaacaataaaaataaaaccaaacacgcagagacccctcccaatctgatttttgcaagtagtttaagaagcaaaagctgttatgctttgttaaaagtccttttggttgcaaacaaatagaaagggacccagaccggtttgagcggtgagtattccacagagcggctgcctgagtccagcagcagcgttcgcatcatggtgctgctatttccctgcgacgacacacagcaatctttcttaattttgtcatattttcacttttatttactaaggaatgacagatcaccgagaaaatcttttttttcctcctttctatgtgtttcattctgaaaggtccattgctctccactgatactttgcagtctgagcttagtgttataactgttctaaaaatgtctcatttggaaggaagagctgtagcctgctctttattgcccagtacctctaacagccctgccaccatcaatcagcaaaatgtctacaattaactcttgctgttgtctccaaagcctggttgctgcccccacggcctcagcaccctctgcctgcacctccctccatggcttcatgacacgatctcctccttatcttgctcttcagaggctgtgtccctgtgcctgcccgtcctgggcaggtggagcccagtggatgggccttggacctcttctttctccccaaaacactctccatggtgagccatcactttagcccagattctctcccaagttccaaagtcacacctccagacacctcccgggcaccagcactccacttctgtgtgcacagtagccactgcaaagctcagtgtgtccatgatgcaatcataacctcgcagctcccactctgcctgcccctcctagagctgccctctcccatgttggcccccatctgggttgatcgacagcactgtgcacacagtacccaagatagaagccaggagttgtccttggccgtggacacttcctcactctcatgtttaaatcctttatttcaaccatttccttctgtttcctaaatgtctcgtgaatgtctgtgccttcccatcctactgaccctgtaaggttaagccaccttcctaactgagcaatgctgggcaggagatgtttgtctcgctccaggcttgtctcttcccagctcatggctcccaccgcaacctgatcgttcattcttgaaacagatcccatttcttattctcacaattagcgtctttccatttcctttctgatgaactctaagctcctgacagcctccctcctgacctggctccttccctgaagtccagcctcatctctcgctgttgccccaccttcagacccagcttcagctgtcccgaattctgcagttccccaaggccaccattcaccatggtttccatcatggtcccctgcctttgcctgggatgcccttcctgcctcaagggaggcactgtcgtttcctcaggggagcctgctccctgttattccgagttaagcatcagaataatgtgtttacttttcataattttatgataacattctcttataaagatcaattttaatatcccaaaatatttgatttcttcttttgagaattctgacttttcaaaagtagtgatgcacagccgaccacggaccccctgctgggaggcagtctccgaagctgccagtggtcttcggccacacacattcacttggccagccagacacacacctgctgctgccacagtggggcaagtgcactcagaccatctgaaggaaggtggggctgaaacccactgactcatttctactttcaacagggatttattgagcacctactatgtgctcaataatatacagtacctgttgaattgggagtttcatgagaaataaggcagccttagtccctgcccttgctgtactctaaaaacagctaaacacatgatgtaataattgccgtgtaggaagagaacatcagtgtctctggctgagctctttgctacctcacagtcacactgtctgaaatgtgtgcttctcttactgctgaaggctgccgagataaaagcagtcacctcagggtgagagtccaaggattcaaccggaagagagcagcagctagggaccccttggtgggaatgtggttcgtgaggaactggagttctgacgaggagcagcttcgaggcatttgcttctcactaacaggagtgtcccaggaaacaccgaaatccatctaagcaggcgacatgccaattttaattacctgctccagtgagtcatcagttattacatgtaatgaaattaactgtagcactgaacccacagttatgtggattatttgccattttcctcacagtattcaacattttaaaaatctgtggcaagtctgagatttaggaatagtgaaatttccttcgatttgtcctggatcatgatttatttataatatgttaacattgaattggcttaaataatttcctgcttctctttctttgagatttccatcctattaagagcagaaaggagcaatttttgtgagtatcccagttctgatgggccaccatgctcagcaacatttcctaattttttttcatatttttactttgacttactggagaattgcaatgcatgtagaccttattttcacaaaatgcaaatgttaacatgcctatttagctctcccagccatgttccttttcttgggcaattgtcttcttttaaatctcaacttttatttagatacaggtggtacatacgcagatttggtacctgagaatattgcatgatgctggggctgggagtaggaatcccgtcaccctggccatgagcataatacccgatgggtagttttttaacccacccccctccttccaccctccagtagtcctcagtgtctcttgtttccttgttcatgtccacgtgtgctcagtgcttagctcccacttatcagtgagaacatgcagtatttggttttctgttcctgtgttaatttgcttaggataatgacctccagctctatttacgttgctgcaaaggacatgatttcattcttcattatagctgtgtagtatttcatagtgaatatgtaccacattttctttatccactccactgttgatgggcaccggggttgactccatgtctttgtcattgtgaatagtgcagtgatgagtatgcaagtgtatgtggtttttttggtagaacaatttattttcttttgggtatatacacaggaatgggattgttgggtcaaatgatcgctctgctttaagttctttgagaaatctccagactgcttttcacagtggctagactaatttacattcccaccaacagtgtataagtgttcgcttttctctgcagcctcaccaggatctgttgttttttgactttttaataattgtcattccaactgtgtaagattgtgtctcattgtggttttgatttgcatttctctgatgactagtgatgatgagcaattttttgtaagtttgttggctgcttatatgtcttcttttgagaagtgtctgttcatgttttttgcccatttttaaatggggctgtttcttttttgcttgttcaattgtttaagttccctagagattctgcattttgttgaatgcatggtttacaaatattctctcccattctatagtttgcttgtttaatctattggtagtttcttttgctgtgcaaaatctctttagtttaattaggtaccacttgtctatttttgtttttgttgcacttgcttttggggacttagccaaaaatgctttgccacagccagtgtcaagaagagtatttcctagattgccttccaggatttttatagtttaagatcttacatttaaatctttaatctattttgaattaatttttgtatatggtgaaagataggggtccagattcaatcttctagctagcatatgactagccggttatcccagcattatttattgaatagatagtcctttccccattgcttgttttcattggccttgttgaatatcagatggttgtagggtatgcagctttatttatgagttctctcttctgttccattgatctatgtgtatatttttgtaccagtaccatgctgttatggttactataggcttacagtatggtttaaagctgggcaatatggtgcctccacctatattctttttgcttagaagcgctttggctattcaggctctttcttggttccatatgaattttagattttttttctgattctgtgaagaatgacattaaagtttaataggaatatcattgaactgtaaattgatttggacagtatgaccatttttacaatattgattcctccaatccatgaacatgagatttttttttatttgtgccacctcagcagtgtcttatagttctccttgtagagatctttcacctcaagaaaacatcagacaaatatccctcatgaacatagacacaaaattcctcaacaaaatgctagtacattgaatccagcggcacatcaaaaagttaatacaccatgatcaagtaggctttatttctgggatgcagggctggttcaacatatacaaatcaataaatgtgattcagcacataaatagaatcaaaagcaaaaagcctttattgagatatggttatctcaatagatgcagaaaaagctttcaataaaatctgacatccctccatgataaaaaccttcaacagactaggcattgaaggaacattgctcaaaataataagagccatctatgacaaacccatagcccacatcatactgaatgggcaaaagctcaaaccattctccttgagaagtgaacaagacaagaatgcccactcttacaaatcctattcaacagagtattggaagtcctagccagagcaatcaggcaagacaaagaattaaaagccatccaaataggaaaagaagaagtcaaactatctctctttgctaacgatatgattctatacctacaaaaatcataaagactctgctaaaaggcccctagaattgataaacaactttagtaaagtttcaggatgcaaacccaatgtacaaaaatcagtagcatttctatacgccagcaacacgcaggctgagagtgatatcaagagcacaatctcacttccagtcaccgtgaagaaaatgaaatacctagaaatacagctaacaaacgaggtgggccattctttgatgtttcatacaaaccactgttttaagcaaaccaccttgttgtgcaattgtgagaggaaaatgcagaaggagattggctgcaaatattaaacccagcatagttaggatttattttccttttgaatttcaagtttgaagccttgtctttgatttgcatggaaaagaaccagaaggtgctgaggggctgtggttcccaacaggattctggggcctgcagttctttccacgcagcctcagagctgagctggaagccagggggcaggcccaggaccatgtacagaggtgcacaagttaagagcacaaaggttggcaaatgcagatgagtgtccagtttaggcaattaatgaggctttggttaaagctgttctaaagctttagctgtaaatatacataaaataaagctattctataaaatttagctaaagctatagttaaactattctaaaatttatagggaaccaaaaaaagagcccgaatagccaaagcaaatctaagtaaaaggaacaaagttgggcacatcacattgccccagttcaacctatactataagactatagtaaccattaaactaaagtctcattaaactaaccattaaactacagccttttataagaaatcaatttgataaaagggaacaacataaaagtttatctcactgaaagccttgtgtaagaattcagaaattagaatcagagggaaaaattatatgcatttagctagtcaatgtcttttgattcagacaaatgtcaaggaaatctttcttcttccctgcatatttcacacttatttatgttttcccaaaaattattttggtgcagtttaactatgactattgaatatatgtgacctttctaattattaaattgctttggtagaataattttatacactgatctatggcatttctaataataaaaagcaagaaaatgcataatagctagatgtatgctagattaggaaagaaatgtgagaaaatatgtttacaaaacactgttactatagtgctgtgtccttaaatacatgttggtaggagaagcatcaaggagtccgctaaggtcacctcccaggttcccccataagacctcactctcatgcaagaatctattaacttgtgttctccattttactgtcaggtccttgagggagggattatgcccatcctgtgccaagagcatctagtttgtggcacgtgggagcacttagcaaatattttgttgaatgactaaataaggcgtttcatagctggaaacttcagaaaagggccatgtgcccaggcacagagggactggttacagaagaggtgccgtagcaaattagggtgatccagaagcttcttcccaggaaaagtcttcttgtcagggtgtcttttgggattgtattcatattggaagccctggggcagccaggttattgttcatcagttctgagcaacgtggatatgctccatatgaacatggaaggataaaaatagcatcctcctgtgcttgctgcaaaaggagcactcaagacaaatgataggcccaccagggatggctgaaaggtgcctgcatcttttaaacatctactgtggatttgaatgaaaatgcacataattataggatgagaaatttacttttgatctgggctggaaatagagtgtgactctggttgcgtgtattttttcagacaaaccctgcttgcaggcattctgcatttatctggggtttgcagaacgtttttttcctcaaggttcgtctgactgctcttgattttttcatcttttaatactgagcagatctaatttctgtacaatattgcgttcattacactgaaaattatgctatatttaatgatgcaagtaaattgaaaagtattggctaaaatctggaaacatttctctcttaaaattgctgtttccaaatgtcaactgaatttctagaattcatttaatgtccctttgtctaggttatgggagcatttccaaggtgattctcaatgtacacttttagcctcacatgaatagaaaaaaatcttattatggtgttttagaacaccagccccttaattctcccctacactcagagctacaggatataataacccaaccccacagatacagaggggcctgcctggctttaaccccagaagacatcacgtcaggttcggcagagagcaatacagaagcacttctataaaggctcttttgcagctttcatggccagtcaagagatgataaaacagaatggggaggaagtggcacccaacagggtgcagctccttcatctgcatagaataagcagagcctatttctcattcatgcgcccatgaaaatgggtgtttctgattggagagcatctcttttccagtggtaataaggggccaggactctcccacactgtcccccaccaaccaccttcagcactggcttcccagatctctgtgcagcactgcacaagccagggaagggaaagggcacgccagccttgagagaagtcgtgagtcacttcctccctcccatggtgctctagatgccagccacatggtcatgcatactaaccccaaaagaggccggcagaggtggttcatttgggtgaaccccaagtgaaatggaagtaagttttataaacagctatctagtctctaacccattccaataagccaggaaattataagtataaaaaagttaaatcctacatgactgaaagaaatgtatcctataagatcatctgttataggctctgtgcctgtctttttttctgcttagaagctgctgtatcaaaattacagaaggtctccaggtacctagtgacactctttgggcattcaagagcataactcacaccttccaaagttagattttgatcattttgcacctccatggatgggtagtgtcaaattcaggttctaacacaatcaacctttaagatcatgcagccctgtaggacagagatagccatccacaagggcttgcttctggatctcaggtggcaccactgctttctgttctgctaatgagtaaaactggctccatacaaatacatattaaatatgattcactgaaatatgaaaaatatatttcaaaaaacaaatatttaaatattcgttttttcatatataaagtttaaatgatcaaaaatgacatcaataatataaagacattggtagtgctttacttaatacgaaactctaaatcttatcaggactgtgtgcaggctaatctcaatgatctcaattatttttcttgtgcctagttttgtcactctaattccaagtcttgcttttgaagtaatataacaattttcttataaatttgttggaagtatcattttacaacccccaactggggagggcaggaaaatgccccccaaacacattcacatcctaatcctggagcctgtgaacatgccgtcctacacagcaaaagggacatggcagatgcgattacgttaacaggtcttgagatggggtgattagcctggattagccaggtgggctcaacaggagcacaatctctagtccttacaaagaggaggcaaggaggtctcagttagagagaggagatgtaacggtggaggcagaggttgagtggtgtgctttgtagatggagcaaggggacatgccccaaggaatgcaggcagctcctggaggccgaaaagataaggagacacattctcccctaaacctccagaaccagaaccagcctgaaccaatgcagctctgctaccaccttgatgtcagcctgcgagacccatctcagacttgtgacttcagaattatcagatacacttgtgttgttttaatatactaagtttggtgtaagttgttacagcagccataggagatgaaccccaacagcttcaagccagcctctctgagcacctcatggcctggctacctttttaattactctaggttaccatctgtggcagacattttcagtggccttacccagcacacttctccctttcctccaggggataaagatagtgttgtgctaaacaaatctgcgttgccagccatgtggattgcatcaatttggaaggaactttcaactcagtggtggaaaggagagggattgtttctgagaagcttttctacctcttgagacaaaaggaaagtttcgtccctttttttgcttctggatgttgtcatgtctagctgtgattcctggagcccctgcaaccattctgtgattggaaggggagctgcagaccctctgcagactacatggggaatgtctcggagcagagggtacttgatgccattgctgaaccactcagtcatccaaccagctgtagagctgctctagggacttcctgattcttgctgctgaacaagctgattaatacaactgcataggtacttgttgggcatagctttcaggccttccaggagtaaatgaggagcaggagaaaagtaattgtgaacaagagagggtgaaaggaaaaaaggttcatataaatcatagataccagaaacttcatacaatgaggaggaaaattacttccagtaacatcaatgaaataaacctttttatctatttcatggtttgtatttttatatttccttttatattctgttctttttactccactgagtgaaggagataaagtcttgttctgatgtgaaatgtaccatcagagtcacaagggcatcactggcatatgaaactatacctgtgccttacctgggcaggaaggagactgtttcactcaccttgtggatgagcatggccagtccacttctatgatacatacatatgcatacctttttatatgagaaatagatttctctagatatatagaattagccaaaattctatcgagatacagtaagttccaacataaagtttcttccagcttatgagagctgattgacacatctcttcctagtgatttcaagttggaggcttgaaatttataccacaaaaatcagcagctaccgctcatcagagctccccttcccagagccagttgttatgtcacaggaaaggggtccccttccagaccccaagagagggttcttggatctcacacaagaaagaattcagggtgagtccacagtgcaaaacaaaagtaagtttattaagaaagtacaggaataaaagaatggctactccatagacagagtagccctgagggctgcttgttgcccatttttatggttatttcttgatgatatggtatacaaggggtggactattcatgcctccccctttcagaccatatagggtaactcctgatgttgccatggcatttgtaaactgtcgtggcactggtgggaatgtagcagtgaggacgaccagaggtcactttcatcgccatcttggttttggtaggttttagccagcttctttactgcaacctgttttatcagcaaggtctttatgacttgtatcttgtgctgacctcctatctcatcctgtgacttagaatgcctgaaccatctaggaatgcagcccagtagcttcttcaagctgaataggcgcaatgatattcctgcctaacttctagggtctcttgtgttcagggtagagaggagctcagtcagaaagcatcagtatggcaagggccattcatgactcttgagttccaataagaggtgatatctggaagattaataagtactcagtttaagaaaatgttgagtaagcttattctgcattcttactcaaagagtacagcagcaatatattctacaacaataaagccaaataagtaaaattatcccaagtaaactaaattagaaggctttccatgaactaggcaactgttggaaccaagctggtagggggttgctagatcattccagtacatgcccagaattagaacactgatttagatttttacattacccatccctcttgtttcttctgagcagcagtcagagatcactggttggtttgcaggaataagcacggttagcctaaattgcaaaaacaaacttaaaaacaactgatgagactagaatctaataagaagtgtaccatagttcttacaacataacttttttgtttgcagtttcccatttttactaaagacaaatcagcaagacaaatttgctttattatacttggcctgattatttgtataaagtacaacaaggaaaattattttttacataagctctttttaaattggctttgatggaactctattccatagaagaaatcttagataagacttttttaaagctgagcccagccatgggtttctaccctcaaatacctctgagttgggtaaattcctttttctgagatcccaagataacttggggctcctggacctgttagaaagtgacattctttacttaccacaggtcagaaaccttatacagggactgtataataggcaaggtatgaggccagttttccaaacagcttttattggctctacaagtcaagtttgactccttaaacgaatgcaaactattccagtcaaagccctggtaaaataaccagtttctccaattgtgtcatgttgcaaagaaaacagattcttattgcacttatgcaaataactgtattgccataaattaagaatattcacaaatagtttccaacttctggagaaatcagatagagagaaacaaatatgctccagattttgtttacaggagtatagtttacttaattgctaaaaagctgtaaatagctcaaaagttttcttgactctgaaaagcaaaacaaaggatcagcagcattttaagcaaaaagttaaaaaatattactttagactttcattagtttagttcatgcagttaacttctgtttgatattcatgaacatttcagctctctatgagagttctgaaagttttttcctctattctaatgtcataatttccaaagttagcagaaacttgcattcaagagcacctgtcaaagccctatagctgattacaaaccacctttggaagatgatcaaaataagacaattgtttgtggatgacaaaagatgttagaacagccacagtcaaaaacacgattaacaaagaaatttggttacctttgtggcatacaataattcaacacaattataattattactgataatgtacactaagtcatatcagaattataagagttttttataattttagaagacataccaataacatttatacaaatacagcccaaagaaaaccaatcattttatatttgacagtgcttcctgtgtgacttttataccaaataagccaaatgtcactgttgcattagtgcattattgatgtcagacccaattcttagtaaaccttatagataaatatatccaatcttattcagtttgaccataaggtaagattcttataaaccttttataaccctttacaaatttttgtgaaagagcagatcataagcaggtttttgctctaagaaaaacctattatgcttttattccaatgtttagtttatggaaaagctgaaaaatgccactttaattttagtcaatgcagactctcttacaattaatttttcacaaaccttccataacttgcttaagccttcagcttcatcctaacttaaaacaatccattaatcctttaatctaggccaaaaaaattacatttccatgcctttttataatcttttaccaaaaacacatttcacttttcttatacaccttgtgtatagaactgtgtcttcactagtctcaaatacatgttatcctgttaactcttagcagcttttacttttgatgaaaaacctggttagtaagcaattttatttatgtattagatgtggggcctaggacccagacagaagtgcagataaggtctgactctctccagcgtttaacttcacatgtctcaggccttacctagaatctaatgctccaaaataaatggaacagttttcaaaagtcaaagaaacagtgtataaccttaaagcatttagtaaacttaatatttgatctgcataatgtagaccaaatatttatagttctgaagatatttttattttatgaataatctttaaaactctatttcccaaagattacttaagtcacatgaactaaataaaaggcattacactttttacttttctgacaaaatatttgatttaagtgcttattattaaaccaattaattaaagctctttcatttataaacatcatacacagaatacatataaatacatagaaagataaaagatagaggactcattttccaagccaggaattgaatcctgaacccaggccaccattgtgaaaagagaaagcatggccacatggttacaaggtcaagcccccaaggacatagaagacaagagggaaacctcatccagtgttttttcagggacctgtagcaaagtttagaactgaccagtttgctgggtcaccttgaacagcagtcttacaggtgtcctaagcccatgttctatccctagggacccctcattgtgacagaacaataaagaaagacacataaagcacaccagattggctacagcttaagactagcctcacaaatccttttttccattaatcaaactttacagaggagataaacagtgatttttaccattcattcaaccagtttgcacagagagagaaacagcggaaaagcattgcctgcagcagggtgggaaggcaaggcgctcagggaggccagagaaagacccacccattgcagcaacattgaaaagttcaggcagctgcttgtcagtagcaaagggatcttttccagcagtctcatcagctctcaagtttccccttttagggaagaaaaagctccccatgtcccacaatcccgtacatgcctaattctgtcactcacagctattagcaaagagcaaggcagattattccaaagagaatagcagttaacatcctgtagtaccaaacccgttcttagctgagagggactttaatgagagggactttaccaagaggggcctctaaacccctgaatcttagaaggcactctaaccctcctaaattgggcttctaacccaaggttggtcaagcatccgtgccttttatgaagaggggcctctaacccactcattcttaagagagactctaactcccctaagttgggcctctaattcaatcccattctttacctggctatatgcaccccacttacctgaaggccgccaatcagtgccatagtctctttcctttgggttgggggatctcctcagcatcgtcccttccatgttcaccagaaagatgtcaccagacaccaccacttacctagttagcctttgggtccctttatggtagccagaaaaatgttacagggaaggggtcctaatccagaccccaagagagggttcttggacctcgcgcaagaaagaattcagagtgagtccacagtgcaaagcaaaagcaagtttattaagaaagtaaaggaataaagaatcgctactccattgacagagcagccgtgagggctgttggttgcccatttttgtggttatttcttgatgatatgctaacaaggcgtggattattcatgcctccccctttcaaaccatatagggtaacttcctgatgttgccatggtacttgtaaactgtcatggtgctggtgggagtgtagcagtgagtatgaccagaggtcactctcatcgccatcttggttttggtgggttttagccggcttctttactgcagtctgttttatcagcaaggtgtttatgacctgtatcttgtgttgaccttctatctcatcccatgacttagaatgccttaactgggccgggcacagtggctcatgcccataaactcagcactttgggcggctgtggcaggtagatcacctaaggtcaggagttccagaccagcctggccaacatggtggaaccctgtctctactagaaatacaaaaattaggctgggcacggtggctcatgcctataatctcagcactttgggaggccaaggcaggcagatcacgaggtcaggagatcgagatcagcctggccaacatggtgaaattccgtctctactaaaaatacaaaaattagccaggtacggtggcaggtgcctgtaatccagctacttgggaggctgaggcaggagaatcacttgaacttgggaggcggaagttgcagtgagcctagatcatgccactgcactccagcctgggcgacagagtaagactccatgtcaaaaaataataataatacaaaaatgagccaggcatggtggtgtgtgcctgtaatcctagctacttgggaggctgaggcaggagaatcacttgaactcgggaggtggaggtgagccgagatcatgccattgcactccagcctgggtgacaagagtgagactctgtctcaaaaaaaaaaaaaaaaaaaaaacaaagaatgccttaaccgcctgggaatgcagcccagtaggtctcagcctcattttacccagctcctattcaagatggagttgctctggttcaaacgcctctgacagttacacatttgccagtacaccactgggaacaatgaaaggaaatacttggtttctactctcatcgatgattttaactttaataacttttggtattgccttatttctaatcaaaatgtaatgacatgactaatattttaatttgctaagtcagtctgctcagatctgctgaattgatctgctcaaattaattgctaatgctaatagtatgttgcaagactgaaggtttaaccacttgaagcatgcaaacttattttgtggatttttaaaacttattttatctctctatatgttaaaactatatagactatcagaaattggcattagggaattatttagctctctcattttccatagttccaggccttataaagagccacactgtgagtacagacagtactgaatctgactcacagccgcattctggaaactgctaggctgcatattgtggatcataacacataaccctggaatgaggccagatctaataaaactaataagctgcgccttgtttgacacatttcatgaattgaaagtgcaggagcctaaatgaaatcaaaggcccctttcagttggcaaagaacaatgagcctaaataagttaggattgatgagtgggcaattcaatcacctcctgcctttgggcgagtcattttaccctaaatgggatgctggttctcacttgtgaatcaaaaggggattgaaatgagggatttaaagtcacacaaaatgacttgttatcccagatgactaaagccaggaggtctgaaaccaacacttgcttgatgtgttttgcagaaatttccacacactaaagtagaggacacttgatccagagagggtggagtgaattaactaaagagcaatttatttactcttttatttatccatccatccatccatccacctatccatccagctatccatccatccatccatccatccatccatccatccatccatccatccatccatccattcacccaggtctctgtgacagaccctgagccatgctaagttctgggccagatataaagcagaaataaagaaagatagacctaacgagagaggcgaattgtaaacaagtgtgtgtgtgcatgcatgtgtgtacatgtgcctatatgtggtgttgggaacaaatgcctcaatgtgcaaaacactgtaaccctctttgtcatccgtaactgttctcttcttgctttggagattgcatctccactcatgaaatctgggagtggcagaagagaaggaggcatctgaagcccgtccgagggtctcagggcttcacttcccttactcccttctctccccagttgacatcacctgggtgtcagcagacgcttagttggcttctgatgcagagcagagtgtctgcaatctgcctcacgttgtcctctcttctcactcctacaaatgttcggctgagctccaaggtcctcttcacctggcccttggctgtgggcctcctcattgtataccttcttgaggttgccatggttagaacctgtctttggtctgttctcttagcattcatagcacctgctgactgttgcaggtttgtgggtgctggctgactcccaaagctcagctcacaccagtgctcctgagctgcatctgccatcctttccctggctttgagctggtcactgtcaggctctgctgtgacctgaaacttcttcggcccatgccctgagaaacaaagtacagcagggaacaactatcctctcgcaacatactcgggcaccccaggatttccctcagtcgtctccggttacctacagcacagacgcatgtgcacatgcatgcacacacacacacagtttccaccctggaggggagggtctgggactgtactgctggccgcttgctctccactcaccctgtctctcctgcctctgctgccccttcctgtctgggaggcactccctctggcttccctactccaactaggaagacaaaggaagatttactgaataggtaaatatttgggtacccacttaatgattattcatgtaattataatatactacttctaatgcttttatagtaaagtggcaataataatgattagcaagtaccaggcagtgttctagatggtttacatgaattaactaatacattatttaccataggcagctgatgtatgtactgttatcatttccattttaatgaggagactgaggtgagttgcccaaggtcctatcactaatttgtggcagaggctggggcaggatttggacttaggctccaacatgtacaccttaaccactattatgtggaaaggatgcagtatgatttcataaagaataaaaagatgaacatcaaaatggaaaaactggagaagtactccaggcatacagaagagcaggacacatctagcaaatatttggtgtatttggaactgaagatgtgagggtgaaatgttagaatgtgaagctggaaagaaaatggggacagattctggaaaacggagtacaacacagtgaagcgttgaggatagaccctgcacacagccagtgaagggcctttggtagatgagtgacatggacaaagtatttttagaagggagtgtctggctgcaacctgaagaatgagccagagaggagagagactgctatccagaggtcatttgagaactggctcattggttaattaagtcaacaaatatgaggtggcctctgtctcatgaattggtatgaaatgttatagagcaaaaaagaatggatggaatatgccatccagggctcacaagttagtgagggtgacagaatataaacaaatacataagcataataaatgccctcatagatctctacgcaacaggcactgctgttacagagggtttaattctccctagagaggacaggaagggctctctgagctgggtgcaaaggcatatcctatgggaataggaaacacatagaacacagttacatgactttaggtttacaattccataaaattgtgtgtttcaggtgcctgttatactactagtcctgaatagaaatgaaatattttatgagtttgcatataaaatatcctagttaactgatatggtttagatctatgtccccactcaaatctcaactcaaactgttatccctgtgtgtcgagggagggacctggtggaagatgattggatcatgagggcagtttaccccgtgctattctcataatagagaaggagttctcacgagatttgatggtttattgagattttatggtttaaaagtggcagtttcccctgcactctctctctcctgctgccaagtaagatgtgccttgctcccccttcagcttccaccatgattgtaagtttcctgaggccttcccagtgatggagaactgtgagtcaattaaacctctttccttcataaattacccagcctcaagtagtatctttatagcagtgtgagaacaaactaatacagaaaattggtaccagcagagtggggtactgctataaagataacctgaaaatatggaagtgactttggaactggaaaacaggcagagattcaaacagtttggaggactcagaagaagagaggaaaatgtgggaaagtttggaacttcctagagacttgttgaatggttttgaccaaaatgctgatagtgatatggacaatgaagtccaggctgaggtggtcacagatggagatgaagaatttattgggaactgaagcaaaggtcactcttgctatgctttagcagagagactggcagcattttgcccctgcccttgagatctgtggaactttgaacttgagagagatgatttagggcatctggcagaagaaatttctaagcagcaaagcattcaagatgtggcctggctttttctgaaagcattcagttatatgtgttcacaaagagatggtttgatattggaacttatgtttaaaagggaaccagagcagaaaagtttggaaaatttgcagcctgaccatgtagtagaaaagaacaacccatcttctggtgaggaactcaagctggctgcagaaatgtgcataagtaatgagatgccaaatgttaatagcaaagacaatggagaaaatgtctccaggacatgtcagagatcttcatggcagcccttcccatcacaggccttgaggtctaggagggaaaatagtttcgtgggctgggcctagggccccactgctctgagcggccccaggatatggcatcctgcatcccagctacttcagctccggctgtggctaaaaggtgacaaggtacagatcaggccattgcctcaaagtgtgtgagccccaagcattggcagtttccacaaggttttgggcccgcaggtgcacagaagacaagagttgaggtttgggagcctctgcctagatttcagaggctgtatggaaacatctggatatccaggcagatgtctgctgcaagggcagagccctcatggagaatttctgctaaggcagtgcagaagggaaatgtggcattggagcccccatacagagtccccactggggcactgcctagtggagttgtcaggaaagggcaactgttctccaggcaccagaaaaatagatcaactgacagcttgtgccatgtgcctggaaaagccacagccattcaaggccagcccgtgaaagcagatgcaggaagtgtaccctgcagagtcacaggggtggagctgcctaaggccatgggagcccacctctttcatcagcatgccctggatgtaaaatatggagtcaaaggagattttggagctttaaaatctaatgactgcccagccagttttcagactttcatggggcctgtggctcctttgttttggctaatttctcctatttggaatgggaacatttacccaatgcctgtacccccattgtatcttgaaagtaactaagttgttttttatcttacaggctcataggtggaaggtacttgccttttttcagatgagactttggacttggacttttgagttaatgctggaatttagttaagactttaggggactgttgataaggcatgattagttttgaaatgtgaaaaggacatgagatttgggaggggccggggcagaataatatggttcggctctgtgtcctcacccaaatcttatctcaaattataatccccatacatcagccgggtgcagtggctcatgcctgtaatcccagcactttgagaggccaaggcgggcggatcacgaggtcaggagattgagaccatcccagctaacatggtgaaaccccgtctctactaaaaatacaaaaaattagctgggcgtggtggcgggcgcctgtagtcccagctacttgggagggtgaggcaggagaatggcgtgaacctgggaggcggagcttgcagtgaaccgagatcgtgccactgcactccagcctgggtgacagagcaagactctgtctcaaaaaaaaataaaaataaaaaataatccccatacatcaagggagggacctggtgggaggtgattggatcatgggaccagtttctcccatgctgttctcatgataatgagggagttctcatgagatttgatggtttacaagtgcagtttcctctgcgctgtctctctccagccaccatgtaagacacgccttgcttccccttagccttctgccatgattgctagtttcctgagtcctccccagtcatgtggaactgtgagtcagttaaatctctttccttcgtaaattacccagtctcaagtagtattttatagcagtgtaagaatggactaatgcattgaccatgttcattgtgcaatgaaatgggtattcagcaaccatatactcgagtattttattaactcccaaacgaagacagaataatccacatattcagcagcttgattaagactcataggaggcaggggattttaagtagcaaatcaagcactgccctgtcttcacagacatgcaaacatattctgttttgttttgttttgttttgtttgagttggagttttgcttttgttgcccaggctggagtgcaatggcatgatctcagctcactgcaacttccgcctcccgggttcaagcgattctcctgcctcagcctcctgagtagctggaataacaggcatgcaccaccacgcctggctaattttgtatttttagtagagacggggtttctccatgttggtcaggctggtctcaaactcctgacctcaggtgatctgcccacctcagcttcccaaagtgctgggattacaggcttgagccatgcgcctggccacacatattgcagctggaacgtggtggcatagcagtctctatgtaagtggccatggaagatcacaacaaagggcagcagggcacaaagtccagagagccaggagcaaggggaattggtgatgctagaaatttagagctggaaagagcagaaaaaagagcatcctaaatagcgatgcttggtcttctccagcagtcatggaggagtcagggttcactgtgagaagagagacaccatttccacaaattgtctaatgagaatctggagaatgaccctcttattctctgtggatttgaattttctctgtaggcttcaatgagttaaagaaaatactcttcaaactacatactaagaagttcagtctttcttatggcaaataaagaaaacctagtaactttttaaaactctactttattattatgacttgagatgtttgtttctaaaattacaacccagtggactggctgtacatttttctatgtcatttgtatacaatctaaaaggtctaaataacttgattgtgaatactgtgtttgctgtaaaaaaaaaaaaaagagagagagaaaaaaaggcacacttagatgagtggcctacgggtaaactatgaaagcagagattctactacacagataataatttttcattaaaaacttgtcaaggtttagttgataaatgtgattatcaataaattttacatcctgttatttaatcagcttatatatgtatctacagtcattgcataaacatggaattgtctgtacccaaaatgcatttagaagtacattattgtaatacaaaagaagtttccagtcttttatgttcttatcccctagatttattattatacgcaaacccaaaaagaaggtgtcactttctggaaacgtattctgacctattttgaagtaccctgaatggctggcagacattgctccatgtgcagttttaacctgcgagctctctgggctgtgtgtgctgtgtccttcacgaatgacttctgttcttcaatcactgtaaacaaagtgacaggagcaccaagagagtttaagaaagaaaatgttggcatacaaaaagaatttttttctatacaaagtaaaatttaaagaatacagtgagccagacacagtggctcacgcctgtaaacccagcattttgggatgctagtgagggcagatcattttgaggtcaggagtttgagaccaacctggccaacatgacaaaaccccatctctaccaaaaatacaaaaactaggtgggcatggtggtgagcctgtagtcaactacttggggggctgaggcaggagaactgcttgaacccaggaggcggagcttgcagtgagccgagatcgcaccactgcactccagcctgggtgacagagcaagactccgtctaaaaaaaaaaaatcatcagttcgagactatagcagaagttcaagtatgaagccacaggggtctgaatggtggtattgacctacaaggcaggctgaaaatgacaggagaaggaattatatgtgaagaaataatggaagaatactttccagaactggctgatgaactgaacatggagaataacacgagggaatatgtgttttggctataggtttccagcatttgggacagtagaacgacatggacattgtcggaatcagagagcttgtgcggaggccaggattataggccgtaagttctgtttgagatgcagtttatgaggcctctaagtggatgtgcccaaagatttcagatacacgttctgggttttggaagagtcagaagtggcgaggcacattgcagagtcatttggataaagaccataggtagcatgagcgggtaaagcaaggaggtccttgagggaaactttgagggctgtcctcagttagagaacaggaagaggaagacctgggagtcagggagctcagagaatcacgcaagataacagggtgttcatgagctttgcactaagaaaaaataagggttggatgttcagcttgcctataatatgggaaacagatgacttttttttttttttttgagacagggtctcactctgtcacccaggctggagtgcagtggcacgatcacggttcactgaagccttggctcctgggttcatgcgatcctcccacctcagcctcctgagtagctgggaccacaggtgcatatcaccaggcccgtctgatttttaaatttttttgtagagaagggttctccctgtttcccaggctggtctctaattcctgggctcaagcaatcctcctgccttggccttccaaattgttggaattacagacatgaatcatagcacctggctgacaattattaaaactacaaaaacctgatagagtatatgcaatcaggtccataaattatgaaacacaagttgtgatgctagttgtttagtgtcaatataaaaattcttaaaaaaatgtgatggaagtatttacaaaggaacttgaactagcttatgaagagagacttatcatcgtcacttacaaagaccacactcctctctcacaaatactctagtcccgcgggctacgagtgtgctggcaaaccctcaggtcggtgagtcccactctttgtgagttcgcctggagagcaacatggggagagcgggagaggtgtcatgagcaggtgaggagccctgggaagaccctgttgttaaaaatgtcatcatggatttatccattaaggtttttatttcatttctttttagaaacaaaataccttttggaacgtttcagcttacaagctgtttgtatcttgcagtataactataattagataatctggttgctcctctccaatgaatgaaagcattcagctgtttaactgggtaaagtgaaaagaaaggagaggtaattttggtgcctggagtatctcaaggaggtaggcgtggagggagcagccgttgcgaaggttttggggagatgccagcaactctgttgcccatcttttggtgtgtgtagggaaggtgccaaggtgtgttgtgggttctcaggaagggggaggtacctggagggtggcaagggcactggctcaggtcttccctcctctgtggccagcagaggggcacgagggagccacccagcccctctgggcttctgccttctcacctgtagatagggcaacaaccacacccacctcacaggaatagagaaagctaggaacagtgcctgggtaacaggagggaatcaatgaatgtaagccatgaacaactgcaaagaaaccctctgttatttctattatttgagttacctgcctcatcctcccattcttctgcctcaggctcccaagtagctgggattacaggcgcccgtcaacacgcccggctaattttttatatttttagtagagatgggtttcaccatgttagccaggatggtcttgatctcctgacctcttgatccacccaccttggcctcccaaagtgctgggattacaggtgtgagctactgcgcccagctttttttttttttttttttgagatggagtctcgctctgtcccccaggctggagtacagtggcatgatctctggtcactgcaacctccgcctcccaggttcaagcgattctcctgcctcagcctcccgagtagctgggactacaggcgtgcgctaccacgcctttttgtatttttagtagagacggggtttcaccatgttggccagtatggtctcgatctcttgacctcatgatccacccgcctcagcctcccaaactgctgggattacaggtgtgaggcaccgtgcccggcccaaactgatgattctaccccaagatgttcactcctatacgttgatcttcccaggtcagcctgcacttcagactatacttaccaaattgttattcaatcatctctatttcccttgatgcctaaagtgtccagtccagactcagcctgcagagagggctccctcctggctccctgatatcacctgccagttcattccaactcaggccaccttaaccctaacaacgagccactgtatcttgactatgctgtgctcccctctgtgccatcactcagggggtatcctctgcccagaacactcacccctcctcatctcacagggctcatcaaagtccccccatcccaatgaaacattttcctgactccagcccataatgatctctcctttctcttaaccagagcttttttccacgtagccttggtatgtacccttcatttggtacttaatcacttgaaatcttacttaactttttgtgattgtatgattgtcctcttcagagaatagaaagggaattaatatcatttagcacatgctaaatggtatcatttcatccttataataaccccaggaattaggtatcattttgcaaatgatgaactaataatgcccagaggagctccgttacatttccaccagtcacagcatttgaaaactggtggatttcactacataccagtgatggctttgaacccgggggtgcctgattccacacccaggctgctctccacgaagacagagtgtcattgattcattctttcgacaagctgatcatactaaaatatgaatccaaggaaataagttatatttctctaacacactttcctttttttttcctacccactaactggccccatctctccctaacatttagcacaatgctataactattgtagctattcagtatatatattttttgctttagcaaaatttgattaagaaatataaagcatcctcagtataaagagctttaacaaattggaacaaatctctgaaaaatatatgcatagcaaaattgtatgctgatgtaagagacaacagtgccactatcataacaatttcttcttaaaattgcctcctggcattaacttcacctgaaataatcctttcctgacctatttaattctacttatttggtcgagtgtattaaaattcgcagtacattatcttattcaaggagagtttttgtaaaatagggccatgttttacaattaataccagtggtgaaagccacaaataatctgtttctaacagtctcaatttctaaaactctgccaagacttttcaggcctatcatatatttcttgattcgttatttatgaacacctgttatcctgaagtacagttattctccctctacctctgaccaaagtatactatttttagcattatacagatatgtgatcaaggaaagagaagctttgacaatgtatttcaatatgtattttactcctttttatctccctatggttaaaataaatgcagtttttaaagttttaggaaattcctttaactatatgacaagaggttgagtgggaatgttagaagctatgaaacaagggattatttctttcttatttattacacttgaaagtatcattctttgactgttaccgtcgggaacatacaattcctggataataaaggttaagtgtgcataaatttgagatctgcttacaactgacctttagctgtcttttagcctttttgacagaaacttaaaataaggttattccataaaataatttgattctccattctcaaatccagatttgttactcagtaattaatatcttccagctagacagagccatcagcatttgtagtaaaacagccagccatagacatgatgattaatttgggcagaatcatcacccatctaagttttagtctacccaaccataagcaaaatcaatatatgcatttattcataaaaaattatttctgtcttccgtttatatttgtcaatcatcttttgtaattgtctccataaggtcttacatagtgattgttaattttattatcttaaagtgtttgttttacttcatctcttgctattgtgaacttttaaaaaatattttcaaagttgtttttaatcgtgtatggaaatgctattatttttagtgcattgatttttttatgcaacaatgtttttacagagcttttaattgagcatgtctatagactctcagggtgtgctgtgtagacagccatatcatcctcaaatataaacagttcttttttttcccttccaatctttgcatgtacttttcttgtgttaccacattagctagaacctccagcgtagggttgaataaaaataataactttcttcttatctcctttctaaccaaaatgggaataatcctaaagttcaccatgaagtatgggatctgctataggtttctgctaagcgtttttattttttagtgaagaaattttatcaaaagttttatctgcatctattaaaattatcttatttgtcttcctttaatctaaaaatgtaaacatgatgttgaaaaattctggcatttctgtgatatggcctatttggccatcattcaatgtgcctatttgtttggatttcagtgagattgaactctatggtttcagtgttaaggttatgtcggcctcggtgagattgaactctgtggttttcgtattaaggttatgttggcctcagacagtcagctgtgtagcttttcctcttttcgattcttaaaaagagtcagtacaaaggggaaattttctactatttggaggttaagtaatttcattaggattcaattcctaatgtgttgttctttctataatggttttctcttgatcgctgggtgattttaaagtgttcttaaatttccaaatatatgggggtgttaaaagtttggctatcttttagttaatgatttgttattttatttaactttctgcagaaaatgtgacatgtatgacatagacatagatactttggaatttctgaaggcttgctttctggcttagtgcttattcagctttccaaaatagtccttatatgcttgtaaagaatgtgttttatctaactgttgaatgcaaggttctatgtaggtccattgagtcaaacttacatgtaaaatttatgtgtaaactttatatgaaaaagtaagcaaattatggtaataataataataaacctaggaaagtaatgtaaagggaccagcctaccaaatattaaaatcatttaaacagtcgtgataatcagatcaaaatgatactgttcacaaataaggaagacaggccagtgaaacagaatagaaagtcaagaaatagaaatttataataaggttaaatctccaatcactggagaactagtcaataaatacaataggacaactggatatgacctaaaaacaatccacagttggaaacttaccttacattttataccaggaaaagttacaaatagactagtgatttaaatgtaaagaaaataaatcataaaagtatgagaataaaccattattaatgctcttttctgactgtttctattctttatgctacacaatgggggaaatattcccaatgagactcaaaaatcagcatctataaaacattaacgaattcaaaaacatttttaaattgtcatggcaaaagaaaaaattgaaactcctatcacactcaagactaatttctctaatataaaagatctcttgaaataggccaatgcctcagtagagaaaaaatggcaaaagataagaaaatacaattctcagaaaaggatatacaaatgaccttcaaaaatagctttaaaaggtaattattctcatagtaagagaaataaaacaaccctgaaataccatttttaactataatattgttaaaaatcaaactctgatagcattctctttggacagacattagaaaaacaggtagtcatttattttttatagaaatgtaatttggtaccatctctgtgaagcacgacttggcaatatgtatcaaaatgaccaatatgtatacccattgataaaacagttcctcttccaggaatttatcctacaagatactttttttttaaaacttcacctttattttccacctttcattgtcattatattttgagtgttcactttataaactaattcagaactgaaggacattttcccttttatgataatctcttttaataagagaatttaattcacaaacactttttattattgcttacatatttggatccattctacgtaagtttttctctccatattttttcctgggaccaggaggatatttacccagccttcaagataaagctggtactgtttttttcattccctcttctctattctcttgaaagttcattttatttttcagaataggtattcttaaactttaatatgcttaattatttgataagtctaaagggtatcaataactttatcctcatctctttcaaggcagagatattacctttgacccagattaccttcctctcatcttccttgctattcctttctagtatcttagccccgctttataaacccgccatattgatgatttaaaaaactcataatagtcactgcttatttagtcttaattcattcaacaatttatctactattagctctttcatctcatctctttgtcctgtgttcaactcactttttaataaattttatcctttggtaaagttgatgatccaggggttaaaaaaatacccttcagtcttagtcaaatacatttgatttgtctttatttttgaatgataattttactaagttgtattgtagatgaataacttttgttctttgagcatgttgaacattttttacccttttctctgacctctattttattaatgagacatgtaatttccatctaatttggatcttttattgtaaactgtcttttgtttctagttgcttttaatcttttccttgactttggagtttcatagtgtttctgaaaagtgtctagatctgcattttccctctgaatatttacatctttcttaattatgaaaaattcccagtcattgttgcttcaaatattgcctttccccatgatctgtcctttcctctggagctcctgtgagtgactcgagggagcatcccgggtcttgggactccctgcgatcttttccattgctttacctccctgtgctgcctctgcattcatcttccagctccgtgatccagatctctaattctcttttcatttgtggtgaatttattgttcaacctagctactgaatttttaagttaatgatactatattttttctaaaagttatattttttaagtgaaatatttttccatgttaagtatttttaaattatttatcttgagattttattcttctgtttccagttgttacctccacagctcgtgtctatgctcattggtctgttgagtcttccttttggtgactgcattgccacagtggtggataatttttcattgcgagctcatctatattaggggttgcattttctgtgagtcccatgtacgagattatgcaagtgttcatgtttttacatttgctttggcccgggccccaagggtttccttttcattatctgagactaatgctttcccttaatttctgggcttttgatttcctaggtttccatttctcagaggaggtttgtcccaccgagagctttgtcaaacaccaggctgtctttctgtttccacagacagatttgaagagatttttccagtttctttttcacaggtgaggcagcccttcaagtgtcctggttgtatgcgggagtctcggattagttcccttctctcaccaaatgctctgtttttctgaagacattaaaaccttattcctagttttgtgacctaatctgatacttcctggggtctcctggcatcacctggaactcacttctgcaactggattttgtctttatctctagcatctgaggatttcctgagctcagctttgcattgggcatattttgttttttaagtctgtagcagttgatggatgaatccgtttcagtcttgtctgccatcttgcctgaaatttgcttcatttctgcccttaagagcatttttcatgttaaaaagtcttaattttagcattaagaatctcatgtgctatattacatgattttagttgtatattcagtatcactggaaaatataaggtgagaaattatttttagttattcatcacaactgcatcacacgtatttgaaaaataatagtacatctacttgtaaaatatattatatatattttctgtagacagtgattaatgcctgtctaatttgtaagacctcttgtaataactcaatagctgcctcaagggttgagaaacactgttaagtctttattttagaaacgtcacaataagtctaaaggaggtcataatatattaatagataattatactttttcagattaatttgtgtttctgagcaagatccttggtaattataacagcagtcataagaacagatattttcaatgaaattttaattgctaatagaagcaaggatatggaaagcataagagtaagtctctgatttgagtttttttcatgaaagtcattaacctctgatgtggtttggctttgtgcccccacccaaatctcatctcgaattgtaaactccacatgtcgagggaggaacctggtgggaggtgattggatcatgggggtggttttccccatgctattcttctgatagtgagtgaattctccttggccttccaccatgattataagtttcctgaggcctccccagccatgcagaaatgtgagtcaattaaacctctttcatttataaattacccagcctcagatgtttctttatagtaatgtgaaaacggactaatacaacctcactgtgtttctgatgtttcaatatagtatcactgtcttacacatttgttatggggataaatatttgacaggctaggtcaagttagaattttattgctgctgaccaaaggtcattgtaagatttaaaggtcacatagtaggtactatgtgatctttaaaaagttataaaacatgaattttaaagatatattttatgagtaaaaacgcttcacatttctggagctaatatcaatgtaatccaggtattcacatataattttaactgatatgtctaaaacattccttgttctgtgtccctctgaaagcaattttcttttaattctggatttcttaaactttaaagaaagattcctaaatttgaaaactactattttatgttaaataaactagttatcctaagaatgaaaaatttactgaaataccttaactgaaataaggtttgttgtcacataaaccttaaaaatgactatttgtgaatctaaattaacaaaaggagccagcaattgagaagaactcttaggaatagcagtcacagtgtgacagacacacacatacatatagataagggatttcctcatttatctcttcttcaaattttggctttaatcttaaattattctcagtatctttttttaaataaggacctcttattgttatttatatggacagattttaatatgtttgcatttgatgatactgtaaaaaacagaactgttgccagagttttaaaagtaaagggaattttttaaatgtacaactattagatatcaattttaaaactaccaaaaaactcagaatagccaattaaaccctaaatgatttctagtgaaatgagggaaaacacaagcacccggaagcctatcttgtctattataatagtcataaaatttctgaaatgtaaataatcactgcaatgctaataagagaaaaatagtattttatttacagaatacataaagttgtagaatacataaatttatagaaacttacatactccttcacctacagagtcagtgttaaacagccgaccctcggtgcagctgccctccctctatcctaggcacagccactcatcatctggtcattgttccttagcaggacagccctctcaaggaagttaacacagggcagattcaaaaggtcagaattaaaattcaatgcatgcctactgaatacctacctattgtgtgcccagcactcttctaggcaatgacaagctccctaaaaaaaagaacttaagaaactgtaatgaataaatgatgaggctacaaaaaaatcaaacagggtgatagacaatagtaggacggcctcacagaactgaaattgagatgaaaggacttgccagtgagaggtctggagaggagaacggtgtgcagtggactgaatcgtgccccaccgctcccctccaattcattatgttgggcaaatcccagcgtgaccgtatttggagatggggcctgtatggaggtaataaacgtgaagtgagatcataatggtggggccttaacccagtaggcccattgtctttataagaagagaaagaccagcgatctctccgcatgcacacagaggaagggccctgtgaggacattttgagaaggtgactgtctacaagccaggaagcgatctctccctccacagaactcgaatatgctgacaccctgatctccaacttccagcctccagaactgtgggaaaatacatgtgtgtttttcaagccaccttgtccatggtattttgttaaggcagcctgggctaagacagtgcgttcgaagagtccctaaggaggaactgctgcgggacttttccttagttcggctgaagacagggttttttgtcccatggccacgaaaattcatgctcacagacaatttgaatttgaatgagtaagacagggttttgttgggtgaaaaaggaagaaaaaggggaaacagggactctcgctaagccagagtccctgctagggtgcttcccaccagccatcctcatcccattttggggcttcccaccagccattcgcatcccagtttccacacaggaagaggaggggccaggctactccctgcggcaaatggtgtgaacctgtgtggctcctcccagtgggcaggaaagatggagagggtggaccttctccaaggaccgcctcccccctggctgtctcagaaccagcgaggtcaggccaggccagggattggagggagggaattagggtgacctgccagtgttgggggtacaacttcaccaggtcaattgtgctgtgctgaggagaacagaaaggagattcaaggattagacacaaagaaagtcactggtgaccttgataaaagcaacttcagtgaaatggtgagggagtgggttaaagagggaacgggaatgaggaagcaaggacagtgatgataaagaattctcttgaaaaactttactatgaagaataatgtggaaatggagcggggaccggggacagtgtggaaatggagccgtgactggggatagtgtggaaatggagcagtggcttttcagaaaaagtacttaaagagaagtcagatatattattaagacacacacatgcacacatatccaggtgtgcacacacacatgcacacacacacgcacacacacgcacacatatacacacatgcactcacatatatacacacgtgcacacacacgcaaacaagcgcctgaggataaacgtaatataagagggattaccaaagcctaggccaaattcatccactgaaaacaaaattattataataaaaaggaaccctggaagatatgtaaaaggaatttacatacaaaaaatcatcctgtaggaagtagaactgtatctactgtgttaaaaaagtttgtgtctcaaaatataatggcaaattgttattctattattttgttgttatttgttttttattgttttattttttctttggcatttttatcattgtaaaatacacataaaacttaccatttttaccatttttaagtgtacacttcagtggcagtaagtactctcatacagtgtgaccatgaccaccatctagttccagaactttttcatcaccccacatggaaaccccatgcccaataagcagccacttcccagaatcctttcccccagctcttaagcagccactttctgtctcttggatttgtctattccgaacgtttcatagaaatggaatcgtacagtatgtggtcttttgtgactgtcctccttcgcttaggaaaatgttttcaaggttcattcatgttgtgtcatgtatcagatgctccacatcctacttgttaggaaaatgaaaatctaaaccacaggaaataccatttcacacacattagcatggccacaatgaagactacagaaaataacaagtgttgacgagaatgtggagtgactggagccctcatacatggctggtgggaatataaaatggtacagctattctggaaagcagtttggcagtttcccatacaacacagcatttgcactcctaggtatatattcaaaggaattgaaaccaggtgttcaaacaaaaacttgtccagtaatattcatagcagcattattcacaataaccaaatggcagaagcaacccaaatgtccatctgcgaattagtggagaaatgaaatgtgttaagtgcattcaatagaacattattcagccattgtttcattgtgggcaggtctgtgtcaacctacccctaagttggaggaagctgagagactaaagaaagagacatacaaatctagttgcttagaaaagaaacttttaacagggacttataaacagaagccatgtctgtgtccctggcagtgatgagatgatatggtagatcctgaaccattaccccccagaagcaggacttatgtgctgtcagggaggggtacacacacttcagaaggagtggtcatgaatttgccctcacggtgggatttatggtaagtaggtgctcttatacgaggaggaatagataaactgaaaatctcagaggcattcccggaactgaggttaatcagaagccaacatggcagattagcacccaggatggagttgctttggcttccatgctccacccctctaatgcagctcttacagtctctcacgccctcctcttccatgaccatccctgagccttagagagagcgcttgatgttgtcaaactttagcagcagtgctttggcaatggaaaatagatcaggcccagtgggattcctaatgagggaggttcacaggctgttgaagcacctctagtcttcagaatacaatgacctcggttttctcaggagtaaaacagcgtgagatatataacattaataatttgcactcaaggattacagtcaaaagagaatttgtatcccagaacaacaacaaaaaagtacctattccattaaagagccaactaaaagtatcatgaagaaaattaaaacctggttcctctttagacttgcagacagcaaataattcaggatttagcccaaattgtaggtaaataataaaaactcaaaaacaatggtgagggctagtatccaaattttttggtctctagtttccccgtttctgccaaggataaatcataataggaccaatttattttcaaaataaattttggtctcattatacttggcctggttatttgcataaaatatggcaagaatagtgatcagcctgagctgcttatttattttttttccagacagagtctcactctgtcacccaggctagagtgcagttgcgcaatcttggctcactacagcctggacctcctgagctcaagcaatcctcccatctcagcctcccaaatagctgggaccacaggtgtgtgccacaactctggctcattttttattttttgtagagacagggtctcaatatgttgtccagactggtaggctctttttaagttgtctttgctggaacttttatgagaaattgtggattctgctttttaaaagcctcaaggctaggagccaagccaaggattcaccattagactatgcttgtaatacctatacaaattcctctcttcttgaattcccaaaatatcttaaggttcccaggcctgttagtaaatgacattctttacttaccataggtcagaaaccttgtaagagaaccatttagacaaggtactaggccagtctttcctagaaagaatttataaagtcaacctccattcctcagtctggtcaattctgaaaatatgccattccagtcaatgccttggtaaaataaccaatttctccaattatgccctgttagaaaagaaaacagattcttactgaacttatgcaaataaatatattgctatcagataaaaatactcataaatggtttccaaatttagggtaactcaggtagagagaagggtaaattttgttcacaaaattatactttacccaacctctaagctataaacagttcaaaagaaaaagaattttcttgactcttcatcaatcagagtggcagccttctaagcaggattacgtacatccaccttggaactgccatccacaagccctgcagctctttgtccgtcaggtgagagctgcctattgggcaccgtagaatccagcagctccttacacagttccagaatcagtcgaacaaaagccatatctgtgtctctggtggcagtgagacgaggtgtttgatccctacctgttgttctaatagtaaggcaacatatttgcaatgacaacagatatttgcaaataatgtacaaacaggtcataaaaagaactaatgaaggctggccgtggttcctcatgcctgtaatcccatcactttgggaggccgaggtgggtggatcacctaaggccaggtgatctctaataaaaaaaaaaatctctacttaaaaaaatacgaaattaaggccaggcgctgtggctcacgcctgtaatcccagcactttgggaggccaaggcgagcggatcatgaggtcaggagatcgagaccctcctggctaacacggtgaaaccccgtctctactaaacaaaatacaaaaaatttagccaggcgtggtggcaggcacctgtggtcccagctactcgggaggctgaggtgggagaatcgcgtgaacccgggaggcagagcttgcagtgagccgagctcgcaccactgcactccagcctgggcgacagagcgagactccgtctcaaaaaacaaacaaacaaacaaaaaacaaaattaactgggtgtgttggtgcgtgcctgtaatcccagctactcaggaggctgaggcaggagaatcgcttgaacccgggaggcagaggttgcagtgagccgagatcgcaccactgccctccaggctgggcaacaagagcaaaactccatctcaaaaaaaaaaaaaaaagttaaaaaaaaagaactaaacagaagataattttttgtaggaaagaactgctgtggtcagtgatcttggaggatatgaagatgtagagataatttcttttctctttctcaatctctctcactcgctcaatctttcatttgacttttgtctttcaattgctccgtcttttttctcttttctcataacttttgtttttcaaaattttgagaataggaattatgcaggtactcagtatttattgtttgaaggcacattataaaagaaaagtgggaaaaacaaatctgtaagttacttcagagagacacttaaaatctaatgtcagaggaaggaagaaagcagcaggatagaaaagatgtgataaataaaccagttatagcaataataatattatattagaatcagacaaactgcatcaataatgataaagaggataaggacataagggtaaattcaacaatttaccaggaggttataataatgctgaacctcagtgtgccaaacaacaaagcctgagaggcagtgccgtgtcatatagccagactgcttgggcttgaaacctaattccagcactgactagctgcagaccttaggcaagttattaaatctctctctgtttcaatttcctcatattgaaaattaggatattaataatgcctacttcttccagtcgcttgaggatcaaatgaactagcacagtgttcacaacagtgtctggcatcacaaacattggtgttattattgttgctgttgttgatattagtattattgccccaaaacatataaagaaaaaatagaattccaaggaaaaatagacatgtcaacagtcttagtagaagacttttaactttatttatctctcactaagataaatttaagtttggaaatgtttaaggtagctgcaataaaatgtttgaacaggatgtcttagcttaaagtcattacaaaaaagtaaatagaacatagtgtacataacaaaactacaaaatacaaagaaaaaagtaaataaaaaacaacaaccgaagaccaaaaaataagatgacagaagttaaatgagaccataaatgtcaatgacttaatgtattaaaatacaacatcttaggccatagtaaaatacaaaatttaattttgtgcttacaagaaacacttgtaaaagtgtgacaataagctaaaagaattagcaaaacataccaaaaatgttttaaaaatatagtatagatgacatttttattatgaaattagtatacaatgtaaaattatccataaaaacattgggcctttaggacctaagaaaaaataattatttcaaattgtacaaaataatgttttaaaacatttccaaatgcacataaatctctgagaaaatatatattccataaatgtatgctgaataacataaattttataaatataaaaggaaagtaaagtaaaactgatgtctgtataaacctacattagggatttgttttctatgctccagttccaacagaggatctggacattgcctcttccctgcttacttccttgattggctggactccctctacatccccagcttctacctgaacatgcattgtaaatgggaagtctgtgagcagactgtagacaggcctgctgcttggggaactgtaggaaatttgattcaccccaacccacagtaaacactcaggaagatgatgggttcattacgagttactcacatccaggggtaggcaggcatgtggcgtgaaactccagaatgctgagagagagctggaaggtacaaaaatctcccactaagtggtattacaattttcggttacaaaatcagaatatcactttttatcccataaatatatattaatatatatataatgtatggactatatatagggaataaatatatgtataatttgtctctacatagggaatatgtatatatgtaatttatcaataaaaaatttgttaatctcctactaatgtaaaagggagtttctcaaaggtcttgatgggctcctcacttgattagaaggtggtaactagaagctgggtgcattcataaggatttgaaaaccaaggaaattatcacctcttgctgggaaggccccatcccttgctctgtgtagatgtattatacctgcagtctgagtctgtgggctcatttccatgtacactctcaccttcagctctgccgccttgctggcagtagctcaggccacaggtaccctggacagtggagggctcaagcaagaccaaatcttctacaggtagatgattcccaactcacaatctcttttctcaaccccagagttttagttcccattccctggtgctgctggatgctactgccaaggtctggacaggggacatggagggacactgagggtgatgggtggagatgtgggaaagagatttgtctccgctcccagaagaagcaggcaaagggaggttgggatgttttgactttgaggtgtcagtggtcccaggttcagcccactctttgtcctctccatttcttcttgatgccctgaatgttctacctgtcatccaggctccagtgaacaagccaggaatcatgcttgacctctcactctcctgtttgccccaaagaaggcatatgcctcccaggaacgtatgaacatgcacttctgtagctttcttcttagaaccttgggcaccaatctttttcagctgtttttatttctttcattttatttttacgtggatcttttcagcaaacattctagaggcttcttgaatcctattcaatatcatacttgagccaaatggtaacgaattaacaaaaaggtagcaaattattaatatgctgtcaatgtgcattgtatgtggatgggagatttaactgttaaggtctaaaggtccatgattttaacctcattgctcattgattcaggacatgatgacatacttcaggtcattagggggatgggttaaggaagtcttcctgaagttctaaagagcgtgcccctctggagtgggtgacagctgcatagcttgtctgccgtgctctgcccgaatgctgttttcacatggcgtctcttctttctttactttcaggtagaaattgagaagctggattaccatcattatctgcctctgttttttgatgggctttgtgaaatgacatttccctatgagttttttgctcggcaaggaatccacgacatgctggaacacggtgggaacaagatcctacctgtccttccacagctcattatcccgataaaaagtaagtgaaccggtgaaaaagcatcactcagtttatacggtgttgctttttgacaacttgctaattaagcaataaaccatgacagactgaggtgatccccagttttgcaggaattttcataaattgacttaggaggccagacaacccaaatctccaaaaatatatcccatcatcaatatttcactatggcttagccacataaataaaccaaattccatggggtttgtgctaatttaaaatgcctcacagtaatgacataagcattaacattaacttacgcatccagaggtctttacctgctgctgctaacttccaagtcttttttttgtaaatggcatctctaatttttaaattataaacaccgttatgttgagtatatttgaggtagtaccattcataattttaaggaagggaagcccagctgcataggtgaaaagaagaatgtttttaaatacctgaaacttttaatctacaataggtaagctgggtgactctggggtagccctgtgattggctttgtctgtgaaatgagattgtccttcctttctgcatgcaccttgctcacaacattgcacggccccttggactggttgtctaagaacctgaggttgtcccacgtgacagccttctggggttccagaacactctctggccattcttaccttgctgccagtagagccaccctgatgggcatgcctggcatccactggtacaggctcaggaagaggatggcctctcctcaagtcaaggtggcagggctggcccctctcaccctcaccagcacatcccctccccagccccagaattgcccacctgtcctgcattgctactgctgctactgctactactaattaaaagcagaggatcagtgcctcctctgaacactcattctgcagatgagggagaccctacctttttctcagccagagctgctccaggcactttcaccccctggatccaggcccaactgcccatggcttcgaggggtgaggaggcccctgctccccccgccccaagttctacctcatcttccactccaggatgggcagcttcccaaaatgattgacaggacgcttagctagtcttctaggttggggaaccccaccctcactggctcaggtgagctcttgccgtgtgctttcatcagaacaagaacaaactagctcaacatagggtcatctcccagagtctggattatttaatcgtatccaaggtcaccatttttattcattcattcgaatttatccattcattcaaatgtatcatgatcaaaatgctagatttccacagttctgctcttactgcttgcatcaaatcaactctgaaactctccctcagatctttgaggtctccgtagagatctgtaagtgaccacaccacatttccaccatgacagacagtgaaaccaaaccaaaggacggtgctacctgatgtgcgagtaacacagagagaaaagagactctgaaaaggggcttattaaatagcagcttgcttgcctcatccacagctgcaggaaggcaggctccttaaaggctgtcagggagggtgtagcgtcccgagccacgttaaaaccttttccaaaagtaatttcttctctcagatgggtcacatttttgaatacattaaattctacttgaactgctacatttctaaaggatgatatgtagctttctctgataaacaagaaaggcccagaatattctccgcaggaactatttgttcttttcctctggcagaatagcagcaatattcggacatatatcctttttttttttttaaatcaatgcttcatgttgggatcactgccttctcaggggtctctccctcagagtccactggaagacactgataggcagaaaaggaattgctaagtaatattttgattatgttgtctgcaattaaagcataccacactggagttttgcaggccaaggtaaagtgattttcaattttgtttgatctgtattttgaagatacataaatgagtaaagcgaggagtcatgtgactaaatttacagtacacacatgctagaggtcatctgccgatgagcgaaaacgttatcaagaactcagtaaacatgatttgtcagggaaaattaactagatatgaatttgatgatttagggttccggaagcaatgacaatttatcttggttgatgccattgcgtggctttcagcgcttctgctattcgatactgatcctgagtgtaactgctccttccttctcaatctgtttatgtcactaaaagcagacttttctcaagaagaaatgctgattacttatgtaaggtcatgcacagttccagcacagtgtgaaaaatattatgtgcataaagaaaatctttgaggaggaattctgaaaggaggctaacaggatctagaaaagggctgatgtacataattgacataacgtataacatctctgtgtattttattttcacaccatacccagtataattttgactctatccaggggcaaaaattaacctcaccattaccagcaagcagactagaagtttttttttttttaattctaactaatatctatgaaaacaaagcaaaatgtataaactcactgtgaggcagtgagctgggattagctgcccttgtatttctggaaactgggttgatttcaacaaattagaaggctgataatactggaatgagaaattgacacatttagtggctctggggtttctaatatgataacaaacaagaatccaccgttctttctcctactgctgcttggttcaagcccccaagttctggaataacccacaccgtgggtctcggacacctatttcactgacgttgttttctggcacaactactgctgctcccttttccctcccacctttctgatttccatcttgagttattttgggtcagaaactccaaaatcatgctgacataaagtgctcagggttggtgatggagcattgattgctgggagcagcagcaaaacctcataggggaggctgagaaaagagcagccctcttacttgtctggatcggggattacagattcacatttactccatccagtaggaaaagacaaatccttctcaatccatcagagtgaaaccaggaggcagtgtctggaatctccgcatacgaaattcagaaggggattcttccaaaacagcggtcaagagggcagagaggggccaagagcaaccagcaaactctaacaatctctctcctcaataaaagtgagaacagtagcaacactgcagccacagggggccatgggaaaaatctctacacacagggaaggaagtattgtgcacaatcggaggaaaagaatacctcaacaacatctggcatatgaaccagaagaaacttgtagaaacttgtttgacatcctcaggattcaggaagacgtggcctctgagaaacagaagcagaaatccagaagaggagattagactcaaataaaaagaagtccattttgaacaggacaaggcaaactgaaaatgccgtagtagaactaaaatctccatagaagtatagagaataatcaactgcacaagatcaattataaatgcaacgttaaggcgctctctcagaaaagacaagtgtataaaaataaggccagaaaagatattaaattggaggacatagaacacaaaagagttaaaagttagtgttcccaagaggaactatcagagcgacaggaatagcaatcataatggcagaggtgattcgaagagatgttctaggaggaaaaattatctcttattacgcaggtagaaaatacttgcagcaatctaaagaaaatcagtgaaaacagactcaggtggaggcacaatttgccaaaaactttaaattataacataaagaaaaatccttcaaacgtctggacaggggaaaaagcaatacaacaacaaataatactgaggctaagattttttgcaagagtaaattccagacaacagagcaccttttagagaaatggggagaaacatcttgggcgtgattttaccccggtcatgtgaagaaaaacactgtggacgcagtgactgcagtatccctctgtccttcatccagaaggtgaatggggctgtgctccagctcacagcaagtaaagcacagtgagagtccccaagtgaggaggacagtgtagtgtgaaaagcagtcagcactaaacctagggttatgtctaaatagtggagggaaaagagtttcaaagccacatgaagtgttgaatcataattttgcagtaatgactcttaaaaatcccaggaaaactggggtctacaccctcaaagtcaatgcagaagataaaggtagttaaacagagtctgtctattaaaaggacaaaagctgagtagacagcaaggaagggctaagaaccaaaagcacaaaataggatgaagaatgtaacatccaatagatcagctacgaaaattaactttacaactgaaaaaacaaaatctgtatgtaaactctctaaaaaacaaaataatacttaaatatgttcaaagatatattggaataaataaaaaagcagaagtcgtgattttaattttagaaaagtaaaatttaattgtaaagagttttcaagtgtataaagaggatcaatttataatgattaaaatattcacaacaaaaatttaatagtcatggcccactgtgtactgcaaactatgacatcatatttgagaaagaatcagctgctactcatcgttttcaccccggaaggaaggtagacttcttgactgagagctaaaaagatccctgtccttcctccacttcctgacctttgactttaagatctaggatcttcaccaacccaagtgaacagccttcctgctgtagcaccgcttcccaagcttcagtatgcatccgcggaccttggtaaaatgcaggctccagatcagcagatgcgaacggacctgagatgctgcatctctgacaagcccgtggtcgatgctgttgctgccgggctgaggcaaggcctgctagggcacagtgagtgcttggacgccccaggccccaccaaagagtcctggacacgagagccaggcgtgggacatgggtgggaggggaagagatgaatgctaattttctcccttgtatgtgggatcaggagatactgcattgttcataatgtgcatgattagagaaacacaactttaagattttaggccttaaatgtaaccattcatggattaaaatagatagtatgcatatgaggtacaagtgaaagaaaaaacactttcagtaaggcaatctttttttaaagaaagccaaggtaacttgtaaaaaaatagaaatacaacaagaggacaaaaggaaaaccaaataatctgttgtttccacgaaggattgggagaaataattcactagtcacaaggaaaaagtcttgatttggaaactcctttgaaagactggttttagcagggactgccagtcacctcatgttgattagaatttaactcccctccacaaacataccttcttccccactaattaatgatcacataaatactgttcactgcaagtcccacatctgctatgattacttttctaatacaacttgtttttctcagcattgataattgcctctcattttgcatacttgatttttatatacttcctaattttcttcaagtattacaagatctgtcaaaagaatattattttcaaaatgttcagaacattaaataacccagatttatctgacttcatctgaaattaattttatttccctttctggagacattcactcttccatcctccatccatccatttgctccaatctggaccacatattgtcttggcctgacacttcctgttactccttttttatgttcaacctctttccttagctctttgtcttgttttcctcatcactgttagagtttgcatcttctagtaatttccgggaagcatatgaaaggtatattttttagttcttgcatatctgaaaattctatcatcaagcttgattatgagtttgctttgttgaaaacccttttcattcagaacagggaggtcatgtctctatcgcctccagagtcttatgttgctttgaaaatcttgatgcatctgaatttctagtcatttgcctgtgacctattggcctccaatctctgaacatttttgaatctttatctctggtgatatgaaattttatgtggatatactttaatgctttttttttttttatcaattttcccaggaaatttcaatttagagacctatgtctttctgcactaaaaactttttatgtgttacttctttaacagtatcttctctctgttttctcttggttttctgatgtaattccagccagtcatctataatgcctcccagtggattctcttagttctttatctttttgttcattttttcctactctgtcgcttagttctatttcctgagaaatgtccttgactctatcttccgaaattgtgaatatttcactttagttattgtaactttcctttcctctgactgttcctttttttatactatttggttcttttatgtttattctcttatctctctgtgaatatttattatagatttgtagcgcttttctttgtttggggtggggggtatttagcagtttctttttggcttcctgacttattatttttttgacttattcagtaaaaataaattttccctttgctaccatttcagactttctttatcctgcttatagatcaacaggtaatatactggctaagagcatagcctggaatcagactcaccaattgaccaacaaggcagtacctctatgactctgcaagaatctcagcattactgggcttgcagtgctcccagtgcagatacagcttagacaacaatacccaagtcctttcgaatatctgaaaagccttccaaaacaggatagctataaataagcccagactgtgaagaccgcaatacctaacttttcaatgcccagacgtcaagcatcaagaccatccaggaaaacatgaactcaccaaaaaaaaaaaaaaaaaagtaagttagttaccaggtaccaatcctggagaaatagagatatgtgacttttcagacaaggaattcaaaatagctgtgttgaggaaattcaaagatattcaagatgacacagagaagaaatttaggattctgttagataaatttaacaaacagatccaaacaaaaagaaccaagcagaaattttggagttgaaaaaatgcaatgacatactgaagaatgcatcagagtcttttaatagcagaattgatcatgccgaaggaagaattactgagcttgaagacaagctattggaaaacacacactcaggagagacaaaagaaaaaagaatataaaataatgaagcgcacacttacaggatctagaaaatagccccaaagcggaaaatctaagagttattggccttaaaaagaaggcagagaaagagatggggtagaaagtttatgcaaaaggataataacagagaactccccaaatctagagaaaaatattaatatctaagtacaagatggttataaaacaccaaccagatttaagccaaagaagactacctcaagacatttaataattaaactcccaaaggttaaggataaagaaagaatcctaaaagcagcaagagaaaataaacaaataacattcaatggagccctaatacatctggcagtagactattcagtagaaaccttacaggccaggagagggtgtcatgacatatttacagtgctgaaggaaaaaacttttaacctgtaatatatccagcaaaaatatccttcaaatatgagggagaagtgaagactttcccagaaaaacagaagctgagggatttcatcaacacaagacctgtcctacaagaaatgctaaagggagtacttcaatcagaaagaagaggatattaatgagcaataagaagtcatctgaaggaacagaactcactggtaatagtaagtacacagaaaaatagaatattatagcactgttattgtggtgtacaaactacacttaagtagaaacactaaatgatgaaccaataaaaataactacaacaacttttcaagacatagacagtataataaaatacaaatagaaaaaaaagttaaaaagcagggggacaaagttaagatgggggttttgattagtttttgttttgcccattcatttatgcaaacagtattatcagcttaaaataatgagttatgagatagtatttgcaatctcatggtaactcaaatcaaaaaacatacaatggatatacataaaataaaaagcaagaaatcaaatcatatcaccagagaaaattaccttccttcactaagaggaagacaggaaggaaggaaagaaggaatagaagatcacaaaacaaccacaaaaccaaaatatcaaaatgaccatagtgagtctttatcaataataacattgaatgtaaatgcacaaaaatctccaatcaaaaggcacagagtagctgaattgatttaaaaaaaaaaaagacctaatgatctgttacaaaaaacacacttcacttaggaagacacacgtagactgaaaataaagagatggaaaaagatattccatgccaatggaaaccaaaaaagagcagaagttgctatacttatatcagacaaaatagatttcaagtcataaactataagaagaaacaaagatataatgataaaggggtcaattcagcaagaggatataacagttgtaaatatgtaagcacccaatactggagcacccagataggtaaagcaaatattattagagctaaagagagagacagaccacaatacgataatacctggagacttcaacaccccactttctgcattggacagatcttccagacagaaaatcaacaaagaaacattgacttaatctgtactatagaccaaatgaatctagtggatatttacagaacatttcatccaatggctgcagaatacacattcttttcctcaacatgtggatcatctcaaggatagaccatatgttaggtcacaaaacaactcttaaaacattcaaaaaaattcaaataatatcaagcatcttcttgaactacaatggactaaaactagaaatcaataagagaaactttggaaactatacaaatgcatggaattaaacaatatgctcctgaatgacctgtggatcactgaagaaattaagaaggaaattgaaaattttcttgaaacaagtggtaatggatacacaacatgcagcagaaacatgagatacagcaaaaacatgactaagagggaaatgtatagctgtaaggctacatcaaaaaagaaaaacttgaaataaataacctaacaatgcatcttaaagaactagaaaagtaagagtaaaccaaacccaaaattagtaggagaaaagaaataataaagaccagatctaagttagaaaaaaaaaaagacccaaataaataaaatcagagataaaaaaggaaacattacaactgatatcactgaaattcaaaggatcattggtgggtacaataagcaactatatgccaataaattggaaaatctagaggaaactgacaaattcctaaacacataaaaacctacctaggttgaatcataaagaaatccaaaacccaaatagaccaataacaagtaatgtagacaaagcataataaaaagtctcccagcaaagaaaatcccaggactcaatggcttcactcttgaattctaccagacatttcaagaagaactaataccaatcctactcaaactattcccaaaaaaaaaataaaggagaagagaatacttccaagttcattctataaggccagtattatcctgataccaaaaccagacaaagacacattaaaacaaaaagaaagaaagaaaacccaagctaatgtcactaataaatattgatggaaaatcctcaacaaaatactagcaaactgaattcaacaacacattaaaaagatcattcatcatgaccaagtgagatttatcccagggatgcaaggatgttacgatatatgcaaagcaatcaatgttatacagcatgtcaacatcatcaacatatgaatgaaggacaaaaagcctatgatcctttcaatttgtcctgaaaaataaaaacaaatgtttaacatcccttcatgatgaaaacccctcaaaaaactgactatcaaaggaatatacctcaacataataaaagccacgtacgacagactcacagctagtatcacactgaatggagaaaaactgaaagcctttcctcctaaaatcaggaacacgacagagcgcccactttcaccactgttattcaacgtagtactggaagtcttagctagggcaatcagacaagagaaagagataaaggggatccaaatgggaaaagaagaagtcaaattatccttgtttgcagatgatatcatcttatattttgaaaaacctaaagactccaccaaaaaactattagacctaataaacaaattcgtaaagtagcaggatacgaaatcaacaaacaaaaatcattagcatttccatataccaagagtgaacaaactgaaaaagaaattttacaatgtagtcccatttacaatagccacagataaaactaagtacctaagaattaaccaaagaagtgaaagatctccacaataaaaacttaaaacattgatgcaagaaattgaagaggacaccaaaaaatggaaagatattttatgttcacgaattggaagaatcgattttattaaaatgtccatactacccaaagcaatctacagattcaatgcaatctctataaaaatacctatgacattcttcacagaaacagaaaaaaacaattttaaattttatatgaaaccgcaaaagacccagaattgtcaaaactatccgaagcaaaaagaataaagctggaggaatcacatcatctgacttcaaattatactacattatggcataaaaaacagaagcacagaccagtggaacagcatagataagagagaagtcagaaataagtccatacatctacagtgaactcatttttgacaaaggtgccaagaacatacactgggaaaagaaaatctcttcaataaatgctgggaaacctgaatatccatatgcacaagaatgaaactagacccccatctctcaccatatacaaaaatcaaatcaaagtggattaaagacttaaatctaagacctcaaactatgaaactactacaagaaaacattggggaaaatctccaggacattggtctgggcaaaaatttcttgaacaatacctgacaagcacaggcaaccaaagcaaaaatggacaaatgggatcgcatcaagttataaaccttttgcatagcaaaggaaacaatcaacaaagtgaagagacatctcacagaatgggagaaaataattgcacactatccatctgacaagggattaacagctagaatgtattaggagctcaaacaactatacgaataaaatctaataatccaattttaaaataagcaaaatatctgaatagacatttctcaaaggaagacatgcaaatagcaaataggcatatgaaaaggttctcgacataattgatcatcagagaaatgcaaatcaaaactataatgagatatcttatcccagttgaaatggcttttatccaaaagacaggcaatagcaaatgttggtgaggaaaagggaaccctcatatgctgttggtgagaatgtacattaatacaaccactatggaggacaatttggaggttcctcaaaaaactaaaagagagctgccatgcaatccagcaagcccactcctaggtatatactcaaaagaaaggaaatcagtatatcaaagaaatatctgcattcgcgtatttattgcagcactattcacaataaccaagatttggaagcaacctaagtgtccatcaacagatgaatggataaaaaaaatatggtacataaacacaatggagtgctatttagtcataaaaaagaatgagatcctgtcatttgcaacaacatggatggaactggaggtcattatgttaagtgaaataagccaggtgcaaaaaagacgaacttcacatgttcttacttattttggggtgctcaaaattaaaacaatttaactcatggagatagagagtagaaggatggttaccagatgcgaggggagtaagcggggatggttagaaggtacaaaaaatagttagaaatagtacgacctagtatttgctagcaaaacagggtgactatagttgaaaacgacttaatcattcatttttaaataactaaaagagcataattggattattagtaacataaagaataaatgctggaagtgatgaatacctcatttaccctgatgcgattattacacattgcatgcctgtaacaaaatacatattgtaacctataaatatatatacctactatgtacctacaaaaaataaagcaaaaataaattaaaatacatacagaaaaccaccatacaattaagagaaccaaaaaccaaatgttggttggttcctttaaattacgaataacattgataaatatttggtaaacttagaattaaaaaaattaattagccagatgtggtgatgccgcctgtagtcccagctactggagtgggaggctgaggtgggaggatcgcatgagcccaggagctcagtgttacagtgggctgtgattgggcactgcactcccgcctgggtcacagagtgagactctgtctcaaaaagtatatatatataactaaatttaaaatgagagaagacagaaataaccaatatcagaaataaaaaaggaagtgtcacacaaatcctacagacattgaaaatatcatgatagggtattaagaacaacttatccctaaaactttgaattgttcatgaaatgatcaaggtggaaaatataacttaccaaaactgacacctgaaaaatagaaaataagttaaaatacaaacactaatacaacaaatgaagaaattaagtcagtaattaaaatcccccacacaacaatagctcaaggctcacatagcttcactggttagttgtaccaaacagctgaagaaaaaaataattgtcattttgtacaaatttttccagacaataaaactggagaatacacacttcaactcatttcataaagctagcataaccttgataccaatattcatggatattataagaaaggaaacttccaggacaatctcactcataaacatcaaggaaaatttattaaacaatataactaacaaatagaatccatcaatatataaaaaatgataatacctcatgacaaagttggttttatttcaggagtataagactggcttaacactagaaaaatcaatcaagccaatttacaacattaatgaattaaaaaatgattatttaataaatggtgaaaaagcatttgataacatttaacattcattcatgtatttaaaacaaactgagaatagaaaggaattcccttaatctgatacagggaattttatcaatcagaataaactagtttacatttcaataacaaccaatcccaaaaatcttaggggcttaaaacaatacattacttaaaacatgaacaatatagatttctgactgtgcaacctgtctgttgcaggttagcagcaaggttctgttcattgtcattgcttagggacccagcctgatagttgttgctggttcagtaccacaggaaacaagagctcagaaggtccaccctggaaggggcacatttcacttctattcactattcattggccagacatagtctagggcccatccaaccttaacagggccacaacgtgcaatcctacaagggcattatgaatacattttacagcccctggattctgttgtcttcctgtgaagagtgttgattctaattctggcagacaattaattggacacagaccccaaaccttgtcttctctgtggtggacaacagctgaagttatttcattttcagttttttcatcttgcagcttttgctcgccatctgggactactgggaatctccccatgtgtgtaattctaagaggtcagctaaggcagagcttacatgcaaatttcagtttacaccctctgcgaggccctcgcttccaagatcccctcttccaattttctacctgctcttccagcccagaactctctctccaagtcagtttacctgctttctgctgccccaggccacacaacttagctcgtagggaaaaagctttcaactcaccttatcaggtgcatttccagattttaagggcagactcctctccaaagtcggcctactttaaattctttggcatggctttcaaggattcccactatctggctgaaaattttgtttttgactttatttcttactatttcccttcattcaccctgtgctctagccaaaccgattgtgccgtagaacttgccttgcacttttctaattctttgtcttcgctcatttttcggaatgcccattctcacatccccagatgcctaaacattaagtgaccttcaaagcccagctccaatatgaattgatctataaagcctcttctgattcacctctccactccctaccctcaactccagtcctatccccactctgccttccctccccgacataactttatagctcctctctcatgtcacttagaacataatgttagaaagtaatacatccccacagcatctaatgtcctggctagtacacaagagatgcatcaaaatatttgcaagattaatttaataaggtacataactgctgtctgtactgaaatctgtataggtgccgtaatcaaaagcatgaagtggccatttgggcctgccactgtactatatattctataaaaactgtcgcataagactctctcatatgaaacaacagatgaagggtataatgatatagtgctttctatttattgggagaattatttaagtggtgagagtacatttctgttgattcatctacattctctcacgtgattctatcataagcagcaacatacttttgtgagatggcctagtaggaggagaggtgaccctggttgccaaagaattatggaaatatcactgctttacaaatagacgggccataacacggtggcttcattaggagagctctaacgaggtgaggtcatccggcagtaaagggcaggcgtgcacagacacagcggaagaaacctgagcaagaacattttaccaagcaaaatattctgttaaggaaaacctagtggggaaaaacaccaccgagtaagaatgaaatatgagaatccatatcacaatacaaaaattactttgggaattctatttactaagaaagaagcaagtacaattgaaatgcattaccctttactcatgatctaataattttacttatcttgacattttccaagtaaattattctgaacgtgatcataattattttaaaagtaatgatttttaattttggaaaaacaagtctaatctgtttaaaaaacattaaaaagaggtgtctgacttaggattattttggttaccagatacagaaagaaagtggtttcaaattgtcttagacagtaaagtttgcctggtcactcgccagaggaaggaatcaacatcaggcctcgccctgtatgaacaggggaatgaggaagggtgatccagcacccacgatggaggcggcagagatggagagaatggacagcttagctgtccctgccagcaaggcacagcatgtttaaagagagaaccagctagatgcattttcaagccgaatccgccgtgcattaactgtccctttcccactctcaaataaataaataaacaaaccaattctatcactcttctagtgtaatgtgatgttgaggggcaaaagctctgaagtcagactacctcatcaaaattccaactctaccgcataactgctatcgtccaagttaactacctggagactcaggagcctaacttataaaattggggcaataggaccgggcgcagtggctcacacctgtaatcccagcactctgggaggccgaggtgggtgggtcacctgaggtcagaagttcaaaaccagcctggtcaacatggtgaaaccctttctctactaaaaggatacaaaaattagccaggcatggtggcgggtgcctgtaatcccagctacttgggaggctgaggcaggagaatcacttgaacccgggagacggaggttgcagtgagctgcactgcgctccagcctgggcaacaagagcaaaatttagtctcaaaaaaaaagggggggaggggggcaatgatgataatgacatccaatttattgggctatttcagtgattaaatgagctaatatgtaaggttataagtgttatcattgtcatcattatcatcgtcatcattatcatcatcatcatcattctctgcctaaattacggcaacattttttagtcacccgggctagagcctcagactgagaatcttcactcctgctcccatgtggaggctgagctgtagtcaggactagcactaccgcagtgcctccccttgctcttcaaaagttgccgtgaaaccccacttcatcactattactagtggcttattccttaagccaccaaagcacaggacacagcaggtgtctcgaatgcctgctcaaagtccaccctagattctatgtttgctgtgccgctttgaacatttctcatgagcacacgccaggttggctgtacaccagtatcccatgcctgtgggtacgctgggagggtgaggggcctgagcatgctgagtgcagaccggatcccagcttgctactaactagctgtgtgatctcaggccacctgactcttttaactgtcccagagcattagaaaactgattgcccagagacactgtaaggagtaatgagattatacaaatagaacatttagcatggtgcccgatcaagaataaattatttttatatccttggttttccttcatggtcatgtctctgcagacttctaaattggggtcatcaaaaaaaattgatagatttggattctataacattcatccaagttacagtaaaaactttagatggaaactggactcgatcaaatatagatacatgaggtatcccactcagggctgtacaggctggtaccaaatcattagtgcgtattacttggatacaattgttcacagagttaaaaaaaaaaaaaagaaagaaagaaaaagcctactttttcaaccattcctgtatcctccctataaggaaaaccatagaggccttgccagatgctttgctgatacagtttatttattatctcctttatgaggaaacatattagaatacatgaggttagcttggctggccttattccagagagctcactctgactcctggtaacaactactattttcctaggagctcccgaatcacctgcttaaataatcagtcctagaatcacagcagttattgatgtcaggcttagcagtgtgtagttttcaaactccttcttggaaattggtctctttacccgtcttctattttgtgcacatctcttgtcttgttttgtgaagagcctgtgcacattgtatctttctttacactccactgcttctactgtctaaaccctgtggaaatgtagacaccttttctcaaccagaagaagaaatgtagcagtcattctttttttttttttttttttttttttgagatggagtctcactctgtcgcccaggctggagtgcagtggcgcggtctcggctcactgcaacctctgcctcccgggtgcattccattctcctgcctcagcctcccttagtagctgaaactacaggtgcccgccaccacgcctggctaattttttgtatttttagtagagacggggtttcaccgtgttagccaggatggtctcgatctggtgacctcatgatctgcccgcctcggcctcccaaagtgctgggattacaggcttgagccactgtgcccggccctagtcattcttagaagtagtggtgcatgatgcagcattctcttggtttttactctgaaaatggtgctaactccttcctttggtcaccttttcagttttcaccccaatctttgcagatgaactgagacacaatttaggtacagaggagcaaggagctccaaagacacgaacctgccccgcctctgacagtgccacagtgctgatgggtttactctcagtttctgtgagacgtgctcatacgtgtgtaagcaagtgcaggcccaacctgggcaacaagactgaaaaggagtatgttggatgacatgacgcttcaggtttcattctctgtgtctggaatatggggagtgtcaaatagatcatgctagggactgcatcatggagaccattttggtaactgaatactttcatttactcaaacagcatgaattatgtatctacatttaaaacaaagtatgtcatggagagaatggccaaacactttcaacaaatactaaattatattctacagccatgaaagaatatattttgatctattgaaaaattgaaaaagagtcagccacttgtaatggcaaaactttgatggaaaatctgagttttgcataaagatagttgcatggcatgctatggtatttatatattttacatattatatatgtgttgagagaaaaatcaatattttttgtatgacatttacttcaagtaggagaaacttgaaaacaatgaattaaagaaaaaaatgtaatccttattataggcttacctcatgtccataatagctgatctaaatcgatcatactttaattgcctaggaatatgataaatcaggctgtgtcatatttacttatatagcaattgagctctgttatggaaggagaaaaatttctacaattttgaaatctaaatttggtttgaaaatatattttgaattcattctaccctataaaatagaaaattatatggttggcactcctgaactagcaaaatttatatccattgtaatctaattcaactaacgctataatgggcccaaaacataaaatatttattaaacattttaacttcagaaaaaataataaaattctatgagacactataatagacaaattcataaagacaaaaagtagattatcagggactacagcaggggcatggggagtctttgcttaatggctacagagttgtgggtgatgaagaatttttagaaaaagataatggtgagacttgcacaacattgtaaatctaattaatgccactaaattgtatactttaaaaaggtgaaaaggcatggtggctcacgcctgttaatcccaacactttggaaggccaaggagggcagatcacttgaacccagaagtttgagactagcttcggcaacatagtgagaccccatctctacaaatataaaaaaattagccagccatggtggtgtgtgcctgtagttccagctactcaggaggctgaggtgacaggatcacttaagcccaggtggattaagctatagtgggctatgatcacaccactgcactccagctagggtgacagagtaaaaccctgtctcagaaaaaaaagtgggggggagtaaatgccatattttatgttacatatattttacccactaaacaaaataaggtattaaaatacataagaatgataaaaaaactaacatgcctgctctcagcactataatgctatattttcttttagaaattctagcctctgtcacctgaccaaaaaaggagagataaatattagaaagcaaacacaaatttaacaatatttttggtaatatcattacatataaaatccaacttaattcactcaaaaacaattagatccagtaagggaattaaataagttagcccgttaacaaagtaagtatataaaagtcatatacttttgtgtgtatattatcaataacctttaggaagaatattgggattaaataattttacacaaataacaacaaaatatagaatttctgtgagtatatctaacaaaatttgcaggatctatgtgaaaaaatactataaaacttttccaaggaacttaaagacaagaaaattgaagacatatcatgttcctaatggaaggattcagtagtaaagatggcaattgtctgccaaattattctctaattttaccaaagggccaagcacatttgcaatttcaactaattatcttaaagtttgtctcaaaaaataaagggttaaaaataattgagagaatattgagaaagaacaatgagaaatagattgaattctgatctattaaaacacaaagttacaatcatgaataataatatgtaataacaaaagaaaaatatgcactgtatattgataattttttagaaagcagtttttaaaagcgcttatcttttagtggaacatatgtctatggaaaagatagtcccttctgttagcgtctcagtacacaagtttctagtatttatgcagtttacattctattttataaaatgaggtccgagtgcaaatatgctttatagtttacttctttagtcacttgtgtcttaaacattttcctattttaaactattttttctattagatgactaataattttatagtttttcattgtgtggatatactatagtttacttaaacaatttgttgttcttggaacatttagattgtttctaattatcaataatactgggcttagcattctttcctacaatgctttgtgcacatttgcctaaatccttggactaactacccagaaatgaaactgctaggttagctgttttatgcatttttatggcttttaggtttattgccaaactgctctgtagaaaggttggaatagtttataacatggtgtctatcagggcgtctcctcttttctcttttctcaaacctgtttccacactgacagtgttaaattgtcaacaactttgtgttaacatgatattaaaaattaccaatgaagtttgtgaaaggaaaatatcttgggcccccaaaatcactcaggaaaagtcaagctggaaactgcttagggcaaacctgcctcccattctatcaaagtcactcctctgctcactgagatagatgcaaatctgatttgcctcctttggagaggctcatctgaaactcaaaagaatgttaactgtttgtgtatcacctctctgtgacctggaagctccctccccgcttccagtcttcctgcttttgctttaagttgtcctgcctttccagaccaaaccaatgtacatcttacatatattgactgatgtctcatgtctccataaaatgtataaaaccaagctgtgtgccaaccaccttgggtacatgtcaggacgtcctgaggctgtgtcaggggcgtgtcctcaaccttggcaaaataaacttcctaaattaactgagacctgtctcagattttctgggtttcacaagttgaacattccagaatagtaaatgttcatttttatgtattaatttgtgcgttgtctgtttatgtgccgtgcccatttttttaattggaagattcagtcctttattgggttgtgatagctatttgtatgttaaagctattaacatttaaagcatatgtcaaaaatattttttagaattttgtttgcttttgccttttgtttggtgtttcttgttttaaaagaagaagcagaaatgtttccttttttcctgataccacaatagtgaatgacatctaatagtagaaaaagttctcactttgcaaaaaaaaaatcataaaatagtggattttatgcctgagaaaattatacatgtagcatataaccatttaagataaataacttttaccacccttgacttcaaattattttttccttattcttcagcaatttctctatatctgaagcctctatcttgtttattatacctaaagccagtaagcagtacaatagaaatccaattttctgaatagaaaggttccatttgttgatctataatgtcagtagactcctcatgttagaaccttttcaaaaccttaaatcttgagttcaaagtcctcacttatgtcttgacaatagctttcaggcccatcaacaaaagaataaacacatttcttctctttcaagctacaaaatcatattctctttatacctgttagcatactttttcaaaggaaaagaactgtttcaaaaaaaaaatctttttgctttaattccgctgtgacagtaagaacaaaaagacttccgacttcatggtgtatcttaattctctgagaatgaagaagagaaatagaggaactgaagagaaaatgggcagtgtaagaaatccctgttggacgaagttaagaggcttttaaatagtgcatatcctgcctttgtttcacagctactgcagaagttttagagccattacctgtccattgaggaggacttagagctccattttagatgccattacgcgttacagttcaggcattttacttcttggtcactgtcaatccaataacgttgatcacaaccatgttaattcaggcaaggtttcctgatagctaatatctaatctatgtcctaatagttaatatcattatccattgtgagagagattattaatgcatgcccaaatgatcaattaggtatagacatggacataaacctaataaaaatttaatgttagtgttactcatatatctcatatatacatatgtgtgcatatatataatatatatattatattatatatataaatttactccttgataccagtatattctacagggcaaacttcttctctcacattggcagtagatcagcatacccaggctgttttattgcaaccttcggcgggcacacactaaaagaacaacactgggatacgccagcatccagtgaccacaacggtcaccaaaaccttttctgcaattaccacattcaggtagtaatcactttgttaccttccataggctctcctacttatgacttcatagtgtcaacagaacagctttttttaaaacacaaaaacaaaacctatgaaatggagtgaggactgtatgtgctcagtcatacatttcttttaatatatacagaaatgcaaacaacacacccatgtgattctgttctgtgtctaatccttcctcactaagcagtttataagatatttagctagctgtggctctgagtccttcttaaggagtgggatgggaaggagagatgaataaagagaaaagaaagaaacccaggatctcaaacatctgattctgtttggttgataaggcaaggtgggacccagggattcttgagcttgggaaaaatcactacagcctcaccctccttttgtatgcacctccatactcctctccagcacttccaaacgatcccaagaaagacacactcccagtgacacatccagtcagggtatctttctactatctcttgaatcccccaggggaatctcatgcatccaagctggagcagcccctgcagtgaaagaactccttactgggaagctagtccctagcgcgctgcttcctctcctggaaactcttcatgtaaatgacatctactcagccctggggtttgttcccacatctgggagccttcccttaaccctagactaggcgtgggacttgattgtctgcttaaacgccctgtccttcttatgtgtaattgtcacatttgtcatacttgtttaatatctttttccatactattttacaaaccccaagaggttggtaccatacttgcctgattcatttctgtccttccaattcctaaaacagtgatgggcatgtaatgcatgcactctcaatagacatttggtgagggaagtctaagtaagttaatacaggtgaagtgctcggtttaattcctggcacatggcggtgctcactacatgttagctacaggtgctgtgaatcacgcacatatctgtgcagtcctgaagcctaaacccgttgagcatagttggtagactttgaaagaatatcaactgcccccaatccttagaacatttctggcctgccagttctcctggtaacctgagcttgtcagtacataaggctcactaacccctgacattctaaaaaggcaaaacagcttttagatcagataagaccagatagagagtctctactgctgactgcaacacgctgcgtgccttcttcctcctcaccttctcatggtgatctgaaaccttgttcttgaatatctcatgactccagctcttaagctaaatgatagcattctaattttagttgtttttcagcagatagattttgtcctgcagtgtgtctaactgctgctgtaatgagccatcatgctgctgagttctatggttatatttaggttggttccctgagtgaaggctgagccgtctcttttcattacatttgtatttactttcaaactaaacaagaacagagtctggactggaccagaagttgtagggggctctgaagtgttttcatgcaacaaaccctagttcgttgctaggggggatgaatctgaccacatttttttaaaaaacttcctagtgattccagaggaaatggctgtgaaaccactaaatgatatcttatattctaggacttttaacagaggattcggtttagttcaaactagccaggcataaaggaagcacttaggataagtttgaactaaaccaaatcctcagttataagtcttggaaaataaggtatcatttagtggttttgcagctatttcctctggaatcactagaaaatttttaaaaataaagtggggtatgattcatccctttcagcaacaaactaggggctgtggtataaaaacacttctgagcaccccacaaattctgaggccaatggaagcgggtagggggccctgagcaattttagcaggtggtgagatgatcagataagcttgagggagggtaaccccgcggtaccttgaaagacaggttggggaagtggagaaagacagaaagaaaagagatccatacaagagcaggctggtgctccagtgaatgggtcccaaggatcagaaccagaggagtagcaataagaatggatacctagaggagagaaggtgaggatggagagtgagaccagagagagaagatgaggatggagactgggaccagagaagaggaggtgaggctggagaccaggaccagaggagaggaggtgaggatgaagaccaggaccagagaagaggaggtgaggatggaaacagggaccagaagagagatggtgaaaatggagactgggactggaagagagaagatgaaaataaagaccaggatgaaaagagagaaggtgaagatggaaaccaggaccagaggagaggaggtgaggatggagaccaggaccagaggagaggaggtgaggatggaaaccaggaccagaggagaggaggtaaggatggagaccaggaccaggggagaggaggtgaggatggagaccaggaccaggggagagaaggtgaggatggagaccaggaacagaggagaagaggtgaggatggagagtgagaccagaggagaggaggtgaggatggaggccaggaccagaagagaggaggtgaggatggaaaccaggactggagcagagagggtgaggatagagactgacactggaggagaggaggtgaggttggagagtgagaccagaggagaggaggtgaagatggagagtgaggccagaggagaggcagtgaggatggagactgggaccggagcagaggaggtgaggatggagaccaggaccagaggagtgttggtgaggatggagagggagacacaaattcaagagatactgcaaaaggaaaaccagatgatttggtaacatgaggaatgcgaaggaggagaaacaggctttgacctggagtgactgggaacaaggtttatctttactaaatatgaggaacatagggaagaaaaagaagttcagggaggaaatttagtctttggaacaaactgaatttgaggttctggcaagatccaggctgatggaaatgtgagctggagttcaagaacagtgtcaggactgcctcagagatgtattgaccaaagcatcatttctttttatagcctgggtccttttgtcccttcacagtggcatctgctttaaggtcatagtcaatctttttcattagaaggtagaacatcttacaaataagagcctttgacttcttcttggagtcatctgaggcatcacattttattaattgcacttttgaccttctataatagatgttttatctggctcttctacttaaaccatggtacttttagccatcttagaaagtgcataacaggctcccatgattgaagaaactggggccaagaaagtgccagtaagttggccaacctcgcacagccagttatcagcatcctgattcccgaccccctgcacttcccactggggcaagtggtgcctttcagaccctccctggtggcatcttgctctgtctctgcagtacagcttgttactttgcactcagaactgtttctttagaactgtcatattcctgtggtctcttatagcttatgtgttgtttccttctaactgaactttaaaaaattttgcttttctttcctactttgtgagggcctaaacgtagtcactttatgttcacttctaccaagaatattctcggtgtttgtaaccagcctatagatttgaacaccatgcctcaccctccttcccaaatgttcgttccatgttaatggttttaagaattgtatggattgttgcatgaaagagattgttgcatgaaaatgtatctgttgtcaacccacatgggttcctttaactccagcaacattaagtgatcttttgtctttcatactgcttatccaactcagagccccggcctcttctacgaggggaaaatgagctgcattcctagggctggtgagaaatcagtgccaatggggagaataaacagtaatcagacaagattccatttaaaacattagggttgcaatgtgtcatccaaagctataataataaaggcccattggtccccagtagagcacagtttaattaaatgcaaccacaagacaactttaccttaaccttgtagacctgatgctttctattaaaatattttctgcttggtccttcttttaccatatagatgccttgaacctccgaaaccgacaggtcatctgtgtcactctcaaggtcctccagcatctggttgtgtcagctgagatggtgggcaaggccttggtgccttattaccgtcaaatcctccctgtcctgaacatctttaagaatatgaatggtgagtgagcccacgagtcaaaatgtcttttaagccaaagaaaaagggagtggtttgaagtagagttaattagcaacacgtttaggatttattattgcatataaaccatgatccatttggagatctaaatagcatattcccacgccttctccagctactccctagggaaacagtaaagttaacaatttcatttattactcctcaggtacagcttacttactcagtacagaagtgctgaagcagttctataaacttccaataattaaatttgaagtttttttaatggtcttttgaatacattagtaggttttgagtttgttctttttcttcatagtgattctacctttagatacttcctgttacaatttcagtcagcttttttccattggtttaagatgaatttttaagcactattattaaaatctggtaaatggttttgatgattcatttattttttgtagtattattctataagctttggaaaacacagatgaattcatatggctctattttaccctaacaaagatattagcaagtttttggtgacctttggcaggcagtggatgtaaatctattcattaagcgtgtgatttcattgaaatgatgagtctaattttcttttttgttgttaattttgaagttccgtacttctcacatgcatgttataagtcaacatgaagttatttcctgatagtggtatcaataagttagtaatttaatggagcactgaatgaaacttttacaacatgatctgctcatcatacattcaagaaaaaaaatcaaacaagaagctgagtttacagcagctcctgccacaaacagacttttgtttggaatcactattttttatattattactcaattgctattatgtctgctccaggcatagactattcaggaaatcatggaattctcaaaaagcttttagctctctttcagtagtagaaccggcttatatgttaaatactatacatatttagaaaaaggacttcaaactggagttataggagcttacaaatgcctgtaatggagtgcttgcaatggtattctgttcaaattatctgaagagctgtgggtaaggtggacattcaggcaagatggttagtctttacgcaaagtaataactgggttttaataattgagtctcttattgttaaaatgtaatgttttagtaacaatattactacatttggaaaatacttatttaaacagtcttcattcatagttcatatttttaccatatagtagcagcaaatatccatgaagttatgggagactcccgatgtgcacctttttcaactaaggtcgataaaagaaactctaactgcatacctcatatttagattctagtaacttgagggagatagagataaagatgttctgctagagatgagagcattattaaagagatggaagcatcagggaacagccacccccaaatgtcttagttaacatttttgaagtgtgcgattcactaatatttcctcagtaatcctcatgcaaacctatgatgcatgtactattactatttccatttaattgttgcagaagttgcctcttgtagctttcctcccatgtgaacagttattctgtacttgatgatcctggaagatgagcctgaacacatttctcctttcttgcctgagtatctgggaataggtagctactgcaacactgctttaatgcttttgttggtcacacaataaaggctagaacttatatctaagcatcattctgtatccctgtataaaagtagaaaatcagtgatgttcaaaggacaattagaatctttctttatcctcaaggaaatctataaagatggataaatattgctgccgcaaagacagataaatcttgttgggagctctagactactaaacaaaacaattggtttctactgctttctcattatagtttttctttaaacctttaactcacaggtgttcatacacttaacaaagaaaattattgactttaagaataaatccctagtaagattttatcaatgtgggacatttaaagttcatacgagagtccttaattggttccaaactcagctaattcttttggagtctttctaaatgcatgcatcaggaattctacatttaaattatttttctgcttaacatttttctgacatttgtagggaaaaatattatcttccgcttcattttctacttatcttagaaacctgtcacaacaatgccagcctgcagtttgctgtattttcagagggtcctattacaaaattggagcattctagctataaaaacttaaaactgttccttaaagtagctatgttaccctagatccaattctttcagaaaaaaaagcttatcgcaggattttcaattacattagaattttcactaggaaaatgatttagctttaataacattttaagaaagcctgctttatgatatacatcacaaaattatatatacttattttatttaagcagatgtccttagtaacagatataattatttacaattaaaattacattagaaattgacagtatgtagcagtagaaaaaactcatcctaaatttcaatgtatttgagaacaattgcacatttccgtattcctctttttttgtatttctcttttatgtaaatcaatgtcttgttaaactcagattcaaaaatatttctttcaagtcccactacaaaattctttttagaatgagaccagatacaaatgacaaaaaagaatgagagaaaatattctttcaaataaaatgacctgtctgtcagcatcccctcaaagcgcaaacattagattagttctactgcctgaagtttttacaatgtctcctgttttaatgtcacatgaacttcctctgaaataagcagtgggggttgcagagccagggagctagacattgggacagtggcccatgtgaggagcccaggcttccagtcttttcaaggaccagttggaaatcaagtaggggagggaggaacagtccatgctcacagcaccaattcaggccccatctacacgatcagagcaatgaaaacttagagccagccccactagatcattcttgttctagcagagaaagtggctgtatcctcttgtgtgttcataatatttttcacagagtttaattaggctatagttaaaacaagaacagataaatctgagatgtgaatggtagtgtagactaaacagtaacattttggagccagaaaagctgtgacctcaggcaaatcccttaaagtctgtaatcatcaatttttctgtctacacaagatatgcatcgtaacaacttttcattagggtgggcataattagagacaaggtgttcagggcaccttcacatggagcctgtccatgaccgggtattaatgagagagccattatgattacacaacattatatacatatccaatattatatacatacaatagtatatattatagaagaatatcatgctctatgaattattatgtaacaacacaaccaggcaactgaaagtgttgtgtgtgacccatagcgctctctcgttgggtgacctgtcgcttggccctctgtgagcctgtgagtggcatgtggcctcccggtctcaccagctgcatcagtgcctttgcttcaaatggttcattttggctctaattgccaaatgcagggcgagtggccaaataagtgaaagactcagattcattcactggtaacaggttttcaaatccatcctttcctggcataatctctcagcttgaatatgtgactggagtttagggagcatcgtatttacaaaggagaaacctctttccagcacagacaaggaaagcctgggccacggtcctctttgaaaaaaccaaactgctgtctaagcttttgagcttatttgcctgcattctaaacagtgaattttggacgtaaaacatgctgtctttccagtgactgctttgaggggaaagaaaggggagttcctacaaaatattccttggatgcatttgtcatacagccaatagcaatttattctttcctatgttctttcacaaatgttattaaaggttacagaaaattaaaacaataggaatcttcaatttatagctttcagagatgaaactaccaaattaatgatgcagagtattacatttgaggagcatgagccaataaatggcattaaagcttttacagctggaatatgggctccgccagcagattagggctctccgacaggcctgtttaccatattttggttcatttctaacagtaccaatagttctgaaacaatccctacctaaaagatttcagactccagatatcagagactctgataatgttgtaaatttatgtcatgaaatatgcaaaagtaaacataataatgaaatatcctgtccccacgtttgtaggaatcaaattgcttggctttatctaagatgtttaccattatagactaataaaaagttcattaaagagacttaaaattttaattcagatgcaggcacattaaaacatatggggaatgaggatgcctgaagtttgcaaaattttaggatgtttgtaccaggtctttgacctgtaatttaaacggcttctaagaaatagaagtaattattttatgttgatcatcttttaaaacaacttctaaggagaacctaggccttgtaagtcaacctgattcaaaccctccttgataaccctccttgatattcgtgtgaattctctgggaccaattctcatgctcttttcaaacgttgatgaacttctgggaatggattaccaaacaacaacagcagcaacaaaaccttcagtttttctgtcccaaagttgatgtatgtaaatgttatttctcctcacagagatttacatttaattttggaattcaggttcatcccccatggaattctgaacaattctgcgttcatgatttacattttagaaatttacttcgaagtccctttgaaatggttaaatgtgttaaatttgaaccatgagattatcctaaattccttgaggaaattattagaactactgccccccacatttctgaaagttagatttggaattgtcatgcatatatctagtctctctgagcacttcctccatgcacacttaactcatttgtctgcagagaatcctgggattataaagttggaagatccgtgtaggggtcctttggtctaagagtatctccaatttaccaaactaatcaaccattacttccacgaaggcaaaatgtttgtgttggtctttccttttcttatatagagcttggcacacctagtagaatcaggtgcctaatatgtgcttgtgtgaaattagttcactaactcagcctacgcaaccagtacttatttattccgtcttgtccaagcagcctcactacttcatggggtagctgttctacttccaaagagaaaggcagctcctgttttgaaaggaaatttacacctaacatttccatctggttcacctctctcatctaaactacacagcacaatggttaatccttttccacatatagcaagccctcgggaaattatagaaaactttccttccccctcggtattcacttctccaagtgcaatatccctacttcttccaagcattctctataagcagagctcccaaagcctggaaaatctttgaggatggggagggaggactcatttctacagaaacagatggttgtgcagcgatctaagtgagagggcagcccaggacagcagatggtcctgggaagggctcaggcctccctccctcacctgatgcccccacgcgtggtcagcccataaagacctctttaccatggtgaaacctacacatgcttatgaggttaaatgcctttcctcttcactgagactgctacatttgagtctattttcaacccaaatccacttataaaaagcatcaggggagtggggtcagtcacaaactgtaaattacgtctctatgtgctcttctctgtagacctccctggttgcgcctgcccggagggaaggattattctgagttgtctgtaacctggtagggcgatgtctaaagaaatcagaatccagctctgaaggctgtgtcttagcttcctggagccacgtaacaaattaccatacacagaatggcttaaacaacagaaatgtatcgtctcccagttctggaggctacgagttaaagatcaaggtgtggacagggccagctctcactgcaggctccggggaagcctccttcctgctgcttctagcttccggaggtgccagccgtccttgagctccttggcttgtggatgacgcatcactccagtcccgccccatcttcatgtggccttttttcctgtgcgtctgtctgtgtctcttctcttcctatgagaataccagccctcataaggattggattaagggcccaccctactccaatactccaatattactttatcttaactactttcattggcaatgaccctatttccaagtaaggccacatcctaaagttctggaaaagacaggaatttgggggagacactattcaatccagtccagatgatatacctctttcctacagcctgtggggagaaaatctcatctttgataaataaaggtagaggttttgtgttcgtttcactccttcacattgctgtaactagtgttactgagcctgctctgcacggactaatgaaaactccctctttcaacaacaaaaatgtcatgccttttcctttcagcaggaagggtttgtttagttaagaaagaaactgggcctggataagttttgagtaggggagatgcagggaattgatgtttctcttcttcttcggtaatgctgcaaactaaccagagatggaagctcacacttccaacagctctggatgctgccctggggatcccatagcagcaccccagggtgctgccgcaccagcccagtctcgagggacctggccacggtgaggctggttcacctgggcctgtcccggcccaaaccagctgggcaggaggctcaggccactctgcctaaaggggtttgtaccaataaatgtgggtcacctggtggacaagcaggggaagatgcttgggcagatgggataatttgtggagaaacaagaaatgggacaaagcatgcagctgccgagcacagcactgaggcgcaaaggctccggctgcagttcttctgggttcaaactgtttgccggctgtggcttttgacgggtcatgtaacaactccgtgccttagtctccataatttaaaaaccaagttactgggaggattaaagcagctcattgacttgcagagaactataagaaggtcatttttcaggagttctacttggagagaaggaggggaatgaattgtggaatcgagggtaagtgctttgaaactagcgtgttaggtaaatgtctcctacctgcagcacagggtttatggagagaaccaaatacatgtggctttatatggtccttccaagaaaattaagtgaaatctttttaagttaatatcataattaacatctaagatgattacatatgaaataaatattcaagaatcaatacctttcccatatgtcagcagtcagaaatgcaatgcaaagttcattttctagatgctactaattcctaattgcaaatattccaacccagacaaactttcactgctcagctctcccttcccccgaagacagtttagttccttccttggccctctcacatcattgcaaagaagggctgagtagtgacctacgcatagggctgcatcagcaggttcactggcctgccccagtgaactagtgaaatcccaacctctttccactgtgttctgttttcgattggcccttatatttgtggtttctctgtataaatctttccaagttgttgtggccaagtttcctctggacatccccatttcaccagcatctggctttaccactgtccccacttatccaactttacctgaagggatcagactgccaggaggatacagagttgcagataggttcatgacccaggcacatccccattgtttctggaccagtggcaaatgtggtatatcaagaatggcttgtgtaagagaatcccattcattgcttctgaaacggtgatgaaaggtgtcgacaaaaagagtcacactctgtaaaatatttaaagaggcttattctgagccaaatatgggtgaccatgacccagggcacagtctcaggaggtcctgagaacatgtgcctaaggtggttgagttacagcttggtttttatatcttttagggagacataagacatcaatcgatatgtgtggggtatacattggtttggttcagaagggcggtggtttacaggtcatagtgggttcaaagagttcctgattggcaattggttgaaagagttaagttattgtctaaacacctggaatcaacagaaaagagtgtcagggtcaagataaggggctgtggaaaccaggtttcttattatgtagatgaagtctcataggtggtacccttagagaaaataagttggcagatgtagactctccgtaaatctcttcaggactgggagggtatggaatggggaaagatctattatgttaatagagattctttatagacacaactttctccccactaaaatgacttttcagtccatttcaaaatatggcaaagaaagatatttggggtgaaatattttgattttctactttgtctgtcatgtgaggttatgctagagtcaggctggaaagtaagccacgttatatagggttaaatgaaacctctctgatgagattttatggtttgtggggtgtgactccccaggtcccttagataggaatttgggcaagagaagtaaaaggtcagagttcagtcctcaaaaggaactgcagtatggaaacagcagctcaggatggagctggaactggcactcatgccccctgcctgtgtgtggaacaggccatgtgatctgaagcctgcttctcagcctacgagacaccctactgccattccagggactctgggagttatctctgctcttccctccatatccacactcagacatcccatcctttcagtaacctcccctgactccgcccccactagcagaacagagggctcgtccctccgattattcccaatctgccttgctgggtagaggtcctatttcttgtgtccctcctcaccaggcgggagagcccagatgccgggtgacagttgggacaactggcttttggctggacctgttttcaaagccatgtttggaatgtgtgcttttgttacaggaaaggggtcctgatccagatccaaagagagcattcttggatctcacgcaagacagaattcagggcaagtccataaagtaaagtgaaagcaagtttattaagaaagtaaaggaataaaagaatggctactccatagacagagcagccccaagggctgctggttgcccatttttatggttatttcttgaagatatgctaaacaacgggcggattattcatatctcccctttttagaccatatagggtaacttcctgatgttgctgtggcatctgtaaactgtcatggccctggtgggagtgtagcagtgaggacaaccagaggtcactctcatcgccatcttggttttgatgggtttgggccggcttctttactgcgacctatttcatcagcaaggtctttctgacctgtgtcttgtgccaacctcctatttcatcctgtgactcagaatcccttcactgtctggggatgcagcccagtgggtcccagcttcattttacccagcttctatttaagatggatttgctctggtttaaacgcctctgataccttgtcacccctccacccctctgaggtaccccaacagggatccacagacaaaatgactgggttgtggctggtttccagtgcttggccagtgacatccctcctgctagctgggaactggcacatttcccaatcagagattgcgaccaattcagctaaggccttacagatctgcctagagaaatctgtataatatgctttaatgtatttaaacgctcaaaatgggccccaagtgagcaggcatgcacatattcgcccaagagaaaatagcgttcttttctatttatgcaacagaaagttttacttaatctgagcaagaaagcaaatagcaatttctaaagctttaatttaaggaggcttctctattcagtcagctcataatttgtagtttttaagtcccctaaaatatcacctattctggatttgctgataattgagagttcattctgattttcctttatatgcaaatcttccatgagcaccaactaatgactttttaaaggtctctttgtggacattgcagagaaagtaagaatgtcaccaagtgtaattgttatgctgaataccactattcatgccatcgttaaaaggtccgtttaaagggggtgagagacaaaagctaagcttgactggatggaggagcctttccgtgccactgcggaacccctcgcaggggtgggtagtgagggtgagtaaattgttctgccctcccctgagttcccaggctccttgagtcgcacgtgctcttctagagactgatgggaacgctcagcttgcttcactctcagaccttctctccccgcccagcgcggacgggctccgggctaggagctcgcagagggacgggctgtgtcgcctcgcctctccctgcctctgtgtaggaattccccgccgctgaggtcaggagggcgggagtgacacaggagccgtggctgcctggactcctgggctgccccaggagccgaggacagccaggtggaggcggctacggctcggcccgaacccaccacggcctcccctgcagggacctgtgtccagcctccacggccctgcagctgcattcgcctcagcctctcgtgctgggatccctgggcccttctagattcccatcacgcagggtcaaaaatgcccccacccgtgcacgctcaccgtgagaaacccactcccatgccgtgcactgatcgcccggcgtgctgcccggactccagccctgctgcctcggcctttccattctgcaccgcagggaaggcccaggcgtcgcgcggccagcccctggggacaccttcaggctgctcgagagggttccagctgccaggtcaggagcagagcacagccaccgcgccctccaaggacaccaaggcacgtcccgctgtccccccagcgcgtggccagttccccgcgactctttaagcagttctgctggcggtggcccccacacctgcctgggcccacagctcacccaggtcgagggaccctcgtgtcagctccctgccacacctgtggtttgctttctccaaataggaaactgttggagaaatgttcctcttagtatgaaatcagctttccattttattgcctttcttaaaaatctgtaatttttactttgacagaatggaatataaatggctcagaagaagcttaaccatcaataaatgtggagttgaaaaatgcaatggacatattctctagaaaaactgcaaatattattgatattttcttgcttgcctgctttctgtattatattctcatgtacatcttgaattaatgttccaagtaataaagaagaaaggtaaagatggcaacgtaattatgaccaagttctgttcagagccctcgaagatcaatttactttttttgctcttaagtacagtactttaatatgagctttagtgagcatatttatattcattttgaggcggtcatacaatgaaattaaaaatcattctccattcagtgacttttaatttagattttgcataccaattacaactctgcctctgcccccgccccccaaaaaaccctacatttcatcttaagttcatttcttgaaagtatctttgtcacaaactaaaaaactaatgatacaatactggaatttaaaaaacaagatgtaattgggccataatgacaggattattgcctggtaattttcccactattttaagctttgtgtttgacctgcatgctagttggatatttatttgtgtacatcgggttttgaggagttcatagtttttctaacagaaatcactgaatgttacatatgtttgtatgagtctttatttattataaatatgataaacaatcacctaaccaaatgtcttagatgttgttctttctggaagcatattttgtccttccaaagtttcttacaagctgtgagtgtaggataatgatattcaaagagaatcagtaccttttctatttttttgatgaccaactaaaatttctagaagaatttctgttaggaccatagacaaccatggagtgaggagaaggagtgtgatgtcgggcctgtaaaaacctgcttaaaaaacaacccacacattcacctttcttcgtgtacctgctgagctagccactggcggtgtggaacatgaggccttcctgctctcaccgtaagcctggttgcgctgcctacacaaagactaatgcaccaggctacctccaaaagcattagagagcaatgtggtttttatgaaagtcttttttcggggggaatgccaaagagagaaccacataatacatccttcactgattcatttaaacaaaacaaaacaaaaaaagttgagtgcttactatgtgccagcgcagcaaagcttcctaaaaaatcctttaaaaacagacactatgcggccacacagtcattttcaatttaccaaatccctcaaagacttccccagagcctcgcccggtgaacctgaatcaatgtgtacagccacggaaggcctgaggggtgaaggaggttttcactaccgtcgggaaacaagcaggtctagaaaaggatgggaaccttgccacacatggacaccatcctgcaaactttatgttccttctaaccatatatccttaccttctactcctctctttaataacctgactctgaggtcagggtacagtttggaacagtaaaatccagcactgatggcagacttattgaggttgctaaatggcaaaaagagtgctgtttaggcttaatgctctctcttagctaatgaaacagtgaagaactgcaatccaatctcagattttccaccatcaacataaccctcctgcagaagagtaggaatgtcagcttcatcagtgctactaacatgctttgcatcctgggaagatcccaaggagagtctccctctctgggctacctccaaatactgtccatcaggtctctcctgaaatttctaagagtattttttttccaaatctttgctaggagctgcaatgtatatgatttttgctaaatctttgctaaggaccacgtgatgatatgtatatcttgcttataaacccaaccaaagcgcattagagaccatttgtcctgaagctacctaccaactagatttgcgagtccacccaaatgtgtatgacatatggtcagggaggatgatacatcacctgttgcatttcccatcatgaggactgcctaataggtctagtcttgttctaatcttaatagtcctgtgagatccaacagcaatgagctgaaagctagggtttgtttgtttgtttgttgtttgttttaatgtaggtattgttactaaatgtaaattccatgaaggcagggacttttgtcttttttttcactgctttatcaacagctcagcaattgttcttagcacttcctgagattaataaatatttgctgaatgggtggatggagggagagtgtattggttttctattgtcacaaatttagccgcttaggacaacacccacatattatctcacagttctgcagatcagaaatccagcagactcagctatgtaatatgattagaatctaataaggggatcaaagtgtcagttgccctgtgttccctgtagagcttctgaggaagaatccacttctaggctcatcccaggtgttgatagaaatcagttctaatggttgcaggactgaggtctccatttcctggctggttggcagcagtggggagctctcaactgctagaggcggcccacattccctggcccatgaccatctcatcttcaaagccagcaatggagggtttcctatcactcggcctccccttctgccgcatctcatctgccttccttttctgctttcaagggctcgtgtgattcccacccagataaagaagagtattgctcaagtagagtgttaactaatctaactttgttccactttttttttgttacaaggcatggaactatgtggaataatcccttgttttaaggtcagcagattagtaaccttaattctgtttgcaaagtcctttcacaacaataccttgattcatgtttgactgaataacaaggggacggaaatattggaggaacatctgtagaattgaggttttggaatgaagtcatcaaaaaattgatgcctggatgaccatgactgggagcttgaagtacatgttcaagaggatacaaaattaactgccaacatttagtgaaggtagcgcagctcgacactgtattatttttggaattgttattcttactttacagatgaaaaagctgagcattggatcaaatgacttgcccaaggtcacagggcaggaatgaaccaaagccagcacccaagaaataagcaggtcctccttccaaacctgagtggcaggtactctggaagtgtaaattggattgccagaaatagcatttctaaggtaattctgatcaaaagatttcttttatttaaggtactgaagtaaatggaagtttcattgatccgatttaacaactattatatgctggtagatcaaagtagctgttgctgatcttcacaaattcttatgcattatgaagcaaaaatgttttcatatcatcaatttctattgtggagtagtgttcaataatatcttgagaaaaactctaaacacagaaaactatcagcaagttcacctaattaaaaacatcaaacagaatcttctaactttgttccactttttgtgttagaaggcatgtaaccacatggtgtgcattcaatttttttttaatcccagccaaattccttctcagagttatggataaaatctgtgtatgtagctgtcttcgtccatttttgtgttgctataacagaatagctcagactgggtaatttatttttaaaaagaagtttatttggctcatgattctggaggcagggaagtccaagattgcacagaccatttgatgagggtcttgtgctgcttcaacttcaagttgaaaaggatgtaggcaggtgcaaagagaccagagtctctgtgggtctcatggggaaaaatagtaactcgcatgtgattcatttgtacaaattttagtaagatatagagcaagcttacaccttactcttttaggcaatttaatttacacaatgttttcatttctaaatgtaatcctttggtaaaagaccatttgttttaggtgcaattgttcacaatctcttttgctaacaaatcacatagttctcccaacaattctcccaaatataataggtaaacacattaaaaattgctcttgccatgtatacttcaattaccttgccaaattgatatttcaagttaaacacggttgtatattatacagagaagagtgttctcctagtcttaacaataactcattgaacaagtactcttatactatttatgaagtaattcaaaataaggcactaatctacatttactagtacattatggagaagtacttctatgaccctattcctgaaaatcagcctacattttcttagaaatttctacctacttttactagaaatttattgcactagtaagtttttcttgatttcccatattaaaaaaaaataattcattgcaaataaaacctttcctgagtaataatcacttggcatgtaaatgattttagtattaatataattctctctaaataaataacttccaggcccaatgcataatgtaccaagcacacctattaaaatgatagttttgtaatgtgagaatttccattataaaaacctgcgagacacaatctagcacatttaaagaatgatcacttttagattgtaactggaagataaattctaattactatttaatttcttggttgaacatctttggcatgtacaacataaaattgactctgaaattatgcagttaatattatcagcacttagctattccatttgaagctgcaaaggtttaatttgcttggctcaaagaaatattcaaccagaaaaaaaactgcttaaagtttgggaaatttaaaaagtggctatcgatatagttaactaatctataataagctatgttcagtgaaatggctcaacattgggtcattgaaaaaaatggtacattctttagaaagtatgctatttgaggtgttctagaccaggaagataaacatgtttttagaattctattatcaaagctatgggttaatatccaacattgtgacgtgatcctgtgactttagtcaaatcagtcatggaaagttagaaatctcctcccttaaacattgatgcattcttagaattgcttcttgcctaaactatgtttttcaaaaatgtaaatctcagagagttgttcttccagtcacattgctggagtagagatttataatttttaaaatttttaatgagattattgacttgttaatttgtagattattgacttattaatttgtttcaagttcttttgtgttaactgtcttaaaaatggctaacagttatttagtgctttttataggctagattctggattaagctgttttcatgaatcatctcatttaatcctcacaaacccaggaggaagaaagtatccttcctctaatttaacagatgagaaaatgaatgcagagagataaagtaattttcaaactgtcaatcagttagtaaaagggaacttataggattattcaaatggaaagagagataaaaagtgataacttgtacagttttctccatccataaatactgagtgcttcaactgcacctaatggggtatttaattacactgttatagacaaatcattcagctatattggtttaatcttccagtgtttaaactagcagtaataaactaataacattcctaaacttccagtttcttccaaagttatttttattcatgttactaaattaaaaaaagtagtgttcaatactaattatttactgtgatctgttttttaaaacatctgagtggcattattcttggatgaaaagtaaatccaaattcagcctttatgtaatagtatgacatttttacttttggagtttataacagagtttaataaatgtataacatgagcaataatcaagatttttattgcatatgtttattaaagctcacttatagctagttaatagagtatgcgtagattttgctgagttaataaatccaatgcaaagtaccacttgtacatgatgatgtagatagcttcactataggtatcctgaagcatggagttcttcatgcacaatagtttgtcctttgtgtgaaaagataatttgctgaccatttgtgcacggaagtcctcatcatcagcaggacttaacttgagatgattcaagccaattgcaagaaatgctctttagaaagaagaatttacaagacttgctcattaaactatgtaaattaattgtaacttgaaaagaggaaaaaaggctctagtttcacttttttaagtttggggaagatgagttgcaaataatgatcaagaagaaagtcattctgtctaaattagggcatggtggatcttcagcttgaatgtttatcttgagagaatgagaaagagaaacagagagagggagagaaatagataaaggaaaaagaaggtcagtgaatatgatgaaaagcacaagggcattttagtaggtagagagattaaaacctaaaaccatgagggttctttcatattttttaaaatctaatagaaatatgatgagaaagagaaagatgttgaagatatacagaaagaatatcaagtagagccattgatcttaactataaatataaggcagagatgcattgaaaataaaggccacaaactgcaaatgaatgaaaacacttagtatgtcacaaacatgacaaacaaaaagctcctggaatttttcagactgagatggccttatttcattggtggtggatcccagttgagtgtcaaccctcaacgagtgggcagagacccctgcctgaatctcctgagtcacacggcgcacactgcatcccattaggactgatactgttttgcaacagcttaactaatacaatttcaatatttaaccaaaatctgctttcctgtaacgttcccactgggggcttcatttggctgtctggaccgggcctctctgcttcatgagtttccatagatttcttggtgaatattcttctcgtgcatcctgttctttgatgtattgattttcaacaatacatcaaaatcaggtacaaggcagaccttttctttgttggattccaaatgtacaaggactcaatcttgattacatcctaatgctgacgtttctagacaatatttatttgctgttctttgtttccctttgtttctcttgctctataaatttctccaaaatcctaacatgttgtttgaaatttggttgtttcttcttatgcaagtttgcatttcaagttattttatagcctagatatataggaatcctgctttcctccgaatgtgtaaaaattaataactgttaatagtcctctgctatctaagttttaggtttgacataagggaggtggtttgaggctgaagccgtctgatgtggtttggctttgtgtccctacccaaatctcatgtcaaattgtaatcacccatgttggaggaggggccaggtgggaggtgattggatcactggggtagatttccttctttctgttctcatgatgatgagtgagctctcacgagttctggttgtttaaaaatctgtagaaccacccactttgctctcttcctcctgctccaaccgtgtagaaagtgtctgcttgcccttcgccttctaccattgtaagtttcctgaggcctccccagccatgcttcctgcacagcctgcagaaccgtgagccaattatacctcttctctttcccttttttttttttttttttttttttgacggtgttgctctgttgcccaggctggaacgcagtggtgcagtctcctcacactgcagcctctgcctcccaggttcaagcaatctcaggcctcagtccctgagtagctgggaccacaggcatgtgccaccacacccagctaattttttttttgtctttttagtagacacagggttttgccatgttggtctcgaactcctggcctcaagtgatccacccacctcaacctctcaaagtgctgggattataggcgtgagccactgtgcctggctgaacctcttttccttacaaattacgcagtcttgggtagttcttcatattaagttgttgcgccaacctatagcaatgtgagaacagactaataacactgtccatacaaatacaggaaatgtagatctcttgtacatttggaatccaacaaagaaaaggtctgccttgtacctgatctttatgtattcatcaaaatcaatacatcaaagaacaggatgcacaagaataatattcaccaagaaacctacaaaagcccataaagtcgcttgtttcttcaggataaaactttagatcactgttttggcatgaaagcaaagtatcaccttggcagaagactgtgtcaaccctccagtaggcatgctgacatcttgattgttttctgctcttttgcttctcatcattttattggacagggtatagcccagctagctggattcagtgtcatatttcatattggcaaagaaaacttgtgattgaaagtaaggtttctctaccagacaacttttacaaagaatccaatggtgtactctttcaataatttatttcccttgctccccaaaagtcaatcatttaccaatcttattacttgttcatttgcaactgtgtacccaccccactgttgccagctgcccctactatgctgtaacagtgagttcagagcatcactatcacacgttgtctatgatagcaaattcttctttgttctccatgcagcaaaaattacatctgttgtctcatctcgatttgaaaaacctctcagcaattctaggaacaggtagccaccagtccaaaagaatgctggacaaaattgtagtagtagtttgtggttttcctttcttccttttgaaatatttctatctttataatctcttaacattatctgagtcctatctaaggcattttagtaagtagagcattttagtaggaaagagaaaaatcaacttcctaagcacctcctcccctcaatgctttgaagtctcagcacatatgctcatgggacaaatgacacttttgtaaaagaagaaacagaaaacctgccaattgactgaatattgggaataaacaagcagggatttccactttttaaagaattcttcactttgttaagaatttacatgatgactctttctgtggtactatagagcctcctccacagtgaaattgagaaggagattgggacttgatatgcaaactcaagtatataactggttcattagagagaaatgaatgataaatatcagtttcatggagatggcaggaaaatcacaagatagagcttgaccactgagatttctagagcttgaccactgagatttctagagcttggccactgagatttctagtgtggagatactatatgctggtagcaattgtacaaagatacatttatggatagaaatccaggggaaagaagaggtagttcatcttcacagattccaactgagaaagggcagaggaaaacatggcaatgtctcctgaaggctgctaggccactgtttcactttgtgcagattcatgacgccagtctgggaagagttcgcttcctggtacctggtacagatggggttatcccacctcttctgacacacatgccatagaaaaaaccattcattcatctatttcattatttttactgaatattttatatgtgccaaccactgtgctaagcagcaaatatagaatagtgcatgtaaattaataaaagcacaaatatatataattacactcactggagttcaaagtgccagtgacaataatgatggtgatagcagccaacagtcactctgcatcccctccacatgagacactgtgctaagtgcctttatctgcagtatctgaacaaacttcaggccaggcaggagagcacagctcaatttgcttcgttcttgtctgagactcccagtggtcacattgctgtcttcaccacagagccccttgtagagccaaaataccatggtgagggagggtggatacaaaacattcacattgcacaccttcaccttcctctagcagcccctgggctgtcaccgtggcagcactttgatgctcagcccctcagacctgttgtgttggcaggaaaccagctaactgaagcagagtaaatgaagcaaacaccgcctcttgaaagggccatggtatggctgatgaggagacccaggatcagttactgctgtcttcatagcttgcatgaccacaggccagtcattcagtccgtctgtgtgtttcttcatctagcaagtaggaaggagaaacactcacatgtcttcaaatccacatgtgtcaaatccaaatatgctcttccctcttcctgctggacattctgtgatgcagattctccttccgcttcttacatctgtttttctttccttcaacctcagtgcatgttgtcatttatagtcaagcaattcattcctatttcttctcaccacccactttgtgcagagccttttacgctagaacctgcccaagaacaggaagacctgggttccattgcagataaccccagggttccttccctcccacactgtagttaatcccaattgcctggcaccaactcatacctgagctgtggaatcaataatttctggattttatgatccccttgtaaacgctggcaaaatcaatgagatttccataccagagggtggggaacaatgaagtagatgctattgataattagttcttttacagaaatgcaaggtaagtacagggtgtttatgccacttttatgcataatgaggcatttatacaaacaacatccacacagctagttgaactgcctggagcaaaataatattcaaccttcaaatttaataactgcataaacttagaactgataggatgctttctgctctggttttgaagtgcctaattaagtacattcaaggaggttattttgttttgttttgcttttagccccctccctttgaaacccacttgtggtcagtgttagagagctgatggttttcttaatgtgtcattgttatagaacatgcctgtgattctgtattcttcagtgtaatacctgtgtttctgtgaaataatctgtgagatttcatgctaagcattgctcttgtcttttctatttttattctaagtatattaactgatttccttggagggacgtgcttgcaagcttgggtgtatcttggtttatctaataaacatgctcctggcacatattgtgtaaatctaattttaacaaattgaatcatatatttaaatgcctgaggggcactcattttaagaaattaatcatattctgaattttcagggaatttttacacccaaattttattttctgataatctaggttttcacttgatttgctttatttaggtgacactgtaccaaattattaaattcattgaggaatttttaaaagcaaggcattgagggaaaggattctgggaagatggtagagtaaaaagcaccaggcatctgcctccctacctagacaacaattgcattgacagaatctgtctgatggaactttttttgaagtctggcatctattctaaggattgaaacattcacagaaaggcttagaaggtaaattgtggttaatttcagtcatataagctggtagcaaagtggcagctacccatcccccagtcctatggcagggagctgtgcacctgttcctagagtagcttgcacacagcttgtgggagccagtgcaggtgaaaaggaccctttcctccaaaacttggggacctgtgttctgattgctgcttctgaatgtggagctgcaaacacagagggggcaactattgctgtatccctccctcatttgttgcaagcccctccccctctggttgaagcaatttccagggaacttatatggccagtaaccccctttttctttttttctccttccccctcatttttctcctttgcttcttttggaaaccaggcatttaaaagcaatcacatgtgcaaaggcaactagaaagtcactatgcatgcccaaggaaaggcacaggcctaaagaagacctgagaagaccttaggtttacacctcaggctggtcaacagcacagatacaacagagaacaatttttttaaaagaaaaacctggggaagggggtagtctgatttccagagttactatgtcattagatcaaatatccagttttcaacaaaaatcacaaggcatacaaagaaacaggaaagtattgtccattcaaagtaaaaaataaatcaatggaaactgtccctaagaaacaacagatagtagacattgctagacaaaggctttaaaaacaactatcttaaagatactcaaagaactaaaagaacatggggaggaagtcaagaaaacaatgtatgaacaaaatgaagataccaataaaaaaatttaaaaagtctaaaaagaaaccagcttcacaactggaactaaaaaggacggtaactgagagaaaaaatttatcaggatacaaaagcatgttagagtggacagaaacatcatctgtgaatttaaagataacacaataaattacagaatctgaggaatagaaagaaaaagcatttctcttttgaaaaagtggacaaagagtgagggacctgtggaacatcataaagtggaccagcatgttcattgtgggattctagggagaagagagagagaaagcggtagagaagttattcaaagaaataatggctgaaaactttctaaatatgatgaaagccatgaatgtaaacatccaagaagttcaacaaactctaagtaggatgaactcaaagagaaccacactgagacatattataatcaaaccatcaaaagacaagcaatcttgaaagcagtgagagaaaaaggactcatcacgtatacagaatactccaaagattaacaactgacttctcattagaaactatggaggccagaagacaatgggctaatgtatttagcaaggaaaaacaaaacaaacaaacaaaaaaaattgtcaaccaagaacccaatatccagcaaaactgtatatcaaaagcaaaggggaaattgagacattcccaggtaagcaaaagccaagggagtttgctactgctacacccaccctgcagaaaacactaaaaggaggccacagattgaaatgactagaaattagcttgaagccatatgtagaaataaaggtctcggtaaaggtaaatacatgagcaattatagaaactagtattgtttcactttggtgtgtaactccacattttgttttctacattatttaacctattaatgcataaaaaatacaagttcatgtttttggacatacatacagtgtattaagacgtaattttgtaatatcgataactgatcccaacactttgggaggccgaggtgggcagattatttgaggccaggagtttgagaccagcctggccaatatggcaaaaccctgtctctactaaaaatataaaaactagttgggcatggtggtgcgcccctgtaatcccagctacttgggtggctgaggcacaagaattgcttgaacccaggaggtggaggtttcagtgagtcgagattgtgccactgcacttcagcctgggtgagagaactgagactctgtctcaaaaacaacaacaacaacaaaacctgaaaagggtgagggtgctgttgcataggagcattttttgtgtgtgttattgaagttaagttggtatcaattcaaattggagtcttataacattaggatattaaacgtaatccttagggtgaccacaaagaaaatagctatagaatatttacaaaaagaaatgagaagcaaattaattcactacacagataaagactaagaatgaagactgaattctaacatccatatatatatgcatgttattcagtcttgggaataaaggaaatcctatttggagtgtcatgaatgaacctggaggacattatactaagtaaaataagccagacacagaaagaaaaatattacatgatctcacttatatgatgaatctaaaataatcaaacttaaagaagcagagaatggaatggtggttcccaggggctgtggggtgggagaaatagggagatgttggctaaaaggtacaaaatttcagttataagatgaataaattctggagagctaatgtacagcatggtgaccacagttaattatactctattgcatactagaaatttcctgagagtagatatcaaatgttctcagcatcaaaaaaaaaaaaaaggtaataatgtgaggtgatggatatgctaattagcttgattatgataatcatttcacaatgtattcatatatcaaaacatcatgtgtacaacttaagtatatacaatttttatttgtcaattatatctcaacaaagctggaaataaaagaggaagcttctttaaagatgtgtctatgatttcccagtgacatggatcatttaggattgtaatcaaccattgaaactgttagttagccaactaaatctcttatatacaaatagaaaccttgaatctcataaaatcaatacttaatgaatacctactgcatgctgagttccagagacacatgaataaaggcgatgtaggctgtgaccttattatactgggctggattctgtggggtgggactgagtagaggggatgactcgctttatctgggggcatcggggaaggctttctaggggaccagtctggatcttggaaaaagcagagagctactttatgctttaatctgcattaaaattgtccagtggtaaagcttgatatgctgtgtggatggtaaatgtttcttacttaatcagaaaagcatcctaagagtgatggattctaaattgatttttactgcagtggatgcatacaaaatgaatgaagggaattagtctatagttcccccacgcccctaccctaagagatagtttgtgtgaaagattatacatgagtgaggaaacaacagggccaaacctgaaggatgaaaactgattgacggacttgagttgaaaataaaaacaagcaggacgaggctgcgattgcaatgtgaagtcagcatgcatctactgtaatttattcaaatccaaccaggcccagagagcaggccaggcccccttctgtccactccaccttccacgctactcttgggtccacactctggagagaccatgagatcaaacataagaatcctgcattcctctgtcagtttcagctcttcacctgcctctgaagtgtagtaattacgtcatggccctccagtgcaaccacgccctaacagaagcgagccacttcagctgctgcatctattccaatgctggaagaaaagctattcatgcctatgggcatttggggcctataggaccttaatccctgcttgccctcccaagctgagatatagttacacttctagaggacagggaaacttcctgaggggtgtattagtgcattctcacacagttgtaaggaaatacctgagactgtgtaatttataaagaaacaaggtttgatgagctcatggttctgcaggctgtacaggaagcatagcggcttctgctcctgggcttctgcctcaggaaacttacaatcgtggcaaaaggcgaaggagaagcaggcccgtcttacatggttggagcaggagcgagattagggagcagatactacgcactattaaatgaccagatctcagatgaactcatacactatcgtgaggacagtactgagggggaaatccgcagccatgatccaatcacctcccaccaggccccacctccaacactggggaccacaattcgacgtgatatttgggcagggaaataggtccaaactgtatcaaatgggggggatgtgtctgggtggaagtgagtcttttatatatttggagtgattgagagagtcagaacaacagtgtgtgcagagcgctcttggttgtagagaccagcgacagcagtccaggtatgacggaaatgaaaatgttagccatggcttagcaaaggtcttttgaaagaaacgagtgtagatgtttgctcatggcactatttctagggcttaggtcaggggctcaagggccattctcaagggtttgcaccaggataatggagaggaggaaaaagcctgagaagttggcaccttaaaatcagcaagactgaagagttcattaagtatgggctgcagagaagaagatgattcaaaaatgactgagaagcttgggtgttaggatggtgatgccgttttcagcactggagaacacaggagacgcaggtggtgcattgagtcctggacgtggtgagtcggaggtgctgcagggatccccagacgagcactcacagaagcaagttggaagggcaggctctccatgcctgtcccgtggccagcatcatttctccactccctgtcaccctcggaggaagagtttcatccaaaagctgggtgagcatgcccaggtacagctaggaaagtggaaaatcagaaagccaggagaggaaaatcagaagttgaataaaaggaggatgaattcagggaacactcatcccacactgtctagcgttacccttcagggtccctgcaaaccatctaggaaagagcatcacagtggaactcccagtcacacttgtgaatgtggaacccttcttggtgccagcaacaagtacagaattactgagtggcccctgtgctgtggcttcagctcactgctcaagggcaggggccacctagagactgaggccgcctggctccagccactggggaggtttcctaccccagcactaaggaggctggtggtgagggctcccaggaaatcagaaaggtcatgaaaggagtggaggttttgagattgcaaaagaaaatttctggccaggtccagtagctcatgcctgtaatcccagcactttgggaggccaaggtaggtggatcacttgagatcaggagttggagaccagcctggccaacatggtgaaaccccatctctactaaaaatacaaaatgagctgggcttggtggtgggaacctgtaatcccagctactcaggaggctgtggcaggagaattgcttgaacctgggaggcggaggtggcagtgagccgagattgcaccactgcactccagactgggtgacaagaacgagactctgtctcaaaaaaaaaaaaaaaaagtttctaatgaaaaagggaggcaaggtcactatgtggagattagataatcaaactctgaaactgttcagctgggtagaagaaagcaagatcatggatgtgacaatgtgttgatgttcatgcttgttgtcttacctaatgtacaggcagagaattgacaacatggctgttcttaaaattaggttgaggtttaagagaactaagcctgtaagagtgatgaaggctgacttaagcattccgtcttaactgggacatagaaaacctcgagtctgctattgactctgtcagtaattcattatgtggcattatatatatagtctctgtgcattaggggagaaaccgaggtgaaaacaggaattatttcctcagagcacactgactgccaaggtgtttatacactgcacaaggaagaggaaaataatacttgccacctacctacccattaggggtgacgtctggagagaggcattcaattttcggatgaacgggtttatgaatagcagcgtatcacctgcttctgatctgtcttatttttgcatcaattcacctcctgagtgatagtggcaatggtgccacttgtcctttgagtcactgattccatgtctcctcacccagggcatgtggaagggaaggtttgagagaagtgaggccccattctttaaggtgtgatagaacattactaattaaacacaaaaaaatattttttaagcaaagttactgcatggctaatgtattttatttatagatccccgtttctgggtcctttaaaggaaaactgttattcatgttaggctgatcctaccttacctatgtcacttgctaacttagtaaagaactctttttaaaaattcagagagtgtcatatttattttccatacatcttgtcatttactatatatgtttgtaaacaaatatgttccatttcttaggagacatctggtttctaactggtttgacttaataaggtaacagaagttccatgttcaatctgccttcaagggttgcattctcttagtgatttaatgcttcaaatagtgtttcattcaagggcagattctgattctctatttctctcctctcacctcctctttccttctcagacatgtgggaagtgacccttgcatagagactcggaaaaactctgaaaacagaacacataaagctttaggatattttcaatgacccattcctgttctttcctttacttgaaaaagttcagaaagtccaggtctaggtcacattctaagagagctcacccagagtggactctgcttaaccaaagccttcaaggggctctttcaggcatgagcaggaaaatacatccacaagagtccccgctgcatgcagatcccagggccatctgctgtgctctcagagatgctcattgttgtcatttaactgcgagggccacagaggggacaactgcagattcctgctctacagctagactcctggggcccaatacaggccacagctcttcgcagccatgagatatgcgagcacgctgcctaactcatctgtaccaccatgttctcgtctgtgaaacttgggtattaacagtacttacctcatgggtttgtttcaaggattgagtcaatattagcaaagcattcaggacaccacctggcacccagtgagtgtgacgtaaatagtaaagaaattggcttttcctggcacgatgatcaagtgattggtgcccagcagctctaagcaaactgtctttgaagggagagaagaagccccagcagagattgttcagaacagctcaacgtcatgcaggagttgctcagctacacccatctcgggatgatggagactccaagtgttacgtattttgcaagcttcataaatctgaccagatatagacaggagattgtaacctgtgctttttgtttatgaatcttgtattgagttgttgaagatggttaggacaatttaatgttgcataaaaaccacttcttgtaacatcttaatagtgagaataggagggtcaaggcaagaaaagtgctgagaaaacaatccccccaaaaagtttctctcttaatttcaacatcattttatgtatttttgttgttgttgttgttggtttgttttatagctttaaatgttaggattacattttggggcttattattcaaatcaaatatctggcaccattcattttctgcttccacatttgaaagaccaaatgttcatcatttctggtgtcggttcagcctctggcctcctttctaagacacattttgtagagtattagttttcccattcatagcacgagaaaaataatacattccttttttataatagaaatgtgatttgaggttgcttacagagtaggtagaggtttagggggaaaggctgtgttttgtgtggctctaggatgaattatatgaaataagataagagggaaagctatagtgggtcacttgaatactgacctagtattcaactgtttttgaaaagaagttctgctctgctgtaactcctgctggccttccagaagcatcagctgtgtcacaccacaagtcttaaaggatctcccttgtttccactgcacatctgcccccatgaataaactaagtgggcaacatggtcatggttatgtgttcttagctactctgtcctcagtgtgtgaaatgcccacctttaggggcgctgttggggtgaggcattttagctcccaaaggatcctattagagtttgaaggccctgagaccagacagccacactgcacagaggggcagcctggacccacgggacatgagatgagttaatccacagttagccaagaggttaccgcagaggtagatattcacttattcaaaatttaagtgcctactatgtgcaaggcagaaatctgcgtctactttctcctcatcagcaaaagtagttctacttttgtttttggtttttctttttaagaaaaaaaaaatactgtggacttctgtataatactcattttagccaaagaattctgcaactgaagagtttgagtcagtctccatggcatccctggatgagttctggtcatgaaggagctcaaatgatccttgtcagccgggggaataagctagacccaggccctcccatgcctggcctcattcctttttcaagggaacaatgccatacctcactagaccctagctatacattcctccagccaaatgccaggaagcatctgaccatgagactttaagagcaaaatgttgcttaaagaaaaaaatgggagctgttctaaattcaagagctaatagatatactcttccattttctatggtcaaagtcataacataacaacatcactacaaatttaagaaatagctacagttaattcagtagatattgtagtgaatgaatgcctgaaatatggtttgagggtcacatatttaacctcatcaaacctcaatttattcatcaaaaaatagaagtgatcattattttgttgtgaagaacaaatattataaaggaccttataaaccataaagcattatacatagtttatccttctcttttccattccttaagcaggactgtcagtgcaattgccttatattttagtgctatggagtacccttatctttttgctaaatattacaaatccttttgcttacaaattagtctgtcacttctattcgatggattatctgtctacctcggggcttctgtgatgcacagagtcatgggctcactctctttggctcatcttgtaggtttgcaatcactcttacaactgtcacttccagccgatccaggactgctgcggcctctctgctctgaaatacacctagtatgtgaatttcacatcacttctcagtcataaaacagacccatcagaagctcattttcctaagtttattttaaatttatagagcattcatttcatccttctcggtaatcttttttttttttttttttttgagacagagtctccgtctgtcacccaagctggagtgcagtggcacgatctcagctcactgcaagctccgcctcctgggttcacaccattctgcctcagcctcccgagtagctgggaccacaggtacccgccaccatgcctggctaattttttgtatttttagtagacacggggtttcaccatgttagccaggatggtctcaatctcctaaccttgtgatctgcctgcctcggcctcccaaagtgctgggattacaggtgtgagccaccacgcctggccggtgatctttttctctttctcttttttcttttcacttgctgctattctatacatgcggaggagtttttggaaggaaaagagggcgccttattaatggtcattttctactaatggtgattttgatactattagatacctactatgggcattgaaattggtctctagttccattgagaagagtagaaaaatttctagtataagtacattcataatgtttagataatatcttgagaaaaaaatagacaaattcacaagttcttctttgacttgatagatttctgagttctcatgtgtttgtccatcttcattctgctttaacgcatttacacacacacacacacacttccttttctatttgttcagctttactgagatgtaattgtgctatagttggtttgtgtgacccctccgaatcgcttgttgaaatttgatccccactgttagaggtggagcctaccgggcggtgtttgggtggtacaggcagatccctcgcgaatggcttggtgccctgcccatggtaatgggtgagttctcaccctgctgttcccacaagagctgtttgtttaaaaaagcctggcacctccccctcgctctctcgcttcctctcttgccacatgatcccttcgcaacagctccccttcgacttccactgtgaccagatgcagccccagaagtagacactggtgccacgcttcctgtgtagcctgcagaatcggaagacaaaaaacccctttccttcataaattacccaaccccaggtattattttatagcaacacaagtggactaagacaaattggtatatgaaaaccacacataattaatgtgtacaatttggtgagtttggaggtatacatacatttatgttaccatcaccacaacaaggagacagacacatccatcatctccagaagtttccttttgcgtgtctgtgtgagggaagaaaacttaacataagactactgatacagctccgaagactggagaaacaccagggtcctttgtctcatgccaatgctattaacgacaaggacacccgtggagtggttttaaggagcggagagtttaacaggcaagaaacaagaaagaagaaaacagctccccggtacagaaggagctgggctcctaacggagaaaaaccccgtgtgcccaggaaaaacagttgtttatacctggaggctggaggaggcggtgtctgatttgcttagggcccaggggattggcttgaccaggtgtgtcattcacatagccaacctggtcctcccaccctagccttttaatatgcaaatgcgggtcggcatgatgtcctgcacacgtggtgttatttggaggcagccatgacagctgtggtgacaaggagaagagggcgggaaccgccatgtcgggtggacctggtttttagctgctggcatttacatatcaatgttgccagcctggtttttcaagctgctttctgttagaaaggaaatggtttggggggtcgctttttattataggaaaattccaccaagaactctcaccctttctagctgcctaaaaattatttcttaataactcctatattactaccctcctaacagaattttaagtgcacaataccttatcgttaactctaggcaccgtgttgtacaggagatctctggaacttatcttgtgtaactgtaatttgataatccattgaacagcaactctgcatatgccccctctccatccgctagtaaccagcgttctattgtctacttctgtacatctgactatttttagatgctccatataagaggaatcactcagtatttcttcttctctgactatttcacctagcataatgtcttccagatctgtccgtgttgtcacaaatggtagtatttccttctttttaaagccaggatagtattctactatatgcatataccacatttcattcatcagtggacaattgggttgcttgcacatcttggccactgtgaaggatgctgcagggaacatgggagtgcagatgtttcttcgagatcacaatttcagttcttttgggtatatacccagcagtaagattgcctgcttatatggtattctattttaattttttgaggaacctccatgctgctttccatagtggcagcagtatgtattctttggagaaatgtctattcaagtcctttgcatgttgtaattgtgttttttgggagttttcactagtgagttgtaggagctctttgtatatttcagaaattaactccttatcacatacatggtttgcaaatatgttctcccattgcataggtggcctttccactctgttgattgtttcctttgctgtgcagaaattgatgctgggggaaaaaggggatttgaagtataggccaacttcagaacaatttgaccaggacttgctaagtttttttttaaattaggaaaatacatagaatgtgacttaaaaaaataatcaattacctaagaccttgtctactgggtcttaagttgaatttctaaattctggagccaactatgtgaccttgggcacgtgaacaaaagttaattctataaactagtttaaatcctgtaggaatataacattattttattttattttatttttcttaagaactttttggaaaagaggctgaggaggttaggaaagagcctctgattttatgaagaaatgtccagcatttccccaggaatgggattccacacaagaacaccagctggagcagtgccgtagagtcaaaggaaggaagaggctgcagttcggcaccagtggggaagccaagggcatcttgcatgctggcaccttcgagaggccgtacagctggagggtgcactttgcattgccccatgtaggctctgtaattaatatggctgtaaattttgaaaaactgttattctggcagtcaaaaataatcccctatatataggcatcatgtaaacttttaaaacgtctttcacatccttcaaaatgtataatctcatgaattacagtctcatgaaaatatagcaaataaatatttggaattataagagaggaaaaaataaagaagtgaaaaggatttgccctactccaaacaaagcaatgcaattgtgcaacggaaggataagtcataagaaaacagtagagcgttcagaaaaaactccaagagtgtatgtgggaatgtagaaattcaataaaggtgatattttaaatcagcaaggaaagactagattatttattaaatgaaattgagttaattgattctccatttagaagaaaataaagtcaggaggtatgtctcatagcagtctccagatacttttaaggatgtttaaagatttaggtgtaaaaatattaaatctataaaagtactagaagaaaatataattttgttaaataatttcagagtgaggaagccattttcaaccacagaacaggttctaggaagtataaggaaaagattgatgggtctgactatataatataaacttaaaactcacatacagtgaaaaaactcaatatagagctgcacagcaaacggcaaattggaacaacataatctcaacacatgcaacagtaaaggcttaatgcccagacctatgaaagacccctaaatagctataagaaaaagacacacaactcaatagaaacagcaattcagaaaagaagcatagtcaaaaacaatgaagaaatgagctacctcattaacagtaaattcaaaccgctatgaaatataacctccagtttttatgaaattccaaggaaatggacattcttgttaacagttgatgagaaggcaaataagcatgatgtttttgaaagataattagctttcttttaatactaagtgtgtataccattcaacccctaaactctactcctaggaaactatcccacaagaaataacaacacagatgtcaaaatagtaagaatttctgaattttctgaaatagtaaatatttctgtgcagcattttaatcaaatgatacatatgttctgccttaggaaaaaggagcacagtttattgtaacataaaacatgcacatatacatacaaacacttacacattgcagatcaaaatgagctgtctacatttatctgacagatggtctgtgtgtctgtacgtgtgtatatacatacaaaaacacttacgtatatcctagtaacagcataggaaaaagattggacgaacaggcacctaactgtgatgattctttgggggtcaggggattgctgggatgataaatttttatttcaaacaaagtatgccaaatgacgctttcatttataagataccaaaatacaatggcgttcaatttcactcagtagcatatgcaaagaattgtctcattaacctctgaatcaggcctttcaccttttgctggaatggctgaccttgagaccaaacactagaaccacccatggaacacctgttgaatacattaatccccctagatgagccttcccacttctgttcatttcacagaactaatttctatggcattttatttttacacaacattgaaaccaagattgtctttggtatttatgagggcatttacaaaaggaacagagcaaatgcggttgagacaggtcacaataattctctctgtctctctgacacccagtgtttcaagcttcaccttccttttacacatactcaattaaattaaaatacaacgtgcaaagaaagcaatggcgaaagaatctgaaagggcactgcagaggtgaaaatcaaataacctcatataaacctttcctattaagagtgaatatatttagatttttaaaaataaaaacccagaataattatgaaagcaaaatgccacagacccagatagacagggaaagaaaataaaggtgctgtaaatccacaaggcccatggtgttcacatttcttcttgttttgctcagctctgagctgctggcaggtgttgacccgaaggggagtctatccaggcacccaggtagcactgctggccaggtcagatgccactggagggagggtggaaacacaggtcaagtgctcttgagcccctccccatctctcaccccagctcttcatcgctaagtagctgggaactgactacgtagcatcaattacacacgtacaactctgaggagttgtcagactttagccctaatagtgccttcagtttttttatgagactatgtaaatgaatgccaacagggtcaatgaagtggcaagtgccatttctaacatttaacaaaagtggcgtcatttccagagctctgcccagctctgactctttctcctggagggtgcaaaaagaaaaacagaaacttttctcgaaggcatcatatttcagacaagtattgtttcaattatgacattttgtcaaattgtgaagtttaaaggacaaattgcctcggcctattcctgcttaagccttttcatgccacttatggaaaatagcctgtgcttttaatgggtattttgtcagttaatattgccatggagagagaacaagctgtagcttccttctgctgagacttgaagccccatgaaggacagacttgtctgttttgtccactgcttgtctctaggtctgccgcacaagtgtgtccttcacattcactattgttaaataagaatcttcaggtcgccttataactgcacaccctcaattggattaattcttattagtttccccttcctgggctatagaattaggttagtcatgacactgaagttgcaaaatgcttgacatagaaaagtgtgtatgctctctgtcatatatgaagaagtctttatctttacatttacagaaatagtttatcgtaaagtcttgtcatttgagtctcaccatgtcatcaggacacaatgtgccataacttccacacatgcttgtagctcagagtgcacagtttagcctgatgacagcctgctgattatttataaattaacagatccagtggaaatattatatcttttgtttggcagaaatatatattttaatatgtctcacttgtttttgtaatccatctcataacatgaactttagaatatgtactatgtatttttaaaggtatttctttgttccttgattgtggtttattatttttcaaacagcttcaaaatttccaatttccagaagatttttaaatttaaagtgtaattgttttaaaataccaaaattggtgagattattgaagaagatgattctctctactcaggaaagccacttaaaattggatgaaattgaggaagtacagcaaaagcttaattctcaggatattaatctaggctttctttggaacaagaagcagggctgagaaattgccctcagttgtaaatggaaaatgagtttaagcatcctcctaaagaatcataatttagttctagtcagaagtagctgagcaggagaaaacttgattacttaaaggcactaagtatattaggaaacgaaatacaaataccttcaaccagggccgctgctgcagtctggctgtgtaaggtctggtattctgatggaaactgataggctccattagagatgtctatcatgtagaaaatgaatttaggatgcctttgtcatttctcttgtctgtaggctgagcttttttaaaaattgagctatattcatgcaagttatataacttaatttactgctgaaatggaagctaaagtggttagtgcagtgatactcagcctcagaggctttaaaacactggcagattgttcacacagaattgtgcctgatttgcctgatgcatgccattaggatgatcatggacaagatctcagactgtcatttagccaaaactgtgtacatattatgcatagaacaactcacccaaaattgatagctaatgggaaagtttccaactaaataaagatttggaatccatttaccgctcagtaagctatttttgctccatatcatcaagtttccagaagtaactgctccttacatatattctaaagaacgtataataaaaaagcccagtgacaaaatttgatttgatatatatctcatccatctgttttttttggtagaaacctaggtggtatgtgttaaatgttaagtataagagaattctcaatattttaaaaataactcaaaatattgaggaaaacacctaaaacccattgatgattgtggtagctcaggctctaacagtttcttaaaatgtgtccatgtacacactgggttagaatcactgttctcatttacaagtagagcttcctaggccccacgattctcattcattccttaaatgagaatgggggggaagttggggaagggtctggaatttgcatttaaacaatttgagcgcgatttgaacatgcattcaaattccagaacccctgctttgatattatgtcaatgattttggaggcagatttagtcccgtcacaggacattgtcgttttttaggtgcccaggtttcttgtgacttcatccatgagatggcatgtacagtacctgagtacctgccactgggcaaaaagatgaccaggtgagagacgaaggaatgagactgcagccctcaccatcagggcacaaacaccccagtctcacattccgtcaagagtcgttctattacttacatgtcatccactctagacagtgcctacatttcaatgttgagcgtgttccttgttttcttatgattagaggtgacacagtactctgtgtccagtggccgcccaggtttttgaggtaagcaaacactgtcctcctgatcagcagcctccatcttcctactgatcacagggcagcgtggcagtggttaggagcacggactccacctctttccgactgtacatccttggccaaggtatccaacctcacactcagtttccttcctacctcacactcagtttcctccctcagtttcctcatctacatcataagggtaacagtagttttggctgtgaggattaaatgggtttatatttacagaatgcttaaaacagtgcttggcaaattataagagcttatttggaaaaataacaagattagaaggggtggatcattccagaaaattaaggaatcaaagagaaagatggagagattaacaccaatctggcaaaggaagccttccaaagaaaagtgtacctcatgtgtctcttatggttcctggggacatagtgggacaaaagaagtaaaaggagaaatggcaaaggcaaaataagcattgtcttagataaggaatgagggaacaatgaagaaaacagggctgcatagtcacttatataaccacaaagccgcttagtcctatgtgtgccttgactatgtgtatcccactggaatgaaggtggctgcactgagcacctttgggggtggaggatgctgaacaatgttagcaaactgcattggatgtcacacccagcttccctgtgtctgtccggagaaccctcctttctcctggtcttctatgcccaacgtctggctatttcactttattttttctcctcccttggccttaagtcaggaactaatttttccccactttgcccttcctatgtcattattctttcctttctttcctactttcttttctggtaccctattttgaatgtgtgtcacctttaacttcaggtacatgaacaagctcttagccagtctttggaagcatctgaccacagcacctccaccacttttctgtgcaaaacccttcaatgaccctgcacaataatgtcaagactttatcagtgattttcaaagatttttcccactttgggcacaacgtgcccttctagcatcatctcccactactgggcctctcccccatacctaatcctcctcctacaagccctgctcttgccaggctcagcaagcaggtccatggactgagagcacctttgcacttagcgggtcctttgcctggggttgtgtctgatctggcccaggagcagttagggaaacgttactgggccagaagcactgcaggtgggtgtactgagttgaaaagtctccccgcaagatccatgtccttcccagaatctcagagtgtgaccttctttggaaataggattgtgtaattagttaagataaggtcctactggagtcgagtgtgtcctaattccaatacaactggtgtcctcttaagaagagaaggtacagtcggccgggcgcagtggctcaagcctgtaatcccagcactttgggaggccgaggcgggtggatcacgaggtcaggagatcgagaccatcctggctaacagggtgaaaccccgtctctactaaaaaatacaaaaaattatccgggcgtggtggcgggcgcctgtagtcccagctactcgggaggctgaggcgggaggatggcgtgaacccgggaggcgtagcttgcagtgagcccagatcacgccactgcactcactccagcctgggcgacagagcgagactctgtctcaaacaaaaaaaaaaaaaaaaaaaaaagaagaagagaagttacagtcacacacagagggaagatgacatgaagacagtcacacacagggaagaatgccccgtgaagatggacgcagagagggggccgatgcagcttcaagccaagaaatgctaaggattgctggcaactaccagaatttggagaggcgcataaaacaaattcttctcttaaagccgtcagaaagggtggccctgttgagcccttgattttacactatgagacacttgtttttagtcaccaggtttgtggtatgttttaagtcaccaggtttgtggtacgttacaacagctgtaagaaactaacatggcagctgttgaatgttaagagccctcagctgtgaatcggagcgatcctacctccctcaccaccgaagagtgttgcagggatcaaacgggctaagacgtgagcgtgctattagatgtgtaaaattctacacaagggtcgttaaactttgacttattttttgaaaaccctcccattcccttgcataacccctaccacaatactttacccataaaatgcgttcaataggcacgtgttgaatgttttcatttattcatttactatatcacattaattttattttaaaagacccaaacttagtcataagtaacatggctcatcttcaaactactgcgtagccatttgtgtgcagctttgactgcatgtggtgttatttcagaaagatgtgatttggtttgtctagctgaatgtaagtaatacattcattataatactagcttactatatattaattttaatatgctcatgaagttaaatatctgtggatctgaaaataagatttattttatttaagatgaaaaaatttgttttgacaagattggctggttttatttatgccacttactagaaatctaataaatacatattttatttaacatgactttttaatagcattcctttgaatttactcatcagtaaatttaatcaatcacctttttaagaaacagaacaaacttgctagtcctagcaccataagatgatctcttgcaaggaagtaaagaagaatccaaacttgagtgccaggaatcattattgataaggtgaaggagaacaagtttcccttttgattcccaacttctacttgaaatatgacacccagaatgtgattctttctatatccatttcctctaagaatctttgagcaatttgtgcgtgccctgtggttaatacagcctagtcatagcccagtgaagctgtcggcagtcctgcttagagcagaaacacagaccatgacagttacaagcatgtgatccacagagccaggaaaagaccctgagacataacccacttctgtacctcctcagtaggagctatactcaactcatgaattaattttgagctcttaatggcacttattaaatccagaagaaaaatacctaaataattcttacttatatttaatagcaatttagattcctgcaagtggggacaaaagctttatttcacttccaaatggacttcaaataacatcaattggatgtgcactagaaaaatataattttaaaaggtgttcccaagaattagtaaagaagaaaagtcatgggaattagggagagtaatttctaggaaatttttattggctgcttttgtccacatgatatttacagtgtatgagttaggttaagctagactataccaaagtaacagaatatactaccaaatttcagtggcttaagaatcagtaagttgatttatttttcaggttaataggccagtattggtcaggtgcagatgacttgggagaagaaggatttgctccatgcagttgtagggacatgtggcctcatgattctagtcacaaggttgatgttgtggaggaggttttaataggccaggtctggaaggagtatgtatcacttatacttcttccattggctagaactcagtcacatgaccacacctcactgcgcaggaatctgggaaatgtagttcatcaaacactcaagaataagtggaactgaattttaatcaataactacaagtctctgcatcaaggagaaatgtgtacctgatgtttatcatggaagagaagaataattagttgactttttgtgtataatccccaagcaaaagaagtctgattcatgctaaatcttcctaaaacagaagtagatcatttgtggggaatatgttattagaacacccctagagaggagcctattacccaacttcattttccagcttcattctcttggcaggagacgtatttctctttctgcctgtccacggagtctgtgccacaagcaaagagatgctgtatgtcttgcctataaagcagggctgggctgcgaagctgtcgagcccggtgcaaaatggaaatgtggagctcttgattcaaaagcaggaaagcaatgttacaaactaaaatataaagcttttatctttcttccccagtctctcaatttgccatagtgttttttacttgctatttagctgcattctaagaaaaattaaacatttaaatattggcatgaattttaccgttcatcttaatattgtgcaattccaattttaaacgtaaacatttaaaacagggtctaactcatacgtgcaatcactgaaactaactacacaatttgaatttcgtaacttatatatgtgcatatacactttgttcttgcaagaacagcagacatgtcgcataaaaccaattcacttgtttttatttcacttcttgagactcgcacattctaccaacattctaccttcagtttactgatgaataaggaagaatggaaagggaaagaactatggggtcccctatctttcccttccgttccatgtcatcatttcctgcttcagttgctggctccaacaagaaaagcacaggagtaagaaaggatatgatagggttcattggtcactatgtttcttagaatgccattgccttctttctgcattcaaagcaagttctggttcaaacgaaaagtttggcgtctcggggctgtaagtacccctgcttactcagtaggagatgtcacacatttaccttgacccctgcacactgtgggttcaccaaaattctgtctccaatgggcgttgaagagacttaagccacgcatagagcccttctaagtgcagggcctcaagcaacttcatgttctgtactatactaaagttctatactaaaagacacatatttagaggaaggataccacagaccaacactgatgtctacagcagcaagaactgtaggacatgccgtcaattttgtaatggcttttaaggggaaaaaaatactctattaatgtacatcttaattggaaggtgcatccaaatttcagaaaaatgtaaaataacagggggaaagcttcaattcctggaattgtagcacatcacattcttttccctaatacctacctaacaactactactactaatggactaatatatgtttttaaatatttcaaacatccagaaaaacattgagactgatctatgaatccctgtgtacctaccaatcaactttatcaaatctcaacagtttttccacatttgcttcacaagattcttaaggggaaaaaaacatttcgaataacaccgacaccacctgtggacccctcctgtacttatttgacctctcctccctactctgaggtgatgagtttcctgaaatcattctttatcattcacacgcatacttttttactctcagtatatatatctgtaactagaaacaatacatttttcacgttgtgaatttgataaagaacagtataataatactgtacatatcattcttcaacacgctttcttatgcatcattattactttgagatctgtatttctacatgtgattctagttaagtcattttttttttttttttaattttagacagagtctcgttctgttgcctgggctggagtacagtggcacaatctcggctcactgcagcctccacctcctcggttcaagcgattctcctgcctcagcctcccaagtagctgggactacaggcacacgccaccatgcctggctaatttttgtatttttagtagagacggggtttcaccatattggccaggctgatcttgagctcctgacctcgtgatccacctgccttggtgtcccaaagtgctgggattccaggcatgagccacagcacccagccttagttaagtcattttaataactaactagtgtaattgcataaatataccccaatttatccatttatttgattgtcattttaaatgtttctcctttctctttattataaacaatgattcgggaaatcttcttccgcatttctcttagtatatgtgagctggagtgattttaaggtaaatacctagaagtagaaatgctgggctgaaagttatgtgcatcatatctttaccttttctacatgtggccaaatggctctccgatctacaagcccagaggcagtgtgtgaggtgcatcgctcgacaagccggctgacgcttgtaaatgcccaacatctgaatccttgttaaacacagaagtgcaagatgtatctttaaatttgcatttttcccaatgactagtgaagttgagcatcttttcttgtattaatcaagtttcttttctaaaaattgcctatttcaatgctttgttcatttttttctgggttatgtatctactttttatcaatttgtggtattttattcattatgaatactactgtttggtcatatgtgtttgcagactttagtttttgtgcctatttattcggtcttttacaaaaataagattctaagtttaatgtcattagattcatcaaaatcctctctttgtgatttcggatttttgtaccttgattaagacaaccctccattccctgacatagtagtgtcattgtcccaatctcaattattgacagcatcaccctaactccctgctctgcctctctctgatgtgaagtttccctttgtgcatgtgttttctgcttttcttgttttacccactgcaggtatacagtccctccatctccttcgaaattatctggtctgttcttaaacctttgtgtttctatttgaatttgaagatcaacttgtcaagatccattttaaaaatcttgctggaattattttttggaattgcttagatttacagattagtttatgggaaatttccacgtttaagagattgaattttcccttcagaaacaaagtgcatatctccattaatttagaattttttatacttcattcatgtttttaaattttttccataaagatttgcacagctttcgttagtttcagggttcattttttgaaaacactttgctgtttactacagtccttagatttcctctgtaacataatctcttaaatttattcatagttataacggaaactgttgtactacaccttgattttttgccaatttagggattactgaatgaactaatgcaaaatccattttatgccaatctatacacttggttttgaataatttattcaactaaatactttctaaagagaatcatatgcgatgaataaaaatatcttgaatagattggaaatgttcctgttttgttttcattgtaaatgcatactaaatgcgttaacaacatagaaagattctgggttctagtagattcctcaaatataaacactttggatgcaccactgtttcaaaagatgaatagtttaaacggaactcctatttacagccatgtttgcaaatgcattttttactttaactattctgagatataaaaataagcacagagattttgtgatagctttgcaactagcagtatttttgaaacatgaaataggcgttttgtctggagaagccttatctatcacagtccatgtctgaaatcacagttgtttaatgaactctgttttatggaagctgccgatgcctcattcgtaagtctccccattctttccaatgtcacacagactttggagatgaatttaaatttcatcattatccatgacctacaatgtgtgcattgaccatactagattttccctttttgaatatattcccaacactgcaactccctgccctgctttattgttcgcttgccagtcctcggcatcgttttattcctccggcattttaaacaaaataaagatccaggcttatgctgaggcagtgctgaacaaacccaccaaaatcctcagaactccatccattcaaagaggagcgccaggatttcccaagcgacaagaacagggcgagctctccgatcctttctccatccccccaaacctcccctggctctcgagaacaccgtcagtactccctaataccccgtgctccaaatccggagctcggtctccacccggccgcactccaagtgacagcaataatagctggtgtttctaaagtgcttactggtaccaggggctgcatccgtgtagactcatttaatcctcacagccctaagagagacacgtttgacagatggagaaactgctccgggatactccgtcggggaatggcaggagctggccccacagcccggcctggcgccaccgcgcactgcctgggccctgcagcttggagcaggccctgagtgggctccctgcaaatattctcatgctcccttctcaccaccgccctgcaaggggcatggtactgagctcaccgttttacaggtgaggaagccacggctcagccttccgagtctcctctacctgagcctcagagcctggctcagaggctctgtgcccagaacgacagtacataagaaggagtgggggagcctgtcggagccgcctggggcattagcagatccaagttccaaatttggaaaacttaaatcgagttacaaacctgtcatcaatttgacagtaatgtttttataattacacattgtgatacttacctgcattataaagcaatttaaatgttgttttgtttaacacctcagcttggatctggacgtttttctaacttaagaaccagaacaacggtcacaaatgggctcctgaagaatgtttcagaatgctctgttcacaaccatgggggcgtatctgccacctctgcccccaaatggacaatccgtcagtgtgataacccatcttctagaatggtaattaactcgagaagaggcagtccccaacctttttggcaccagggaccagtttcatggaggacaatttttccagtgaacaggggagaaggtggtttcaggatgaaactgctccacctcagatcattaagcattagattctcataaggagcaagaaaccaagatccctcacatgcgcagttcacaatagggttcatgctcctctgaggatctgatgctgctgctgacctgacaggaggcggagctcaggcagtaatgtgtgctcgcccactgctcacctcctgctatgcagcctggttcctaacagaacgtggacctgtaccactctgtgacctgggggttggagaccctgcttggagatgttctcctttatccctacctgttcattgcaacactgaataaaaatttaactgaaatgttcattataattcacatgcattcaaatacttggttgtacttgggtaactgtcagagtttcctatattacctcactgctctagctttgtcttttgttccattccatacatcatttctagactagtcatccaaaatgagtgttagaacatgagtttagagtcatatagaccggccatatcctgactccatcctacactgcccatattagtttcctgtggctgctgtaacagatgaccacaaacttggtggcttgcagaatgtgttctctcacagttctgaaggccagaagctcaacatcagcttcactgggccgaaggcaagctgcgggcagagagaatccattcctggcctcccccagcttccactgctaccagcattgcttggcttgtggccacaccacgcaagtccctgcctcgtcttcacattgcctcccgctcttctgtgcactgtgtccaaatccccctctgcttccctctcataaggacactgtgattgaatgtaaggcccatctgggtaagccaggatcctctcctaggatccttaacttaatcacatttgcaaagacccttatcctaataaggtacatttataggttctgggagttaggacctgacatctttctgaccatgggtcaacctgtgtgattgcagggaaattatttaatctgtctattttcagttgttttcactgtctaatgggtatctgtttcacagggttgcctgaggctcagaggagacagttgacataaagcacttactgcaatgcttggcaaaaaaaaagagaaagcttttaatcaataactatttgttttgtttctatataccaaaagttcagcatctctccattactttctgtcttaatcccttagtctattaggttggtgctaaagtaattgcaattgccaaagtaattgccgttaaaagtaattacaaaaactgcagttacttctgcccccacctaatagaaatccctatgtccatcatctagttccaacaattttcccaaccttgtcttttactattttctttgtagactttctagtctaactagatgcgtttgctaaggagtccctcaactgaatgttcttgcttctcccctttgtgtctttattctttgttgctcctgcctgtgaaagttgactccttcctctttgcctatccaagtactgtcccttctgccaggacgagccccattctcatcctctccttgaagctttccccagtcaacccagcccaggctggtctctccccttgaggatgatcagctgctctccatgatgctgcctcgctcttaccatgatggctctatacacgtagaccaagctgcatatagacatttacatgctatgtacgaagcacgcagcaatgatggataaaccattgcgacagagaaccccaggaagtcagacctgggctcagagactaaattaacatcttagatccctaggccagaaacagagtaggcagtgagggggcctgaagcctcaggcctcctgagatctcagttgaaaagcagtccgtggtggctgagagcctggcctccatggggtagagaggatgagagtctccctgtggggtggagtaccaggccaggcctgctgctcagaggcagaggccagagtggagtctttcactaaaaatgaaaatagaaataaaataaaaatctgctgccaatgccatctgctgctggactggaggctctaggagttgagtgcagacagccacaaaactactagctgggaaagagagagcaacaattgagaaggagtgaaagaaatggggaaaaacccttttccttctaaaataagtctgcaaataaaaaatttcataacccatgaagaatttccatgctaaaaaaaggcagcccacacaataaaaatttagaacacatgttcattctgttattaaaataaattcctataacagcatgagaggtcccgaaatcatgctagatatccaaagaaataaataggataagttcataaaagtaaaaataaattattttttgaaaaggatagaaatcttgaaacaagagcagacgaatctgaagaagaacaaatgataaattgggttaaataaaataagaagctgcccagggaggatggaggttaacggcatcatgatgggagagacgaatgagctgaaagctgctcttcgaattggaagtgtatttccaattgagaaagattaaatatgtaaattgtatcctaagcacagtgtgataaaactgaaaaacattaaagacaacaagaaaatatttaggccaccaaagagaaaaggcagacgccacaaagacccactggatcgtcagtggaattatcagcagcccgagacacaaggcagtgggttgatatctcgagtgctgagaaaaaacaaaagcaactacctagaattttacacacagttaagatatcacccaagagggaaggtaaaataaagacaatttccgacatacaaagatgaaaagagttcgccaactctacttaactctaagtaaaattacagccgaagtgagtacattagtaagaagaacaaacccacagctaagactgagataccagaaataatggcaagtcccaaaattgataaaatgtcagtaagacttatgaactataggatttttgtaatgtatgtgttttttttttttttaaagccaaactaacactccagacaacaatggcaggatgtcagaggagttttcagtcgtcagccaaagctttgttttatctggaagaaagttaaaaatatttaatcactatggaatttccatacctaaaaccatgctaaaagatttaaagaaaaaaaatgaaaaatccatattaagctaaagaaacataaggagtaatagtaagatcagattaaaaaaaagcattaatggagaaaagaggggcatcgtaggataagaagaagcaaaatccaccaaaatgacgtaaaaatcatgatcctgtattatcctaacaatatagcagaaacatgtaaagtaaaagctaacaaagtgataagaaaactggacaaatccacaaagtaaaggatcataactctaacagatcaaataaaaaattattgaggatatggatgattttttagtaagaaaattaacaggtgagttttgacatatagagaattctgcacccagtagcgatagtcctttgtatgctcctagaacatttacaaaattgaccatgaagaagattaaaatttcaacaaatttaaataatttatattatttaaatgatattctctagcaactaaaaaaggtacaactaaaagtatagtgtttgaaatgaatttataattcataagctaaagcactggatgaaaataaatgtagaccattcaatttaagaattagaaagtgagcaacaaggtaaatgcaacaaaaccagaaataaacaaaagagcaaacattcatgaaatagatgtcaaggaaatggtaaagaggatctgcaaaacaaaaccaggttctttgaaatagcaaataaaatacacgtttcaccaagaatgagcacaagaaaaaagtcacaagtaaacagtaactcattcataaatcaatgcaaatgaatttggaattcagttgaaagaaataatttactagaaacatataaattaccaaaaaatagaaacccaaaataagccaataaacattaaaaaaatgaataagtaatcaaaagcttccccaccaaaaagaagtcacatacccagttcattttacaatcaattttttctaagtatttaaatatcatttctttctctcaaactattccagagaactgaaaaagaagaatcgaagaagaaggtaggataacttatgtgagcaaaagacagaaaatatatgaacatagttgtaaaaatcctaagtaacatgttgtcatatttaaaaaatcctaatagatcaggatgaagtaggactgtccttggaatggacgtgatcactgtgttcccagagccttgctatgtggtttgagaagggcactgcaccctgtgatattctctccataaaacataaccccaacttcatgatgagaaactcatcagacaaacccaactgaagaaattctacaaaataccaggccagtatttctcaaaactctgaagatcatgaaaaataaagaccaagaatccgtcctagaacagaggagactctggagacctgagaactaaatgcagggctgtatcctggtggaatcctgaaacagaaagaagacagcggtggaaacgctggcgaaatccaaatgctatctgaagcttagttaaaaggaatatgttaacgttgatttcttagctttgacaaatacaagatttaatacaagatattaacattggagaaactgggtgagggatgcagagagctctctgtactatctttgcaactcttagtgttagtaaatctaatactattccataataaaaagtttataaaaaaataaaaagttcataaaaaaataaaaataaaacacctcaacagctactcatgatggaaactcttagcaaaccacaaagggaaaggtgtctcagcttgatgatggtgtccaccatggcttcgtggtttccaacgcataagtagaggttttatttcacacgttgtagtgaggattaaatgaaacaatatgtatgcgatgtcttatgaattaatattattattcctgtgatcccagagcaacaacatcagaagtcggcttgttgctttagcgcagagttcttggccttctttatgccatgcagcacttggacagcccaggaaggccttcagaccacttctcagaatgtctgccaatgcataacacacaattcatgtagttactctgtgtgtacatatacagttgttaaatcacaataatactttttttgatattgaactaaacttccattctaaggatagccctatttggtcaccatgtgtggctgagaaatcaacaggcctgggcgacgtcagcaaggaggtgaggcagagagaagaatccacgtccaatgccagggctgggtctcatgggtgggtgggaaactcagggcaaagagatcctgagaggggacggggaggaaagaccaagaggtcggtgtgggaacttgttgagtttgagttgaatgatgtttccaactggatatttttcataattgcgtaatcttttctgaaaagtagttttcaggccaggtgcggtggctcacatctctaatcctagcactttgggaggccgaggtgggtcctgaggtcaggagtttgagaccagcctggccaacacggtgaaaccccatatctactaaaaatacaaaaattagccaggtgtggtggtgcatgcctataatcccagctacatgggagtctggggcaggagaatagcttaaacctgggaggcagagattgcagtgaaccgagatcgcaccactgcacttcaacctgggagacagagtgagactccgtctcaaaacaaaaaaaaaaaaaaaagggaaaagtagtttttaaatcttttgactgaccatgcactcactccatcagtttaaaaaattatgcatgaaaagcaacacacatacacacacatacatacacacacacacacacacacacagttatattactgcaacaacgtgggttagtaatatgtaatgtatattacagtactaacgtttgcataatgaaaacacacgaataaaaattgtaaaggatgatgttaaaggtaatacaggccgggttcagtggctcatacctgtaatcccagcactttgggaggctgaggtgagtggatcacctgaggtcaggagttcgagaccagcctagccaacatggtgaaaccccatctctactaaaaatacaaaaattagttgggcatggtggcgcatgcctgtaatcccagctactcaggaggctgaggcatgagaatcacttgatcctgggagatggaggttgcagtgagccaagatcacgccactgcactccagcctgggcgacagagcgagactctctctcaaaagaaaaaaaaagtaagcacagatataagcatttttctctctgcatccctttgatttggtgagctccaggcagtaacatcaggtacagatgtaaagtctgaaaaaaacagaggagttgtgtctgcaaaggatcactttcacaatgaaagactagagcaggtagagagattggggacccctcccaccctcttttccccatcccctctgagccctgctgatgttgaaaggtagctgatgcctcatgcttcagctctgagctttactgctattgatgctacatctcagtgagttctggcttggagaccactggtcccacccaacccaccatgagagacgatttgtgaaaacagcccagagtctggagtctgaatgccttggtttgattctggtctctatccctttccagctaaatcttacatcttagacaaatcatttgatcactccaagccttggttttctcattcataaactggaggttgtatatttcttttcacagtgtaatgaggattaaatgagacaatgcaaatcaaagtgatttgtgagctagaatgccaggaactacaccagcatttgttgttactttttgtataatcaaacctagtcatgcagtgtacattttcctgtctacatcttccatcaactgtaaatacaatgggtcatattctgcctaggtccagaggtggcaataattctgcaatcattaggttaccttttcctatccacagcacttgttttcctgtcctatgcaaaacactggttttcaagctgggatgattttccctcccaggggatgtttggttgctcccagtgagggtggggatacagtactggcttcagcggataaaggctggccatgctgctgaacatcccacactacacaggacagcgccaccacaaaggacagaaagcgtcagtacctggagcggttaatccatcctctgaaccgactgggatgacgggcatggaagttttggttgttgatctttactcctcagttgaatcccattttctgttagaggttacttacctacattagcagaaggccctggcctggctttgggtgtgtctagggggcactgacgcctaccggagatgggagaggagaaggagacctgcagggtgagatgagaggcggtgaggagagagagctgctggctctgccttcacttacgaatgtaacctttctaacatgtattaagtctctggtggtgaaaacctcaaaattattgaatttcagttttgtataagtagcagtcacattttactgctttcccttcttctactgttctcttctcccttctgtttagttcttctgactcttttgaagttcaaaaagccttatgtaccagatcatcactcttccgttctccctcttcttctttcttttataaatctttgtgcatgacacacatttaatgaccaggagatgccgtcggtagccttgtgtccatttctggaatcccaagacttggctttcaccaccacttcctgaccacagcaagcagttaccaagggcaatggagatactttcattcctagccttggccacttaccctggtgccttctgttgattttcagaatcagaagtcaagttgatcatctgaattatgagttattcagtctaatggcaaggaaattaataagacaaagtcgtgaaactcccatctgtctccaagctatctacttgtggatgtttatcaagctaagaaacttgccatatgtgtaacatattgtctgaaggaaaagaaactctctacttttttctagaaaatcctgacattgtatgttgtgtttttgttccaccttattaaatggccttctcttcttgtcacaagtaaataaaatggcttcatcctgttcatctttctctgttagctttccataatagtaatatgaatggtttctgtttacatggggtgttcaacctcactcctcaaaggatctaataacatcttttaagttcaatctgttcttgtattttgccttacaaactaacatgtttttaaatgtcttttcagaaatgataaacttgaatttttctcatggtggcttttgtccaaacatctctaattgttttggagataatatcctattcattttcacaatattcctctgaaaatgtaggcaatattatgccaccttgcgcatggtcagaccacagcatgtgggagttgattaactctctttttgccatgcttctacattgctcatcccttttccattctgttagcacgtggatgctatcaattctcttctaatcatcctttgcagttagctgaataccccttatgaagtttatcagcctcaactcctgtgatagttccttgaggacatcttatcctccttcattagcttacagggtcagtctccttctctgattggtttaggaccatgtgctgaactctgcacatatgatccacacagttcaatgtatataattacaaaaatgtctaagacccaaattaaaggaagcaatatgagcattacaaatggatgcatcattgaacacacatatatttatttctcaaatatagaaaaatgaaaatgtagcattcttataggatgatagtaatatatttgttttcaatgtgcttttcttatttatttaatcctcatgaaatctgactatataagcagggttgccatgcccaacttaaagatgaatgaactgagactcagaggctgggttgccatcccagtgtctccaatcttgcaggaaatacagtatctcctaacaaattccagtgatcacatggcagttctttctattctgactataatattttctctgaagctctattcaccaatcttgccttcatgttcacctccctcatatctcactttcctaaaacccaccttttatcacatgtcttcccccaaatcaccaatagttagcaaatgttcctcagagggaaataaaaagtattgagcatgtgagttacagccttccataatatgggagttttgttcgcctagaccttcctcttgcacagcctttctttttgggcacactgggctgttcactatcccagccacgcttcacatctcccagccccggggaagatgctacccccttagcaatgcccctctagcacctttctttaccaaccagaatagaaatggactcacagagactcattcactgcctgtttcttcagcattttatgcccctttcaatcctccgtgctgcctcatacatttcttctacacagtagacatttggttaatactcattatctggttgataccactgaaaatatgaaattaggcaggaaactcactctgaggacaagacgatgtctactgtaatccacctgcagacgtgttagaaatttgcactaagtcacagatgcttatagtgtgtgtgttgagggcgggtattcttaccagatttttctttaatgctgcaaattggcagcctgagtgttttgagcatccatggccattagaggcagtctttcaaggggagttttcacgtcagtcatctctgtgccctcccactgtactgaaaacagtgtctggtatgtattatgcactgtaagaatatttttacatttttttcattgaataattcatttaaatttgatatacaaagggatccaatgcaaactttcattgaaaggcgtgatcctggagcctgttataatgtgtgcaggccacatctggccatcacgggcaggttcgcatctcacacagaaaacatttctagccagagagctgcatggaagcccaccacccttcccttgagaacacactgctttatgaaagaacaggacaatggcatctcaacatccatacattcctcttcagactcaagtagtggcatacccagtattccactgcaggataacactcagaatatggaaaatcggtcccagtgacacagcttttctctgcacagtagctagctcctctccagctctttcccatctgcctccaactttgcgtgtccatttctgcatgagatggagcatgcgagaacatacagcacacagaccctaagcagctcccaacactggaaataccttcctctctcctgaacgtgctctgtgcaattgcaatgagagattccagcgccactggtaacttacacttggtaccaacccataactggctgctgcacaactgaccggtgatccatgcacagtattctcgtggaagtgaatgagggttttgtgaaaaatctatggcggggggggggggggggggggtggaaaaatgtccctgacgtctgttgaaaacagtcaggccctgctggagggaattgtgtcactgtcgactggctctgttaggaggaaacagtttccaggccctgcagggccgtggctggcttccttccccttccttgaagctcctgccccggccctgccacctcccgcagaccgaaccctcgctgtcacctccccttctgcacagtccaggccggtcgggtgtcctcactccctccttctcctgcagagcttccggaggggacgcctcccgcgggcgctggccgcttcccaggccccggccctccccaggcctctctccccgaggctccagccggctcccccttccatcctccccagcgcactggcccgtctgccctcctcgctcaagtctccacccggtagatttaaaaagtgaaaagccaaggccacgtctatgtgcggcctcgccctccttccctgcgaaccctggagaacacggccttgtgatgaagcaaaccccagtctcctcgctttgcatgggcttttctatccaccgcgagctgaaacttctccctaaagcaaccgcgtctccagactcctgggcgctttcccttccgactccccgaccccgcgagcctccctgcaggccccttctcctccctcccccgggctgcgggtgctgcccgcacagcctccgccctctgggcgctcctatccttcgcactccagacccgcagccccaacccaacacctgtgagctccagaagctgtctcccccgaccccgggccagcctggagtccctgctgcggatcggatccccggtgcaggcctccctgccagcagcgcagatcctccttcccaccctgcgtttcctacctgggtcctgttgctcccgttggcttacggaaaggaaactcggtctcatttccatttctgtaggaaactcagagatgcctgggactcctcccgccctgggactccccactctccgtagttcacacaatttaaagttccccatttttaattttccctgcgggactgtctagctgtgcgttagttcaatccttctttcgatggttttctcactgggattcctgttgctagtcctctccctggccctcaacccgcaaaccggcgatgttcttcctgacgccggagtggcctctacctcgcaggctgtggaggtctgccacctgccaagtaacaccacgtgtttcttaacctgcgcctcagtttgatcatctatgcaaagggggagtgatcacatctagctaatacgagtgttgtgaggattcagtacgttatcataaatcatgccccaagggcatcccggagctaaacaaggctaggtaggagttagtgctgtcccacttgtcagatcccagcaggacacaccaggccgcccactggctggctctaatcctcctctacaggcttctgtccctctgggaccttaccttcctgctccctcgcctgtgctcacactggaccactccttgtcccttgaccatggggccgtctccatgccccaaggaagatgttctcttctctgtcaggaacatctccctcctgtcccccagccatgggagtttaaagtcaattcaataccaccttcttcagaaatccttccaggctcaagttcccccgcctcttaccctctaagaacaggaaaacccgtggaattatttgctccctctgtgctcctacccgtacccgggtcatgatttcagcccagcaattgtaacgatccattggcggttaccccgcttggtagtgactgctttgaccagtgaaatctggatccaacagtcttgagggtcactagaccactgaaaggcgagcagtaggtggcaaagaaatactggctaaatttaaatttttgaaattataaattttggaaatcatgacctagggtaatgttttctgtgctgggttttatctacattattattggtttggggtgtttgctctgcccgggaacttcaaaaaccagtttctgaccttcttttaaaagtaaatctcttacttaagattgaaatatattaaattcctttatttttgatgaggaaccataagtaaacaatggatggatttttaaaacttttacatctcaaagaagacatgaaaattgaaaaatacccactttgctttaacatgactgcaatttgataaacttttatttgcaaaagaatatacagaatctttattttaaagacttatttagtggagctgaaatctcaccattgtactccactagaatgaaacctttgttggcccggatcttggtttttgttgttgttgttgtttttaattccttgctctttagactgttgtttaaaatcttatgttttttaatgtgttaccaaggagaaaatgtgagagcaaattccacagtgtagactggaatgcctccccctgccctccccagcaacacacacttcacgatgtctgcatatgttcccgtcctcatcggcaggcttttgttccagtcctgagaaagacagcctcccactaaacaaataaggcctccaaagcatgtgtttttctttggtgttcctgcaaattagcacgaatctgtgctatgttgtatggaatttcagagagacattttattatttgtcctcgataggaaaatgtgcaaaatccatggtttgcttattccagatagaattatctcacttttctttaaatcagcatcagtaagcatgaattcagccacataaataactttacttttaaaatcatgaataaaagttgagtttacccgctaaaaagtatcctttgatccaaagaatatcaattatatagccttaattttttaacggaacttaaatattatcaaagctgtatgtctagaatgaagaatgaaatgaatcaatgtattagaaatttgcagatgtgttacataacaatcacttcctaacgaatgcttagaagatcctatttatacttttgagcccttagattctaccccaaatatgtcttcttaaatccactgtttttcttttctctttaatttcagtttgtttggtttaatgatagctactgaacataaatgccaaattacaatggcacttcccagctgtgtgcagaactttatattttaagtaccaatttgtgataaaagaatgcttccagctcaattctcatcagcattagaggttttagcaattgccaattatttttctaaattacctattttaattaagtaaaatattgtgaatttaagattatgaagtgttcaagcattatttcatctttaactaattagtgagaaaaaggaaattatattttgggacattaaatggctatttttagaataaaatgcttctatggtttcaatgccttaaattaacagaaaatgcacaaacttctctcgaaatcctgttacatctggggtctttgaagtacaccttgaactgatcatttgttctaatgtaacataaatttgtatattaattagagccaaaatgcccaagagattaagcttggtatctcccttgactaatttaacacatctagatccctcagcaacattttaaaaccacctgtttctattttgccttcatggaacaaagcctagaacataggaaggacctcaatgtataactattgatatgactgtcatccttagttcagttctgagatttccattcctaacttatcattgcatctacattctatttcttacaagagcacttcaagaaatatgtacagatgaaggaaaattggcaccaaaatctgcctgcctagcagcttacagcaatattggaaggcgttgaaagccattattaactgacattggcaaagtgattttgaaaaatcttcgttttatatgtcaatgcaggctatgatggtccctaaactgttgcttcaaggcagagatcacaaactttttctctaactgtgggtctcccagcattctccctcctgaacacggcctattaacggtagtgagctccggagggtaaaagggttagtcaacaattctgcttggctgcttcaggggagagccagtgttttgcagtctagtgaactaattatgcactcttgatgagatcattaaaggacaataaaggaaaatggaaacaattcacaatatgtatagacaaatttctatatcgaataatttttgtttgtatttaaatgttgggtagaaacttttctatcctgagtaatggttggttttaaaaaaagaaaatcttcagattgaaacttatcctttaagcataaaagtatagtcaggaatttttagtctttatgactaacacagatgataccgatagtttggtatctccgatctgatcaataaactctactcttacaatggagtggtgccctgtgagggaaggggtgggcactcctggatccccctgagcattttcagtgcttctgtttcattcatccaccttattctggaaattcaactggggagatttatattttagatatgtttttattaaaatgctcctttcaaaattgttttccaatttattcaacaggcaatattaggtaatatatttgaaaatacaaaaaatggtgaattttgtcattgattcctgtgtagtcacgtgaattcttggagtttctaaaaggggattttttttacattggtttacatcccatttcacgtgacaatttgaagcatccaaaatgatacaagcgaattggatggatgactcaattaaatacaatggaagtcaataaagatcaatgcaaagtagtgtcttgaacagcaataatcccataaatacaaactaagaaagaaaccaattaaatttagtgtgggaaaaagatgaagaggttttgataagtgagaacagtacaactcaaagaacagccaactattttgtgacatgtcaatactatcgctattgagtgtaaaatgcatgagtccgtctccctcaaaaccaccagctcctgctgcaatgtaaggctctgtggggtgaacagtctggaaagaagaaagcagtgattcccagcaatggtcagaatccaaaagctgagaggccctaagaggaagaacagcggtgattttgcaccagcgatcatatgtctctgcgggaagggcagcatttaagagtctgtggaaagagggttttaacatctcctttccccaggagggatgtcccagtctcagaactgggatccttctggcatcaggatgaccagaattggggtgcccttaacggccagccctggtgcagcctcctctgcggagctggacgtgcccccagggttgctcagccaaacagaaggatcgagaggcaacatgataggtgcctaggatgtggctataaaaggttcttgtgggcactgtgtgatccttcattggccagtgccactgcaggaatgatgaggaaaatggccagcagttgagatatttaggctggacattagctaaggggctgtcttggcagctccaggagatgggctgatagttcatcttaaagattacagacccttcctccttgcggcatagaatcctatgtgaggcagctttccagaggaatgctggcgtccccagtattaagacagacaaaaggactggaaagctacgggggagaaaaggaattaaataagccacactgatttgccagaaatccctccattctgtgcctagatgttgctcttgctcatgtgctatgtaggactgccagattcacaaagaaaaatacaggatacccagttaatttgaatttcagatgaacaagaaataatttttttaaatataagtatgtgtcatgaaatatttaagacatgcttatactaaaaatctttttgttatttatgtgaaatgtaaagttaactgagcatctgtgtttgatcaggcaactacaggaagaaccacatgcctcacacatacatggtctatgtcctctggccacctgcatgtgacatgctgaaactatcacatcaacaaaacaagcccaaagctcttatctctgaagcactgggagttaagttactaccttagaggagatgagcactttttaaaaattaaatgtggaaaaaaaaaaacgtggaacactcacaatgcaacatgacttatccttggcctccaaagccctcacacctagattattgaattaatttttcactagttcttcctactttccactttctccccatacctctcttctatacaaaactctcaaatcaactgctgcgaaggctgctttcctaacgtgactgggtcccctttgggcatccagtgaatgcccaaacaggcatgaaagacccttcccgagcccgctttccaaagatacgtatgcttcctctgcccttgaatggtaccccgggctaggaagttacagatgaggccagtgaagaggaggctcgtccctccatgaagctgggagggtcattccaactcaagggatcagggaacacttccagagggagatagcatttgagcttcgctttgaagaatgagtgaaatttaggtatgggacgctggggagagaaaagcctggctggtcttgggcaaaggccctggattaggaaggtcttgtgtgttctgagagcgagaggccctattggctaatggttagaggatgcccagattcaacaaactactgacctttttgtaatctctagaaactttttggagtgccatgtcataattaaggccatgcaacagggaaagttatctgcaacgattttaagcatcagaaactaagaagttcatttaaaatatttctgatctgtacctttaaaaattcattttcagtatcactataatccactcaactgactctaagtctcatgcccatttcagaagccctagctgagtctctatcctgtcccaaccccactccgactgcaggtaagattctaatggctgatctacctttgtgcccacgcacatcctcttgctttacttgctagccttctcagccgcctctagatctctgcacacaccgcgctgttcaggggcctttttatgtgctgttccctccgtctggaatgtcctttcccctcttttctccaaattcatccttcaggattcaagctaagaattgtctccttcaagaactcttccctgagccccgagacaggccgaggggcccttcgcagcgctctcctgaggaagccctcgccgccgtgtgcggaaagctgccttgggaaagtttctcccatctggccctgagctgccgcagtctcctctggctcttggctcctgcagcctcttctccatcagggctgtcagccagtctctgggcttcagccaccgcctttaagctcatgactccgaaatttcagtttgcctgagccacagacgtatatattgaattatctgttcctaaaagcctcaagatcactcccaactcaacatgtttaaagctaaactctcatcttccccaagcctgctgcttgtcctacatcgcttctccatccctgagcaccagaggagcctgggggccgttttagactcttcttcgcccttctcctgaaccagcaccccagcccagtgcgccacaggtcatatctgagcggtctccctacgaccgccacgccccatgactccctcctcttccactgctgctgcctgggttcccactgaggagctctctccttgggagccgtgcccctcccacttcagtcctccccaagacatttgtatttattttctattgctgccaaaacaaatttacagagttgggggcctaaaacagcagaaatttattatcttgcagctcaatagtgcagaagtccacataggtcatacaggactaaaatcgaggtatctacagaaccgtgtcccctcctggggctctgctggaaagcctgtttcctggccttttccagctttcactccttggctcgtgggcctcttcaaagacaacttcttcaaagccagcaacgttgcatctccctgaccgtttttcgtgtcatctctagctgtcatcttgtgcctcactctgccagtttaaggaccatcgtgattatacttgatccacccagattatccaaaaggatctccctatctcgaggtctttaatgtgagcatgtgtgcaaagtaccttttgtcatgtaatgcaacatagtcacatagtcacgggttccaggaattaggttacgttcatcttggcggtggtgggcagaatattctgcctaccacacagtggagtggtcttcctaaaacacatctcttctcctactgacaattactaactactacctgtggagtaaagtccaaacttcctatttgggcataatggtctccatcctccgtcccgcgtccagtagtgcctacattcaagaaaccactggcatttgctccgtagcagtgtgactgcctctgtgtctactagttctgctctttgaccttgagtggccttaccttccctcagctctcgtgatcattcccaagtcaccacctctgcaaagcctcccaggacccaccctccgaggtggaacggcacactccttctaggtgcttgctgtccctacaaccacatctctcatgtcacctctccctcttcattgcaccttgctggttaccagcagagctccctgtgaacaggaaacttgtctgtcctgttgctgcatccccagcaccaggcatagtgaattacaaatgttagttggatgggcagatgaacgcacattaggctgcagagctcgtgggctgctcctggggcccatgcttgctctcacactaatataagaacagttatccagccagctgaggatgtcaacagccacttctcagaatgaaaaaggacacgaaccaatgtttcactttactacaccactagtgaattaaacgaagccacaagcactcggcttggaagattctatcattccttatgttctattccccaccgtttgggccacttagtattttcttcagtgaacctttcttgagtgttcaataacactatgaaagttgtcattagaccaagaacaaatgaggtttagtttactccttagtagacaactaatgaacattaccaagctgacaggcttaactcttgacttttctattaggacctaaagaatccatagaaatgatctacggttcttggaaagaaatggaaaacaaaatatttgtgggttcatgtgtagacccttatggataacacctcttttattcctcaccaggaccatgtgaggtggtagcactgagagaatgggaaatgctcccaaattcttaggtacatgaagaaaacaagattggaccttcatctatgtgttttctgcttctgtagtaaaatgaggctgctgactgtattaagaattgtacctacagggagtggccaccttgattaatgtgtgggccgagaaagatattgagatgggcatgagtggagaattatagtaaaagcaatcccggtgatgaggaggagggactgatgggttttagtaactgcttgtgcatgcctggttgagctgaaccacgaaacctctttcacccatcattacttgcatcttaggatagggaatgagctgtttgagctgatgaacccttaaagatcaaagcttccatttttatgcaaatagccaagagcaataaaacctaggaaagaaaagtagggaacgtgaattacagtaggatgtgtgtcattaaaagttacagcaagccgggtagttattcagaagtaagctcccagcaaggacaacttttcaaatttgtgttttaaattatttttaaatgagaagaggtaatagcaaaatataaccctgagtttcatttgttctctaatacatcacagtgttaagatgatataaatatgcaatcttgaattagacattactaggaaataatattgcacactgacgtgccaggtacctcctcacactgcagcaggcacagggctttggtgctggaagctcttggaatctgacttaagtaccactctcaaactaaacatggcttctttagctttttttttgcaatggaattgcaaaacccattttgcagtccaggtattgatcgtgctgccatattatactgtggttctatgtaagaaaccacatccagatcctccctgaatagacctctatcatgttgcttggaggtagaacatgcctttaagaataagctgctttgaatgccatgagcacaggttttggagtgagagagctggttccagtcacagatctcctgcttccaggctgtgtgacctcaggcaacttagagaacttctctgaatccacattgtcactgcatactgttgttgtaagcgttacataatgtaaccttttgaaagaatttaaatgttatatctatctggcatttagctagagtttaaagagtttaaagtttcattttagctaagaataaatactgttatttattataatattaatctattatttatatatgttatataatatataatttattatatatttacattttagctaaaaataataaatgatttattataatataaaatttattgttatattagttcttatttttagctaaaatgaagtaaattcatgtgctgtaaaggaagagttattctacccttattataattgcatttatacaatttttaaaaactgatgctgaatctctagtggaaagagtactggactgagtcttgcattatgggttttagtcctgattctgtactcactaatttttttctaccttcctcagccactgtattcagtatttaatataatgagcgttctggtaagttctttacatacattatcttatttacttttacaaggtcaggggtgacattgacccaattacttgtcctttctaggttcttcttctgctttgataagggtgtcgagtgttctctcggtcatttcagcaatagtattctaaaggaatacctcccacaaattgttttctaattttacttcgaagaattccagagatgacagtcctagggtgttcatgacactggtagacaccttcccctccccttcggtggccccgatcctcattccgcctccacccccgtgacttcctctcctgcctccttccaggatggacaacccacgctcagccccactctctccttgccagccctgctccgacagaggctggctttccccatcaggtgttggttagcacttctctgtacttttaattatttttcattttgattattttcgctgtgtgttgggaatcactatgaggtagagagaaccatatcaaagacattactctgcatgggtctgtcctctgtcaagtccaagacatggattcattgtcatctcttatattttttggacacaagtttgatgaggtttcttaattttgacagttaatgcttccaagaaacttaataaagattctacagccattttagtaaccagggaactacagtggaaatatatctctgagtaataaaatccatcccctggaagctgtcaccaaagactcaataatcatgttcgccacccagcatcctttctggacctcaagctgtcttgtcaagtgtgcttaatatccaggatatttagtttaccacagagttaactcaagtatatttgtgttcatttccatgcaggattttgcaagtcaccaagacttaagataatggaggttttgacctctaggtgaacaattactttctttcttttcatgtactgaactcatgaaaatatattgatgaattaataaatggcataccttttataccaaattttaacaaaacaaccttaaaagaagcttgaattgctgcgtggacaatatggacatcatgataggaaagtaaggcattttagtaattaagttaaacagctattttgcccccataactcagttttccttccaattttccaaccccaattcagaattactgaacctgaaacttgctgagaagaataatatgtagtcagcttaatttccccccttgaatatgcttaagggaacaaaaccctctcttcttggaggaattcccaccatggtctctggtttttcctttccccctcagctaccatattaagcatttactctcttgggcattctgctaggcttcttgtaaatatcattttatttgctcacaagcactttatgtgaatatgaggcacctggagcccagagctactgcacgcccaaggtgacagttaggaagcggcaaagccaggatttaacctgtgtgttagaagtccatgctctcatctgttgcattagaaaatgtgctgctcttgacatccatcttccgggtcatgtaatcaacatcacgtatacttggctctctgttaccttttgcatttcaatacaatcccatagcttggagttcaaggtcctccaggatttcagtcttacctactgtctccactttgtcattactccagaggttgaatcttcatcaggaagcctaaggtttttatccccaccgagatgtgcctgccatatttgcattcttgataaaaaccttatttaggattattcattttcaaatcttcaagtgggtgaactgttgtttggtttgggtttggtttactgtgtaatgtgatgcctcgcagaacatgccatattagggcattttgatgtattcatttgttcaaagactggatgcattcctttgtactggcctgcacatatatgtaaccagttccttcttgatggacattaggttattttgaggatcttgctattgagaaccatatcataacttatattttgtacacgtgcgtatattttgtgcacttgtgtgtatatatctgaaaaatacagtcttaagaatagaatgtgcatgtttcatttcgaaagagatcaaccctgaccccctccaatcctccagaagttgaaaaggttgtcaaggtcctcattttcttaatttggtgttttacgtttgggtgtcctctgacatcggggttcaagtgagttcattccgtggctccgttgcactacccagcacccaatagcattactaaaagctgagtggacctctcaaaatccaggggctgcttgtcgagtatttagaaagggattgaaattgtaggcatgtgtttgttgtagccataaaagtatcttctcaaatgtatttgcatgaaattttaagtaagtctagatcttttgagtggaacagactgatacatacctgccagagaacagatactgaggagtcaaatacagctcattagaagacacacagaactgcatggggagaaaacacctgtcccacagccttgggtatggggcttgctggagcctccacatcctggactctgctggaggaaaaactgaaagtaacccgccagctgccagggcccactcccagcctggagagccaggacagccaggtctcggcaggtgctgacctacaaaaaggacggtcctgctaggtgaagtgtggtcagggagaggcagctgcaggtgatcttggaaatcaatgctcattaattatcaacgtggctagtaaagctctggtgggaccttggttctcaatcctggctgcacgttgaaatcacgcgggacgttttaaaagttctgatgccaatttctaatcccacttgttgtgcaataaccccaatccccctcaaatgcctccaaataatctgagtcacatgtgcttgacacaggcttttcagctttcatttcgtttctgccaatttcttcctctcctgctccatctgatgccacaagagaacagcctctggattggcaagtgcagactaccagagtggtaaatgcttgcccaagaaagaccccagttcacacggtcagagggtgattttctccacctttctagacctgcaaggattcaagtgtcacatctggagcttagctgggcaattttgcaagcttcccaggtggtacatgcagccaaggctgagaacaactgtggtagggctgcagccagggtgaggcccactgggtccagcccccagagctggcaagagctggccagccgtaaaggccccagcaaagcagggcatggtggtctctaactctgactatgaaactggtgatgaagacagagccagtccttctggttttcggtagcacagtagggttgtcaagggttgtcaagggcagcacagagccagggaggtggagctgctgtaggactcaccagagaccacacagcaaggcaaactccaaatcgatcagcctggctgctaatggaatcgtgtcctaaccaagtttcgttaggaaatgtgtgcaacttcgctgcagggcatggctccagctgggagggactgcaggaaatcaggacctgacccacctttttctttccaattaagtggatccagcctgtgtacaccaccggggatgtggctggcagctcccacctaggggttttcaactattgccacacctacttgctaattcagctgctttatcagctccacatggttttttttgttgttttttgttgttgttgttgttttcttttcgagacagagtctcactctgtcactcaggctggagtgcagtggcatgatctcggctcactgcagcctctgcctttagggttcaagcgattctcctgcctcagcctctccagtagctgggattacaggcaactgccaccacgcccgactaatttttgcatttttagtagaggcagggttttgccatgttggccaggctggtctcaaactccggacctcaggtgacgcgcctgcctcggcctcacaaagtgctgggattacaggcgtgagccaccgtacccggccttcagctccacttttgagctagatttaaatgccgaggattttattagtataaaaaataatattgtccatatttttgtatcatgttattcttgtatctgtgttattgtattttattaatttagaaatggtttatgagtcattcaaaaagtgttcagtagcatattaaatattgagattattaaggcaatttatacccaaatagatttagaccttcagtctgaatttcttttggtataataacttttattgtaaaatacaaaggttgataaataattgtgaagatacattttcaaagggaaaaagaatttgtaggcctgaattattattttaaatctataaataatatattttacagataaatagatattgcgatttgtttttaagctgtcatgaatcaaagaacagcctttctcagataagcagaaattgattaaaatagacatgatttcagatttttatttatattatttttctgttctcatgcctaatcatgaagttctacaaagttccacatttaaaaaaaaatgtttggcttaaaaaaaataagatgtaaaatatttgtttttgaaaacactgaggccatatcaggaagggtaattgggaggaaaaaattaggtcacaatgagtaacaaaatagtatttgtttctgttttcacttgctctgcaatagccataatctccctcaaattcctttcgatatctcagtcacatgtgttcatggcacagccttttcagcttccatttggtggctgccaatctcttcctcttctgctccatctaacaagagaatatcctctacgttggcctctaaactaagtccccagttcacactgccaaagtgtgaattttctcccaggtctggacaagactctgcctcaattcccatccagcctctatgtcagtccacactcagtgggcgctggggatggttattaagggacctcgggctcttccctcgcttgagttaagaagctgcataggagagagagtagagctaccttaagatctctttgaacctttcactcctccaggaacgatgcgggctggattgcaaaactatcagattaacagataatacagttctcaaattcattccacctctcagccactggcccgtttttggggccttagttcaagctgggcccccatcacacttgaattccaaacattgtgaactagataggccacatggtttagagacagaaacctagatttaaatcccagttagtagcgttagctgagtggccttaggcaagtacctgaaccattctgaggttcaggattctgactttatttcctggcagagctcctgtggtgatttggtaaagtcatgcatgctcagggtatgtatgtatgtacatgaaccaaagatgctggacaagggtttgcaatggtgacttttttttaacagaggttaaaaagccaaaagcatgtgttgagcctctcctaggtgccttacacgtatgttagggtctatgggggtttaaaaaaaaatactaacaccaggtccctatccccaagtgccaacactctaccaaggacacgcatgtggcaagtgctacatggtctcacatacagaatgcagacaaaagctttagaaaggtctgatgaagaaaagccctccagaggagtgacagtttctggagatgcacgttaagtgctgtctagggccaggaacagcatagcagaggcaccaaacagggaggccgcgctgcctgcgcaggaaacggtaaatggtttggtggagccagcgtggggcaggggctggtagggggcgctgaggacggcagaacggaaagggccctgggggagagaggtctgactacaacccaaagaacgcaccaaatctcagtgaggaaccgcggatggggagtgacatcactcatcccatcagccagtggatatttattggttgcctggaggaaccagtaccaagaatacacccataaaggggtcaaagccccacccctgtggagacccctgtctcagggggaaaaaggggaaatggccacaaacctccatccttgtgataagtgttgagatccgggtaagcacagcgcactagggtaacccaggggagaggcgctggcccagcgtggggtgagcaaggagggggctcaaattcaagccttcaagtcggttcaccctgtccaggcttcgggaagctaactggagggagggagcctggcagaaaggggaaagctgggaggagaaacatcactcagaggcctctgtgacggcccaggcgaggggaccagggaggcctcatttaggacagtgaagatgagaatggggcgacagggggagagaacgaatgaaagggcttcattgcatctaaggcaccattagccattctttaaaaacttccttcaatacagaattatttttaaaacgttatgattctaatataatacaatttctcttatttgaaatcttcactggtttgcccacaagcgccccgatttcatctaaatccgagtgtaatgaaagacagatgcattgtttggagtaacacagaagctccaattcctcggctgcagggcttggcgcggggtttctgggcagcgtcgcttgcgcccggcacatgtgaaagggttttgtgctcgtttcctctgcatctgccgagggcaacactgaatctgtcttctctccctgctctcctctttgactgttttgtttgttccatttgccctgctcaacaacaacaacaaaaaaatgtagattagaatcggccctttatttcaacagcagtgaaagaattattttgttaattggtatattgataccccaagaactgcttactgtgccaagttattaagaataagtagacgaggggcagattaaactttgaatcacctgttcctttgggcaaaatacataaaccaaattgactgcaaccaaatgtcatattatttacatggcgtgcacaatttattttctaaaaacgtgctcaacaaaagatttgaatttgctcttaagcgtctaatggatcccacttaatagtgaagctctgtcatgtgcccttctgtataattaaatcatatggaaaaatgtcacaaagcaaaataaaatgtatttatttcagccatatcttcccaaagcatgacatgaagtctgaaaaaagaatcactaagcatttttatgccatctgtgctggtaggggatatgtttaccaagtatgtcactgtaaaatattccattttgaattaagcatagtctacttattactatatagtgtctggctgaatgagtataaaattggacaaaattccatatctgacaaaatactttttatttgttattttgttgcaaacctagtccaccgtaatgtcctttactgaattccaagaaatccaaagaaagaatcatagattatatttgtgttaaaaatctgcatgcttttctatccaaataaagttcagatcatcttttccaacagttgaaattatagcttctcattagcagaatatgtctcactgtgacaacttggatgatgatgctattgggtctgttaatctctattgcaaaaggagggctaaaatgtctgcacaatcaaaaaagctgttgttccagtttgctggtaaaacacaaagttatatccattatgatttctacctaccagacagaagaaaccttaagcttatagtttgccattattatgattaaattttatgaatacttatagaatttttatttcctatatgcgataagccctctttgtagtttgttaatgagatgtaaaaattctgtaaatttttcggagggcagtttgatcgcctccagaaagcatcagagggtcgcagcttaatcactgattcattaagtaaccctgatctatgctatatccttcagggttctttgccaagttgatatatcatggcattgttttgagactcatgtgaataataaaatgtaacatagtttagaaatgaaaatactttataactatgttgagctccttctagttgtaaatcttcccaagtcaataatattcatatcaaaattttcaaatctagctaaatgaaggagatgtgacttggtaaaaagtaataacataaaattgtatcattttgatcatgattaaacaggaaagctattatttttctaaaatgaaaaaaatagaaattttagtttgtcatagaatcaagggctagattcacttaataaattgtcttgattctgctcaaaactctgaaaaaatttaaagctctgtaaggtttttgaagtcccacttcctttcaaaccaaccctgctatctccttgaagccatttttgacaataactgcctgtgaatgtgatttgtaaactattagacagcacacaaaagtgaactgctgtcactaatcatataactatcattcagattgtggcagctactctttccgatagttcccataggtttccaattgaacatagtattttttgctgcggtgtttgttttatcaattgattgtatgtattttcatattattttgtacactgtctttgaacttgaccttaaatattttctgtccatggcatatcccttgatgtgattacaggtcaaagtccacatcatagatgcctaaagtatcctgtaggaaaacagaatgggcactccaataaacatttattaaagcatttggccgggtgtggtggctcatgcctgtaatcctagcactttgggaggctgaggcaggtggatcacctgaggtccaagaccagcctggccaacatggtgacaccctgtctctaccaaaaatacaaagattagctgggcatggtggcaggcacccataatcccagctactcaggaggctgaggcaggagcattgcctgtccctggggccggggttgcgggttgggggtgggggtggagtttgcagtgaaccaagatcacaccacctcactccagactgaacaacagagcgagactccgtctcaaaaaagaaaaagaaaaaattgttaaagcattgcatgaaatctgctttaactcctattctaataaaacaacaacaagaactctgaaaatgactttcaccataattagttgaaaatgttactttcctttggcccaactgtatgtaattcattattatatctatgtctgagactgagtgtgggttttcaatataatcaaacgaaagaccacctttaccaaaagaacaaatttaaagttcttttattcctgtgaaccatattctccaatcatctacactgaatattttaaatgggaatttttgaagtgttaaatatttatcaccatgtttttctttcctcatttatatggagtactggagcttgtggccataatattctaatgcaaaatatggatcaactttcagtctgaaagtttgaaagttaatacactgattttaccacctgcaaaagatatccatatttgaataaaagcgaccagaagtgaagctaatcaatttaataacacatgcagttatttcctctttcttttaaaacccagaaggaaagtggggtccacatggtcctaattgtgttattagttcttagttttcctctaggtgctcttctaagtcttcttttgagcaaatatcatgaaaagctcaagatgagaagcagtgttgatttgaatgaaaggctaatcccagttgtcctttttctaattgataaaaaccatgatgatcaggatgagtctcactgaagcgtgtattatgataaagtaaactacggttcatggagtcacatttgatgttcagggatctcatctgagaaggaaagagagcacctttcctcagcctggagaaaatgaggcgtcggtgggagcaggcagagctgcatctgtcagtgtgagtgaggaaatccatgtctgattttccaaaggaagtcaagattcgggtcaactgtggggcgaaagaacaaagataccactggtggttcaggacgagaggtgcgggttgggaatagccatggagctggacgtgtggtactgaccagggatgggggaattgttgttgcgggtgtggaactggccccacttcacacggctgcgtgctgtgctcctacggcagccaggctgtagagcaggaattctcatgtgaccactggtttggttatcccagattaggaattagcaggaggagtgtggcaaaggccatgtctagaatgtgctaggaggagctggccagacggctcaggagagagaggccgctgggcaggctgggcggggaggggccatacagacttggggagcgccttcttctgctctggttgcccagccagccacaaactgggtggcttccacaacactcgtgtcctttctcacagtgctggaggccggcagtccagggtcagggtgtcagcaagatcggtttctcatggggcctctctccttggcttgtggacggccactttctcgctgtgtcctcacagggtcgtccctccgtctgtgtgttgttgtctgtgtccttatctctttttataaggattagagcccacccatgtgacttcatttcaccccaattacctcaaagacacttctccaaatacagtcacatttttcggaggagctggaagtcagggcttcaacataggaattttagaggctgaaaggtgacagttcagcccgtaaccagaaaaaggcagttgccctgcggggaagggaactgttgaggggtgagactgctggaggaagaggaggctgtggcttagagcggggaacaagaggtcccccaagagagatgggacctgagtatgagttgaaatggcctgttccgtgttgttctcaccctgtaaaatccctgagggcaggaatcagctttctgcatctctggttgcctggcccaccgtcagctcggagcattaaactatagggactcacccctgctgaacatcagattgagggtcatgtgcccgcaattctctccaggcaccactagagggcgagcctccattttgaaaactacccagaatcccctgctcccgctggggtcaggaccgcccctactctctcaaggactcaccctactctgttgtgccacacaagccgctgccacagggttcgccctgcttttattctaaatcttatggtagcttggaaagtagcctggcatctgatagaaacagccctcaagtggtccagcttcccccaccttgcactgccgggcagtctctatttgctgtcgattccacgcagtctatgcatctgggttattttcacttttccaaaaccaactctcagccgattcactgatcttctacagggttgctccagttcctacttcttttatcgcttagacctttctttttattccctccttcattctcccactccttttcatctgtagtctcttcttaccagtacgagtccgtgttacttcatttgtagctcctaatgtcagctcatcaaatgaactatagtgaagtaaaaggatatcgcctagtgctaggttatagcaaaactctcaaacagttagacttgcttttctgcaaaatgtgagcatgtagacttttgcatcaactcatagtaaactttaattttgttttgatgtctcaaaagatttaaaatgcaggttcgaccataatttttaaaagcaaagtagaacatgctggctatattatgaatccattcaatgacaagtagtattagtgactaaatgatcattataatgtaatgttagctgcagagaattttgaagaaagataaagaagcttgccacctagtagtcaagatgagaaaagaaaagaaaaaaaaaatcacagatcaaagggggaagtcccaagagagcatccccacattgcaatagccaagaagagctggcattgactgagtgctgactgggcaccaggctgtgtgtccactaagccgtttatctgcttttgctcacttattgtatatctttgcccctccgtgaggcaggtatgactgttctgcccattttacagatgaggaagctgaagctcagagcggttaagcaatttgcccatgaccacacaactatctgatctaaagcataggctcctatctactcccaatgatgtaccaatcctagcacgattatagctcttctcaagtgcaaaaagttcaaaattaatctagagataaaataacttttccccccagtttctcatgagagtaactaagcccttccatcagctgtggccagctgggcagtgataaggtagtagatgtatacagaggactgaaaagaggagaagaaacacagacagactgaaaaacaactgtctcctccctggtggagcatgagcccatgggtcgggaccctggactgcagctggcccaagtcggtagcactgcctgtggggaccccttctgagagtgtggaaaagtcagctttcccctgtgagagcagctgggtggggaggggacattttccatcacagactctaccatggatttatttttataccaaaataaacaagaagtccatcaacctggcacaaaagttaatggacctgcccccagctagggccctgtctacctggggtctggccccgtaagtgtgcaaattacagaacaggcttccaaacatagaaatatctttcactgtaatcccaggaagctctaagcttctacattttattaagctgcagttattattttaaaacaaggccaagtgcctcttggtatatacttaaaacctgcaaattgctttttaatgtctcagacttgtagccagcattggaaatttccagttcctctaccttgatcagctcagacatttccaccccctcaacctaaatgagcagaccttaacttcacacctgattctctaaagaaagctaccaaaaatacaacaaagatgatgggatttttgttactttaattattttaattgccagaaagtatattttgcttaagcattaggagaaacagaaagttgccccagagaaagcctctttgattcaggccgtggaataatttgttttagtgtacacatgcacacacacacgcatgcatgcacgcacacatacatacaacctgaggaggagtaaacacttttgtggatttttcttttctgggaagaagaatgcagcgttcattgattaacacaatttcttgctctcttgacttctggtggatcctgaaacacatgcgagaactcacatctgggggccagggagctgggctcaggacactgtgtgacactaagaactgtgcggtctccagaaagttctaaatgtcattggcctcaattacgaatctctaaaacagagactggtgtgccaattaggttttaaaatattaaaaaacttgacctaatcatttgaattctaggagttaagcctaaggaaatatcaaagatagaaagaggcttgaatgcctagatattttcaatctgtttttaataatagtgaaaaatgaaaataagttaaatgtctaccaatatgaaaatggctaaatcatgttttgttctcataatggaatattatatcaccatttaaatgagtggagagtatctaagaacatgataaaatcatcatggtataaaattaagttaaaaaacaaggtataaaaccatataatacagtcttagttgtgtaaaaatatgtgcttgtgtgaatacacacacgttaggaaatacacctgagtggcaatgatggctatttctgaggagggagattacacaggatcatttttctttatccctctctgtttgccatctcttccataataaactgcatcatcaaaaaactaagttattttgaaaataaaaataatggattggtctagattatctctaaatttctttacaatataaacctctattccacttatgaaccaattaaaaacaaattagaaaataacagggaggttttggcatttccaaaaacagtggctccttggggtagagaccttccacacctgatctcatcccatccaggccaaaaccgtagaggatttgcagccagggttataaagatactgcaacccattttagaaaacgaagcatgaatgtcccccttagaggcataggtggtttctcctctagaccatggcttgaggcttttgagccctgcagtaaggtgggctcgtcctcactgatgagagaatcacgctctccgctctcccccgcaagtggcatatggtttttgcctcaggacctccagaacgtgggtgtggctgaagttgctgcttccttttccataggaaatattttcaaggtcgccctctccaccctgaaaactagagggcacctcaatgggtgtctgcaagttcccagctcaggagctttcacctctatttgacaggcccttcataagttcctagttaaaaccttggggttagagtgttggtgccttgtcctctccatagccaaaggcatcgctctgtgctctgggcttcagatgttaaggagaggtaaatactaaaggacgtcattgttccctggagcacgtatcagctgcacagttatgactcaaggcacaaaatctgaagtaatcaagtcgtcctttgactactctgtgcaagaaaatgcatgcctcagaaatgtgtagccacgcaccgcacttttttcaaataattctactcagctggaagtgattttttatgtagaatatcctttcatgattactttagagcaggaatacccaatcttttggcttccctgggccacattagaagaagaattgtcttgggccacacataaaatacattaatgatagctgatgagctaaaacaaattgcaaaaaaaatctcataatgttttaagaaagtttatgaatttgttttgggccacattcaaagccatcctgggctgtatgcagcccatgggctgtgggttggacaagcttgctttcgaggatcagtttgcttttcagtctgggcatagaagagagaagtgggaacttctgaatatgacccaaaacttcaggttcccagtgcctggtcatagagtcacagactccttattcttttgaatatcactttgtttttaccatagagagactgtatagaatcatagtgcaagaaagtgccttcaaaaatgaaccagtctatctcattgccttcaagctaaaccataccaaagccattgctaactagtaagtaagggtctctattttaaggaccatcgcaggagaatcccagactcgtacagagtttgtcaatcatcattgttgggaaactttttcatatattcaacttaaacctctcagaagagtttgtcaatttcttcttattcaattctcattcaaggtgaaaacagctgggcaccgtctccatcatcatcatcattattgttactgttaccatcactaatgccactgctaccacctgagacaccaaggacagtaggtgctttgcctccactgtctcattgagtcctcacagcacacgtaaataaatagaggggttttatttccacctttgatacatgaagaaactaaggctcagaaagacaaaatgtttgtccacagtacagcttgttgtagcagagtcgaaatatcaaccaggtggactttttgtacagggccatgttactgcgtcatctactttgtatgattacaaactttcttaatctccaataggtgaaattattttagcctctcatcctgtttcctaacccagaactctatacctctcagaaatggttgctgatatctgtttgaccactaggaaaagggggaactggactagtattttctactgcgttccgatctgccctcctaagataattaggtttgagctggggagggaagaacagctaactttaaagcttggggaacaatgtcagctcccaaatatcttaggggtggagccatctgtttgggagggacctgaagagacttctgttgaagctttgtttgtttgcagagggagcatagagtgtttactcaaatgatgcattcatttggggttggcttgcgggggagtgggacctgtgaaggctggggggagtggttaaaggacatcactcccccccagccacctgtgactctactgctcctgagggattgtggtaacagttctttctggtgggatgccactgaggctttctggtatccccggggttgtgtaaaagctctaggtgctgggaagtggtgagcagctgctggggtgcataagggggagtggggagggacggaatgtcgggagcaggtgagctgcaggtggaaccagggtttcctgaggcctggcctgtgatactgtgaaacatcaaggagtgtgagtccagggagatctgagcagcacctgtcaaaggaggaggaggaggaggaggaggaggaggaggaggagctctgcttctcaggctcaatttccactgaggaatcccagcatttttaactcataacccaagcttttgcctctgggtcatagtggatcaaaagataaatgggccttttcaattttgtatttccaatctcagatactcgaatcattcccaatctaaagcacagtttgtgtttcagttctctggtgcatagcccaggtaatgagtctattctgtttatttatctagttcagagatttgggcttctagtcaaagtaaccttacacaaagaaacaacaaaacacaagtagacccgttaagagcaattgtaagatgtcagtttctccgtcttacctgccccccaccccccaacttgtgggggtttcttctatagtctgcatagagaatctcaccttttcctttgaacggcctctttatttctttaggcagtcatgactgttcttggacacagaaggtgatcagaacaaagatactaacacttcactggttctcttttcctgctcacagttgcttcaacaataaaaattgtgcaatcttgatataagtcacaaagtgtaaaacattcctattctttcataagtgacacttttccctattaatggagaacaaaggaagaaacaaccagacagaaggaaaatgctcaccacacaggcagtaaactagccccgttatgcccttgactcttttgcttttgattatcatttgtttactcaaatatttattgaaacctaccaggctaaaaagcattgtgctaaaagctggaaaagaaagaaaggggggagggaaagacgaaggcaaaaaaggggagaaactcagacaaaattcctgtccttaaagagactgcagtcaagtttgcaaagttaacgtatgtggtagaccgtgagagtgattcagatgaaatgctcttggagcctggctctagagatgagagaaggtttcctaagacatttcacttggacttcagacactgggcaggtggaagaaatatattctaggctaaggaaatagcgtgagtaacgtctttgaacataaacaacaaatttgcagccgaagttgcatggaaaaggctggagagagggaaagtcaagaaataatggagggtgttaaatgacaagcccaggaatctgggacagtcagctgtcgttgaatactgacaaataggcaagtgacatcatcacacatgggcttctgtttggaggggagtgacagccctccataaggagtttagggagttgaggtggattcaggtgagccagcctggagactgttgctgtatccgggacaaagagcaagaggcagaactaggacagtggcagtggaaactaagaggaaaataaaatgcttaaaacagtgcacagaaataacaacataacagacgccccaaggcacacacagcttagcagttagttacacatacggcccagggagatagagacagacagagatatttgggagtgtccacatgaaaccagtaactggaaatgttaaactgagtacaattaccaaagatcttctggtaatgaaggaaagtgagccaggaacagccctctgttttcgagcatgtccatttgagagagggatggagacagaagatgagcctgagggtgacttagaaagtcagagctgggaggagaaacctggaagagtctcacatcagagaaacctagggaacagagttttcagaaccagggtctgagtgacaatgtggagagctacacaaaggaaagaaaataaaagaccaagcgtgaagaaaggctccaggctgtggagggtttgtgctccacaagttacaggaggctgcggggacagaagccaggcaacagggccaaggtgtggcctggggagtgacggatcataaagccccctctcgtgagaaactgggataatggaaggagagactaaaagagtgttagctaagaaattagaaaagggatttttttttttttttttttttttttttgcgggtgggattcgaccgtgtttttctgcaaggagaagagtctgagaaacgtgccctaggcctgtgcaggttccattccaagcacgtccaaacagcacacatgcttccaaacagcacacacgcttccctccatgcacccccaggtgggaactgtggccacaggtcaacgcttctcttccctgctggaccatttgttcaccacaggcacaaatctgctctgtcttgttcaccaactgacacttagaagaggctcaaacctggtcattggctggggactcaagacagaacaaggagtgttcccactaccaagcttccagaacaggaaggaaagttggaacggagagcagacggagctcagccaggagaaacacgaggccagctgaagccagtgggcctgtgagaaggagggctccctgcctggcaccagggctgcagtcccttgttgaagtgcatgcagaggcagggtctgggaatgctcattcccaccttgttgcctcatgagcacgccccatgcaattctgggcaccaccctcagcaacaagactagctctcagccaccctcacagctcggcgtggcacggacgtgctgatcttatggtcagagggacaaggggaagtgctgcgtagactccaactggcaggggcggatcttttgtcctttccttctccttcctgcagcctggaactcaaacgagaaggcccgggctccggcagccacctttggctatggagtaatcttgagacacagacacatgcaggaaactttagtattaaagtaggagaagccccgttcttctctgacttcatagagccgttgcactttatggtagcctggttgcttccttctggactttttctgacaggagagaaattaaacacctgtcttacctaagccagtattatgttgaattttctgttacatgcggccaaacttaatctttacattaatgctacaacattaatgaaactgctaggagaagctgccttgccaggctccccggtggctgccatcacatccagcacccggtttctcaaacttccccacacccaccacagaaaagcaagaactaggtacagtatctggcattctgtaggcactgatggtcatggaattcagtctctctggtgtattttaagttgccattcaaaaataaagcactcaggtaatataagtgaattttgattaaattacaagtaacaattcctattcgggttgatagagctctttctttaaaaaggctgaattttatctccttttatagaattaaagtttttacttttcatttgtgatgagctgaattttcaggctgatgaaataagtcactgatatttaccacacaggacttaatcaaaaagaagcttaggtttcaatggtgggtttcctttttgggcatggaccgtggttttatagtggaaagctttgtagcttggctcacactgatgtccgctgctcctcacatgtgcgtcttatcttggaggctgggctcctccgtaggttctcctgccaacaagcgagacagaaaggaggcggcagctgggggaactcagccttccttcccaccacacctgcaccttgctgagccactgctcccaagacgaggcacagaattcccagagcagcctggcttcaacctactcatttggtgttctttaaattaaaaaaaaaaaaaaaaaacttctggcaaatcgtggtggctcacgcttgtaatcccaacactttgggaggctgatgaaggtggattgcttcagcccgggaaggagttccaggccagcctgggcaacatggtgaaaccctgtctctataaaagaaattcaaaagtaatccaggtgtgttggcacgtgcctgtagtccctgctactcgggaggccgagatgggagaatcagatatctgagcctggcagtttgatgctgcagtgagccagattgtgccactgcactccagccggagcaagagagcaagatctgtctcaaaaaaaaaaaaaaaaaattttcttacatcactagttttcttgcatggcctatgagttcccatccactctgtaagcctttataagtgttatggtgggatccaagtataagctctgagttactgtctcattctcccccgttcacttacagatgacattctcgcagaccagaccagcaagtctccttgcccgaggccacacaggcaggaaccgccaggcaccccgtccagtgtcccagccgagccctcctgggaggttcctgtgtgctggacacatgcctggctggctattacctgtgtagtttatccagtggttacactgacttgaagtggtctttctgaagacgacattgactttgaaattacttgcattatccagtgatcagctctggtcattgtgatcctttccaagccatacataattttgggttttgctgtggctgctgaccagcatctctgtttaagagactgagctttgtgctagagattctggttttgatgcatttcctaggcacgcccacttctccagtagaaagccaggagtgagtccctcaccgagctgatccttgtgaagatgaacagttctctccatttgtgtttagtgacaagtatgttcgttaaaatatcacgaagccttcacaagatgttctactaactagttcgagacacagcttgtatactgtgcactgaatgagtttgcataggttgttacatagattatcatacacctataataaatagagtatggaaaacactgctaaaaagtttcaatgaggaccaggtgcagtggctcacacttgtcatcccagcacttcgggaggctgaggcaggaggatcgcttgagcccaggaattcaaggctgcagtgagctatgattacgccactgtactctagcctgggcaacagtgatactctgtctcaaaaaaaataaaaataaaaattcattgagtttaagaggggttttttgtatggttacaaaaaaaaagcagtttaattcctttactcttatgagccacttatttggttcttcaaacatgtagaggccaaaaaggcactgtttctttaggttaaaaaaatgggcaaaaaatctgattttatgtttcttttctcaaaaattattcactaattattaacagcaaacgctgcgtctcctggagtcaccaggcaccgagcgttgtgtgtgtttcacccgcttggcgttttcattctcatttcatgtatttgaaagctggggctccgtacagttatgacattgacccagagtcactcagattgcaaatgacagagccagggtgtgaacccagataggtcaacctcagcctgagtgtctctaactcttcaggttaacagccttctccggataccaaagcagcactaaaccatctattcagctgtgcgggcacctgtgtgggatagaaggggctgagggatcctgctgccacattgataactatcgctggaaccagggtctgaaaccgagtcagactgaccctgaaacctacttgcctgaccattttactcccatacctcgggctatcttgcaaaggaagggttaaagaatacgtgatgcaacctcctgaaacaggcagcctaggaactttgacccacacactcagccccgatctctgtggccacctctgtgatacagacggccgcttggggacagcagaggctcaggggcagtgaaaagcagtgccggggctggagatgaaagagccaattctccattcttctgtgagtccccggagatgaacactgtgaacttgttcccagtctctgtgtctcgtgccagcggccctcccctcccccttccaaggacaagtccacccccagaggatttgcccctggaaatgggtcctcatggacaggggagaatcagagattatttgcttgaggtggcaaaaaaaaaaaaaaaaaaaaaaaaaaatacagacacatctccggccaaccctttttatagatgtatttttgttttttacaaaccaaatagcagaggttgattattagtacagtagtttggggttttttctcatcattaaccacttagttactataaatgtgttttaactcacggggaaaaagtccagcataccgtaaaacctgagtcccacccagccagctcggaatggaaggcttccaaggcccgggaggcgcgctctgtcaagttgctgattcgggagatagcagtgaatcggggttccaccacgcccccagaatactattcacagcagctttgtcattgaccgttctcccttttggacgagatctgaaacaaagcttccaatcacttccgatcctaatagcgttacctctcttaggtagggtgtaaggattcttagtcaaatttcaactcaagtaggttacctaggaacattcttagggcttaacctacttagttcttcttgcggtttcagttgaaagtgatagactcttccaggctctttgtgttccacggtccggtggtgaaatcactgctatctctccctccttagagagcccactgcttcccaccaatgagttaagtagtttttcttgcccatttctgcaaatttgtgttcataaaatcagttgatggatgaaagttactgaagaaattgctaacaatttcgaggctttccttaaattgatagtttgttttactttattctagttctcagtggaaacaaaaggcaagaatgatctttggaatgttctgtttacaaaatcaacccaaacaagatatagatgagactcattgtcttcctccagaataacaatcgcctttaatttctgtgctgctgaaacagtcacaagagtcatgatagatccagaaagagacccttggtgcttcatgtggtatctttctttagtacgggtctcttttacattcagcaggtttcattagaaaaaagaatttcaaagtatttcattaacaaaattgagaaaatgcgtatttaaacattgacatccttatgaaagagtaatttcttacataaatgtagcattttcacctatgttacctcatttaatcttcagaactaatcttaagttgcaatttcacaattttatagacaaggaaatggaaactcatagatgttaattcactcgttccgggccacggaggtgtactttttagagcatagtcttatttaatggtcttgactctaagtccaaaacagaagcctccactttgctgagcaccaaaagatcgggagatgagtcagtgtgtgagtcccaagaggaagagaatctgcgggtccttagcagttaaggaagcgtcatgaaacatttcttgaagaatggataggatttaaatagtttagaagatgcagtcttgaaactatgtgggtgatccaggttgcatgagcaacaaatatttgttggacaattgaagagtgaatgaatgaggacggagggtgtctgagatcaggaaaatgatctgggaaggtatgaaggcaaacattcccacgacgtgttcggggaaccgtgagtaggagccactggctctaagagagtgtccctctggacaagtagagagagatggactgccatgggtgctctgggggctcgaagggcatggaagggcatggaaggccaggctaaaaagtgttgattttgccttacagattaggtcaggtcttcattgcttttgactaaggaactttatcctgaagacaagatcatgggaaatcattgacaacttgtaggacatgatatgaccaaactcagtgttttaggaagatgagcagggagtgaagcacaaaacagatgaagagtgtgtgttgactctggttttaggaactcaccctgtgcctctctaaagcttctgtcagctcttcccatcagtgggaagcagatttagaggccaagctgcctagaagacatagggttaaagaaaaaaaaaaggaagaaaaagaaatgcacctttaaaatttcccaaccttgatttatacctacagagatgtatgtgtggtcactccttttattagggtttttaagctaatcagtaggcttgactaaagaattgtaaaactttcactacaagaaaaattaaaagaagtcatttcctgtatctaaaatgatcacgtatacttctgaaattaggaaaacgcaggccaatgataaaaatataactgtaacgaaactgtaggttttttactgattgtattacacaatatttccttttggattcttaatacaaagcaatgcaacactggtttggtttaaaataaaatatggagagattcttgttctgtaggaagctcatcactctaatgggtgtcttactcactggaacagtattttggctgtactggagcacatcgaaaggaatgagatttagctttgccaaacttccactgtgaaagagtttgctacaacagtgttttattttattcttattgaacttcagccagttgaaaatagaatctcctcaccatccttttaaattagccttaagctgcagataaaagacaaaaatcaatgtgcaaatttagctccttgtgctcggttccttaagaaatttaccccagtgctaatatgcaggatgcatagataatagaacatagagtaactggaagttttaaagtagcatttcttgttcagtttaggtctacttaagagtctggtaaatcctgtacataaattgtttctttaatgctacattaaagacagtgcatctctttatactgtccatactagctcagtaacactgcccctgataacatttcatgtggccatgacaaattatggtgaaattttcagtgtccaattggaatggaaattgctagaaaaaagcggtgcctaaataatggtgcaattctatttattccatttcactaagaattactaagggcttcgaaaacccaaatcgaaaaaggaagcacataaacaatgttcgtattggccatactagcttgaatgtctctaattgttctaagtggtacaggtgctatgagctcctaagaatatccctgtgtttgagaggagttaactcagagccttgggttgcttgctgtcctgccgcactgcacgagaaaggttagcaacataaagaaatgcaactttgcctacttcaggcattaatataaagaaacctacgtacaggcacccagagacacaaaaagagagagaaagctcaccattcttgaaaaaggcagttctgcaggctccacaaacaagtacaccagtgaatgggaatgataagaggagaacaatttggttacattcagagacctggtgggcaaatggaaatgggacaagcagtagaaattaggccagatcatggaagatttgttttgttttgttttcatggcatgatacctgcaaggccaggaaggctgaagccagaacaccaatgcaattaattagcagaaaccaaaaagtaattaatttagcacaccaccatatagggcagaagcaaatactgctgtttgtagccagggatggggaaaggatctaaccacactccaggcacctctgcacatggcaccacagagagaaagatggaggaggagtgcagccgtacgctgggagtcatcacaattgtttttttaccgataaaagcaagtgggaacaattggccaaaacaagcctggattgtagtagaaaattaagctaagaaagaaagatcaggggacattgtgataaaacaatccacgtaatttctataacatggatccagcttaataagatgtcctgaagttcagcatgagtaaagttccaggacagttcagggttgtcataggaaatctacatttttcaaattaacaggacttaaagatgttactgttacttcaacacttggtaaatttcactgcaaatatataagccattttaaaggaaagtattagataatcaaagaattcgttaagaaaaagaacaaattgagtgcccacaatataaatggtggccctgctgcagattagttcccgatgcctgagataagatgctggaggaaatcgcggcatcatcaatttaatcccacacaaaatgcaagcgaccaccttagcttagttgcagttgtggtgggcatgaacttcacaggggcataattgaaggccaaaattaaatgctctttatttctctgtatctccgtgtaatgtcctgatcctgagccccagactgcctcatgggtccagtagggatgcctctcagcaggttgtgcatcgggagaattttgctgcattgagctccagagctgcttccctgtgtctcctctcccactgctgaccccacccccatctactctaagccccagcaaatcaccccagcactcccaggcagtgagtgggggagggcgtgccccctcctctctctgttttggtccagcctatatgtcacagggcttctttaaacagtgactgggcctttctgctggccttcacttaactctcagctcagcttgcaggcaccctctgagacgcaggcactgcccccttatagaatctgcatagtgggctgcctagccagggggcttcgttgtgtggccttttctctggcaggctttcagatttcccccttcccccaagaatggagccaaggggtggaccccaacatagcctgctggctgcaaagctgcacacgcctggagagctgctgtccaatggcaaatggaagcaacattctcattgtctccactctcagacaccctcagattactgagggaattctctcgtgtgcccccttcaacacacaggcagacacagatacacacacacagacacagacacacacacacacgcagacacagacacacacacacagactacttgtcattctaaacttgccacctctgtcctcagcatggggccagtgtggtggagaggcctgttttgcctggctgtgcccacagtctcatctctcccaacttagattcttactaagagttggaactcttgattcctctggccgcttctggcagcctcttcccctggacacaccctatctccctgcccagtggagccgtcgcgtgcaggtgtgcatctctcactcctgccggaccaggcgctccctggccccatctcacagactaaaacatgaggctgttcctttgcttccgagtagtttgatgtcattcaacccagcatgcatttcctctccaccgctctgctccctccctggaggtgcttctgttcctacccgctgaggggcacagtcaggaggtatttagtcggcctcccgtcgccctcaccgcacacacaagaccaatttgacggttgtttgggggcatccactcctggggctcttgacattttccccgggctctgcgccatcagcgccctttcctgcccccacttcacgggctctgtctcctctccaggcacctgctctgcagggagggagacaccccccgtcctcaagctccacagggtcccgggtaatttcatccgtttcccttccctatcagtggctcccaaatctgtttttctcaaagtctgttttcctctgaacaccaaatcacagtttcaactgtatgtgatacaacacctgaacctcaggatggcctaaattgaactcattattgacttctcacatccgctcctccgttgtatgcccaacatccctccatagactgatctgttcgcggcctctgctggaacctcagtgtcaccttggacgccaccctcgcccaccctacccacgccagtcagtgcacccaggcctgtgcaagtggcctgtgaaaggcttctgtgctcgccgcccgcctttccagtggctcaggactggccccatctctttgcagcactgctgagaacgcctctcaactgagagcccgcgctcctcccctccatgaatgtatctgctttccaccccagacttcatcatggtgctgcaacgttgacagccccgtcacctgcagaaccatccaaacccatcggcagcacacagagaccctgctggatttcccagccccgaatcccaccttttctacttcaccctcttttctacctcactcagtgggtttcccatcccaaagtggattctcacctccatggtgtatcaaagtcctactccttctcccaggtccaaaagagcttctctggggaggaaccccagcatcccaggccatgagtcaggactctcctccagcactgctgtgacgcggcacgtgaccccacctgcgcacttagcacctcctgttacgcgcctgtccgctgatctgcgcctgtcatcacgtgaagagctccagggaggccgggctttctcccagtcccctttatattcctcgggtctagggcatgcctcacactaagtcaataccaaataaattgtccactcttcaacaaggcaggaaacatgaggggagagttaaaaagtcccaaaatgagcatatctctttgaaacaccccttacaatattagtttttaaaattctacttgttgagctatgttggagttgtgtgggtttatatgagtatcttttcctacagggaactatgtgatctgtgcaaatagagtccccacacacaggactggtttgcatcagaacatcggggaggcaggagccccaagtcaaccattctttgtatagaaaaagctctcccaagtcactcttttctttggcatgtgcatagtcatcttttaccaaatgtttagtcagtatcaaattcatttgctactggaaaacctgttttgatgacagttgttgctaaaaacctgtacctgatcaaaatgattgagcttactaactctaaattaaggagtgtctatttaagcccccgaagctacagtagaaaatctaacgtcatctcttagaggtgagcttgttaaaatactgacgtgatgcctttgtgagtccaccgtctcctttataagaatcaggccactgatcctcaggcctgaaggctcatctcttgggaaatagaggtcacaccaagggtttggtccgtgagtgagaaggtcgtctccagcctagaaaggtgaagactctttgattctacagttctaaagcgtggcctgaccgttttattttagtggcctttctcacactttgtctagtttcatttttgttacataatctgcataaaaattccctcagtagttacaattgcagtttagttcatgtctgacttggtgtgtcgttctgttgtgtttgagatctgaaaaactgtcgtcattgcccatccagatagcattcagtagaggggaaaggattcctttgtacaaagcaagcatgggcttaggatatttccacatactattcatttgcagacattgactaagaacaattaggaatgtacgctagaacgtgaaaaacatcttttacatttggatccatcttgtaagtgaccaacatacttttctttgaaaaaatagagcccatacgtttgtggcctaacaagacatgagaggataattgattaaaatgtcaaaggtggttggggaatgctgagatggaatgatactgcaggaaagatttcgcaaaaacaaattaaagtggaaattacaattcatgtataaagcccgtttgtatgatcaaagcaggcatcatctgtactgctaagttctacgtataacatagttttgttaaagaaaagtcaggcatgagatggacataagggatttgctgacaaatgcataacagctctaatgactaattttggttttagttagtgcaattctgtaggtggacatttagccagtttgttaacaaggtgttttaagaatgtcttccaggacaatttaaaaaaagagagaattatcttctcttacagaacaatgaaaaacagaattatctttcagggatggatgtttattacataacctattggagaataatggaagggaactagatgccttatgcccagcttattcattatctgatacctttaaaggctgaatggcattgccaattattcattgtggcaggggctgccatcaatttttagcttacagattgctagtttctcccgtgttctcttccatgaaacagcaacatactccattttgttctctatttaaaaattttacattgcagccctccaacaaattaattccatttaggtttcttcgggaagagatacaaatgagttttgtgaaagtgtacttaaatgcagccatccagccatcagcatcaacaggcagtcagctgtgcccagtgccatgcgcctgatgcccgtgactgacaagggcccgcattcactgtcccgggcttatgtgaatgctgacacactggtcaccgcagggcatactgcttgttgctgcttagttcatgcttgcacgggcagacccccaggtggcctgtcatttatttctataagctaggtctggtaacaccacaaaagcagtaacattcatttatatgaaggagaagtacataatccaaaaatcagaaaaattacttctgatagaagaaactaggtttcaaatgcgggtcttaataatacaactggattccgattgcattacattggttttctcttccaaataattggcaaatgaggacaaacagctcatccccatcctaacaggaaggtctgaatctgaagccttaccatcggtgactcattaggaccccattaagagccagaaaacttgcctaaatataatacaaatcgaatcttcaatgaggactacacatttgtaaactaaatttgaagtccccaaacatttacaagtacatttgttcttcataagtacagtcgtaaagaaaagcccagtcagtgacagtcaaccttgagcaacgttggaatatgaggtttgaaagtgaaaatagaggtcggcgcacaatctagttagtgcagagttgcattagacacaagtagtcagtgaccccgatgcacggaggaaattctgaaggttcaacatctgtctgaaaataatcgaaaggccctgcctagcagcacaagggactttcaagaatgggctttcctgtaaattttggatttcttttcttagagaaggtaaaaatgacctgctttctacttttcttctgattggactgcaatggccaaaaatatttataagaataaaagttaacaaaaacagtctaacccgtcagttcagaaccctagtaaaatttgttttggagcctagaactagaattgggcaaaagtgtagggctctttctcttataccaaaaagcccactcaaatgttctgtgagcccgctccaaagataaagtcagaaacaacttaacaacttcgtcttctttcactgattacttccctcgtgttctgtctattgctgatgatgtcctgacaaacagctccaagcacactcacccagtgcccgtgtgcagcatgcagaccacttgtcacccaatccatttctgagggatgactgtgttcctgaaacaactgaaatcagaaatcccttatttagcatttattagaatactgaatttaaaatattacatattatcatttgaaaaacaaaacaaacaaacaaaaaacctgttacttagattcaagttaaaagagggactatgtattcacccttagtccaggagaacagcttaaaatatgagcaccttttcctaagccattccacttaaatggacactagacctcaaaattgcaaacaataaatacataaataaaagcaataattaaaaaactaacttcaccatcatcccttcccgccaccccccaaacctacttccttcccaggcttcagatgaaatttctatgaatgatcccacccagtctcattcctcagctcagtgtcaagttccagtgtcctctgatcttccctttctctgacccccacacctttatggcgagtggccccccaacgccacgaggcctttccccttcactgctatggccgctttctgcaccacccttgggggaggtcacagcctctctgtgacctaagctctctcctctctaaagagaaggcatccacttaggtggtttatagggtttctcctagctcaaggatcttgagtgtatcgttgagctaagatacactcacgagctgagacctcctgactcaggcactgtggctgcactccaccaggtgacttatctgtggaccacactccacgtggccatctgtgcctatgctcttcctccacccatccaccaaaatgccatcttctccactcccactcagagccatgacgtccctctgcccccaggttgtccaggatcctctcatcttccatttccagccaccttttttctctaaaccctgtaacacttcataggagtccctcccaatgaaagccacaccccgcctggtgtctcacaccccaaagcagactgtaagcttcctgaagactgtcctgctcctcaatgtcccatcccctcccgaactgaccagcggtgctatctacggggaagcaccggggcagttgttgttgaattgatttcagttaattcagtttttaactgaatcacacaaaggatgtcacaagctagcttttataactaaagaaagcacagttgtgcagctgcctccagagtctctgggggttagagggaatgaaatagggaaagtccccagaagccagctgactgctgctcaaaccaggtgcaggttgggagaaaatctgtagtgaatgaaggaaaatgaaatgcacagtggaaaagaataccaacattcttgcaaaggaaccttaaagtattatttttgcaaagaatgcaaggattatttcagttcccttgttgactgttttgtatggtcttcctacagatactttcagaaaaagatctattgtttgtttttctctgtgctgacacagtatccattgtttagaactgtaatcatagcacacatagttgaaaatgtgggctcggggacaagctgtattttcccctctggttctttagacagtgaatactgtgttctttatctcttatcacagctcttttgtcaaacatttaatgattttttcccccagacaaatttgtagtttgttatcaaccataaaaatgtctattgccttatttttaaacatttaaactttggtaagtgtgtctcaagatgagcatgaattaaggtgtttatttcattttaaatacttttttttatcatagcgtacaaagctagagttctctgacatggatggcttatgtggatctctatttagacttgatgagagaacattttatttttgtactgtgtgtatttgcagggaagatggttaggctgactggctcccaggttgggtgtgttgggagcatctgtcaagggttggacaggtgcagacatctgtgacgtcctgcagtaggcagccatcactcgatttcctgcttaaaaagatctgacacacttcttcactccttggatctccattttttccaaatgcccgatacttcttaccattctacaacccttaaaccggatcccaaagtctgtgagagataaaagccttttttaaacccaataaacagtcactctttgttgttcctggttttaaaatgacaatttattgcttgatacagacatttgaagcctataattcaaatgaatatttataaaaataaatttcaagcacactggcatgtaactgcagggtaatttttaaatattcatttttaaggtggtgatagagtctagaaaaattttaatgtgccacgttatattttataaatatccaactatagaaatatgccttgtgtgctaatcatttccataaggcttcacttagattgagagagtgaaaatgggtgtcagtctttcaaatatccagaggaaaaactttcattttgttttaaatttgtttttgagggctgaatttaaacttaagacaatgtatgaagagttaaggtcagagttggtactttcaccactattccatttgtattgctttaaattctctgattaagtgtggaaaactatcaacaaggcgattgttcccaggggctgcccggccagaaataccgagactgaccatttttaagaacccagtgctatgtgcggaacagggcggcatggtggcctcctgagaactgggagggaaacactaaatgaagacgtgaacacatgggatttctttctttctttatttttattaaataaaaaatatttttattttgttatattgaactcgacaaattttcctcagagataatttttgtttcaatattcaaagttagaaattgtaccagcccgtcatagtttgaaagtattcctaaaagtaattcaaataaaaatgtattttaaatgtagtacacattttaaacatattggagaaaacatagaatcagagactttttcaaatccatgttggactaggaaactgtttctttttgtttctttttttttttttttttcctgagatggagtctcattctgtcacccaggctggagtgcagtgccgcgatctcggctcagtgcaacctccacctcctgggttcaagcgattctcctgcctcagcctcccgagtagctgggactacaggtgtgggccaccaaagccggttaatttttgtatttttagtagagacagggttttgccatgttggccaggctggtctcaaactcctgacctcaagtaagactgtttcttaatactaatcagatttgacaacagatgaggccatctgtgatggaggttctgcgcccgattacacattcccctgtagctcatagactcagtgctcctttctacagaggagagattccatagtcagtgttcctggggttctgtttttacttttgaagttccagaacttagtttcagttcttcctcttgatgtctctcttttgttctctccccctctctccctccctccctgtcttttctcctgtctccctgtcaccctccttccctcctttcatatctttctttcttcatcttgttatttccatctgtctgcctttcccaaggcaggaaaccccggcgcctccaggctggtggtgtctggctctgggctgcacaagccacaggccacctgccatcaagcacagaatggacttgacggggaccctgacagccagtcattcctgggactagatagggtgcagccggggtgtccgaggtgtttgtagtcatagtggcatacctacactgaagaggacagcttttttgtaagcggtggttgcttcactcatcaaaatagcctatttgtgaaggcatcaatgtgcaagtattttggagcaagtaaaatcagtcctggagattagaacatgcaggcctactgggccacaggaatggggctgcctgttgagactggagtgcaatgccccccaaccccacgcctgctgttcttccctctgctcttctcccttcccacctccttcactctcccctccttccccacgcccctccctcccttttggtcatcagtgcactttgcaggcatcagatatttggggctcttcaagtgcctcccctctacatcggtgtccacgggcttgctgaacagtgagcctctcctccctcctgggactggtcctcttcaacttgagccttgatctggagtcgatggtagagggagtccacttctcttgaccccgactctcaccatgtcaaaaggaggtgatgtttccaaaggtagcaattgaaggagcctctttatccccccataacagagaaagcatcggggatgccttggcctctcagccacgctttgatgattggcatttgattgttctcacatttcattatcgtgaaccactaataatgttggctaattgtttatttcatttataattccttaaatctccatctagtcttgaagctgttgcatccaaagagagtgctgccaaagagaagtttaaccacaggtgccgccctgaccacacttccaagactatctcctcatgtgggttctccttacatcatacatttgaccgtgaaacccatgaagacaggcgtccaatggagaggagtgttggaggcctcttccctttccacatggccctagagcccagtgttttcaatgtggtgtgactcccttttccagcggcgaaatcgttcccccgcttcccagaagtgtgctttaaagacattttgtgataagggagtgcaggtaggaaggggtctaacctcccccagggctccctgcgcctcggcggctgaggaggtggcagtggaggccgcccgacccccctctcagcctccctgtgctgcgttccctgccctgccgggaaatggagattctgcgcctaaagacacacagtcacgctgctttcaaagtttcagttcccacggccattctaaaatggcccctggagagctctggcttcctcctgcgccccttcccgcgcccgcccctgggtgtctccgctggctccccagcatctcctcccagctcgggatctctctcactcattcctccctccctgattctcgcctccattctcccgctctccagcagggcgcagctccctcttgctctttctggagaagcagggatcccagagaccccctacgagctggttccctcccagaccccgtccctccagtcgctggctcagtttccttcagtttcctccagctcatctcctgcccacctcaaaagcaacaggtccaagatcccaatcagcatttctcgcacagcgtttccgcgagaacgttccctgatcatctagagttagggaagtagaaccgtgccctgcacatgataagcacatggagactctaatcaatgagagctactatgattgctgctcacggacagcgcccaacagctctgttgtccctgctaatgacaccgtcgtccctcccctggtcaaccacgacccaaatgttaaagtgacctttcactcttttcgccaacatgtatccgctccaagacctctcctgtcctagggctactgggagccttacctgtggcctcaccttgctgtgcagcattggggagttgctgctctgcaccttagagatgtcaaatgggaagagtgacagctacttcagcagggtttgaggcaacattaggcaacacagtgtaaataaattacataacaatctgcttggcacttagtgatggttcaataaatgttacctgttgtcgtcgttggaactgttgacagaattcagtgagacttcagtgatggtttcttgaaagagtcacttatcatattctgcaatcaaagaaggaagagaggccaagaaataaacagatacatgtgcacatgacacaagacccagggtgagcagatgttcagaagacagagctaaagaaagactagagagacagacagacagacagaaagactagacagacagacagacaaatagataaacaggtagaaagaaagactagacagatagacaaatagacagacaaatagacaggtagatagatggatagacatgtagacagactagacagacagactagacagatagatagatagatagatagatagatagatagatagatagatagaggcggacagacagcttggtaaatgggcaaatgatagaaaatataaataaatatatgaaggagggagaaaactgaagcagaaaaaaagtaagaagaactcgtggtcattttactaaacttttaaaaacttgaacctaaaattttcaagataacttttttctgccaggaaaaaatacatatattagtagaatgtgtcaatacctgattttttccacagtaagagcatttccctttgaatacagtcataactggttctccgttagtagtaatcacagctcatctctgtggatattgttggtgctttcagttgctccagtacacatctattttgaaatcacctttagctataaaggaagaaaaaagaaataccatctgtaaatgcttgctctagaggtgtgtcataaaagtacagtcccattaacctactgtccttatgaaactggtggctattttcttttcttttctttttttttttttttttttttttttgtgagacagggtctcactctgttgcccaggctggagtgcagtggcgcgatctcggctcactgcaagctctgcctcccgggttcacgccattctcctgcctcagcctcccaagtatctgggactacaggcgcccgccaccacgcccggctaatttttttttttcgtgtttttagtagagacggggtttcaccgtgttagccaggattgtctcgatcttctgacctcatgatccgcctgcctcggcctcccaaagttttgggcttacaggcctgagccactgagcccgccggctattttctattcttatgttaaatgttctctctttaccttccattttaagggaattgacaagggagcaattcagagcaggggttatcttatctttcaaaggaacagaactggccacatcccagtagaaagtagaaaggatagcatccctgtccatgtcaggagcacaaaacaaaaagtacaaaaattgtgatgtaaaccacttgaaacttacaaggcagtacatagggatataatgacttcatcatcactgatgcaaagagaggtttctagatacgtgtttatctgtgagccccaggtccccgctaatctgtgctgatgtcttgaggaaaattggagtgagagtaaaaactttgattcactcacatactttcctttttcaagtaggcatttcagtctagccttggacatgcattaaccaaacgactggaactagttattcactaaagtgaccacagatttttaatatagtctgcatcaactgttttgattatgagaattttacttctcttttcttgctaatataatgagtcaagatagctcagtaagttaaaaaatattcagagtttgattatttgtttatcatttgttcaaaaaacaccatcaaatacctagattgtgagataaatgaggaaatcatagcaccatctccatactgcttatgcatcaggcacttgctctcagcactttacatgtgtgtgtgtgatttacagttgtgtgaagtggatggtatcattgttctcactttacaaatgatgaaagtgaggcccagagatgttaatttgcccagggtcacacagtgagaacgggtggatcggatgggcaccgaggttgtctggcaccaaggatctgtgttcctgttttgctacatgtagaaagtgtgttgccttgcccattaatgaggtcccagcatctgccccggtgtttgataataataagggcttaatgatcgtgaacccagaaaatctgagacaggtctcagttaatttagaaagtttcttttgccaaggttgaggacacgcccatgacacagcctcaggaagttgtgacgacgtgtgcccaaggcggttggggcacagcttagttttatgtatgttttagggagacacgagacatcagtcagtacatgtgagaagtacactggtttggtctgaaaaggcaggacaacttgaagcaaaggcaggaaaactcgaaacagggaggggcttccaggccacaggagatgaaatgaaaggttacattcttctgagtttctgatgagcctctccaaaggaggcaatcagatatgcacctatgccagtgagcagagggtcactttgactagaatgggaggcaggttggccctaagccgttcccagcttgacttttcccttgagcttagtgatttgggggccccaagatttattttcctttcacatgatcatgtacggaataaagaaatagatgaacacccatgatgttcaatgtactcaatgaagctctgagtacttaaagaataagaatgataaaatgtttcctgccctcaactaaattgcaggctgattcttgcagcttgagctaattcataagaaactagagattctaatccactttcaccagagggccttcagctaggacagaggctcctccagggtttgtgtcagccgctgttccaagtgaaaagtagtgctttgtgtctattcattccttcaaggctcatgacaaccctataacccagggactattatcatcccgtttgcctggggaggaaacccagccacagagcaggcaaggacctaggccttgatcacacaggcaggaaagagctgatcccagattcaaactcaggcagtgcagcccaggaggcctcacccttaactgccaagcttggccgcctctcaggcacctaatacttccctggaggagtaaatggtggaggtggggatagagaatggccagactgaaactccactgagaaggatgcctggggcagagctgtcttcctttgaactcctcgcagaactcattctttaacttagccccagaggcaaccacaattcagtgtggttcttttgtttgttgtgtgtctgtgtttgtgtatgtgtacagatatgtatctacgtgtctatatacatagatagctacaaacacaaatacatatttgtatatactgtgagggttatatttgtattatatgtaacatatatctctatcactgcctagaggaaggtcttggacattttaaacatcattaaatggcactatagtgtatttatctttctgcagacttgccgaagaatacaaaacatttgaccctaaaaagtgactctgctcactttttaattttaaaatgtgatcagagatatagtacttggatgggcaaaaagtgaaggaatttgctttgataaagactggcaaccagaggaatcttttagtcctctttatgtactgccagtctgagcctacaaatattttttattaaaaatacagaaaaaaaggcaacttttttttctaatatagaaaaggaaatgtcctaggtcttttagtcccctgggactcttgcatcacaaaatcaggaactgggacattggcacctcctgaggatgggaccacccagtgtgggcttatatatatgtgcacacacacagcacacttgtcccaatgtctacaggatgttctactccatgatctagaccatttgcgtgacctcgcgcaaaggcaacagtactaaccttggagtctaaacgccaagggtatgaacgtgggcacgtgtcgcatacttcccagttcatgcatactttccaaacaacgcacagccatgagtgggagaggggagaggattgaatttcgtgagcagcatgcaagatgtattgacaggactgcaccgagagtcttttctccaaggaaggtcaaattttaaccttttaacgttggaagtgaagacacctgatatgatcattgacaaaccaagaaatactaaaaaccctcaagagttgaagcattcttttacaatccttgttttagatacctttttaatagggtgaccaattgccccagtttgctcagcactgagaagtttcccaggacacagaacattccaggctgaggcaggatgcttggtcaccctacttctgcacgtcagcgtgcttgggaagcgccctgcaccaccggcattcctgggccccagaacccaggcactgggccggatcaggccccaggccccaggccccaggcactgggtgggatccgcagaacatgggtcctgcctctcagcagttcaggtctcttcacatttctcagcctcctatggccacggtttcctgtgctctgttcacgtttttcaaatgtgatgtttattatttcttaacttgtaatgtgtcaaacaagtataaggaaagctaacgagacggaaacatagggaaaaaatatttttaaagcagtattacaagaagaaagtgaatacttaagcggaattggtgaaaacctttaatttacagaaagtgtcacaaacccacttccacttcattagagtacatatattatatcaattcttaatagtagttataaattgtaataggaaccaggaagactacaacatttatcagttcacaagtggatttttcgtaatcctgctgtcttcaggtatacatttatgtcccaatttctttaagacacagagtcataaagagattcgggtgttccctgagctacaaagcagaagagcctccctcggcccctggggagcctgctcaggaatcgggctgtgtggggacagtctcctcacctttgggcatgaggtggggctgggcaaagaccacccagctccctaacccctactcatccacctcctgccccagttaaaatcaataaatatttactggcagctacaggtgtctggggaggcagaaaggaacaagtcatgggcccccacccaaggagggggcaggatgcagcgtaagaacctgcgcttggtcactgaggtgcttggcctcaggccaccacctcacctgcgcaattaggtacatggtaagagcatggtgacggttctctctccgctggggtgacatggggatgttaggtgacctcgagggccattgacacagtcagatgtgggagccccgggtccattgcaaatggatccagtctaatgggggagagagacctgccttcctcacacggtggtggccaacctcgacgttagatttgggggaagttcagaggagtgagcgggcctccctggggggcttcccagaggtgggcttagagccagactttgaagggcaggcagggttagagtaatgagcaaagggcagaggaagcagtgcgagcaaacgcggggacctgagcaggcccgttggggcagcaggagggcagcagggttctgggaagcaggggaagccgtcctgtcccggccggctgctgggagaaggtgggggcagaggggaaaatggagggaaactggtgcttccgtgtccactggtcaggggtgggagttgattagtaactgagggaggaaacataagatcctctctgagtggaaagtctctagcagtgactatctctgagtccttctccagtcccaaagctctgccatttctgcctttgctgctatgaaataaatatatatatatgtatatactgtttgtatgtgtttatgtgcatgtgtgtgtgtatgtgggggtgcatatatgtgtatatatgtgtatgtgagcatgtatgagcatacatatgtatgtgtgcgtgtatatgtgtgtataaatattatagattcagattttcccatatttccccacattctgccagcagtaatagaacaagctacataaattgccacaaactgtcaaatattcaggattctctgttctcagagttcaaagagaagtagttgtaacgatggttttcatattgaaatgagaactactaagctaagctaacctagagaggattctagcaaatagatcttggattgattccttgcttgcaatttatctaagcaatccataccaaaaaaaagtaataaatatgcaattttgcctaaatctcatgaataactgataaaaagctagattatctgggcttcagcaagtactttcacatggagttataaatacagaacattgaaggagtggtcgggaggccaggatcccaagtcagactgtgagaattcaatctctgggtgccttttcatctctagtctgattgatagactgtggagtgcgttctccaaaaacaagttttagaggagccacaaagtcggaaggggctgtgggggaagcaccttcggttgcctgcttgccacagctgctagtcagggaataggtacatcgggccgttcctcatcttcctggcctgctgacccacaattatcctcactcaaaagcactgtagatgggaccaggcacggcggctcacacctgtaatcccagcagtaatcccagcactttgagaggttgaggcaggcagatcacctgaggtcaggagttcaagaccagcctggccaacgtggtgaaaccccatctctaccaaaaatacaaaatttagccgggtgtggtgacatgtgcctgtggtcccagctactcaggaggctgaggcaggagaatcacttgagcccaggaggcggaggttgcagtgagccgagattgcgccattgcactccagccgggcgacagagcgagattccgtctcaaaaacaaacaaacaaacaaaaaaacccaccaaacattgtagaagaaggaaacaccctcactgtggatcacatgcatcacttctgaagatttattttgttaaggaaagaaactttgtttgcctcgggttttgggttggtgatgagttttcctcgttcagctcattagcccatagaacaactgcttcagcgcatcacgctggcagggccctgaaggagaagataatccgctctttctgaatccataggacaataatagcaaattctgagcttattaaaatacatggtgtcaccagctcatcagaaagggcaacaggcagtataccaatgcagttctggtcttgtagtttcaaaaggctaattacttttacaataaaataaagagaacttacctgtcattgagctgatgcatgtaaaagctgtttctagctaatagaggtttctgcaaatgattcagtacacattttccacaatgttccacaaatcatattggggtatagttgttggcggcatttcatacctgagtgaggtgtgatcatgttttaattaggatcctgtaaggtgaaaatagactgcacatgcaaatagtcggaactaattgcctattttcatgatacatagtgatttctaagaaaattatgactaattttaaatgaactaaaaatatgaagtgatatccaacctgaatcctgtgatagggtttgggagtttcttacctaaagggctaaatctttgtcatttcatttatagccattcatgaacacaggtaatagtgtttgcagatctttataaaaatgtgtgacatggattgttaacattagcttggcctcaaggtaattttcctctagaagtatttatatattttaatagacaactgacagactattggggcttcaagtcctttccttataaatttgaatccacctttatgttattactgcattcaattttctctagattatatgtgccaatacaaaaattctaaccttttccccttggtttaatatttttctgtgtgtttttatatgcatatgggaaacactgacagagatgaaacacccatcccatctgttatccttgtcctctttctcttctcctctacccccaccaatcacaagtgggaccctggaaacccggggctgtaatgcatgaaagatctagaaacgaggagaggtagaacacactaataagaagagcccatggtcagagcacccctgcagattgtcaggagctaagaatggaggaaaagagagactcattaagccatgccccatggagaggcaatgggaggtgcataagaaatgtttctggaagtcctgaccagggcaatcgggcatgagaaagaaagaaaaagagaggaagtcaaactatccctatttgcagacaatatgattctatacctacaaaaccccatagcctctgctcaagacctccttgatctgataagcaactttagcaaagtttcaggatataaaatcaatgtacaaaaaccactagctttcctgtacaccaacaacagccaagctgagagccaaatcaagaacacaatcccattcacaatagtcacagaaagaataaatacctagggtatagctaaccatggaggtgaaagatctctgcagtgagaattgcaaaagactgctcaaagaaatcagagatgacacaaacaaatggaaaaacatttcatgcttatggatagaagaatcaatattgttaaaatggccatactgcccaaagcaatttacagattcgatgctattccaattaatctaccaatgacattcttcatagaattagaaaaaacaattttaaaatttatgtggaaccaaaaagagactgaatagccaaggaaatcttaagcaaaaagaacaaagctggagggaacacattacccaacttcaaactatatgacaaggctacagtaaccaaaacagcatgtactggtataaaaacagacacataaaccaatggaacagaatagacagcccagaaataaggctgcacacctacaaccatctgatctttgacaaacttgacaaaagcaatagggaaaggactccctattcaataaatggtggtgggatagctggctagccatacgcagaagattcaaactggaccccttccttatactgtgcacaaaaatcaactcaagatggataaaatacttaaatgtaaaacctaaaactacaaaaaccctggaagataacctcagaaataccattctggacataggatctagcaaagatttcatgacaaagacaccaaaagatgttgcaacaaaaacaaaaatttacaaatgggacctaattaaactaaagagcttctgcacagcaaaggaaaccattgacagagtaaacagataacctacagaatgggaggaaatatttccaaactatgcatctgacaaaggcctaaaattcagaatctataaggaacttaaaggaatttacgggcaaaaaccaaacaaccccattcaaaagtgggcaaatgacatgaacagacatttttcaaaataagacacaaatgaccaacaagcatgtgaaaaaatgcttcacatcactgatcattacagaaatgcaaatcaaatccacaatgagataccatctcacaccactcagaatggctattgctaaaaagtaaaaaaataacagatgctgacaaggttgcagagaaaagagaatgctatacactgctggtgggggagtgtaaattagttcagccattgtggaaagcagtgtggtgattcctcaaagaacttaaaacagaattaccatttgacccagcaatctccttattgggtatatacctgaagtaatataaatcattttaccataaagacacgtgcacgtgtatattcatgacaacactcttcacaatagcaaagacatgaaatcaacctaaatgcccatcagtggtagactggataaaaaatgtagtacatacataccatggaatactatgcagccatgaaaaagaatgggatcatggcttttgcagcaacatggatagagcttttatcctaagcaagctaacacaggaacagaaaaacaaatcccacatgttctcacttataagtgggaataaacaagaacacatagacacaaagaggagaacaacaggcttcagggattacttgaggctggaggctgggagaagggagaggatcaaaaatctacttatcaggtactatgcttagtacctgggtgaaaaaataatctgtacaccaaacatctgagacacatgtacccctgagcccaaaataaaagttaaaaaatagaagaaaaggaaagtaaacccccaaaaaagaaatatttctcagactcttggagaagctgtcccctcacagggaatggggagaacagtctcttaagtttccccagagaagctttgtcacaagtaatctcaaatccagatctggttgaattctctgagagagaaagaaatgcaaaattaacactcaactcaggaaggttgattaagagaaggtgctaatatttgctttccttttcctcaattctgaaaatatcatacttcattttttttcttttaccgctgtttataagtatgttcactttgctatcaggtcagtttggttcgtgtgggacatttcgctaggattttatttcttttcttaataaatagtcaatatttgtcaacatatcacttttgacattctgttttttaaatacgctttgtagaaagtgagagatttctttaaatgaaatgatttcagtcgcagaacacacatttgtttttaatctctggtcccagtggtatttatctcttactaagaaagcaagctttccttttagaaagtgatctgttccctcattgttttatttataatttagagtatgggtagtctgtctgctgaaatgaaaataatgaccacagcctattaagtttctccaaatggaacaggtgatacccagggtttcaaaagtctgaaaataacaaatgatcaatgagcaaagaaatgaaggtataaggcctaaaatttgcaacataaaaataaacacatcctcaagaaatactgaaatcgatttttatttccttggctcacatttgtgctcattacacatcagacatttccatgatattcaactccctacggtttagatgtgagaatagcacatggaaacaaggacactcacacccagttgtgtttcccatccctgtttcctggctcatcactacatgatgagatgcttgagggagctgctcttcacacttaacgcccagcactcagcgtgtgcccagatagaatggaggcatggatggtagcctgctccattttaatattagattaaaatgcaagcatctcatttctttctacaaaattaaaatataagactgtcaggatccataagtgtctcttataatgaaagtggaagaattagaatccataatcttatttttgcaataaaaatatgaatcactgttcacaaatattcagcgcaatagaataccaagtgagattgtgcctgtcttagaaagaaaggcaagctctcaatctgtggataccatatggatgtcgctgagaaggagtggggacttgggcagcaaagctgccaggcgttggggagcatatggaagtggcctgtttggggccacagacggtcgggcaatgcttccttctctcttcacagttgtctaacatattgccactgtctacatgagcataacttaatagccaatttgaattctattgtagttaaacttggtgttatcctgttagtaaactagcttatattgcacaatcgagtccaaagattatttttgctttatttactacataaagcaaatactctgtaaagaactgaaaccacttttattcatagactatattggagattttcttttcttttcttttttctcttcttttcttgtcctaagacataacatagtaccttcaatgaagatgacggtggtagtgctagtatagtatacaaattagaaaaaggataattgcagagatcagaatctaagctacattttactttttttaaaaaaaaaagattgtcaggttatcatgttaaaattagcatcttctctatattaataaatcaattctgtgattaaaagtccagaaataaaataacaaataaatgtgcattttatttagctatttttagtgtgctattggatttgaagctaatttggctaagcacacgtttggatttccatcttttttggtatcacttcctaggattttagtgcagtggctcctaaaaagaatgctcaaatattacttataatcccccaagatatatcttctttgcatggaataaaatgtgaactaacttggagaaaggaacactttagacatacatttcattaatgtaaatatccacctcaaactatgtggattagcatctcttagaattgatgttacaatgctaacaagagaaaaagaaaacaaagtaccggtctacaaaaatatttgtctaatgccgaatgttagattattaaacagaaaagcacattagctaatgtgaaatgatgtttttctccaaatttattacattttccccctctgtgttaaattttctttaaaaggagatctcacaggagtggataggcaagctggatctgtgagcagctacaaatagaagcacaagacaaagtaatctataggctggcactcacattcatttactaaataaggtcgtgagcaatattaggcacatttttctgacacctttcccagttgactagaagttgagtgcatttagtaaaggaagtacacagtgaactgttgttagtatttatcaggaaacgtgatgagtggccctgaaatagagcatcttaccatccaaatttctcagtagccttaataaagaatagtcagtagccttagtgcagactagctggagtagatctaagcagtattaatgtggcagtccgcctcagcatgaaagtggagctttgcaaaaggacgagaaatggatttggatgggcaaggttgaaagtagttgtaagttgatctggcattttatatttcattaatcaatttctaaatctataattaaaagaaaactacattgagtggttgggcataaagtagagattgaatgatacccacaacaaataattgttaatattgacaggttatgctacagggattgcctaatttcacagatgagggtaacacaaaatgagacaactgctacataatgtttattctaaaggaatattatgacattactgagttttgaattttcctttgtattgactttttcataatgcatgaaataagcatacatcaacctagttaatacctgaacaagacaacatatccaagccataatttgatgtaaagcatgtgacacaaaggaaatatcatattgtaaatatcgtactgtaaactaacaactgaaaacttccatatgtctaaagtacacaaacatattctttattttaccttcacattctttcttttaaagaaagaaaagccattgcaactcagcagtgaacaaggcaaagacagtcaattgaaatcaaccctccattgcacagtaagagtatatgtgtgaagttcttgagccgagcccctaaaagtctccatgaacatcaaaccacgcctgttgggggacctcagttctctaccaaatgtcttgttaattgagctttggcaaatgtctccatgaggaccattgtcacccgtcatgctcatgagagtcacggcctacgcttccacatacttttaaaaatcttattaaagattacagagcagtcaggtgagtacacagacaattacatccagacgatgaacagaaggacagaataatgtactaactttctgctctttaatggactttacctgtgacccaaatatattccttctaaagcatttatagaactatcaaagtttagatattgtaataccaatgtgtaatccattctataatgcagaatatctttctaaaatgtgaaaaagtgccaagtattcaattcaacacagtaagtgttgaacatgaggacaaagaaaattcactggagggccttcattaaaaaatatccccactgaaaataaagcagagaccaccagagtggacagagcactcaccatggccttagaaggtggagcttccaagcggatgcacccatttctatgggctgaggaccataacctctgagcattaacttcctcttccaaagcacatggatgatatctactgcagaggcatgttgaagggattaaattggttaacgcatactgaagcagccactaaatttctctgttaaatacatgtatctcttccccttacttttgctgagaacaaaataatttctgttctttgttgcacccagtttgtactgaagggcataaccttgaatatttgaaaaggaaaactctcttcagttcaatggaagatataggacatgttaagtaagaaacagcaagctctttaaatcagtgaatagctgtattggggggaaaaatgtggttcatcccaaggcagccaaaagttgacctggtgaactgtctggttggttttatgccctatttaaacacacattaaacagatctgaagtgtcttaaaatggaaaaatgtcttcgttcaaataataagaacttaataaaattcttcattacttcactggagccttatttgacaatactaaattttttctcctaggcttacatgatagattctatcacagaatctttctctcccaccaccttttttttaaattccctttggctcttaactctaccattatgacagcaacacttaaagctgacctttttttgacagagttagcaattctcctccaggctatgtagtgattcttcaatgcttatgtgtaaattatgcaactgtctcatacttcacagaaacattttataatcctgtgtactattccatcattggtttaatgaaaacattaacacttggtttccataatatttaccatatggtaaagtcactgttttatagagtaaagggacagatagctgaggtcaatttaaataattgtcttaaaattccccatgatgaacaaattttttaaatttatcttatctaccaatagcatggaaatatcaagcttatatacacaggtggacttgcacctttaccgtatttgattatttttcataacttagaatctaggcatatatctatgtaatggagtttttacagaagcctttggacaagaacacatttgttgtaattctcggtatttaaatcaattgcgcataataaaatgactcatgaaaacattctacttaatatggtatatcttcccgtagtaaaagatgacttcctcgttcctccccctataagagttaccaatgtaagcagtcgaaatggttgagcctcttggttttgcactcctaccaagtctggtttgtaactaggaaaataagcaaacaggtcatgagggtatgaggggagggtagcataatgcagtgctcattctcttcctcttcctcaataattcagcccaaagccaccaaatggagctgagcacgtgcagtcagcgtctacctgcagtggcagagggagccactgtggtccagggaggggtgtcagggcctaagaagagtgaggaagacatctgtgtggttgggaagcactgccaatggccctgcaagtgggatcagaataccagagtgaccagaaaggcatctgcattgggatgaagaaggagtacagagcagtgggatattggttacatacaggggtagatcaaatgaataaatataaaaaggataatgggagccaagagagttacaaatatgaaaagatagagaatttgaaaatactctggggtattggattagagttgagatactggcataaactcatgattttcattatagataaaggtagctgtggaaatgagcatggttgtaactatgtgtatgtgtgtatagctatgttcactgtgagggcccgggagcagtggcaccccaaaagcagtgagcacatctggtacctggattttggtttctaagtaccattctccctaaaaaggaaccaaagctccttgagaaatggccaattccagaactaaggcaggaaaagtccaagaatgatcttggaacagagccatgtcaaaaagaaagaaaatgcttaaagagcaaaggagacatgtgcaggggacacagatgctggctcaaaagggttgcccaattgccaagtcagggaccctttgaccttcaaaataaatgatagtaaaatgggctataacccatagactacattaggaattaatgactccatattaatataaatgaataaatgaataaaagtttgatgaaaaattgtatatttaccattatttcatattatctcccaacaaaatgcacattaattataaagggaagaagagtaactttactttggaaactgataatcttttttttttttttgagacggagtctcgctcatcgcccaggctggattgcagtggcacgatctcggctcactgcaagctatgcctcccaggttcatgccattctcctgcctcagcctcccgagtagctggaactacaggcacccaccaccacgcccagctaattttttgtatttttattagacatggggtttcaccttgttagccaggatggtcttgatctcctgacctcgtgatccacccgccttggcctcccaaagtgctgggattacaggcatgagccaccatgcccaaccagaaactgacaatcttaattgaaggatcaaggttaacatggctatgaaatggacaaattaaaagcacgtggcagctgatggagcacagtgggatatatctgccagaaatgcaaaacctgactctaatcattaggaagtgtcagacaaaccccaattgagggatgttcaatttttaaaaaacaaaactgccctgtaaccttttaaaatgtccagggcatgaaagtcaaggaaaaaaaaaacaaaacaaaactgaagaactgttttagataggagaataaagagacatcacaaataatgcaacatgtgattctggattgatctttttgctattaaggatgttattgggacaactggcaatatgtgaatgagttggggataaagtggtagtaatataccggtgtttgttgcatttcagtgcttgtgttacgattatgtaggagaatgtccttgtttgtagggaatatacactgaactatttaggttctttttggtgataaatgaagtttagtatcttttcatgtgatcattgaccatttatactttttttatgaagcctctatgtatatcctttacccatttttctattgttttggttatttttttctcattgattggtattagttatttgtaaattaaggaaattaaccctttgtcagttataggtattacgaatacccccacttaaagtttacaaataaatccattgatcttttcctcaaggacagtaagggattttgcttaattctgtttttacattttaattatttgctctaactgaaatttacattggtttaaataatgagataaagatctagctgtacattttttaaaatgattagtcaattgccccaacaccatataaaaagtagcctctctttttcccacctttgaaacacaacctatatcacaatctaaattctactttattttgatctacttttggactcgattctgttcttaactatttcttctccagggccaaccaaactcttttcattaataacatgcttcggtagagtattgtccaatagaaccgtctacaatgatgaaaatattcactgtttactctgtccagtatagtagccaccatcacattgagcctggagatgtggctagtgtgactaaggacgtgaattttttattttataaatttctaattaatttaaacttaaatttcaaatagccacatgtggctagtggctaccatattggacagcagagttttattatcttactggggagtttctacccattctttccacagttttccaagatattctcacacgtttatttttccttctcataagaaatctagactttctggttttccagaaaaggtcacattgaatttacagaacactttgggtacagttgttatacttttaaagtatgacatcattaagccttcttttaagtctctcagtagagttttaaagttttctttatataaatttatacatcatcttttaaatccattcatatatatttaatctttttttaatttttattttgttttatttgtttgctgttgtaaatggtgtacttatttcaatgtcttttactatattttctcactgataattatttatatatagtgcagctatgtaggtatattttgtaatcttttgggtaattctctttatgttttcaggttgttgtaattcttctttccagtattcaaactttctagttatttctcatttaacactgttggctgccatttcaatggcagttttaagtagttgtagcaatggttaggatcctcgtcttattccacactttaataggtatgttttagcattttatcattaagcttcatgctggcttaaaaaagaaatctgtcaattcttgccttaccactgatttttaacatcagaaatgaaggttgacatttgttaacatgcctcttctcctaccttctatgtaagttatataatttacctcctctaatatattactagtatatattaatttgacccatttgtaatttttttttatctacccatgtattcaggaaataaatgccactcagtcacggcattttttttttgtgcaatgtactgctaaatttctttggtaattatgtaaagatttttgtaatattcaagataatcatctattttagaactattctatcatctttcagtgtcagtggtatgctgtcattatttaaaagaattttggaggattctttctataatagtttaaataagcttaaatagagaaatatcattccatggaaagtggaattaatttgcttctaacgccatcttggcatggcatatttttatgttaatttagcaatagctttaatagcatgcattgttatattgttctgttttctgtctcttctggagtcaatttagtagattccattctccttgactaggttgatcctgatatcattaatctaatgccaaatttagaaagaggatgttttagggaaatatgataattttatttctagttctgttgcatttaagatgctcatgggacatcgaggtagaaacagccaataaacaaatagaatatatatcttagagctatttatgagcaatctgggctggaaaggtagccacatgcatgactgtggtggttaatgagatcacccaaggacaacataaagcaatgacgagtaatggcccctggtggaaccctggaaaccccaacatttaactgggtaggaagaggaaaaggcttgagaatgacaggagagacagaaaagtcaagaataaaagatcaaaatctcccaatgcttcagaaaggacaaatagacaaatactgaagcatacccattggatttattgtttaggagatcaacagtggcctcagcaaaagcgatttccaggaagtgtttgagacaaagcctgcttttgggtggctgtaaagtgcactgaaggtcaggaaccgcagcagtaagtgtaggatgtgctcatcagaagcccggctgggaagagaaggatccatgagtcttaagtaattttagagatcatttttcaattgaacacatgaaatgtagacttttccctcttttctgtgtccagaggacgtgagaaagaaagtttttcctgtgttgtctaatagagagctggccgttgtaaagagcatctggggacagctgccttgtcatgcactttgagggatctgggacaccagggtgatgtggagatgtgaaaggagggccataaagcagtgtctgtccccagtggagccagcaccaagggcaagggctggaaaccgaggggcttgcacatcaccaaggaaaccaaggtggaggaacttagacaaaaacctggtggaggatgggcagaagacagtaatgaaaccatcgattcacaggctgctctcaagagaaaaggggaagaaaaacgaagaggaacacaaactgaaggcaggatttttaaggaaatatttacaaatgcttgaaaactataattaatgtaaagcaaggatagctgataaatagaatatctaaaatgcaaatgagagcttaatggcttagaaaaatcaagttgagtctgactacttcacccagccctcaataaacaccatccatctacccttcagcgcacccagcccccgtacacacatgcgtgtgcatacatatgcacatgtacacacaacgcagagatacaactttatcatagtgtgagatgctgtcgtatttggcaacattgctatattttcccccaatttgctgtccaatttattttaattatttatatttaggaaaccctcttccaagaacaaaaccacctattatttaaggttctgctgtctttaactagcactgcaactttacaatattcaatgtgcttgctttcaacttgcattgtctaattaaatcctccaataatccatataaaagcaatgatcgtttatacttgctgtatctacagaattacattctccatgaggaactttgaaatacccacaagcattccaccagcacgcctttgcaagtgaatcttcccaattttcattcaaaacttccgttgagtcctaataggactggggtctgggcacaagtgtgaaagactctgggatgggcagaaccaggcttggcgatagaggcttagcctgactaaatgaggcctgggaatgtaccgctccctgcagaagctaggggtgcagcccgattgttgtaggtatgatgcccaaaggctaaaacaagctcctggcaagcaccaaaggaaagctcagactcaggaaactcacccccaacgggagcccaatcccaacagagcaggtgataggcaggtctaggcatacgccagtccctggacaggaaggccagggttccaggggaggcccagtcacagatacaaagcccacgtccacgcagtctgctcaggaggggaggaggggcatccgctcacttgaaacctttgatcatgattctcaaataggcaacaatctttctacataccccgagggtaggggttcccggggtaggggtccccagcccccgggccatggactggcactggtctgtgctctgttaggaagcagctgcacagcaggaggtgagcagtgggcaggtgagcaaggcttcatttcatctctatttagggttgctctcattgctcgctttactgcctgagctccgcctcctgtcagatcagcagcagcattggattctcacaggagtgtgaactgtgttgtgaactgtgcatctcagggatccaggctgtgtgcaccttgtgagaatctaatgcctgatgatctgccactgtctcccatcaccccatcacagatgggaccatctagttgcaggaagacaagcttagggcccccactgattttacattatggtgaggtgtataattatttcattatatattacaatgtaatgattatagaaataaagtgcacaatcaatgtaatgcacttgaaccgtgaaaccctccccgacactggtccatggaaaaattgtgttgggtgagactggtccctgatgccaaaaaggctggggcccctgccctaggaaattcatatttgcactcttaggggtgttgtattcttcattctttgcgaataaattagcttcctcttctccaaaagaaaacagaaactatcacatgaagactagcacatcttcccactgaaaacttttatcaacttacctctctctgtcctcatatctcactttccctcctcgtatgatggatacagcaatctctgtgcagttatctaacacagatagatgctgaattctggctgtactgaattccatcctctgttatctacccaagaagttaatttctataattattccactttctactgcaattttcatgctagaaataaattcctttttgcccccacatccccttatgggtattgcctcttctctgcttctctcttcaacagaactccttccaagggctatgagtgctttccatggccacgtcctcaacactgaccccgtcccctctgcaacccactccagttatcttctgtctccttctctccattgaaatgcctcatgtcagggcccctggcagccttggtgttgccaaacccaaggtcctgttctttgtcctcctcttactcaaactcccagcaacactcaccccaaccatctgctctgataacagccttgtccacctgctcctccagctcctcccagctcacaggtcgctccctcatctcctgggctggctcctcctccctctgccgcaggggcagggctcgggctaccctcttctccagctgcactctctcaacatgtatatagcccagtggatctcaacaggggacagctttgccctgcaggggtcacttgacaatgtctgaagacacttttgtcacaaggtggggagatgccgcaggcattcgtgtctggaagccttggattcggccaaatatcctccaacgcacaggacagcccccactgcgcttactccgcatagaaggtccacagtgcctgttctgtccagcaaccctattctagtccatggttttaagccattttatacacagatgacagagtcacaggttgatatgcccagctctaaccacccctctaatttgtatgtccaaccgccgcctcactattcctatttgaatgtctaaataggtgatttagaattaacctctgacacagctcttcattttcctccaaagtccactctttcttggccatttccctctcagccaatgccaccagttatatagaccaaagccctaaaagtcaatctttattcttctctaatccttataagacacagcccatccagcagcaaagctcatgggctctgccctcacaacccaccttaaagctgagcatgtctcacagtatccagaatgtgtcttcccaagccttcactgtctctgggttgaacttctgcatttgtcttctagttcttctccttgcatctattcttaaagcctgaaaatctgctttctatgcaaaagagttatcttttcaaatacattaatcccatcatgccattctcttgcttaaatacctcccaatggtttctcattgagctgagagtaaaatcctcctccccactgcggcctgcagtcagcctgcctttcccacctgcctcctcctgcagctcagcctgcctttcccacctgcctcctcctgcagctcagcctgaatttcccacctgcctcctcctacagctcagcctgcctttcccacctgcctcctcctgctgcctccctccctcctaccagcatttccctaagcctcagaaacaccaaggacatttcctatttgcagcctttacagtttctgctcgctcagcccggagcatcctggccccggtctccatggggtgctcaccattgttgaggtctctgtccaaacatgcttccccaaagaggcctcccctggctgccctatggaaaggctgcacaccctcctcccatatcttaccttgctttattttgcttcacaaaacacactgctatttgaaaccaagtcatcatctactatttaatatcaatgcattagctctctttctccctagcatgtgagccccagtccaagcaaggatgccgtcttttcaccaccacctgcccagaatccagaacagagctgcacataaaaggagctcccaatacatgcagagtgacttctgtgtcttctgcgacagatagagtcaggacagagggcgggggtgggggagtgcaggaaggaaagggtgtgctccatctttttagtaattatgctcatgctcacaaagcctcgtctgtgagtttttccatacattgtctaatttatccaggggtgtgctcccagtactcaggcctcttggcagggcattctgagacaagggacagaaggactgactgctaagcgggggcaagtggggctgagatgtagatttgcacacgccctctctctctccatagtagacctgagaacaagggtacgaggcaggagtgagagccaggctctaaggcggagaagatggcacagaaaagacagcgtttgggaaaactcacagaatgccatagagtttccataatatatgataaattaaattaggtaagaaaattgcagtccagtacttaaagtcaaagaccactttttgaaacttccagatgtgtgtgatttggagataaatatttgcatatctttcctttaattatgtttttttaagagagtatgtggagaagttaaatactcatgattgcacgtaaatgttaccaaaagtatatggaatgtctaatcatcattaataatggctaaactgtattgcatatttaccaagtaccaggaaccatcctaagagcttacctggatttctttgttaaatcctcacaacatccctatgaggtaagattcattattgtccctgtcatttgggaaaggaagacctaagcttactgatgttatgcaacttgggctctgcatcactttgctgtcttgttccagcaatttcacatgagaggcaagacacagtgagaataaatcatatagttcaggagtaaaacaagctttagtgtctgcagattactattttaaaaatcctaatggaaatcaagcattttgaagacaaaatacataagaaaatactgtagtggtctgtctcagtcatctagaaagcatttcattatcttggaagtaaatggcacatgataaaataaatactctatttccccacatctggctcagcatcgcagttttcctagttatttgttcctgtattcccaaataaaacagagtccagagataggaatcttcaggaagccactgggtccttagagtctgaatctgggtgttgcgggaaggttgatgccacttctcttccgtgcgggcaaaggcagtgagaagaaggagccaagctccctgcaaactttgtacacgtgcctttgtgccttgcctacacctcactgtgactctgtgaaatagacattactctttgattaatttcaccgtgtgcagctgaaccagtgactctcagggaggtactttcatggttgcaaagcacatcttacgttgaagctggaatcctaggcttccgcctgattatcagaaaggagggtatttgcagccaagggaactatttgaaaataaccacaactttaaataaacaagcaagaaaacataggtaaatgaataatattccaaagaatgccaaagatgtgttgtgtccctgcaagtgtgctgaactgtactgaactgaccaaagcactgcagttcagtgggcttgctgaggacccaaagctcaatgtcattcgctcactgttgacagcaaggcctttgcctattaaaggacttccctgccaggcacaggtgtgtattggagagaagagctgaggatactgggtcgtgggaccttgcacagccagactgttaagggctagaagaatattttctaatccgcagctctgggatctataaaatctgctagaaggtatgagaatacagacaggctgcaccctgatcacctggcgatattcaggtgcagtgcaggagacactgaattcagcagcagctgatggaacatttttcctaaataaatcaagttgttcaggtgcgctgaccaaatgacaaaaaactgtaaagtattttgtaaacttttattatagattacagtggtaattgaaaagtcaagaaaattaacccactataaaaaagatatttgagcatgtaactatatttacaagaagcaggttggaattctcagggacagcttgtggaaatgaaggtcccccatggtccatcgcaaccaaccgtgttcctggcgatgctgtgagggtgcatgagatgggagcttgcatccaaagaaggatgtgtgaggccgaggcgggtggatcccccgaggtcaggcgttcgaaaccagcctggccaacatggtgaaaccccatctctactaaaaatacaaaaattagccaggtgtggtggcaggtgcctgtcgtcccagctacttgggagcctgaggcaggagaatcgcttgaacctggaaggcggaggttgcggtgagctgagatcgcaccactgtactgcagcctgggtgagagtgagaccttgtctcacttaaaaatatatatatgtgaacaaaagcattgcacggaaaacacttttaaacacgttcacaaataacaaggatggagtggaattaatggccatcctaaaagagctgaagcatttgcccaatctgcccaagaaagaaaaattaagagatttgaaccactaagaaataatgtagattctgcagaacccaatattgacatcagataaataaacagttataagtattaacatatataaattactgggtccaaactgcctccatcccaagtaattaagagaattgactacaacatttcaaatgttacttttgaaaaatcatgtagagttgtagtaatatcagaatgccgtagagaaagttaatgattatgtagctcaaaaaggaaaagtaaatgagactgtaatattgtgattatttaacttagtgtacagattgatcttgccttaaataattaccaattaacttctactgaaaaatgtagtaggtatgattgtgtataacatacctagggaaaaagaagtaaaacaaaagaacattgaccgggcgcgatggctcgtgcctgtaataccagtactttggggggccgaggcgggtgaatcacctgaggtcaggagttcaagaccagcttggccaatgtggtgaaaccctgtctctactaaaaatacaaaaattagccgagcatggtggcaggtgcctgtaatcccagctacttgggaggctgaggcaggagaatcccttgaacgtgggaggcagaggttgcagtaagccgagattgcgccgttgcactccagcctgggcaaaaagagtgaaactccatctcaaaaatgaaaaataaaaaataaaagaatattaaggataaactaaaatactgagaataaaaatgtgtgtgtcccattgagaaaacattttctgagtgcccactgagctccacacacaatgggaaagcagaagaaggatggaagtagtagaagcttgcattctaatgagagtgttagacgactcgactgtaatgcacaggaaaaagtaaatgctataaaagaagaagcctaaatcaagggttacaggaggatttaattttggaagagggaacaggaaagagaaagtggtcagaaaaggcttgaggtagactgctttttgctggctttagcatgtggtgggctttcgactggctgaggaccagaagaaacatgcttagggagagggagctggtccacaaacaggcagaatggcatgcattatgaagatgtgccttgctaattgaattgcttttctaaacagtggatgaaaaataaagtagaaacagagtgattctgttagtcaggttccctggaaatgggctctgagttggagattcttgcacagaaataacgcctataagagactgagaatgctatccttatcaaaattccagtggcatttttcacagaaataggaaaactatcctaacatgtatatggaaccacaaacaccctgaatagccaaagcaacgttgagcaaaaagaacaaagctgggaccaggcgtggtggctcatgcctgtaatcctagcactttaggaggccaaggtgggaagatcacctgaggtcaggagttcaagaccagcctggccaatatggcacaaccccatctctactaaaaatacaaaaattagccaggcacagtgacaggcacctgtaatcccagctactcaggaggctaaggcaggagaataacttgaacctgggatatggagcttgtggtgagccaagatcatgccactgcactgtagcctgggcaacagagtgagactccatctcaaaaaaaaaaaaaaaaaaaaaaaaaagaacaaagctggagtcaccacactgcctgatttccaaatacactacaaagatataataatcaaaacagcatggtgctggcataaaaacagacatgtagaccaaatagaacagaatagagaggccaaaaataaatccacacatttatattcagctgatctgcaacaaagctgccaagaacataacacagggaagggacagtctcttcaataaatggtattgagaaaactggatatccacatgcagaaaaatgaaactgggccttatctcacaacatacaaaagtcaactcagaatggattgaagatttaaatataagagttggaactgtaaaactgctagaagaaaacataggggaaaactacgtgacattggcctaggtagttttgttgttgttgttgttgtttttgatataacccaaaaggcacaggcaacaaaagcaaaactagataaatgggattatatcaaactaaaaagcttctgtacagcaaaggaaataatcaatagagtgaagagataacctacggaatggaagaaaatatttgcaaaccaaaaatcctatgagttaatatacaaaatatataaggaactcaaacaatttgatagcaagaaaacaaataacccaatttaaaaatgggcaaaggatctgaatagacatttctcaaaagaagacatacagatggcaaacaggtacatgaaaaaatggtcagcatcagtaatcatcaaggagatgcaaattaaaaccatgatgagatatctcttcacacctattagaatggctaatatcaaaatgacaaaagatagcaagtgatgtggtttggctgtgtccccacccaaatctcatcttgaattttaatctccataatccccacatgtctagggagagacctggtgggaggtgattggatcacaggggtggttaccctcatgcagttctcatgatagtgagtgagttctcacgagatctgatggctttataaggggctcttcctccttagctcctcactccctctctctcacctgccaccatgtaaggtgtatctcttccacttctgccatgactgtaagtttcctgaggcctccccagccatgcagaactgtgagtactttatacattacccagtctcaggtagtatctttatagcagtgtgagaatgaactaatatagcaagtgtttgtaaggatgtggaaaaagaggacccttacgcactgttagtgggagtgtaaattagtacagccattatggaaaacagtatggaggttcctcaaaacgttaaaaatagagatactgtgtaatccagcaatcccacttctgggtatatagatgcaaaggaaattaaatcagtatgttgaagagatactgcactttcattttcattgcagcattattcacagtagccaagacatggaatcaacctaagtgtccatcagtcgacgaatggataaagaaaatgtggtacatatacacaatggaatactattcagcctttaaaaagaaggaaattggctgtgcacagtggctcatgcctgtaatcctagcactttgagaggctgaggcaggaggatcacttgagtgcaggagtttcagaccagcctgggcaacacagcaagaccctgtctctaccaaaaaaacaaaataaaaagaaggaaatcctctcattttcgacaacatgaataaacctggaggacattatgctaagtgaaatataccagtcacataaagacaaaaactgcgtgatctcactcatatgtggaatctaaagtcaaattcatagaagcagagagtagaacggtgtttagcaggagcctggggaaggaaagcggattgggagatgttggttaaaaggcacaaagttttgatgagacaggatgaatgagttctggagatccactgcagtctggtgacgctggttaataataatgtatatttgaaaattgctaagggagtaggtcttaaatgttctcaccacaaaaacatgagaagcatgtgaggtgatggatatgctaataagcttgatgtaatcatcccacagggtatggcgtacatgtgttgaaacatcacattgcggactgtaaatgtatatagtttttatttgtcagttaggccttaataacgctggaggtgggaagaaagaggaagaaacggctgggcaggagaggttagactgcctggaggaggtcccaggcaatctccacttgaggccaaggggctggggctctgtgcctatacattagccagcccatgcaggctgctggaggaaggggtaaccttgagtgaagcagctcctgtctgaggcagagggcaattcccagggtgagacccagccatcggtggctcacatcccagtgcctggggagaacctgttctctaggagggttggggcagtactcagcagcagcctccaccgtgacccatgatgtagtaaaggataaactccaaaaatgtttgaaagtgtttgcatcattgatgtctattttaattaaaagagccaatgggattaaaaatcatggtaaactgatcctttgtagttcataagtgtgatgagtaggatttcacactcatgtgtgagatatgcctccctcaaaccttataaatgatgatggtacgttaaaaaaaataatggtaaaccacataagattccacgggaatttttgtggcatgtaaaaacatgacttcctgcttgtattaggccattcttgcattgctataaggaaatacctgaggctgggtaatttttaagagatttaattgactcccagttctgcaggctgtacaggaagcattgtgctgccatctgcttcccaggaggcctcgggaagcttctactcacgatagagggcgaagtaggagcacgcacatcacaagatgaaagcaggaacaagagggaggtgggaggtaaggtgccacgtacttaacaaccagacctcaccagtactcactcactagggcagggatggcacccagccatgaggcatccaccccatgaccaaagcacacctcccaccaggcctcgcctccaacactggggattccatttcaacacaacatttgagcgcgatcagatattcaaactatagcactgctgttctaatgagttagaagttgaagatgcaccaatatatgtaacggaaagataacgagaggactgtaagccattcccatgggtgtgccgtccttcatgaaggagcagagccagcagcctacccatcgttacaggacttgcactgagccaggtcagcaggagcagaaacagctttatactgatggggactacaaagctttaacacccaggtccagcaaacattcacccttacacccagaccctcatacacgtttgcaagactggacaagataggtctgcctgttccattgagacgaactgccctccctgtggcgagaatgaaacccacaacttgggtgttattagcacagcctctcatcaaattgacaccaccagccataggttatgataataagaaaataaggcaaatgcagctaagctgatatgtccaagtcgaaaaaactaatttcagcttagaaaaacagcacactaatgaagcttttaaaaattaacttgtgattaaagatcatacagacaggcagtgttggtgaaaaaccacaatgaacatcaaaacaagcatgagttcagagtctggaaatgtatccagaaggttattgtttttaaatatacagagaagacacatatatttgtttcctgtttaagatatatatgtatattagaaaacaagaaaattatttttttttcaatctaccactaatcagtgtgacaaaaatccatgaccctccaggaatttgaccagctctccaggcaatggattcttcaaatgagagcaagttgaagtacttgtggtatcagaagatgtagtcagagtccctgagcccagagggtgttcttaatctacgcctgaaaatgattgaaatggacatcagtggaggcagataagctttggaaatctttaagcaggcaaaaaaaaaaaaaaaaaaaaaaaaaaatggaataagtaaacctagaagagtacctggcacacagcggaggctcaacatgtgctggattaattcattaattcattcaaaattatgctggcggtcagtttatgacaaatagattaagatagtgcacgggtgcacggccattagagtatgattagtaaaccaactttataccaaagaattcctttttatggaaaaagtacagtcacttttttaaaactttcggcaatactgcagaagtaaaggaacgatggtgaacgatcatgattatttttgtaacatttcccaaagtaaaaatttcagctgaaaataaaaagaaacctttataaattggaataaatgcagactggagtgattctctagcacagtgaccaacatttggacacatcacataagtcttaaaggtcgcagaatgagtctagttatatatgtttttccattccagacagcttgaaatttactgtctaattcaaaagtccaaaactataaaactcctgaaaataatctttccaaatgaccagtttactttctccctggacctgaaaataggatggaagggaagtctaattctgagaaagtagaatctccttctgatgttttgtttataaaaatagtaaacattttactgaaccagaaagggctaaatttcatatctcaatttaaaagtatttgcaggccaggcatagtggctcatacctgtagtcccaatgctctgggaggctgaggcaagaggatcacttgagtccaggagttcaagaccagcctagtcaacatagtgagacccccgtctctacagaaaagtaaccaggggagaggtggtgcacacctatggcactcagggggctggggcaggaggatcactttgagcccaggagttagaggctgcagtgagcaataatcgtgccacagcactccagcctgggtgacagagtgagacctctgccttctgcctctaaaaaagacaaaaccaccaccaccaccacaacaaaaaatccagtatttgtgatccctttcaaagcactgattcttctgcttctcagagcactcagattgcatctgatctttgcttgccagaatcatcattttatggtttagcaaggagttgtctgcaggctttgctccagtaatggttccaaagacattcagccacagcttgaataacctgcacctgagcacaaatgtggcattcgtagtcaagcaccatcgttccccttcagttagttagtctcgtgacttttttaagtagtaattccacacctgtcaaatgctgttggaagagacccttgaatagttctaggagaaccctcctctgggaagaaatttgggacagaagaatttttcttaagaaggaagaaaagatggatgaggaaagcgctgacttcctctcatgaggaccaacaggctccacaattcctttagcggcagttgtcagcaagatgcccagaactgtctccaggcgacagcagaggtcaatttcaggtccacagagtcccactaacctcctataatttagaacctaattcaattgtaacctgatggtgaaattattcaacagtttgcttctgggcattgaaataaataataaaaaacagcaaatttaatactgccattgttgacattctctacagtggcatcagaaacgcctcaaagtcctatttacttccaagtggccatcttcatagtacattgtcctttgtgaaagctctttgcaaagagaatgtacgtctatatatgtaacatttgcaccatgcattacagtttttaaagagcttagcaaatatgaatcttctttactacacagcactcctttaagataaagcattcaataaccaatttttaatctcttcattgtagcacaggtaactgtgtccttatgttaggaaattatgccccttagaataccagttattccaatttatcagcctaaaatgtatatggagtacttactgtaagtctacatgcatagaattttttagtgtaataaaatattcactatttaatggacaaaacatccgaaagagatcctactttctcagaattagacttccctttcctcctcctattttaagttccagggagaaaataaactagttatctggaaagcttatacttagtggagttttatagtttcgacttttgaatagacattaaatttcatgccatctagaatggaaaaacatatataactagactcattccacggcctttaagacttatttgacgtgtccaaatgtgtccaactatgtgtctatatgtctgtttattgctgatggaaacagcaacagtaattcaccttcaaaatccctaaaacgtggttgaataaacaaatgaagaacgcaggatggtgtgtaatgccgaactgctgtaggtgcagagttagggagggaaaaacccggaaggttatcagagcctccaacattcagaaaagacttcctggaggagagaggccttcaattaggcctcgaaggacagtatttggagagagaggaggaggtaggtaaggtgtccctgccagtaattacagcctcgtgaaagaagcctgcgggacagaaatgaatatggtattgagatggcagaggagagaggtcaagggtgccacaatcttcaggcacaactaagaagatccctgcaaaggcaacggctcctctgggccagcagagaaagtggagaccccaaacaggggctctcaagataggatggggctgcggctgggagcggcaccacctttgggaggctggcaaggtgggcaggcccacgggggagccgtggcttgctggctggggtttctcctgccagcagcactggcgtcctccaaaattgcttcctgcggcttttctatttctcttaacttcatccactgtcttttcttatgtcctgtgacccactcactgccatgccactgaaaatgctgttagaacaagaaaacagtagtctgtgtcatgttaatcacatcctgctcgaacatggccagagttccctgcccataccctttataaagcagtggacagtccccagatgggcttgctggaagtctgcaccggcgctgcatgcaggagagccccgggctgctctgaccacagtgacatgccgggttgtcacaccctgcacggatgcagacaattccatacagatggatcagcaactttgcaggtcttcacaactatgagcccagatccgctgagccaggatgcctcagcaaaaggtgacttcacatagggtggcttgaaaaggcaagcaatcctggctgactgcatgccttccccaggaccagcacccaccaggtgactccttttaccctcaacaaactccatctgccagtcagagccccttatccatgagcttgcatagtttcagaatcactctcaacaagcagagatccatttgcctctctgaggtgggaccatacaggtgcaagagcctctccagaccactggctgcaggttggccatgataaacagcctcacccaagaatgctgagcacgcagttactgtaggtaaacaagtcccggcttcactctcagctggagctggcactacgttggtatttatgtaatgctgcattggcagatatttcatctgcagtatatgttgaaatggacagataattatttagaacaaataaaataagctacttctgaagatgacttgaagtgggcactgacttgctgggactctcaggccagcctctaccacccaaggcagctctctacagaacacaaaggtccagcctagaagggagtggctgaggtgagtgcctcaggacaagccaacacagtgatgttcattccaggaatatttatgatgaagagaacccaggagagctgaagattagcgtcacactcttataatagagaagagttcacctgcaccaggtgccgtgtcccgctggggcctggctactccagaggctcctccgctgctgcaatgtgcccgagccccaacctgcaagtcctcctggtagagtagctcttagctccagcctgcgtgtcagaccaacgcccacactttgtccacttcttactttgtttagtaagaagggaagggaaaaggaagaaaaagaggaaaggaggaacaaaggaagaggagaaggaagaaggcagtgcagtaagggaagggaaaggtgggaaggtgtggaaataagaagcagagatgagaaggggcagaggaaggtggctctgtggtcctggccttgttcatggcaaaacacacttatactttgagggtgttccgcttccctaaggcacaccggggaaggtcaacaggttcctgtggaccagcgagaagaggagccctgttcaggaacagcaggcaataggaagagacaaaagtgattgattccctgaggtgccagagcaggaagaacagtccaggcatggcctgagagcagagcaaggtaaagagcacgcctcacctaccccccagctcacgctcccaggaggaggccctggccctgcacagccagcccctccacccctcctccaggagcctccacccccgaaaccagccctcagccctctcccaactctgctcctccagctgaaatactgcccctcacaccagggccgcatccctctgggactacagctggagtggccctgccagtgtagcaaagggcatctctggggaggagatggtctcagcaacttcaaacacattttctgttaagttttctcttgtattgtgatgttacagaacacgctcagcaggaatttgtcccccaagaagtattctttgctgcaatccatcttcaattcacaatgggaataacctgctcactatcctttgtatttttctcacctactttcatgttttctacatctctgttaggagatttaaattatttagggacaaagctgaaggtgtgtgaatggatggatgaagagatggctgaactgattgatgaacaaaaagttcacctgccagtaaaaacagaggaatggagtagaatgcaggaggccggaggctgcaggggcattttacagttgacctagatggtaatttggagagagagggagagaaatgacaccagccttgaacttgagagatgccattttctaaattaccctgtgtggctaaatgacttttgcatgctagcccaaagaaataactgccatgcatttcactgtgtgagaaaacatattatgagttcaagaaaataagaggaaacattttaacatcaagatgggaagggataaagacagtccaagaggccgtggagggggcaggatacagctgtccacatgagaaatggcagtgacttctttgtgttaggggcagaggagatggagaaaatggaaatatttgaaaaatattgaagacatataaaggacaggtcttaataacacagaattgtgagtgaggaagtaggatgagtaaaagataacttctggatttctgttctgaaaacaaaattctggaaggggaaatggaatgaggagcacgtttgtagggaaggagggaaattgtaagttgcactgtccttcattgttaagatttcaccaaatgagagacattcaaatagaaatattccctaaataataagacattttgtcttggggctcaataagaaatgcctggtgggaagtaatagattttattcagccatttaagagtgttcaggtcttgggggataactatcatcattaaaggaagagtactcttgtcattaatgatggagatggtccatagaaagtgacacagagcagggacagaagatgatctagggtgcagttctgagtctcaccctctgctatagtttgggtatggtttggatatagcttgtttggcgctgccaagtctcatgttgaaatttgatctgcaatgtttgaagtgaggcctggtgggagggtcatggggggtgcagatccctcaggaatggcttggtgccattctcaggggagtgacttctcatgggagtgggtgagttctcactcttagttcctgcagaaactggttgttgaaaagaacctggcagctcctcctctcttgcttcctctctggccatgtgatctctgcacacaccagctccccttcgtcttccacaataaatggaagcttcctgaagccctcaccagaagcagatgctggtgccatgtttcttgtatggcctgcagagccatgagccaagataaacctcttttccttaaaaattatccagcctcggcattcctttatagcagccccaacagactaaaacacctacatttaagggacagacggctcccaaaggagaccaagcagatgtagccacagatgcaggtcaaaaaccacaggagtttacttctatgggcaccaaaagaagaatgtgtttaaacaaagagagcagagtcaaaaatttctcttggaggcaaagtaaaataaaggctgaaaaatgtccattgaactgagcaacaatgctgtcttgggtaaagcagttttcatatagaggtaaaacagaagccagattataatgggtaaaaaaataaatgagagttgaggaagagagcaagtacaggcaactctttttaaaaagttgattttgacgaaggaaagtggggccaaatgttggtaacgttttgggttagacagagacttgctagttttaagacgaaaagacacgactatgtttaaatgaagaaagatatgagctccatgaaactgaaggtacaaaaaagaaaggctataatctattgtacaagggccctgaggaggtgggaagacatagcggaagaatttgcctgaaatgagaaggggctcacctcttccatcgtaagccggctgaatgggagttgtgggcatgactcgagcagttcagacgcaccacatttcctgctgctctctaatatccccaaacctgtcatatttccccttttgcatgtgacagtctaatgataatcctgaagcatatacagatatatttcttctccattgataaagcatcatataatcttctggagacacaggctccattaaaataatttctcaatttccccattgtacgtaactgccttccatgaagcttgccactaaaatgtcacttgactgagaggaggtggtgttggtgactagaaaatgtatgtcttgagagcatggtgttcttttacttgtggaatatgaaatatctgcttccaaattcctcaaggtccttctccttggagaaggggttttcctcttgccagatcatgccattcatcccctgtgttaatgtctatagactagcaaggaaatgtgcctaaattcaacagcttgccagcacctaagagaaattatcagaaatattgtccacttcctcttatacatttctctctggaaaattttttcaatttcacaaggttttatcatctatattatagggatttgtttttaattcttcacaatttccttacactcctccaaaggaatctttaacaagtacagttctctttttcaattctgcccttggtgagtcaatttatagtgtggtttgatattttattattgtcaaatattgcttataagagagaggctttggtttggtaacaactaaacactaaaaaagaaaggaaaaaagttgttttttttgtttgtttttgtttttttaaagagaggctttgggaaaactggcaaactttctgctcttccaaaggttacttgttatatgactgatctccaagcatttatttatctgaaaaaatctgtttgtgattctgcctatgtcagggcagcaatggctacaagatactttgaaagatggtgggatatgccacacagggtatggcataccctgtatgaacctcagggtaaatcatgttaaatagaactgttctcctcccatctgccaaagcacatttatttttcttcaaaccaaaatgtagtttgacctccaggtaggtttcctaaacaaccctgcccttctccattcctcctagtgccaccttgagctggccttcttctgaatactctttcatttattggtaattgtgactcacttatgtatacttatgctttgctagcttctttccccctttggaaattaatctcagcagaaactgagttgaatctcttctacgtattcctaagcatagctgtcctttgagcactccataaatatttgtctactgactggttgaagatttagtctcacacaagtgcagatgaacttcatctcattttagaactctgatgggaaatatgactgtgttacacaagattccgggtcttttcctaccctcgggtgaataaagagccataatcaattacaaatgtctgctatgggactgaaaagatggcaagaagaggtggagactgtgccgctgtaccaagagtttgccacttcgttttagtggggcattgaatggttgattgtattagtccgttttcacactgctataaagaactacctgagactgggtaatttataaagaaaaaaggtttaattgactcatagttctgcaggctgtacaggaggcatggctggggaggcctcaggaaacttacaatcatggcaaaagctgaaggagaagccagctcatcttacatggcttgagcaggagggagagagcaaagggggaagtgctacacacttttacaacaaccagacctcatgagaactcactatcatgagaacagcaaggggaaagttccgcccccatgatccaatcaccttccactaggcccctttcccaacattggggattacaattcaacacgagatttgactggggacacagagccaaactatatcattgatggtttgatacaggcttttgagatacgtaatgtgtagatatttcctttaattacttagcatgatgaatttcatcaaacctaaatatatatcagtggtttgattggctagttggtgggtggggtttttttggcagggggtgggtttaccctccatttctttagtctgacagtataacttttggtcacgtgattgttccataaaatatattgggattgcatacatcctaatttgcagtaattttattttcttgatagacacagtcttctgtaaatggatttttatcttagcaagtattttttatatacatattttctaccaacatagctaatttgactagatgttattaaatagggagaaaatctagctctagttcatgttttctcttgcttaaggaaaacaaaaatgctcaacttttgttgaaaatgaatgtaaggccaacggtaacattattcaaaatataataatgtcctttttaagataaagtaaattggagttgtctctttgtcaccccagttactgtctctaaggccacatttctgttctcataagataggttatatgaaaagaaattgaagcaccataaattacattagtgtaaggtcacaaattaatcactttataacctattttctcttgaaaactctttctttatagaagttctaccagaaaatggctcacactattgaacttaataggttattactacatgttttgctcagtattctaagccaagtcatcaggaaaagattatagttaccagttcccattgtcctgtttgacatcaatgaaaagatgctttacttatattttcatgtgttatttatcctgtcagaagatatatccattttatatgcagctaaagttcctggggcttttcattaatcaactaaacacaggatgtgcttgaaggaagagctgtggaagggagtattgccccactgtggaagggagtgttgccaaacccttttagtaaaactgaaattatattttcttggttaactgaaaaagaaaatgttaatgatggtgtggactagcatcagaattaattttactctacaattgaatttatggtcaaagtgtcatattcctattatttaagaatgttttgtattatatcttaaataaaatttattagctgaataaatatttatatgcatgatataatggaataaaagagggagcaatggagactttatttcaataagtgagttttatatacaacagtaaataattaaatccaattgattccagaactcataaggcacttcttttataaggataagtgcagtattggtgttagattgagtctataacttataacagtatcatacttgggaggaagaatttgaatagaagggcagaacagaatttgaatctagttcaaatgagagaaaatctttgtaaagtgctggcataatgaaggaagaagtgatttgacattggcatagattctctctgctgtcaaagatctgaagaagtcgtttcatcccactgccccacatggggcattttagccagttgactgctggtggtctcagacaaagaaggaacacgttcaacaccaccatcaaggactttcgtagtcttgattcttagactttgaataactcttctttgagttctattaacattcatctttatttttctcagtattgtagaatagaatgtttagacttcccagaatatttttttctcatgtaaaaggctcaaaaaaatggtgtctcttctgtatttctatcagtcactctttcttctttgtccttcatacttgagttaatccatctcatgcttcaacctcacttttggcgtgtaatcacccatgttgttttgctatctctgatgatggaagtgagtttggtggaagcaaagatggcatttgtctgtgtctatatccccaactactgacctagtggtcagcacttagcatgtggtaaaagcttgtgaaagaagcgtttcaaagtttagttccaaatcccatcacctcgataaattactgaacaaggcacttattctttttgaatatttttctcatttataaaatgaggctaatgatatcttctctctgggttttcatgacaagcaaaataatgattgagagatttgtaccatgtaagatatgattatttttctaaccttcaactggaggaaattctgtcaacacacggttttaagtttccaagtagtatatttctgtgcattctgttggcattcaatacttactgcccactgaaatgagtcttcttcttttatcataatattcttaagatgcttgcctggcgtcttggtttcaaggaccacctctataagagactccacaatctacacttcaacacttgatcatttacctctgcccagaatcatgtctgtaagaattagctccatcagaatttcgtccaggagtccctaggtggacaccttgctgcttctccctgctacaactcaatctctccaagtgcaacccctgtccttcttaacatcacctgatggtgtgggcacagctggctgttcattgcccctcctgctcccacggctgccccaacccctacacacacccacaccccccacccctacacacacacgcacactcccacatacacacacacgcacactcccacatacacacacactcacactcccacatgcacacacactcacacctccacccccacacacacacacactcacacattcacactcccactcccacccctacttctacacacactcacatacacacacactctcacactcccaccccgacatacacacactctgacacacactcacactgtcacacgctcatacttccatccataacacactcacactcccaccccccccacacactcacactcccatcgtcacatacacatacacacacactcacacccccatgcccacatacacatacacacaccctcacccctacttctacagacacatacacacacactcacacctccacccccccacacacactcacacacacaactgacgctggctcgcgcacatgctattcccagagctctgcttccgagacggtggtggctccccggggccgcacctgtgcctccgccgggcctgtggggtgagtgggatgctaacgcctggccttggagagagatgtctgggaggaggagggggggacgtgcaagggacgattggggggtgcattaagaaagaaacccatggaatatgaaagctgtgacggggacagaaaatttaagaaaaagcagaaattttgtttaaagatttagggaaagtgtggctgtttaagagacaagctctgtactcccgtcctcgtgaagacttccataaaatctatactatttaaagctgcttttggtgttgagtgttggagtctgtgagtacagggtgaggtcacggggtccaatggtcgccttgcctgacgccctgtggggtgactcccacctccttggtcccctcctcctcaaccacctggctgggagagggctcgtaccctcctgctttgggctgcgttctcactttcacccagacctcacgctcctaaacacctccttggatttgggcacatacgcggtggggcctcttcagctgtagagtcattaaccctaaactccttgttcatggaatcaacagccgactgtgccgtcctcaccctcggggcgctgccctgtggagggaacgtggtccattccggagcgcagctctgcccatgtttgcccggtgacctcgaccagtatcccccctcaagtaaacgagggctgcatcaggcttccctcctcgcccgtagcaaggggcttgcccttttgcttctgcaccataaaagcactcatgttccagaaagacttctcataacatctgcttgaaattttactccccaaaatcggacttttcttactaatttctaattcttctcaaaaggcaactcaagtctatgtgacatatttatctgccaatctttctccaattcttaatgtaaattatacagaaaattggtatttgatatttttcggcatgtttcctagtgaaagataagattttatataccatgtaaatttcattacctgagagaggggaagaaaaaaggtgaaaggtactgctgaacctgtacactgcaacagtttaatttaaatttatgatatgctgtcattggggaaaaaatcagtaaaatatctgaatgttcacttaacatattttcaacaaaatctcatttttttctcctcaagtctttatttgatttacacaccaagaaaagcagaaaggatggcaggttcaattacaaagctaagtcttgaactttatgttcatttcgcttttaacaggtgtgtgtatgtaatacgcagcccttccgtgatcatctgacctggccctcttgggagatgtggcccaggctccaggagccctcataccctgcactgtttttacacgatacatgcctggggaccagggttttggaaaaaggacctggagggctgagctggcagctgaaaaggcagggtaccaggagccacccctcaatgggctagggctagggacagagctgggagccactctacagtttggtctgggtagatgtggggggtgatctgagttgaggtacatgtttatagcttttgaatggagaaggtaggaggttgatttctggcaaccagttgagaaccatgaagcgggtgtgtagaaggcaaaaggggaaaaccaggtgaatgagaggccatggtaaacccaaagggggggcacgggctggggatggaacagatgaatccattctaatgccaagtccagcccccgtctggcattcctgacattcatacccatttgtgagtaaatctggcagaaaagaaagtgaagggggagacgtgagggtgggctcagactcaaaaacagtcatgtcactgcctaattgcttttatccaagttaaaacaatttttttaaaccaatgatgttagctgaggcaaagctctttaaaagaaaaaaagatttttttaaacttattgagctataatttgttactgttttcatccatgcaacaaaaaacttgggatcaaacattagaaaattaaattaggttcatgcacaaccaaagatcttttctcttgccctatggacctactgagtcgaaattccattttccgtctcctcacagcatttcagagaaatgattatcatctgatgaattgcactaaaagcaaatcactaacagatagatcagcaccattcttctattaattaatgccactgtgtgttgtgtatgtaacaaatgcaaattatcgcatagggcaacattgattttcttttccatgcattcctcagtacaattcaaatgtgttttggaaactgccctggactgggagattgcaatcattgtagcattttcctcttgatttataaggctcaattatctttctttggttgtatgaaatgtcttttctaataaaagagccaaaaagtgagagacagcatttctagcaccaggcacagaagggtgatgggataatatcaaatttcctatggtttagcaaacattgacaaataggggaaattaggattgctcatccaatatgttttggcctcaaaggattcagctaataaagtaactagaaaaattaaatatgtgtaagccacagcacctttagaatacttcacagattaccgagttgtgtcatttatggcaatgaatgtttccaggctgcaagcaaaaaatttatttttcactttacttgaaaagaagatgatgcctccaaatatcacagggaattgtttcttttgtgtccaaatgagttgagatctaaaccaacatttaaatgggcttcaatcatgaattgcaaaatgcagttgaaatgaatattgttttgctgatagtttagtctgaaagcaattgtctttttccctacagatacagtgcctccttcattaagtgacttttagttattttttcataacaggccattatttgtttgaacaaataaattaacctggggagaccaaccatgacccgcattggacttttctgcctgtaagcaaggcgtggtccaggagtcataggttacgtgatgtatcactggctggtgccactgattccactctgagtactgaagctgtgggcctgctattaaacaaatgtcccgaacacccaagtctccctgggcccccagctggctgttgctgacagtgccacacagtcactgtgaggacagaagttccacggggaaaggggaggggcatgtgcctggcaccaagttatgccttcagtagaaatgtgtccagcgtgtgaatgttcacgtacactctgtgtttgtgttgcccagtggtacccaagcgtatgcctgcacccccaacaagcttcttggggttttcattaaggacatttccaagctcccaagtcacttcctgtgtgtgtcagaagtggctcttttcatttccaagactgtgtagctggttggcatctacttgtacctacacgcccacacacacagcaggagccgcgggatggtggaccacccctcagctcctcctctctgggtcctcagtcaccacctaacccaccccagtggtctcctccaggttctggtcctgtctgtccatccgctgaaaaactgaagatgcttagagtctaaaaaacttgagtgaaaccctgaaacactaacctgatggaaatttattatctaatttagaagagaagcaagtgtcttaattgtctccttgttttaaccaacagaagagatttcacctgggtctccaaggcccagctgctgagacttagtaactgaggctaagaagctatctcaccctggttaaataaacagggtccgtgattgatggtgtctgtacaaaaacgaaatgtagtcaaacagagtaagcagagactgagcaagcatttactaacatgtgggcatctgacaaagcattcttacatttgtagtctttaatttgacacagagattttgtctgtaatgtctttggccacttttgtgtgttcattcagtgattcacaaagacgaataatttcagtgccatgtgtgattgtatttcaaacaaaactgagtgtcctaatctggaatatagtctccatttcattttgtaggacaagatagagcagtttgtttcataccattcatttaaatcattttttttcctaaaagaaaagctttcttaagtctctttcttaattccttcatttgcattcagtttgggtggagctgattgatgacgtgtttccgtgtgagcttcatcgaggatctgtgcttgaatcatctagtattttctgtaaggtcgggccaaggagacctaacgtgtgctaaactttacaagcacattttagacactgaaaatacactgccgtgccttgcaattgcacaaatcatttaagagcccctctgtcatgggaataagctgcctccctttgtcatgcactgtgttctgtattttcgaaaggaaggcccagcactgaccatatttcctcctacaaggccccagcccatcagcacaagagctcgtgaggctgaactcaagccccggagatcaaaagtcccatactgtggaagctttaagtatctcattcaggattccatgaaacattgcttcatttctcaatacgtctgtcctccgaaggcaccaactcattcagttgctaaactaattcttcattttcatgtaatcttttgggagaataaaagtgagcagtactaaaatgaaagtgttttttaaacaataatggtgccagaacatgagatttttaaccttggcaaacaaagtattttagccactaaaaaattgcagagctgtaagaaattgctgaaaacttcaatagagaaaaattaattccccgttatgcttctctttttagtaacccatcgacaaagaagtgaattgtcctccatgttagcgaagtggggaggtccagacttgctccttgtctttctaccattttctaccatcattgtatgtaaaagtctaatcttcattttaagtcagtttatgcttcccagactaaactctgcaacaaataatatgaatgtcacacatttcatcatttgtaattaattccaaactaaataaaacaaggagttgtgaaagttgtttttcccctaggatgttctacgtacatttagtaatagtttattatggctttatcttttaaagtctactttcgcggcactttttaacttaattctgttaaactactcttggaaactatcgattctataaactatgccattttcagagacataaaattttgtgcctgaattataattatagcctaaagccaaatataatttagcacattatcagactgggggtatttttaatactaatcagggaggaccctcactaaatatggctttgttcattcaaaaatcgcacagagccggcgtctccgtgacaggtttggagagccgcacgttaatatggttagttctaagtcagccattaaggaaacagaatggatcacggggttcatagagatggagcctcagtcctcttctcctatttatctgcattcattcccttggccatctcaaattcagcctcacagttttcaacaccgtctctgcactgatggttccctcatttgacacccctctccccaccacacactctgagcttctaactcctgtgtccgacttcctaatcagccgctgtgcttggatgtccagtaggccttttaaactgaaggcgctcaagacaactcttgactcggtctccgggcattttctgcccctactcaggtctttggccacctaactacatgggaccactatctatgatttaccaagaaccgtaaagttatcttgaagtcctcattccttcacctttacctcctacctccaaattctgcagcagcaaagcactgctctactccatggtcttcatgaatctgctcacccctcagcgcctccacctctgcctcttgcctggattgctgcaacggcttctaaaaagtccctctgcttccgggacagcccatcgtccactcagtagccagaatggtctttctcaaagttcaatgagattttgtcactcccttgcttaacatcctccaatgatattccatgacgcttagaatcaatgtcagtgcccttacctttgcatataagaggtaacatcacctcaccctatgtatctccctgaccccatctcatctctttcttgtttgatattctccagttgcatcagaagtcttgctgctcttccagcacaccaagattgatgctgcctcagggcctttgcaccagctccttcttctgcctggacactctcgccctggttctgcgcatggctcctttctcctttttgtttggattgctgctcaaattgtgcctccacatggaggctttctaagtgatccagacctacaggctcaggcacactctatcccctcactctgttttcttcttcataatatttacaaccatctgaaatatgtaatgtttacatagccgtttgcttaatacctgtaagattccaccaactagagaggcagcatgtgagaacaggggctctgtctcactccgtgtcagctgcctcttgcccagagggtgctcagtaagcatttctgatgattatgtgacgttagaagccatcacttacatacaaattttctcattccttgttcaacatttacacatatttattttttcacaaaggatttgaaacagctttaggcaaaaacaaatacaatgaaagtcaaaaatagaaaacctagcaccaaggaaaaaaatacaggagaaaagaaaaacccaaagcaaggtggccagttacaacattatcatgagaaagtaggaaagcacagagtatactgtgctttaacagaataagacttttcctaagataaaattctaagtgaaggtcacacagtacagggcaatgtcctcagcagtatttgtaaagcaaatgcagtgggccttttcaaatggctgtttctttgatcatggccaagggcccaaaagaaaatgcagtataatgaagggggatcattaaggggctgagttcatacgctccaagaatagagtgctctggtatccttacttgaaccaagaaatgacttccattctagaaggtttacctaataacataaccagcattttttattgctaagaattaaagggagtttcataattcaatgaaaataaagcattaaagaaatgctagtgtaaatatgtgtccactcatattgctctagctagaaaccctcaatctgccacaggcctgccacagccctggaggagcgctccttatgctccttctgtgaatgttctcccatatgtttcctactcccttagaaaaataggtattattattattaaaagcattaagagatattaagaattgcaatgtgctttatattatgtagtttatcttctaaaaaattaaaatgcaaaattgtcatcatgatggatcttctgtcacatatagattgtgaagttcaggagttggtattgagcagaacctgcttctaacaatattgagcattcctttgaccacagtttgatgaggtcccaggagcacgctctatttttaaaagcattacttaaaaagcactcctggaaagtcttcagtgagcctcaggtcaaagctgcagtcatttctattaggacccccctccataacaaacaatctttaacagacaccaagaagcctgctgttaacacaacctcctacttcaccgtctacctgccactgtcccatctcatcagtaaacaagcagctatttgtctctttccgttaaaagcacctacccccaacttcaatcagattaagaaaaattcttttctactttttccctgtgaagttggtttttattctatgtattaaaaccagggtcctttgaaagatacacttctgtaacattggcacggtagagacacaactgcatgttgacgaagtatataacctctccttccagcaacaccacagacttccaggtaaagccaaagactcgttttcctatgctgcaaagccatctccaagaaaatgctacctccatgccccactgaatggcaacaagggtcatcaatattttgcaaagggcaaatagagaatggcaagaaagagacacacagtgccaggcggagaggttgttgaatgttgcatgggtggggtgaggagcctgtcacaatcatgtgccccgcaagaaagattcccttctttgtttcattcagctgtcgctgagaatcaaagaatgcattagtaattgctattgtttgtagcatttcttgtggttcatagccagatgaccatcctttactgaaaagcttattgtgtggggattgctcagcaccctttcaagatatctagtgttggtttgcggggcaagaggggagtgcatattttatgcaaaaaaaaaaaaaaaagattttgtgctaccacattcctcaattattctaatattttccccaatagaaatatttcctcataatgcaaacacactattccgagaagcagaatacttttctggatctaagttgtctgatggtttctctgggtgatgtgctgcatggcaattgctttcccatgaagccacagaattcccaatttccaacaggagcccaaatctaatccaaaactctatttcacatctgacaactattaggttttctgatagccttgagtaagcaatgacatgtgcttctttctagaaaaagggcatgaccctctgtccacttaagacgaagctgagggaggccaaggcggccagatcacgaggtcaggagatcgggaccatcctggctaacatggtgaaaccccgtttctactaaaaaaaatacaaacaattagctgggcatggtggcaggcgtctgttgggacactactcgggaggctgaggcaggagaatggcgtgaacccgggaggcagaacttggagtgagccgagatcacgccactgcactccagcctgggcaagagagcgagactctgtctcaaaaaaaaaaaaaaaaaaaaaaagacaaagctgagaatctggtttgttcttaatgaaaccaatagaaagtcggtcacttaagttttcaatttatagtgctttcttagccataacagaatgagaaacatgttttgatcatgtctagtggcctgtacgctgaaacaaggatgcacgcaaagtctctgggtcaatattatgttgcctgtagagtggaggttgccctcaaactcaaatttctcactgcattccaacattatggaaatggcatggctaatcatttcaaaagatctgaaaatactaatacattttcaaacatagaaattgtccatttaaaaaaaaacatgcccattatccagcctttcaatatgattaaattcatttgttacatttatttgatttgtttggggccaaaatagccggctggcaagtgcatatcaccagtacaaaccttaagttatgaatatgactgaaaggtcccaagttaattctagttaagggcatgagcctttcagaagggggatcctgatgggccggaagtggagccaactctctcgcctcctgtgcctgcttacattcctggtttggagcaagttattagattccatgggacctagtggtctccgggtgctgtggagattgtgtcggatgccaggccacgaagacttagcaaccagcgaagtttctgtggtttcctggcagcagaagttgactgtgaagtgtgagtttgcttggatgacagggcacccggctccgtggtgaccggcttctgggttggcttctcagtgcaaactgaagtttgagtcagaaaaggctgttgtttaaattggagtgtcttttatgccaaaccaacatggatgctcctttgttctcaaaagggaagtgacgccagctggccagtctgaggctaagtatttgcacaaaggctgaccagatgacacacactccttgcccattgtggttcccaccgcagggaatgtccatggcaaactctctggaatgatcctctaggactgccactcttgtgaatagttggtggcattcttccaagtggtcataaggtgatagacacatttttctgatcatcacattgtccattgcaggaaacaacagttgcaccatttttgtaaatggtagctaatgaagcaacacaaagttctgataaaataagaacagaggtaacaaagcaacagactgccctcttaatggcgccaccaaaatgtgctgtaagattgaatttgcaccataaccattgaaaaataggaagtacaaaaccagagatatttttccttcccgctgattgcctggtcatgagacagactggaacagtgcttggctataaatttgttagcagctgaaatgctcgggggccccatgcaccggagttctgctcctccacactgcttctgcagaattaggagaaagcattgcattttactatcttttaaaattatgaatattggaaactttgctgaattcttttatcagttctaggagctttctggaggagtctgtaggtttttcaaggtaaacgatcatatcgtcagcaaacagtgacagtttgacttcctctttaccaatttggatgccctttatttctttaagaactagaagtagaactaccatttgatccagcaatcccactactgggtatctacccagagggaaaaaagtcactattagaaaaagatacttgcacaagcatgtttatagcagcacaattcacaatttatgtttatgtttatagcacaatttatatttattttatagcacaatttatatttatgtttatagcagcacaattcacaattgcaaaattgtggaaccaacccaaatgcccatcaatcaatgagtggataaagaaattgttgtatatatatatatatatatatatacactatggaatattactcagccataaaaaggaatgaattaacaccatttgcagtgacctggatgagactggagactaatattctaagtaaagtaactcaggaatggaaaaccaagcatcatatgttctcactgatacatgggagctaagctatgagaatgcaaaggcataagaatgatacagtggactctgggagcttagggggaagagtgggaggggtcagggataagagaatacatgttgggtgcagtgtatactgctcgggtgatgtgtgcatcagattctcacaaatcaccactaaagaacgtactcatgtaaccaaataccacctgtaccccataacttattgaaaaataaaatattaataataaaatttaaataaataaataaaattgtgcatattggaaaagaactgggatcatgcagcctttattgggaacttctgaaaccttatctctgcactttggaggtcgttgcacattcgatagtgatggagaacacgtcggggacttcccggaatgcaatgattatgtattttagtggatcttaaactggtttcccaatattcaatcataatctttggcagcctgagtggcagaaacatttgctttctatggggtcctgatttttagctaatattttgggaacactcttagtgtgtattaatcgtcctcttctttggccatagctcatgaggtcaacagtataagggatgagagtgaagatccctgttactcatccattctgtattgcgctgctcggacctccacaggagaagttagggcacgaaatccaagtggcagctcattattggcatgcaatgtaaaatacaaattccaggatgctcagacttccaggacatctgagatatagcctttggaaaataagaaatgggcttgcgatcatagttagttattactactgggggccgtggggcctgatttggggtctttatcatctactagctgagcgaccttgggtaaattgcttaacctttccatggttcttcaaatggaataataataatatcaactctgactgttacatggttcgatgtaatggatgaaggttgaaggagacaaggcacctgtatacctggtctaagccacagctaagcacggtgtctctgcacagtaaatcctcccgagctgtctggtgatcagtgttgccttttgtgttgcttatccacaccgcaaaacgctcccacgtgcgtttcctgcctgcctcacaattaccccacaagacgggtgcactgcatctcacagaggaggaagcagagccaagagacaggcctggtgcacgtgagggccgcagcccctgctgctgtgagcacgccctctgcacccactgaatattccccaagcatcgctgacgctcggccaggcgccggccttcgttcctaggctgtcatctctggacaaggcagacgcaggccctgccttcgtggagtttagatgagcagcaggggggcgacatcatcggggaaacaaatcactgcacgggtgattctgggatggtaactgctaggaagagaatccagtccaggcaggggccggagagggctgggtcccgtggctctgactgaggaggtgacgcttgaggtaggcgctgatgagagccccgctgtgaaggccagaggggcagtgctgcaggcggggctcaccgtgcagagtccgtgactgtcatctttccactcctaagttttggcttagggattgtgaactagatgctccagctttcaatttgtcaactggtttatctcctaacggacacctcaccagtgttttcctcacacattcacaaagacgcttttaacctgttggcaagaagcagatttaattggaaaagggtctgattcctaacagaacaaaagacaaagtatattacatgtagtgactacgttatactcttgtgcagtcgcttacaacttcaggctgggtcaccaaggagatggtgagtgagctttgaaactaaaagtaagcaaattctgactaagaatcatgtccagtgactgagtatgtgtgtgtgtttcttctccattgctgctttgacctattcagatgtcaagaactacaaagaaataagatgctaaagaaatcagaaaatctggccaggcatggtggctcgtacctgtaatcccagcactttgggaggctgaggcaggcagatcacttgaggccaggaggtcgagaccagcctggccaacgtggcgaaaccctgtctctactaagtaaaatacaaaaattagccaggcatggtggcgtgttcctataatcccagctactcgggaggctgaggcaggagaatcatttgaacccaggaggcagaggttgcagtgaggggagatcgcaccactgcactccagcgtgggtgagagagtgagactgtctcaaaaaaaaaaaaaaaaaaggaaagaaagaaagaaatcagaaaatgtaaaaaaatagatgagctcttgtgatatttctaagaaatataattctattaataaaatcgaattggttggaatccaaaggcattttaaagtttcagaacaaattaaactttttaaagtttcaggacacatgtctaaatgtctgtctatctaaaatttattttaggggtaggagggaaattggagattgtctatctaaaccttcttattttacaggagaggagactgaggcccaaagaatttagccatgttgtataagcttactcagccaggtggtggtcaaatctaccctagaaagaatgttccccatcacctggcccaaaaactgcactgtcagttttataaatagaatgcacgttatcaggaccagagtaatattagaagagattaagccacacaaaactatcttccctcaccaggtgcctccttgagcctgaaattccactcttggataatcattcttggggcacacatttccgagttggcctgctcctccaaaggacgtgctcccggccctgcagtcactgagtgccactggagcagggctcccagctctgagagggaggggcttagtgttcctggagacccctgacggggagccagggtggacggctgcagtggcaccccaagctcactggaagccttggggacaagggaggatccaggagaaagggacgggtgtagagcacagggcagaagcggagggccagccacttctcctgctaccaccagggccagccctgcctctgcatcttgggcatcgggacagcagcaatttcaacatagccctgagccaacttaaaatgcaacagcactttaaaaaaaatctcattcatcatgtaatatgtctgatcttaaaactgacatctgattttttaaggcagctgctctggaagaaattttctgtggatcgcaagagtctgaagccccatgaatgaccaaaaatatgcgcctgaaagagaaatgcgctgatgaagggggaggaggatgggaggggagactctgaaattgtttctcactttagggaagaggcacaacaataaaaaacatgaggccccattgaagtaggactttaaattccacccgaaaacaatcccaacaaacagatccattgttatatgttttgctacaagtaatagacaaagcaattgtgaaccaggacctgagccctcccgtcagcacatagtctgggttcttcagctcgcgagtgggctcagatggcctcagaaatgtagtttgctctcccctttaaggtcactgtccaggacgaggtgaggtaaacaagggttccaagtaagccatgtgttacccataattgatcaagggaagataacagccatgaggctgtcctggacccctgcccgtgcagcagggcagaaccattgccactctgcccagaaggtgccccctcctcactcccttctctcgtccaccccataggccagcaggatttgaaggaaggaaaacagttacagctgcaccactgggcttggcctgcactgtgctgatgtttttaaagcgtgggctgtaacagaagagatgatcttcagcctcactcttttcctggtgcctcctcagtatcttaacaccttctttttctaatcaactatttaattacacaagccacgggctttctacgtcaggttctcccttacacgtgaaaccgaggctcacgcagcacatgagaaacaacgtgttgccctgagaggttagcaagttaacctggacttagacccatcatcaaccaaagaacaagaaagacccaatgtccatggcaacatccagctagaatagcacctctccctaaaactggattttgcccggctgcagagttctgtgctgtctacatagaattgttggtgtcacctgggaggctcaggaaaggagagcccgaataaagaggaagaagaaactgcaatttaggtccccaagcccaggaccagcctgagagaccaacctggccaggcttggtgtcaaagggtactgcaaggatttccaggcaggcaggcaggtgacctgaatccaggtaccttcaatgtccaggaggtgactgacgggcagcagccactcaggtgtttgcatagaggcaactggacaccatcctgcaggccaagaggaggtctgtgcatggggcaagaatacaggctctgtctgagggtcaagcaggatggcaggttgtcaggcacagtcagcaggtgggcagccagggagaaagagacctgggccttgggggcgacccacccaatcacctgggaacaacaacaggtcctgattctttttcttcttcttgttctttttttttgaaacagagtttgagacagagccttgctctgtcacccaggctggagtgcaatggcatgatctcagctcactgtaacctctgcctcccgggttcaagcaactctcgtgccttagcctcccaagtagtgggactacaggcctgagccaccacacccagctaatttttgtatttttagtagagatggggttttaccatgttgtccaggttggtctcaaactcctggcctcaagtgatccacctgcctcggcctcccaaagtgctgggtttacaggtgtgagccaccatgtccagcccctgattcttactggaagcaagggggcacaaatggtacaaaatttttaaacagcagaatgtatcactattagctttataacttccccaactgctttcactctttgaaagttattatccttccagaggctcatgtactattctacgttctgctaatttttctatgaatttttaaacatatttgactttaattttcttttagttcacaggataggatgtgtatctgaaattaatttttctctaatgtgctatatctcaaaatcagctattaatcctcccccactgctttgtactgcctgttttactgtatattccattctgactcaaaattcagtctatttgcattagtttaacaaacacatgctgagtcccaccacgtgcggggcactattctgggtgctgaagatgcaacagtgaacagcttggctgtcacatctgtacttacagaggattctcgttggaggagacaagataaacaaggaaataaactatcatctatcacatggtgatcaatttcatgaagaaaaataaaacaaagaaggggaatagaaaattccagccaggtggtgaggtgcaacctaaagccaggtggttagggaaggccttaccaagaaggggacattgacaaagacccccagggatgatggatccgtgaggaaaacgttccagcccacagaaagcacatgcaaaggccccaagaagggacacgtcggtgccttgaaggaggccagtgcccgagtgaaggcaagagtggtaggaggtgacagggaaggtggccggcagttcatgtagagacttcactgtgaggacactgacggtgaccctgagtgagacgggaggtccatgtcctggggatgctgtaactaatgaccgcaacttggtggcttaaagaaacagacacttatcctctcacagttgcagaggccaaaagtccgaaatcaaggtgttggccatgtcgtttccttcgagaggctctgagggagactaaaggcagggggaaccctggatcctggcagttgcaagcgacctttggtgttccttggctcgtagacacatcactccaatctctgccgccatcttcacgtggtcttttcttgtctgtgtctcggcgtctctgcctatctgtctcttataaggacacaagtcattggatttagagcccattctaactaaatctaggatgttcttataccgagatccttaataacatctgcaaaaaccctatttctaaataagggcacactcacaggtatgcaggttagcagtggggcgcatcttttggggagacacaactcaaccccgtacatgttgagttgagaaggtctttgaacacaacagggcaatgatctgtgttaaagggggcattctgggggctgtatggataggggtaagggggttcaggcagcagcagagagcccagttaggaaagactataccagttatccaggtgagaggcgcagttggttgaacaagtcagtggtggtataagaaatagttccatgagactaattacgtaagacacagaaggagccgttattcagaaggtggattctgatcccttagtcagttccactcatttaaattgttatttttttacaactatcaaactacgttcattgctgtttctctatgttttcaaatatctcatagagttaatcctcttcttccttttcttagttggattatataaatctattaatttgcttgagacaatattttccttctccttcaggaatactgtatatatgtaagtgtatgaacagatagattgattgatgtcaacttattcaagtcttttattatcttttaaatattttttaacttctttatagctaggacacatgcctcaatagatttattgccaagggtctcttgtggaaaaggggttgatattgtggacaggatttatatttttattacaacaactggtgccaactaataattaacaaggctattaattttggtatgcttattttagatctagtactttattgaatcattttattaaatattattatttccgctgattcctctgcacattctggttttccattatattaagcacaaataattatcttttctctcttcccattattatacctctttatttttttatgtctcattgcattaactagagttttcagaacactattaaggaatcattcttgtttccatttttaaacagaatttacttcatctatccattaagcacaatatgggctcttattttccacaactttttatcatggtagaaaaagtagaatctattcctaatattttaatatttttggaaccttattaagtgttatcagttgtcttttagacatgtcatttattttaatttaacccattaacattgtatacctttttagtgtatgctgtcatgttggatttcttgcattgtggaatataccttccagcagactcctttagatgggcttaaagcaagatttcagggtgttaatttttgcatttctttgcttatttttatgattagggatctgcttgatttgggtgacatcctcattaaaatcaatattctcgccgggcgcagtggctcacgcctataatcccagcactttgggaggccgagacgagcagatcacgaggtcaggagatcgaaaccatcctggctaacacggtgaaaccctgtctctactaaaaatacaaaaaattagccggcaatggtggcaggcgcttgtagtcccagctactcgggaggctgaggcaggagaatggcgtgaacctgggaggcggagcttgcagtgagccgagatggcgccactgcactccagcctgggtgacagcgagaatccatctcaaaaaaaaaaaaaaaatcaatagtctcatattataatgttcgtaagaactatgacaccttgggagagggtcttggagaactggctaccaacaatttttattaacacttctggcaaaagcactagctttcggtatcaacatcattatgataaaaatgtgtttatgaaatgcctctaataatcactaatgctttggtgtggttccaaatagttcttgtccccgaggaactaacaacacaaagttgtagattgtgtcagattttgcagttcataaatcgtctccacatcaatggtcatggggcagcattattagacccatttttacaaatgaggaatctgatacctgacaagaataggaatttacataaggtcattaagcaaccaagacaggcacagacagaacttgaactcaggagtcctgatcccaaccccgtgctcctttcaacgtgccacactgactcaacacccagcaactaacaacattcagcaaaagcatgagaagacatgatgttctatgctaagactggctaataactgctatggggagagattggaaagggttcttctggaatccccatgctccccaatgccacttcctaacaattatccccattcaccgtgtagaaccccattgctcctttaacattcaggccagttagtggtatcgtcctgtgtccctctcacttgtgtcacctgctgacctcttcagccactgaaccatactgattctagcatctggcccagaagcctccatctctgtcatccgaggtgacctggtgtccatacggaagacagctccgaattcttccttgacctcttcggctccactggtcatttgggcatcacttcagccatccagacccacagcctcagcctcactttggacctcaggaggacctcaccccaaaatattaagctctgacatccttcactctgactataaggtcttagccttcatctctctacagtacgccttcccagctgttccctcacccaggtctttcccatgttgccccatctgtggcccctttccttgccttctccaggctgggtctcagggttgatcgctaggactataggagacctcccatccgccccgctccacccccagaggctgagggatgaggggcgggcagtggagctgatggaggaaggagaacaggattctctgaggagctgcttcaggctaaggtccggtcctctgatgatgtgctggtttcagagttggaagagggtgtgtgcctgtgtgttcctgatgtcctgatgagggtgccccaggacacacgagggccatcccgcccctccaagccccagcccctggcttatccttggtgcctccagatctcactccaactctcatcccccttcccttcccgatgttttccctgcagcatcgtccagtccccaagcacttccatggagctctgctcactgccgtctgggccaccagccagcacctcagcagccccttcagcgatcgctggcatgggctctgccttggtctctcctggtctgacgccaacccggccgcttcatttcctgcgaggggagctctcttcagctcccacgttggtccaaattggtttggtctcttctagacctcagagcccatacacaaagaacaaaggccagttagtctcccactctgcaattattcaaagttcgggctttaaaacgcagagatttttctgcttcatctacccacagctcagcaactgtatttctacacctattgttattctatttctgttcctaattgctattgtagaaaaccgtgcctagctgaagcttcgggagttgccaatccgtgggctcccttcaaatgtaaatgtgttatgcaaatgtcttctgaggctgggagtgggatcctgtggtcttccctgggtagagacagggaaagaatactgctgggatggctgagaaacagaagacaatccgctgccctcgttatttaaacgctcactgttctgagatggtttcctgtctccaacttcctctcctgctctagcagctgaatttaaaatacttgctacagaacactgcttcttctgggcagggaacgctgctgcttaacccttccatgctcgttccctgtggggacacagcgtgttggccagctgcacctctcccagggtctcaggaccatgtctgtaaggtagatgctattcgaatctaggaaccttttttttttaatatggaaaatcacctatctaaataatgcattgtcatcgttagcaaaaccttaaagcatcagtactggtggagaccttgccattccaagcagagttcgaatccttccaaaaacagccacgacatcaatgcaaaaaaaatgttgttttccaggagtgctagtcccatcgggagagctccttccctcctccctctgtcttcccggctccccatgttcctgagcccggagctgatctccgcctcttctgccctcagcttagctgcctgtcatcatgccaggcaggcactggattttcttttctttctatttttttaattttactttaagttctgggatacatgtgcagacagtgcaggtttgttacataggtagacatgtgccatggtggtttgctgcacctatcaacccgtcatctaggttttaaaccccgcatgcattaggtatttatcctaatgctctccctccccttgccccccaccccctgaggtgctggattttcactgtcctgagattttcactctccctcataccctctttgctggcctcccattatcaccagcagcaatttggtccaaagaaagttctcagcttctgaatgaatgagccctcaaacccatgagctccttgactcagtgcttatgctgtgctgagccaggcactcgcaggacactcggccctgctggtcagccctgctggccgggggctccacatctgtggatttggcaaaatgcagatctgaaatacttggggggaaaatatgcctgtactgaacatatacagaaattttttcttgtcattgttccctaaacaataaagtataacaactatttacatagccttacattgtgttagatatgataagtaatatagagatgatttaaaggataccaaaggttgtgcaggggttatacgcaaatactgcaccatttagtatcagggacttgagcatctgtggattttaggatcacccggggtcctggaaccaatcccccaggaatacggtgggacaactatattaattaattaaccttttttgcatttatcagtagtttctgtgttcaatattgtctattgctgctatttccaagatgtggggaaaaggtgaccacaaatatatagaaatgtattctgtgcattctaaaataaattctaaactatatgaaagtagagggcaaagcagaaaatgctggaaaaacggccctggcccaagactttgagctgtttgtctttcgtttttcacactgtcgtgttactcagtagtcctggcagctctactgtaccattctgaatttcagagaaagaaaggggagctaactctgccctggaatattatttatgttctaaagtgctaaaagtactttcaagcgcaattagcttatttaagaggcagagattatgttgttctctgcctacctcatcgggtcactgggaggatcacaggcgggggaatatatatctgtgttttgagcacagtaggaagaaaatctttgtgtaaattcaggttggctttataatgatccggcaagattggaatatctgatcaaagcgaatcactctgatctactcagttacaacatgatctctttttttttttcagatctaataatatatcacaaattgacatgtgcttgtgagaatgatttgtggttgatctcgatgctcagacatggccatcggcattccaattattccctcccctttacttaatttcactacagacttgccccatagctcatggttctataacagtctctgacttcatcacatttttatcaggaaacaaatggatcactggcttgcacaaaatacaaatttaggccaggtgcagtggctcacacctgtaatcctagcactttgggaggctgaggcgggaggatcacttgagcgcagaagttcaagactagcctgggcaacatagtgagacccccccccccatgtcaactaaaaatttaaaaaattagcccagtgtggtggcgcatgcccaggtagtcccagctactcaggaggctgaggcgggagatctcctgagaccaggaggctgaggctgcagtgagctatgatcacaccactgcactacagcctgggcaaccgaacaagactctccctcaaaaataatagtaatatataaatttgtctgcaattgtgaaaaataaataaatttacatactagatccaaggccctgagttttaacttgataactggggccaggtatcttacagaccccaggaggcctttcaaacccgttacttgcgtcgtcatgccaaggggctgagaacccttcccttcccatcccgagagcccagaaagaattctgcaactgtctgtgagccaactagacttgaacaggctaactgacctgctactcaggaaagaaacattagcttgctcacaagagcttccctcacagacttggtacagaagtctaaggatcacgtggcggccgcagcctctgtgtttctgtcccctgagtcagcacgtacagaacacgctgtgcgccaaggaccagaccctgctgtggagaaagctacagtgaaaggtcaagtctgtgcagaaatatgtgactattgaacaccctcctcttctcaatcacaaaagctctttataattcctcctctgcaggcaaaaactgtgggaaactctcacattaggcagaatttttttctgacaatatctggaaccaaagacccacagtcaggttaaaaatcacattttcattgaaacagtttatgaaaagcctattacctagcaattttatatttgaatgcaattatgttaatgttattagtacattatgaatggtactaatatgattattgtttcatgtggtattacaggaaattaattcaaatggatttacatattttttagataaagggcactgctaacacggataaataagaagcctgacgttactttaaaaacaaaagatagcactgagaaagccaggttgtgacttcatttgtaatactaacacaccatttttgtgcttttttgttgatgtaaatattttgcaatttccaaagtgtttttcttgttgaatgcagcaatctgaattaatttccccagcctctgccagtgtgcctttagcccattttatacttgagggagttgagagtcaagagaaggaaacttgccccaatttatacccagaatccagacagtgcaagatgcaaactcaaatagctgagaactcaactcctactgttagatcatcggggaatgtaacttctcacgtcgaatcattcagagttgtaattaagtaaggccggacctctggaagctctccttccctggattttggtgaaaggaaatgcttgtttctgcactgggcaaggctgatttccatctcacagtacactttctgcatctcctgcttatccagaggagaccccaccagcctcccgagctccatcgtccctcagagtcactccgcatccactgcgcactgctctacacactgctctgggctagtcacactgtgctgctggagacaaaagtgtgagcacaaaacaagccagcagcaggggacactgtgtgcactcagcccatgcaaacagtaggtgccagccgaagtcgttcaagggcgacagagcggtcacaggtgtggttgagaagagccgcccagaaacaagatctgggctgggcctagacagagattggtggggcagctgaggtgaggggagctgtgggtgcaagggcagagggcaatttgcagggtatatacacggtgagggcagagcttccgctggttggaaaatagggggtgaaactgagttggggacaaactgcagattacctctaggcttaggacggaggagttgctgccaacttttaaacacctgaaattgataagggagaagctgcctctgccaaaaccaatctggcaactgtgcacagaaaaacaggttaagaaacgagtctttcgcaagtatgtaggcctggggtgataaaggcctgaactacctaggagggatggcctctgccccaagccaaggaacgctatcaaatctgataaactagtaagctgggaatgataattctatggtgatagatcctagcaatggatgatatgcttttaagctgaaagtgctttgaggactagtactctatcttatttgtctattttcagcttgtagtaaagagccggcttccactcctgctgggtgaatgaacgcatgcatgaacgaatgaatgcaggcatgtgcgaatgagtgggctctaaagatagtatgttgtagataatttcctgactaatgatagggattccgaccctgataggcttacaggaagctgcctctcagtcggtcctggtgtgggtggctccatcacctgtgtgcaggccccttctggtccgcatccttttccctggatgaggagggcctgcaggctgacagtgacaggtgttcctccagtgcccgtcaggaatgcccgggctcccttcttctccagggaagggggtggggggcactcttcgggcccgtgggtatttgttttaatggaagaaatgtgggtaaatacagtcttcaagcacagaatgaagtgaggataatattaattactaccttcggtgattgttgtgaggattaaatgagttaatatatatgcatagagtagtcgctgatgtatatataataagcatatagtgttagctgatgttattattatttgttattactaaccaaaccaattgtcccacctattaaattcttaatatttccattctagaaataagctaaataagagcaattccttaaattctttcagcagtaccaactttcctactttcccttaaagccacagttaatttctaagtagctagttgacatgttaatgatcgaggttaaatattacatcaggattttattttagtgattaaagaaaataaacacctaaacttttatattgagcatttaccataattccgagtcaaaaattaatctaatattttgactactgtacatttcacttctgcaaataaaaatttgacccataaatttaaatggatgttggtgcatctccaactatttagcattaaattcattctgtcaacactttccaattatcttctcataagacaaatagtaacagaccaattcctaaaaagtcatttgtgtttaattgaattagtagttgtgtttgattgaaatatgttaaagccattataaaaataaattcttttcacttattggtgaatttttctacctatgctgtcaaaatggctagaaatatcaattacaaactttgtgaatgggaagtggaaatgtccattctttattctttcagaacagataaaaatactgtaaaatcagaaaccggatttggattttaaagactataggtaagtaataccggtaaataggatatctcgtaaagagaaaatggactgtggcttaggaatttaatgaaatagaggggagcggtaattttgagtccatttaggattttactggcttactgtccagcaagaggacttagattaaattattggttttctgtgaatctgaatttcctggtctgtgttgtcaggacagggatggaactttggggaaatgtgtggaacagatgtgtgggagaagccagatggggccaggatcttgggtctaagagagctttctgtaaactctgtagtctctcatgctcatctaacctccttctcctgatttttttgctcacatttattgatcatttactctatgcaagacaaaattctgtgacttttgcatgtattacctctcaatcttcaaaacagcccacagattaactgcttatgtgaccctcatctgacagatgaggaaactggaagctcagagaagtggatgctttgcccagggctggagagccaggctggggctgatatcccagccgtcaaatgtcaggctcctgctctagaccgtggccacaagatttggggaaagttccctcttcccgggcagcaccagttttatgagcacgttcttccttcctgcccaaatgtatagtgagcccctcatcaaatggcttaacttcaacatggaacacgtctgtcacacaggaagctgcgtgcccagagcctggccagagaaccagggccaggggcatgaaagcaaaaaggcagagggtactaaagaccccaggagcttgatgctgaggcagtactctggataagtcactgtagggaaaaatgctccacgtaaactaagctcttcctgaagctttcacactgggagagggggtctgccactcgttggtgctgggtaggcagaactcttcatcctgggaccacaaatgacccctgcattcttccatgagctctgggcttcactgtcagcacagtcccatcagtgacgagtccccgcctcttcctaactgcatgatttatcttggctcattcatttaccaagaaactattgaatgcctactaagtgcctattattcagcagttgtttagtcaagaaatgagccaacgtacaagaacagaaggcagcctgcttctaagtcctagttttctaaagtacttttaagatcagtcatatccagtgggaccataatatttcacaccaattctacaaaaagctacattcaattaatgaaaagcgtaagttatcaaacatgtaaaaagtaccatttgtttctttgaagtatctactataagtcaaattttattaatgagacattacagatgacctgcctcaaaggttagattaaaaagtatttttgcatatcaattctatgtatatgtgcagatcttctaacctattctaaggtgtcataaaatggtttattcttagaacaatcgtataaatcccctgtcacatttaaacaatttactctgtgagtaaaggcttactaagcaaggaaactcccatacggtccctaataaattattaatttcaaataaatgtagtctttctctcccaatggctcactctctgatgtttctcatgcttttcagcactgccagatctgagaaataaaacaaagtaacacccaaatgagttacttttaattctgagaagaatttataactaacagataagatgttgatattttcaatatgtggctttagaaaacattaaagtaatttagaaagaaaaatttagctagcttccataaaaatttagcacattaatttaaatgaataaaatttaacagaaaagcaaaagtacgttatagatactttgaaagtgttgaaattggcctggcgcggtggctcacacctgtaatcccagcactctgggaggccgaggcgggtggatcacaaggtcaggggattgagaccatcctggccaacatggtgaaaccccatctctactaaaaatacaaaaaaaattagccgggcgtggtggcgggcgcctgtagtcccagctactcgggaggctgaggcaagagaatggcgtgaacctgggaggcagagcttgcagtgagccaagaatgcaccactgcactccagcctgggtgactaagtgagactgtctcaaagaaaaaaaaaaagaaagtattgaaatatagtaggatgtaagcttccaaacaacttacagtttaaaatctcaaaaataaaaatcttttactaatgtgatataatttattacttcacatttccaacactatagtaggaatattagcttttttctttcataagaaagccctaaacggtcagtttgctgttcatactttttctgatggccaaatccttacttttttttccaattgttttatggttctatcagctataacatcatatttgctgatttcattctgaatctttccaggtcatggttttgcctgcttttatgtaatattcatttgtgttttatttttatccatgcctccttgaaaagtaggaaattcaatttggattgctatcatgtttttctttctttgagtggctccccgtagcttccttcttgctctgtgtttctcctttaccatggaccccgtgtgctgctggcctgggtggaaacaccaaaatgatgtgcttccgacttcttcctaagtttgtgattataaggttttcaaattacatgcaactttctataacaggcttctcatctggcaaatgaattaaaatatttactgatattgtctcaatcctagcaacagccaattggaaatgtcagtttttaaaagatcctatcgagagtgtcaacaagaactgggtaactcctccaagtaaacttagtaagacatctgcaagacctctgtgaaagaaaccatccaagaaagatacaaaagattggaacaaatggaggcacacatcctcctggctggaaggactcacgttgttggttttgcccatccagcacctggtaacacatgcttagtttctctttacagtctcagtggggtaggcctgccaaggatcccttcccatccctggccaagaggtgagcatttggcccaacttaggccagctgggctctgcctggggacttgaagcttgactgagggtcaaagggctgaaaatgtttggagatgattcttctggttgacaggttctgtagatagcccctacatcatgccacctgtgtccatggagcttcccaaattcctgcctctttctgagacctggttcttcacattgttctttgattcagttcgctacctcctacctttccagtaggttctctttatgttccagttatctgaagttagtttccacttcttgtgagcaaaaaactcaactgttacaattcaatatggtaaagatatcccaccccaccaagttaaggagccaatgggaggcttttatggatctttaaaaaagtgattcaagtatccatatgaaagaaaaaatgggtgagaataccactgagggggaaaagaagaaagagagagagagagacagacagacagacagacagaaagaaagaaaggaaggaaggaaggaaggaaggaaggagaaagaaagaaagaaaaagaaagaaagaaagaaagagaaagaaagagaaagaaagaaagaaagaaagaaaacaaagaaagaaagaaagaaagaaagaaagaaagaaaacaaagaaagaaagaaagaaagaaagaaagaaagaaagaaagaaagaaagaaagaaagaaagaaagaaagaaagaaaggagggagggagggagggaggaaggaaggaagaagagagagagagaacaggcatttcctccaccagatattaagataaatttaaaacaacagtaattaaaaatgtgtggccccaacaatagcatagacagatcagtataacagaaataaatccaagaataattttaaagtttttaatattttataaagcgagcatttcaattcactgggaaaataaaagatcatctcataggaggtctaggtcggcaggctaaccccctggggaaaaatatttttaaaattattaggacctgtctcatatcatcacgaaaacttaaaaatacatatggcttacttaacaaattaaatgtaaaacataaaatgaatttttttttttaaatttcagtgataaggtctcatttggttgccaagctggagtgcagtggcgcaatcatagctcactgctgtctcaaactcctgggatcaagggatcctcccatctcagcctctcaagtagctgggactaaaggtgtatgctaccatgcctgactaatttttttttttatttcttgtataaagggatctcaccatattgcccaggctggtctcaaactcctgggctcaagcagtcctccctccttgcctcccaaagtgccgggattacaggcctgagccaccacactcagcctgaaaccatttttttaaagcccaaatacaatatgggcaaatataacataaagaaagaaatccaaaggaaaagatagatttgattacataaaaatgaaaagattctgtcaaaatcaccacaaataaaaataaaacaccaatgatatgagagtgacgatttccctacatcttctccaatagaaaatggtagcaaacttctgaattggttgtatattaatcagggttctctagagggacagaactaataggatagatgaatatatgaaggggagtttattaaggagtattgactcacatgattacaaggtgaggtcccacaataggacgtgtctgcaagctgaagagcaaggaagccagttcgagtcccaaaaccttaaaagtagggaagccaacagtgcagccttcagtctgtggttgaaggtccaagagtcccaaagctgaagaacttggagtctgatgttctagggcaggaagcttccagcacgggagaaagatgaaggccagaagactcaggcagtctagtcttttcacattcttctgcctgcttttattctggctacactggcagctgattagatggtgcccacccagattgagggtgggtctgcctctcccaggaccgactcaaatgtttatctcctttggcaacaccctcacaaacacaccaggaacaatactttgcatccttcaatccaatcaagttgacactcaatattaaccatcacaggtttgaatgaatctttttcttttcattgcttctggaaattgagccatagtttgatgggccttcccaattcatgtttataaagggacttgcctagatcttttgtgactttacttttatatttaaattcatttggaattatcctaatgcaaggtgtcaggtatgaatccaaatcataacatcaggtgccccaacatcacttattaaatagttcatgttttacctactggtttgagatgacgcatgtatatcaattaaattcctgtatgtatgtttgcccgcatattttaatgtctggtagttcttatccactccaaacatcgattattggtcttttaaagaatgttcctggcaattgttgcttgtgtattttcacatatgaaatttgagaccaatatgtctaattacaattaaaaacctggcatttctactggaatctctttaaatgtaaaaattaacttaagtagaattgctatctttgtaatgctcagtttccctgatcccagaacatgatgtgactttccacttgctcctgtcttacaggcccatcaactgtgttttaaagttttcttcatataggtcatataaaaactattgaagtctgtgtatttgttttcttttcttttcatttcttttctttcctttttcttttttttttttcaagatggagtctcgctctctcacccaggctggagtgcagtggcccaatcttggctcactgcaacctccacctcccaggttcaagtgattctcctgcctcagcctcccaaatagctgggactacaggcatgcgccaccatgcccagctaatttttgtatttttagtagagacggggtttccccatgttggtcaggctggtcttgaactcctgacctcatgatctgcgtccctcggccttccaaagtgctgggattacaggcgtaagccaccgcgcccggcctgtgtattaattttcaaccctactaccttactgaatttgtttgtttattcagttaattctcaggttttccaggtgtaaattttagaaaatttacaatcctcctaaatgtgactatattaccttctccttcccaagttttttacctcaaatttatttttcttgtaatagcattgactatttcctatagtaatagcactgtgtaattcttgtaatagcactgactgttttctatagtataatgttaaataacagtgaagatactggtgagggtggaactttattgagcatatttatgatatgtctccaccaagcagggtgctggcttttggactgagatagatgtattttaacttataaaggcagtatttcactcttcgtattttgtttttatcaatggtggttgttaaatattgtccagtgctttatcaacatccatggaaatgatcataatattttttacttatatccttagtatgataaaatgtatgaatagaattcatagtaatgaaccatccttacatttctgaaacaaacatttggtaatgatgcatcattctttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttttagtagagacggggtttcaccgttttagccgggatggtctcgatctcctgacctcgtgatccgcccgcctcggcctcccaaagtgctgggattacaggcgtgagccaccgcgcccggcctgcatcattcttttgatatgtggctggatttattttgctaatattctgtttaaggatttcataagtgacattggtctattgtttgttctctaaaatgtttgtctttcagtatcaatgttatacttcctccagagaaaaaaaatcttaaggtgtttttttgttttgttttgtttgtcgttcttgttgttgttgttgtttccctaagctctagaaaaagcacttaatttgtggtattctcatgtctggacctagcgactttttctttttgattagacaagaatagctttttgataaccttctgtatttttcccatagaaataagactttttagattttctgcctcttcaagggtcagttttgactaattatattttcctaaaaatttcttcaatttatccaaatttcaaatgtatttgcacagttaaacaaacttatgtcctgtgtttcttttaattctcttaattttctgttactttcctccccccttgatatttcctgtttgcaagttctccattttttttcttgattaaattagatattggctcatatatttcactacatttttgtcttttaaaagccatcttttggacttattttgtagttctgctgtttgggttttctagttaattaatttcagcttttaaaatttcttatgatttaattccatttattttgttgctccttgcctaactttttgagttagtttaattccttttaaattcttacttgttaattaaattaaaatgtaaagtaatgcatttttctctgagcattttagtggcatatcataacttctgatatgcagtatctttattatgttgttttctttttctttttagtttttttttattattatactctaagttctagggtacatgtgcacaacgtgcaggtttgttacatatgtatacatgtgccatgttggtgtgctgcacccattaactcgtcatttacattaggtaaatctcctaatgctatccctccccgctccctccaccccccaacaggccctggtgtgtgatgttctctgccctgtgtccaaatgttctcattgttcagttcccacctatgagtgagaacatgcagtgtttgtttattttgtccttgcgatagtttgctgagaatgatggtttccagcttcatccatgtccctacaaaggacatgaactcatccatttttatggctgcatagtgttccatggtgtttatgtgccacattttcttaatccaatctatcactgatggacatttgggttggttccaagtctttgctattgtgaatagtgcctcaataaacatacgtgtgcatgtctctttatagcagcatgatttataatcctttgggtatatagccagtaatgggatggctgggtcaaatggtatttctagttctagatccttgaggaatcaccacactgtcttccacaatggttgaactagtttacagtcccaccaacagtgtaaaaatgttcctatttctccacatcctctccagcacctgttgtttcctaactttttaatgatcaccgttctgttgttttctattcgttctataatttgggactgtacttcctctttgatgtagaagttgtttaaataaaatcaagttacttggtatgtacctttgcttctgttaaatgtacttctttttcttttctttctttctttcttttttttttttttttgagatagagtctcactctgttgcccaggctggaatgatgcagtagcatgatctcagctcactgcaacctctgcttcccaagttcaagcaattctcctgcctcagcctcccaagtagctgagattacaggcgtgcaccaccagacccagctaggtttgttttttgttttgtctttttaatagagacggggtttcaccattttggtcaggctggtctcaaacttctgaccccaaatgatctgcccatctcagcctcccaaagtgctggtattacaggcatgagccaccatgcccagcccttatttttctattatttgatatatctgcttaaaataatgttctttaatacccaactattgcaaatgagacagcagcaaatgaactctattttccatctttttctcccttcttcctcttatttttttgttagcagcatcatttctacgttaccaaagcttttcatatgtatgttctgttttgccacccacattgttttcatcttagctcttcagtaaatatactcaacactcagcactgatcatttttgtcatcgctaggttgcctgagtattgtcctctagtcattttctcataaaggcaagaaatgatatttcccaaatgtcacatttttttcaaaactgtttgcctttagactttttatttgaagaacagtcttactggatctaaaatttctgacatattttatttcctttggtttgtatagatatttctccactgtccttcgacctagaaggtagctgcggagaattctgagaccaacataagttttctcccttttaagtgacttggtctttttttgtctggctgttcaattatttttctttatatttaaaattcagtaacataggatatggctttgtgagataatataaaggatcagattttccaactaagctctcaagaattagacctgcctccttattaataattcaaaggacatagtgactgcaagagacggggaaagcatgaagtcaaagtgtcagtgcagctcctcaagtcctttcctgccacactgggacactgttcccggctgagcagctgaggactccaggtgatgtgcgaagagtattgctttttttttttattattctctttccttccttccttccttccttctttctttctttctttctttctttcttttttatttagacagagcctcactttatcacccaagctggaatgcagtggtgtgatcttggctcactgcagccttgaccttccaggctcaaatgatcctcctgcctcagtctcccacatagctgggactacaggcgagcgctaccatgcctggctaatttttgtatttttttgtagagatggggttttgccatattggccaggctggtcttgaactcctgggctcaagtaatctttcctccttggcctcccaaagtgctggaattacaggcatgagccactgagcctggccttaaaatagggtattactttcaatcatgaaacagcacaaggtatatccaataattggcattttccttcattttgtttccactaggttcgaagtgaccatttctcttttccttcctttctccccagacatcctcagggtagagaggatgagggacagaccagcttctaacccttcattcctacctggtgttgatcattctgggtcagttttccttgacatagggtgtgctcttccaatatgtgggttgccgtggtcggaatgtttgtgtgactccaaaatgcatatgttgaaatctaatgtccaacgcaaagtattaagaagtgaggcctttggggggtgattagatcatgagggctctgccctcatgaatgatattaacacccttagagaatgagcttgagggagccctttttgcactttcaccacgtgaggacacatagaagcaaccatctatgaagaacaggccctcaccagacaatgactctgctggtgccttgatcttgcacttcccagccgtcagaactgtgagcaataaatttatgttgtttacaaattacccagtctaagatatttggttatagcacttcaaactgactaaacaacaggttcaagtcttcagttatttcaagaataatttctttaatgaaatattttcatattcgttctgtttcagtgtattcgctgtcctcaggaactccaagtatgcatgtttttaaaatctccatgcctgtcttctctacctctcactttatctttcatcattttatttaatgttttacaattttttttatttcaatagtttttggggaacaggtggtgtttggttacatgaataagttctttagtggtgatttctgagattttggtgcacccatcacctgagctgtgtacactgtacccaatgtgtagtcttgtatccctcaccaccacgtacccttccccctgagtccccaaagtccaatgtatcattctcatgcctttgcgtcctcatagtttagctcccatgtatgagtgagaacatatgatgtttggttttccattcctgaattacttcacttagaataatagtctccaattccatccaagttgctgtgaatgtcgttatttcgttcctttttatggctgagtagtatctcatggtgtgtgtgtatgtgtgtatatatatatacacacatacacacacacacacatatacacatatatacatatatgtgtatatatgtgtatgcatatgtctattttgtctatatatgtatacatatatacatatacatactttgtctatatatgtatacatatatacatacgtgtatatatatgtatatgtgtgtgtgtgtatatatatctgtatctatatctatatctatatatatagatatatatcacattttctttatccactagttgattgatgggcatttgggctgattccatgtttttgcaattgtaaattgtgctgctataagcatgcatgtacaagtatctttttcatgtcatgacttcttttcctttgggtaggtacctaatagtgggatttctggatcaaaccacagatctacttttagctctttaaggaatctccacactattttccttagtggttgtactagtttacattcccaccaacaatgtaaaactgttcccttttcaccacatccataccagcatctattatttttttattttatgattatgaccattcttgcaggagtgaggtggtattgcattgtggttttgattttcatttccctgataattagtgatgtggagcatttttccatatgcttgttggtcattcatatatcttcatttgagaattgtctattcatatccttagcccactttttgatgggattgcttgattttctctttctgatttgtttgagttctttgtagattctggatattagtactttatcaggtgtatatagtgtgaagattttctctcactctgtgggttgtctgttaactctgctggttcttttgctgtgcagaagctttttagtttaattaagtcccatctatttatttttgtttttgttgaatttgcttttgggttcttggtcatgaagtctttgtctaagtcaatgtctagaaaagtttttccaatgttatcttatagagtctttatggtttcaggtcttagatttaagtctttgatccatcttgagttgatttttgtataaggtaagagatgaggatccaacttcattcttctacatgtggcttgccaattatctcagcaccatttgttgaatagggtatcctttccccactttaagtttttgtttgctttgtcaaagatcagtatgctgtaagtatttggctttatttctgggttctctattctgttccattggtctatgtgcctatttttataccagtaccatgctgttttggtaactatggccttacattacagtttgaagtcaggtaatgtgatgcctccagatttattctttttccttattcttgctttgcttatgtgggctcctttttagttccatatgaattttagtattgttttttctacttctttgaagaatgatggtggtattttgattggaatttctttgtttctagattgcttttggcagtatgatcattttcacaatattgattctacccacccatgagcatgggatgtatttccatttgtttttgtcatctatgatttctttcagcagtgttttgtagttttccttgtagaggtctttcatgtccttggttaggtgtattcctaagtatttagttttttctttttgcacctcttgtgaaaggggttgagttcccgatttgattctcagcttggtcgctgttggtgtatagcagagctactgatttgtgtacattaattttgtatcttgaaacttggctgaattcctttacaagttctagaagctttttggatgagtcttgggttttcgaggtataccatcattatcagcagcaaacagcaacagtttgatttcctcttcaccaatttggatgccctttatttctttctcttgtctgattgctctggctaggacttccagtactgtgttgaatagatcttcaatcattttacattccctattgcaatttgactttgcttaatttttctaatttctagtatctatctgtttaccaagttttccctagtgcaattcttcctttgctcctgtcattttgatttccatttctatgatttattattcttttagctctttcctgagtgctgtcaacttgcttttcattttctccagtagtcttgctgtctgtgccctgagatcttgtgtttttgctttaagggctcttaatattgaattcaatcagaggtttaatattcaataagagatttcttggcagttgtgtctgtgagtatgtgtgaatatccttcctctaataattttcactactctttcctgtatttttttcttattatatcaatgctatgctggcttttgtttcaaattattcactatcacataagtcatattttccagctaattgaaagagcttgcttgagagaaggagagtcaactccatgaagatagattattcctatgttattgaattacctgggaagaattatcttcccaaatcaacctagcagggcatccaccctcagcctgcactgcgcatccttgttttgggatctgttggtctgtcctgaggttcatcctttgcactggaagcttctgagtgagccctccctccagaggcagagattgttttcgctcgggtctgctgccacctggccagctggcccttccttcaccaagcgtctctgctccacttccactctgcatggcctctgctcagtctcctttccatcctcccagatctagcagctcatgctgtgtgcatgggatgtggagttatcactttagggagtgagtctgccacctctagaagctgtgttgttgctgccgtgtcctgagccctgcctcctctgaacgtcctgctctgcacccccatgctagcaccaccacagttccccagttgtggctcttgagctggccccacctgtctgggctgtctcaacagttttgggtttgcctggatttcactgcatcttgagctggtaggggttatactgtgcaccaccccataggcacacacagagccaggcagtgtggtgaacaaaggcaaatgttcaatgaacactcatttcaaggtcttcactctaaatgagaagatcccatctatcccatgttgtcttagtctgctcaggctgccatagccaaacaccagagactgagcggctggaaccacaaaaatgtataatctcacatttgtggagacaggaagtccaagatcaaggttcggccaatttagtatctggggagggctcttttcctggcttgcaggtgaccaccttctcactgtgcactcacatggcctttcctggatgcatgtgcacagggagagagcgggagcaagctttctggcacctccttataagaacatgaatcctattagatcatctgacctcgtttggacttaatttcttccttagaggtcccatctccagatacagccacactgggggttaggacttcaacatatgaatttggggaacacaaacattggtttataacacatgtaaaccacaacttatggcaggaaatgatgtcatgagaagtagaattaaaatcaccaaggagggaatggaagagaagatgctccttcccgtcagattatgaaaagggtatcatttgaactgagatgagcaagatgggtaggctttgtgcatccggagatggggggatgctccaggtgcagaagccagtgcaagcacaagtgggcaaacataaggcactagactctgggctggagcggtggagaggtggggccagctcaagagccacaactggggacctgtggtggtgcgagcttgggggtgcagagcaggacgttcagaggaggcagggctcaagaaacggcagcaaggctactgggaaaaacaccctcaggagtgaggaagagcagatcattgccattgaagaagcccttggctcctgtggagagatctgagactttgcctcagcacagtcctcaaaggtatctgcatgggatggaagtggggtggcagcagctggcatggctggagctgtaccttagaaagggtaagcttgcaacacaatgtaaaatacattggacagtaaggccagatcaaaacattggcgtacaactgctaaaaaataacaatagccaaaaatcaagatgaatttttttttttgctatatgaaatctagatagtgtacatttaatttcatttaatttcagaagtagaaatctatagcaagatctctagtaaatgaaccttcaaatttatcattatgaagacaaaatttaaacatcttatattcaataattaccaattctaagcaaaattcagaatccatagagtaataatatataattgaaatacagtgtatatgagtcaggctacattgagctaatcttttgatctagtaattcaacagcataggaaaaggaatgaggcccacccaattttggcatgcattccaaattcaattaactttaaccgatatcttgacagcattctttcctttcttattaaaacaaaatctcttaaatgttcaagataaaatcagatgagtatcatgtgcacaagaagcagatcaagtttttcaagaatctttaaaaataatgtagattaaatcaatagaaatagaagcattaatttgaatattcagaacttttttaaaattattgtttgggtcacttgaaaaaaagggcaattttcttttccttattgaataaagcatttggataatattaagacatttaaagtaagccaccagagaagaaaaatttcaccatagttacgctcattgtaagtcaaagactttgaggtgatatacaaattatgctgatgttaatatacacacagacttaagaaaaagaaattttcccaccccaccaagtaattagcaggtcaaatctgtcctcttagagccaaaaagtgaaaatctaaatgaagtccttggtcaagaagtcttgactgaaaagctacctcctgtgtctccaatttaccccctacaaaaatatttatttctcttatctctttatcaaaagaaattcatctgggccaggtgcagtggcttaggcctgtaatcccagtactttgggaggacgaggcaggtggatcacctgaggtcaggagttcgagaccagcctgaccaacatggtgaaaccccatctctactaaaaatacaaaaaattagctgggcatggtggtgtgcgcctgtaatcccacctacttgggaagctgaggcaggagaatcacttgaaactgggaggtggaggttgaaatgagctgagatcacaccactgcactccagcatgggcaacaagagtgaaactccatctcaaaaaaaaaaaaaaaagaaaagaaattcatcttaaaggttttggatttagccatgacaaggcttacaccatccagtgtgtacttttcttcactttcttttagacataaaaaacaatgggaaacaacaatttctttctgcaaacacatggccccaaattgctcaatcatcaagcccttctacaaggaaagcctttgcacccattgctacaatgacctgccactggggcaaattttgtgtaaacatgtaaattttagtggttatcattttattaaaaaaagaagctcttgaatgttttttactactgattcttggcattctgtgtcttttgtgtatgtataatttaaaaatcactttgagcatttatgcacattactatatgacatgataattttcatgcaaaaaatcaaaatcaagttttagattaatttaaagggtatctgtaatatacactcagtttataaatgtgggtgatgtgaatgtaaagagacagacatgacctttcctgactctggttggtggcagatgtgtattttagtgtctgagctttccagccatgaacacaacattcctgatgatttccaaaaagcgcttaactcgaagatgtggaaattgcaatgaaggaatcagtccttctaacttgtagccagcaattatatatccaaaaagattggaactagggatcaaacctgaacaaagaaatagatatgcaatttgattaagattatgtttttcagattaggatgccataaacacaatgttatggataaatcaatgtgttaggtttttccaataaaaacaaatttagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtgaacccgggaagcggagcttgcagtgagccgagattgtgccactgcagtccgcagtccggcctgggcgacagagcgagactccgtctcaaaaaaaaaaaaaaaaaaaatttaggccagatgcggtggctcacacctgtgatcccagcactttgggaggccaaggccggtagatcacttgaggtcaggaatttgaggccagcttgaccaatgtggtgaaaccccatctctactaaaaatacaaacttagctgggcatggcggtgcatgcctgtaatcccagctacttgggagactgaggcaggagaatcgctcaaacccaagaggcagaggttgcagtgagccaagatcaaaccattgcactccagcctgggcaacaagagcaaaactctgtctcaaaaaaaaaaattaaatagggtttaataaacagatttattttgaatttttaattattgcaatccaaagaattatacaattataaaactgtaggttttctggaagattatcttgtccctcttgccatcctgcataaaaacaagccaaggttcagagagtttgctgccagcccggggccaggccagcagctgctggacgttctgacctcagtcccagactgtcagctcctttagaggggagtcatcttccgttccagccggtatcactgccctctggccccacagagttcacgggcatgaatttcttccatgcacatgctgaagaacagtggtctggcagagagccttgaactaggaactgggagatgtgagtgattattagaaaattgctcattaaagctcatagtgtgtttaacagattaatgttattttattttagatatttttattttagatttttaaaaccatcttattctagatgttttaaagcaagaaataaaaccggtattgaaacacatgacatcacataagtgctcttccagcatcttgatggtatttgagttctggatgtccagagccgcccccaacccccgctccccgcctcccttctgatgcctctcagggactcggccttcatgtgtccaaaggcaaattcctgcccttctatctcctcaagcctttgtcctcccctgttgcccctgctaaagctgttgccatctatccctttgcacaagagaaatacaggtatccctctctctcactttatcaaattcaacaccatgttctagctgttttttaattttccaaaataggtcttcatttctctaccaccctaaaccaagccactatcatcacattgcctggggcagtgcagtagccattgaccttcacacccatcaaatattgtccaaacagcagcctcgactcaaaatcagtcatgcactggtccacttgagccttccttggcctccttttggcccttagaataaggtgaccacccatcccagggacctcagggccagcatcacctgactcctgcctgcttgtccagcctcccccagacacccctctccccaccccacctgcaactccaccggactcatctctgcttctgaacagatccaactctcccctaccgcagggcctttgcgcaaacccttctctttgcctgtgatcctttacgcccctgtctccttccttgttcgtccctcccgcttcccctgacacatccccactcgggcagcacccccaccccgccagccccagtccaggctagatctcccgtctaagctcccacagcacagtagcagtgatgatttatttaaagctcctcttccctgctagagtgaatccccatgaggtcaaagaccggatcttttctgtcaaccactgtatcctcagttcctagcacaatcctgacatctttaatctctgcttcacatcatggcgggagaagccaaagggccccggagatatttgccagagaagcaattaggaaaatggcccagcccagagagctggagcagaaatgaagtccaaggaaaagaatgcaccgtccgtgatggggaaggaataataaccacagctcctgcacaggcagagcagctcggatgcctgtgtcataaggagcagagctgtcatggatgcatatactatgtgcggctctgtataaattcctctcaggtagatgacagcatctagcaaagaacattgcccacagtaggtgcaccatccgcctcgaccggtttgatttgactgtagactctgaaaggagcctcactgttcagctaggctgctggaagggactgaatgactccatcccttcatgacagaggctccttgtcttgaacttggaggaaaatgctctattgcatggttctgtcgtgtaaatcacttttaaaaattattcttccctctataaaagtatgcatattttggagcatgatctatctttatgcaagtggaggggtgaacggaatatttcatcaggataaccatttactgacaattcatgctattttatagtccatgtcttttggaatggatgggagtttgttattcagtggtttataaaatcttccagactgaatgatgagctcacatctgttacaattggtatggaaagtaaaactggcgtgagttgtccataaatatttattgtcaggaaatatcagtatgtacagctgtttttaggaaaataatgcctattttattattgatacataaagtgggacatttatgtttactacccataataacacaggtagtaataaaacaatattctgtaaagagtatcagagaggcagaaacaaagatgaaattttggtttctaaagcaagttttacaaaaacattatttaaagaccatactactattctcaatccctttcaaagtgttaaaaaactttaagtcagtcaagaattggcaactaattttcagaatcaataatatgatcataatttctgccatagaaaatggctttgctgtcaaagaccatcttgagaacaggcagtatatccatgctgaattcaacagttcttacctcctaatgtgagccttggtcatctggaaagaaacaggctccttactgagttccatatcgtcccttcctgctccccaaaaggcttttttgagggaaaactttccgcaacaggtcactttaaaactacataaatatgtatatgtggtatgtaagtgtatggatgtttatgtacatgtgtgtatgtatatgcatatgtgtatttatgtgtgtgtttatgtgtacacgtgtagatgtatgtgcatatatgtaggtgtgtatttgtatatggatatgtatgtgactgtggatgtgtgcttgcatatgtgtagatatgtgtatatgtgtttgtgtatctgtatatatgtatatgtacatatgtgaatgtgtgtatgtgcgtgtgtgtgtgtgtgtcttccctcaaagaccatctgattatttttcccatgcagcagatagtacatgagtagtttgcacctaacttttaaaagtcttatgcgtatggttggtggctgtcggaacgaaagtgatttttcaggacaatgtcaggctgcagaatcaagggccctgaggagagaaatggcaggcaaatgctggggtcgcatttgctttggtgttccttgcaggtcaaaaagacagcaagctcttgcctttcactttgcaaaatctgaacaacgttttggaaacctggtccccactgctcttacagaagggaaagggacccctcaccaggaagagccagtttcccaaccccagaagccggggaccctcagccctcccagcagccttcgccgccacgtttgtccccacaggccgcacacacggccatgctcacctcctcctgcggaggctgcccaggcccctcacagcccgcaggatctgggtcacacctgagccagctctggggacacttcgaggctctgcatttcttacatgtttcttttcaatcctgaccttctcttagatcaccccaaagggacaccccgagccctgaccatttacacagatagtcttttaacacttggaatggaagcatttgagcaaagaacaccagaaacagaacaccagccagtctcctgccagatggatgacattattttccactcatttaacagagaaaaataattgaacgaggaaccggggtacatgtgttgctctgagtgtggcgtgcgcagttgggaaacctcagaacggtgtggcccgaccgtggccatgctgagggttttgtggtctggaggttcctggagattttcaggatctcacattcagaatcccacattttcagaaacaccacagaagaagctatttatttggctttgttgttttcttaaaaattaaggaaatgatttggagagactaggcctccgggttcttgcttttcttttccccacagaatttagacattattcaaacatttattctgtatcatctttttagtttgtttttcaaaaaagacatttatcttgtgataatggctagttgcagaagctcagtgagattctcaggttttcttaattgcaatttcgtctcatgcgcttgaaatgccaagcactaatggtgtttgaagtggggctggcgtctgattcaccttcagagttatcttgagctttcagccacaagaattttaaacctgacagtggtaaagaaatgcccttctttcctgattgctccgtgtgcgtggtattctgtaaccgaggtcattaaaggtagacgtcacagtggcaagagcccgacaggcctgtctcctggtgtgccacctccatactttgggacttacctgttacagtttcttggccttgatttcctcatctgaaaaacaggagaataagctctgttaagcaggatcagtacaaggattagattcacttattaacattctcctacatttgaaattctaaatgagcacaaaagagtttcgcgactgtcatacctttgaatgggaactaataaaactaaaaatcccatgttgccaagtttataatgctgattcattttatgcatcactttgcctgaagtttcagcataaaatgtgctctcgattatctaagaaaaataatgcatagagaactttttatgaccaaatactcgtctataccactcaacacttttgaatggctttcccaattaccttcccggaatatacagggaccataaattagttctacagaatatctaaaataactacaatttagggggtatgtgtgtagcaaaacatcatggaatgcactctaaagagaaatacatgtgaattcagattgcatgttcttcaggagggacttattcagatgcggcccttccttagtgcaattaactgtgaactgccacagtgagatcagaaggtcgtgcccagcaaaggtgaaacacagtgataaaagcagtccctccatcagcgaggacaggctcaaggtcagccagttgccattgagatgctagactgtggcatgcagatgggagcctggaactggtcgctggaaaccacaccaacaaatttggaattccgtgcactgatatctaccccacatgagcagaaactgagtttggccgtggaccgactgaaccctgcgccagttcccatgtgtcaggactcgctggtgtgcagagtatttgctgcggctttgatctcattgttttagtttactggctctcctgatttggcattaaatgcgttagaacctaatcagttccaagatggctttcacgatgcggttccttttcctaactatttccaaatcaattcacttagggacattataggttaagagtagttgttgttctcatatgaatcttgagtcagtttttcttttgtaaataacttcattctttttcattgacctcctcaatatttatttctaaatatttttaattttttaaaatacttaagatttcatttgaaatagaattaaatgaaagttaaggaagccttatcatgaatccagttctgcaatgtcattctattaatagctgcagtctaaataccagtcccagccatcacagcatgtccatcgggtaaatcctcactacgtgtggcgcatgttgtcctccccagccctgtactagtccaggagggagttattctgctccctgctttacctatgaggaaatgaagaccgggagtggggacagggggagctggtgccagggcagggacagagcttgtgccccccaccttgaccacagcaccactcagtcctcttctgttttttttttctttttcttttttattttattttattttgaggtggagtttcactcttgttgcccaggctggagtgcagtggtgccatctcggctcaccgcaacctccgcctcccaggttcaagtgattctcctgcctcagcctcccgagtagctgggattacaggcatgcaccaccacacttggctaattttgtatttttagtagagactgggttggtcagtttataatgaccacgttagtcagtctggtctcgaactcctgacctcagatgatctgcccacttcggcctcccagagtgctgggattacaggcatgagccaccacgcccggcctcagtcctcttccagttacccactaccctacccagaagtcacggccaatccccaccctgtgccaactccaaattcacttaattatcatacgcacatgtgcgcatgcacgcgcgcgcgcgcacacacacacacacacacacacacacacacacacacacacacacagcaatcactgagtgaccatcttaatggggattgggttacattcataacctattttgtaggagagaattttccaagggaccaaaaacgttgaccagacccaaatctaaaaagtattgctgcccctgcgcctgtgaaaatgcaagggactgagccaatgggaagaaggtggggagaaggggctgagcgccccgcagcctgcccccacccctggacctgcggctgcctccacttactcctgggaacctgggcaaaccacttcacttctccaagcctccattgcctcaactttcagtaaggatgctaatcatagcacctgcctcacagttgagttactaagattagatgaaataatgcatttaggcacagttcagctcctggcactagaaaatattcaacggtgttagcactgtcgctattactgtgtcatgactcaatgggagagcacttaagctagtgccttccacacaatggtcacttaaaaatgtccttagttaaatgaaatcggatgcgcatgagttcagcgtgaggtccgggtcagggagaggaaggggcattggcgggtagggttgcgtcggtggggcctcctctctgcctctgactggcctctttgcccctctgctttcctggtcaaaggttcgtaagcaaacggtttctcccactcctcggaacatggacttcctttctggaaggcactggcctggccatttacctcaaatgccggtgttcctggcttcagtgcccggctgcccagcggcctctccctgagtctgggttctcaggtttctgctccgcctctagatgacccctctgcccgccagagctggcctgcgggtcaccctgcaagatgaccctctgcctgcccgagctggcctgcgggtcaccctgcaagatgtcccctctgcccgccagagctggcctgcgggtcaccctgcaagatgacccctctgcccgccagagctggcctgcgggtcaccctgcaagatgaccctctgcccgccagagctggcctgcgggtcaccctgcaagatgacccctctgcccgccagagctggcctgcgggtcaccctgcaagatgaccctctgcctgcccgagctggcctgcgggtcaccctgcaagatgacccctctgcccgcccgagctggcctgcggggcatctgcagcccacggggccagagacccggatgcaactatgggcccgccccgtttcctcaggcagctagatttctcttcatattccttttccaacaaacgtctcttgaacatcgactgagttgatagacaccacggagcctaattcttgtaaatgagatattttcacagtaacttcagaacgtggtatttgtcaagggcctctagagaagcaccaacattgctagcgcttaaaagaaagacaaatgtcttccgactctggtgattcagagatcaaggcaccttcacagattttcataagcagagctggggaaggaactccagcaggaagaaatgactcaaggccagatgaggaggtggggaggccctgactcttgtctgggggtaacaatcgtggtttaactggatcctgatgttgctgtgagggaggattagaagacaattggcctgaagcccatcacgtagggcttaatgccaggccaggggagctgaaatttattcaacagataatggtacatttctgaaggttttccccagtggagaaatgcaacacgagctgagctaacgaaggtttaagtaggcagtggaaaagggtgaatttaaagggatagagagaaggcaggagagggcggtggggaggttattccaacaggaaggtaaatttggagacagaccataagggacaacgtgcggtggtggcaacagaaacagaaaggaagaccgacctcgacagtcgaggggctgggggataggatgggcttaagccagctcctcctgcactttcacaagtggcaagacccaactcttttggtagcgtaatccagtgtcttaccatttttcatggaaccacatttgcactaaaatgaagcataagaaattcagaatggaggaggaattgttatgggaaactatcactgggcccatggctttttgttttgtatttttgagatggagtcttgctctgtcacccaggctggagtgcaatggcacgatctcggctcactgcaacctccacctctgggttcaagcaattctcctgcctcggcctcctgagtagctgggattacaggcatctgccaccacgcccagctaatttatgtattatttatttatttatttatttatttattagtagagatagggtttcaccatgttaacaggctggtctcaaactcctgacctcaggtgatccaccctccttggcctcccagagtgctgggattacaggtgtgagccaccatgcccagtccccaatggttgttttaaatggcacacaatttgaaaacatctaaatttcctgaccatttggctaaccttaatactctttaataatattaagtaatctaaaccagattagttcaaagttctgtttctttcgatttctttaaaaagattttcctccattccttgtgcgttgctattacagaagacgattgttaccttctgatcaatgagcaggcgatctcacaaacttgcaaggatttttttcaaagatagaaatagatacagattgatcccgaatgtaaaaatcaagcatagtgctaatatttagacattttcccagtgtatccagggattatttgagtcaccagaaaagatttttcgtgacttttctttattcttaacatgaaaagtttagcagcaagtcaagtttctggaaaatcctatgaaccatcttgttctttggagagcttaacgacacctaggtcatcaacaacaatcaacaatgaactattgatttcagctgtaatgatcgaatagcagtgccttaaatccttcctggcagggatggcagcattgcatgcacatgtatatgtgcacgtgccagagtaagccagtgtgtgggcaccaaagttacctctgtggtttggaacatccagaggcccaaagccagcccttagctccgtgcaggtaaaaagggtaagaaagtgcaacagttaaagcaatacaacggagtgaagcctcctgtgcttatttctaagtaatcaaagcagctgtataaccacaaggcagctgtcccaggccgactgctgaccgtgtagctgacagttacatcatgaactaagggaatgtgatttttagaaatttcacttattacctacctacccatagttcatgagatgaaaaagttttgtaactaaaatatgtaacttccacataaagaatcggggaattaagaggacatataacaacaagataaacatacataatgaaggtccacgttaccattagagaaagtgaacataaatactgaaatattaaagtaaggtatacagggaatataggtttacagtgttgtgatttttaagtagaatttttaatcatttttggaaactaaacaaaaatccagaagaaagcatatgtttttctcatcataaatataaaaaaaaactgtgaaaagaaaatggcaatactaaccacattttgatacattctcataaagtctagtaacaataacttctagcactttaaagttttctagttccgacctagattttatttttgccaagatacaacctagcctgatagctccaatagcaattacagaatatgacccaattatttctttaccccccaaaaaaattaacatttttttggttaggaaacagaagatattttaatgaaaatgatctaaaacaaaaaatgcaattgtggtaaaatagatgaggaaattgtacttctttgtattaaaatatttttcataaaacattaaaaatatattaatgagaatttaatctcatataagaaagttaatatgctataatattgctttatgtatgtttatacgaaattgcagggaagtaaaacaaattatgtcatcataatattattttgtatcccctacagaaatatttttctaaaaccactaaaaaagcatattacagacttagtgaggaggctacctgtaaacaaattattttcatggagaagcaaggaaaattactaaaaacaaaatttacatttaaaatgtagtcaataaaggtcaggtggtcaatgttggtctcagttttccccaaatgtaaaatggcagcccaaggaaaagagaaccgttggacaaaatttgaaaggaaagacatatttttaaggatcagttaggaacaactttttattttcttttatagtaaattttctgacagccatatccttgcatttaaattctaccaatcacagtgactcaaaattataatttgtaattataattgttaattgcttaatgaataattaatttcacagataacttgaaagctatagatggatgatagattagctagataataatagagaattttaagattagaaggaaaacagttttcatctgaataatatgtccattataaagaaatgttttaagtggtattttttatttcactttgttttcatatatatcacaactgaatttctcagccagagcatctataaagacatttcattattttgcatatggtggtttccctttgatgtttggtggttgaacttaacctttctgtaccatgggctcctcctctgtaaaaatgtgagcagtaacattatcaactttccaaggttgttgtggggattaatgagaattcaaattaaataagctaaatgtatttaaatgcttagcatagtgcctgacacacagtaagaattaaaatttaggtcaaaccacatgaaattgacattttttagccaaaaatagttgaatattggcaacgttatctggttcattataaagcagtattcacttttataattattctaggctacgtgcctatttttaaaaacgtaaatgcatacaaaagaaaaaatgacacggaccaaaaagtatttaaaaccaagtaatccacagattagggggagctcctgtcctaaagtgattacaagggcgaccataaggaatttctgtgttaattggcttggccacaccgacactgagtgcccttagcaaggaagcagactgtaagggaaacagccgaggcttcagctttaggttgacctgagatcaaatcccactttgacaatttgcttatccgtacagtgggtagatttggaatattaatgaatgcaccatgaactccttgaattgatcttattacggaagtgaaagaaagtaacattttttagcaccccataattgtcaagcttttggctaggtgctgtctataaattagttcatttaattgttagaactatcatgtaagaagcactgatactgttattataataatgattataattacagcaaactctgctgcaggacttactagtagatagcagctgctttgcatatataccctatttaaccttcacagccacacgctaacatagatccctgggaggaatattcgagagtttttcccatcttcttcagcatcatggccaacctcatagaattaaggattaaatgaaggagcatacataaaactcctagcctgatgcctgacaccttgcttcccacagggccaattcagggtccttgtcccatgccctgaggccctgagtagccctggccttctgctatcagaagggcttccttagtaaaccccacgcagttctaagctctataacccagagcagcaggaggctgtcttcataccgcagcccctggggggtgttaggagactcgtggaaacccattttactttattcttcaggaaatataggcccccaaagtctatttcttgccaaaagctctaatttgctatcttatagtggtcaggtttttggggtagaatagtagaactaattaaaaagggagtccattgtgttccttcaagcaggaaacaatcataacaggacttaaaggaatttagtattttgagtaattttcttcaccttcaggcattttttttttgagacggaatctcgccctgtcgcccaggccaggctggagtgcagtagcacaatctcggctcactgcaaactccacctcccgagttcaagcagttctctgcctcagcctcccgagtagctgggattacaggcacccgccaccacgcccggctaatttttgtatttttagtagagacggggtttcaccatcttggccaggctggtcttgaacttctgactgagtgatccactcacctcggcctccaaaagtgctggtggaattacaggcgtgagccactgcgcccagcccaccatcagactttttacatggagaatgtttgggggcccagtgatgtagttctttatgggattcataaagggtttcctgacagacacactactcgagtaatgactgtagcacgcagagatatgtgcagcccagccatttatttcactcattttaatgtactttgctctttcagacagggcaataattagacctgccagtagcttttcgatatgagaaaaaccactttaaatgctccacactgatttctgtaaacagcttgctttttcttaatttataatgttatctcttctaacaggccataactacataaagggacatgaaaaaagtaaaagaaataccagataatttcgaacttaagatcacatgtactgaactatctatccaaaccattattttaccttaacttgaatagctgtcaattgtcgatctgattttgcaatagctcactgcctatcagaaattccaaatctttttgtaatgtttgtttttaactttcaaacctgctctcaatgtaatatctttcttcctgcgacgaagctttgtttctttagttaaattgaaataagactatgtaaagactttgtctccctattattcactaaagagggtgaacaaaatcaccagacctcaaaacaaaattgacaccctggtgcttactggtgcttaaagggaatgtcagcacacccactgaaatacttcttcagtggaggtcacggttcaggttgctggcatggttttataaggaggctcgtgttgcagctgtctgcactgtccctagcctgaagataaatagcagacttcagtttccactgctactggtcttttaaccttcaataagaacaaatacttctgccttagcttcatctgcctccaagttcatctcccaggacctagtgagctatctcttatctatctccttcccagccttcagcttgggcttcctagagctcaagagcatcccagcccactctcatctttagaggctccccatacattaaaaaatgtagaaatgccaacacaagttcaaatcaattgcaatatatcatgaatgtttacattgaacaaattcacacttttcacatacaaaccaaaataacaatgactttatgtgtagcctcattgagacttaatccaacttaagacactttgtaaacctgagcgctgcacccagaagtgtgagttcttgcctctgattagcgacccctcacagccacctgatgggtgggtgggtgtgcagtcataaggatgtaaagcaagctttttagaaacctaattcactgtaaatgtccctccttctgtatatgaccatcaattcagcttctcacaatgatggactgaccgtgcagtgtcctctgcattgcttaacacaatccctccaattcttcggtgcccaaggtggtggcccgggatacctgggcacctttagaagtgatagtgactcttcatcacatctctctgctctctgaaatagtgcttattgcatcgaccaaaaagaagtgaatgctggagtggcttgtgcatgccaaaaaatctaacttctgagatcttctggtctactccctagcttcccagggtgataagatgagactttgttttctttataacctctacccagtagacaaataggccaaagataagaacaaatcactctcacaaaggaaaaaaaaaaaagcccacacagcaaaataatacatgggaaaaggttaaccctccttagtaattagaaaaatgctaactaaagcaaccttagagtagcattttatagacgctggattggcaaacacaattttacttctaacacccaatgctgtgataaagcaggcacccgtatgtgttgctggaacatcatacactggcctaacctttctgaacaatcaatgtggcagcctataccagtaaccacaaaatgttcatattctttgaagcagtaacctcacttttgagaattctttcaaggaaataatacaactaaggaaaaagactttatgcacaaagatgttgattgcatcactcacaaaaattgtgcaaatctggaggtagacttaatgtctctagccaaagaagaacagctgagtaacttgtattccttccactccatagctattaaacagccatgacaaatgataattaggtagagtagatatcaatgttgaaaatcccagatgccataactcagtgaaatcatcctctccggtaacaacgcattccaacctcaaggtctttgcctttgctgttctgcactgcacgttcttctcaagcttatttctttctcccaagccgacttctccacactaagatgtcagcttaaatttaattttcccagggagatcttctggatcatcgtgcctgtagtggccccccaagtccatctctaccacatcacctttccgttccttgccaggacttctcactctgaagtactcttatttaatggttggttacctggcatattaccggactcctctgccagaatgtgagccccctagtctacattcccactctagtccaataatctatcctcagctgctgaagctctagaacacagctggtcttcttgaaatcacagaatttggatgatgacatctgagttcatattagaagctggttcctgagtcccaccttggatttattgccttgttcttttatcctccgactgggaagccagtttacaaacagacactgatctaagcaccaggcaggccatgtggccaaatgaagagagctgtatttcaccaaggcgaatgctccagctgttgctctgggggtccttcccaccacccaagccccatagacgtgtcaggaaccatcagcctgacctgcccgccctgccctgcagccagagcctacctgtgatgaggagagtggaggacggagttggcgtcctcgaggccaggaaggttgcctgtccctcagcacttcctctgccagactaccttgactccccaaattcccaccactggagctgctcctttgagccaaaggtgtctgtaaaaactaaacataggccgggcacggtgctcgtgcctgtaatcccagcactttgggaagccgaggtgggtggatcctgaggtcaggagttcgagactagcctggccaacatagtgaaaccccgtctctactaaaaatacaaaaattagctgggcatgggggcgcgtgcctgtagtcccagctactcaggaggctgagccaggagaatcgcttgaaccagggaggcagaggttgcagtgagctgagatggcaccactacactccagcctgggcaacagagggagactccgtctcaaaaaacaaacaaacaaacaaaaatatatagcctagactgaggacccaccatcacatggcaagtctttaagtccagggtcttgctgatagaagcacgtagggggcacagagctcccagtacagatatttccaagaggctggaactaagtggaatgacctatccggaggccttgggcaggtgaaggacaacagaactctgggaggtaacactggggtgaagccagaaaatcagttgagccctttacccaggtctccatcaacctctggaggtttacattgtccagacctaagatggcaggcgccagacttagtggaagcttggtgagtgagcctgcttaccagagcatttgcctcagtttactcggcgctctcagtctactctgcagatgacgttgaatttggaagcctggtccagggcaggagctctgatgtctaccccatcccaaagggcctaggaccatggcgctgaagagtctggaagaggacggagggtttctttgggctcagaggccaacgtagcaatctatgcagagaaggtggcggtagatgcggggattttcgcctcagtagagaagcggagggagtctcctcgaagcctccgccctcactctcttcctgcagggaaagatgtgagccagaatgctgccaatgcctcttactatctcctgcttaaccgggctgtctcctcgtggccagcaacgggcaaggagatagtctctctgtcaattcagctacttatctgacataaattggaattataacacatgtattaagtgcctttagtgcctcaaaacacaaaatcaggaaaccggaatataaattattttgcaaatattaaatcccatagtgatactacaaaagaatgacctttttgtggcttaaagcacaagtatcaggtgtgcatttgaaaataaaatctgcttcctcccatgagtttagtagggccacgtccactgcttcctctcgtgagtttagtagggccacgtccactgcttcccatgagtttagcagggccacatccactgcttcccatgagtttagtagggccacatccactgcttcccgtgagtttagtagggccacgtccgctgcttcccgtgagtttagtagggccacgtccgctgcttcccgtgagtttagtagggccacgtcagctgctgcccgtgagtttagtagggccacgtccgctgcttcccgtgagtttagtagggccacgtctgctgcttcccgtgagtttagtagggccacatccgctgcttcctgttggcttatcagggctgcatgtctcacagtcagccagcagtctagggaatgggccagtcatgagctgtgctcctaaatttggaaaaatcaggaccttgtggagacaaaaaggaagtaaacagagctaccatccttcagatgaccacgtctgggtgccatttgcagaagaagagccagtcttttccccattcagttaagcaccaacatattgaactatatctgaaggaaaacggaacgattaagtgtaagcttaagctataaattgtttgctcataaagtcctacgaccaagtatcttaatcagagatgtaagcagggtgcaaggtaccagtctagactaaaaaaactcataaagggacatcccaaagatgagggctccaagttcaaggtgagtccagataacaatgtcctgctgtccctcatggcctgaggatgaagcagttgctctttaaaagtgttgctcctttgtgaggttgtagagtaaactcattttattaaacagtaaagcaaaaaacactccatggcgttctgtggggctatacttcctgtcctctcccagaggacagttaaatgatggccagtctactcttatctgggagctacagtatagacaaaatagcagctgcagtaataatagttgtcgaaatttatcaacagcacgttaaattaatataaacataatgcatattctcttatttttgtcctggaacctgtccttacagatggatattatttcccctgtttcagtggagctgggatgcatggccatttgtgttcaacaagagcacgcctccgcccctcaggggtcctgttgtttcatttccaagctgcctttgtccagactaatcttaatgtcctgattcaggggaaagccatcgggtacactaaactgaggaattttaagagataaaaatgtaactcggacaaataaacattctttattcaaaagtatcaaaagtcagcatatttcacctatcaacatttccaacaagcttcagtgtctattgtgcaaacccaattttgctgctgtggcaaattaaatggccacattcaaaacttccccccacagtttagatactgttctctctctctctcttttttttgtttgtttttttttgtttttttttttgtaagatgtggccaaaactttgattgggctttaaagccttaaacatttgtaaaaatatcaggcaagctcaagcattttcagactgtgtcctgcattaatacacttggggcaaagtggatgtctcttgccacatttaactcaccagtgtagaagctgataaaggctgatagccagagcttggaaagatatttctaggttatttttaactaagacagttgtaaaaggcgtgatggatttaactccgtcactttcagagcagctaactgagttcagccagcagactgctttgatttgttcattaaatgtattatgtttgcattacttgagttcatttgatgagatattcccactctgtaaaatatccagctaaggatttggaaatctattcaaattttgcatccattaattcattttagaattttcaaagagtaggtactttaggcaagctaagatatatcccaaatattcggggaaacatccaatctacagaaatggtgtaacgtgttttttcatcgtaagcacgattggtgagtttatccatttaattatttttcttgctagaacaagcagtacatcaaggccatgagaatcttttactttgtagctctgtgccccgctgtgcagcccagtcacctacaatgattcagccttatcttgttatgatggtgagcactgggatggctatgcaaaggcttctaagttctgagttcatcattttagaaatgcgtttccccatagtttaatgtgtttgctgataacatttattagaaatctgagatgagcagggtgagggggccaagcctgtaatcccagcactttgggagaccgaggtgggtggatgacttaagtcgagacgttcgagatcagcctgggcaacatggcaaaaccccatctctacaaagataaaaaaattaaccaggcgtggtagtgcgtggtcccagctactcgggaggctgaggcaggagaattgttggagcccaggatgccgggattgcagtgagctgagatcgtgccactgcactctagcctgggtgacagcgtgagaccctgtctcacaaaaaagaaaaaaagacatctgagatgaatttttatttttgtgcctcaatcacagaaaaaaaaatcagagctgaaaacaggttgtatctggcatcattaacattacctagaaatggagaagtctgatagcagctgccaggctggctcatttttaaaagttttcaccaccagtgtagaggtggttacaattatttccagtaggttttatcactcctgagggcagccatcagtagttcttttccaatcaaaatcatctattttgctgtttcgcgagctggttgaaaatcaccatgtagctatgaaataaaccatacaaaacaaaacttagatattaaatgaaagcactataaaaatccgatatgttcttcttcttggagcaaaagctgctaaaaagtaaatgggaccaggtgcagtggctcatgcctgtaatcccagcactttggggggctgagacggggggatcacctgaggtcagggattggagaccagcctggccaacatggtgaaaccccatctctattaaagaaaaaaaatacaaaaattagccaggcatggtggcgggcgcctgtaatctcagctacgcaggaggctgaggcaggagaatcacttgaacagggaaggtggaggttgcagcgagccgagattgagccatcacactccagcctgggtgacagagcaagactccatttcaaaaaaaaaaaaaaaaaaaaaaagtaaatgggataatctcatttttcactatgaacaaaaagttttttttcttctcaaatttaaagatgatccaggtaaaccccactttaagttgaggagtacatgattgaaaagcagccagatgaagctacctagctgtagagaccctccacatattgaagctcatttgatcgaacatttccaaattcatgtaagtgctatttccatggataacaactcacaaatatgtaaatagtaaacaaagaattggaattaggcacatggtggccactacacctaccatacactttatttagaactgagtttgcttatatcagtatctggatccagtaaacccacaaggtagcaatttacttatactttcattcattcagtttacaagtgcccaatttgaatttgatgcccacgatgaggtttataacataattaccatgatcctttccccccacgaggtggtagaatgcaaaagggctaagtaaacaggaaacatctattaagggttttagagtaacctggaaataagcagggaggggactacaggcctagtgctccaggaattcaaaagaaagaaagatgatgtggatgcaaaatcaaagagggagtaacattagccctgaaccaaagtaagcttgaacttaccaggaggaagaggagagcatattcccatggggaatttaggcatgaatgaaaatttcatgcagtggggtcagtaggaaatccagcctgagtgaagcaggaggtcccactgtggaggagaatgcaagtgaccggcttcgtgagggagatgagatcacacaggggccagacgactggggttttgaatcggatccattatagaacatggagacactgattattaaccagaaaagaaatgatgagataaattgttctgcagggtaaatcaggaagaggaggctttgaagatggaaagataaacagactattaactatgatccaggaggaactggagtgggaggcctggccccaccgtgtcccacacagcagcaactgcacaaagaaaggagggccaagggcagcatttcatcttccgagcccacactcggtgcctgtgctcctcacaggagccttctgcacttaccagggggccatctgagggcctccacaccacattcaattccagcaagaactgttggagaactgcaagaaccctttcctgaaggaaacccagagactctcctactcttcgtagagaatgggaaccttcaactttgattcctaaactttcccaacataagtgacttcaatgtggctttctggtttgtttcttaagaccattcaaatacttggaaggttcctcctttttaccttctcactctattcctgcgatcccacagttataggttctcctcgtgcctctggtccaataccaggcgtccgtccactaagtagcaatgacgtccctgggcagtcacgctcagcctgctcgtctatcttgtattcatgaaagccttataatttcctcatctagaagactatgtaactaatatctaccagactaaaaataaatcataataaatgcccataaagatgggggtatgaaatgtgaaattgatcctagactttgcccatactgaccatgtgtttatggcactgagagaaaagtccttgaaatcagtcggccttgatttttgtcatcctgcctgtatctctgtgagtgatactattttaaggacctgtaatgaagtaaagatagtgtaatagtctatgtcataaaaagtgatattttttatcatagcaattgactatcctaggaaacactacccggttggttgcagtggctacagtatctccccatcacttactcacctggaacctctctgctgatgatacggggctaaagttcttctgtaggtagcaaatgttctgctacctcctgctctcgctgtgatgacatgtgatgcttggacctctctttctgaaccttcccgccatcattcttgcacttcagcagattcttactttgatttctctttttcaggatcccagtatcacttactgcttacatcatttcactacattttctcacctctcaaaacctcaattttctcccctgtgaaggggaataataatagtatttagctcatagggctattcttagttttaaatgacctaatctttgtaaatgacattatattgttgttattattactccaccatgagataagacagcgagaaatagatttaacacagacagctggacttaactctctgctctttttttgaagcactctgttccccgaatcatgttggccaataagaaaagagatgagcttttacttcacaagcttgaattcagcttaattcaatgataactgaatctattgttataattatccagtagagggataaattgatgaacccacctatttttcttagtataactttcaggtcaaaacagtaattaatcagagaagaccttagcttgcctttttgtagtcttgaccaaatcattgtcaattggtatgtaaaaaagaaattaacccatataattggtctttaaaaagctatatagacttactgaaatagcagaatgtaatagcatttgatgtagggtgtcaacaaataatatgaattttgcacagtgctctcttaactagaattaattatataaacatttggtcttttcaggttttcttagaacttgacttgacacctgattttgatgcttatgaggtttctgacttactttgaagaattacatagttgctttgtgatcatcttttcagttgaaatacaggcatccattgaataactgtcatttctaaatgcttattccaaagttacattgtgatattataaaaagtaatattaggtgaatagaaaccagagagcatccaaagttcagtctttattcagaggcagtaactgagattcagagaagttaaataacctgcccatagttaaatagctagtgagttattgaatagtatagctactaagttattgaaaattatatctcaggctatttgccttgaagtccagtattcttttcactatatcagtatgatcccattgttagtgttgtacatttcatagataaatgaatctactttgcagttggacaacgacaattgtttagaaattgtcattgtctatgtgagggaaatttagatattgaattgactcttaggccaagattcatgatctcttcaggtgaccaatggccccattcagaagatgaaaacgtttcctcaagcttttggaaatatgatggcttagtaacctagtgctttagtgacccagccttcggtgtcaagaagagagaaagagaacgagacatccagctgggaatcgagtgcttacttcaaagcttttatcttcagaggaaagaaatcttgtgaatttcattaatgtcaacaagatctgagaagatttgaagtgggtaagcccttgggcatctctagcgtgccagatgccgtggttattgtaagttttggttgaaaaaccattgcaactttgattcacacacccatgaaccaagactttggaaatatccattgtaaggttgtatttaagggaatgtagggaaccttcggtttccaagagaacatgaagtcagccaaggaagcagtggctaagcatggcccagacacagaaacacccaggattccaaatggggaaacacacattatggttaagggggagaaaagttgagtcccctcaaagttacatagcaaagctaaaaaaatagagtgaaagaagcatttctttaggattctaaaagcagataacttcacggcttctccccaaaaggctcttctcttactcattgtttaaaaagaaaaaaaatgaatttggtcctaggttttcccctgcctctttcttttctttctcactccttcacctccagaaaagaccagattggaattcatagctgtttccctataattatctaaactttactggagaaaactcttattctaaaacaggtaacactatttctatatagtaaattcagtccaagctaacccaaacaaacacatttctggcaaaacaaatggtgacaatttaatctaggtattgaaactgtaaatatcttaaaagataaaatatacctgtagctttccttttcccctttcttaattcatattaaaaaaactcaaaagcaaccatttctaaattcgcaaacattatgagttattgttaatgactttttttagcaatatgttatctgttgaataaatttcttttgaaaatttttagctttatttcactaaaattgacatttctgcttaaaaaacaaggagtaaatacaaacaaggagtttctgttttggtcatctcaatcttttaactactaaatccaataaacacaaaggaaaaatttggctgggtgtggtggctcacgcctgtgatcccagcactttgggaggccaaggcgagcggatcacttgaggccaggagttcgagaccagcctggtcaacatggcaaaactctgtctctactaaaaatacaaaaattagctgggcatcgtgatgcacacctgtaatcccagctactcaggaggctgaggcaggagaatcgtttgaacctgggaggcagaggctgtagtgagccaaggttgcaccactacacttcagcttggaccacagagtgaggctccgtctcaaaaaaaaaaaaaaggaaaatttattcagaatcatccaacagagaatctgtgatggcttagtgtcgtcaagaaacatgataataataaatgcagtgagttccacctgcacaaacctgccaagacctgagccaggccgccagggctcgctttctctctcaccacagcggatgacatcactgcaacccaatcagaagaaagccagctttagctgtgactgatgacgtcaaaggttacaggtcttaataggtgaaaatccttttacttgggccttaaagctcttgaaattttttagttcagcatttgagaatcaaaaatatgccttttctggtccagaaagaaactatttgatttcttctgtcagcattttttttttaaattccactcagtgttgcttcagcgagattacctggccccagtggggaacacatggcaaggcgatttctgcagtcggcttgattccgacaaatgctgggtacggaaagagcttggatctggcctgagttcactcaagcgccatgtgtgcaaagtggctacgcctggcagcaaatgctccacatgccaacggccagagcacagccctagaccgatggcggtgcggctgaaccacgaggcctccgcagctatttatttcagagccttggttttatggctgtcattcagccttgggtgcgtggagagagtcagtctgcctgagtcaatgtctcatgctctctgcggctaaggtgaatgttgttctatcagtataatcgtcatgtatttgtctgagatagttgctaatttctacagtcagttctacagtctagctattgtgtacctaggaagtaacacaaaccattgttgttactgagcctggcaagttgcatcataaaattcaagcttccgaaagcaggtatttagtgtgaagaaagactggtaatgatagttttatcatcatctcagtcacctcttaaccatttcctgattcactcaggtggtttttaatggagtttcccaagttagtgtttcctgggagaatgtttggttcgttgccttctaacagcctccagctcttcaggcatctcaggcaggagagcgtgttggggccgggactctcctcccgtggacctgacaactctgccttccccggtgtggtctcgctgttccctttgagagtgcgatgctgccgcttcagccaggacgttctcaaaattagcagaagggcttccttcctgaaatcgtgcctatttaggattttcttagtcattacgaaaaagtatagatagagttcataaatgacttcatctattcggtatcaaatgaacaacacttcaggcatgttgaatgagcaatctaaaggaaacatttatttgtttaatttttccagtgccttcaataaggctttcatttccaaataactcctttgtgtattgctgttcatacaatggctatatatttaccatttaacagtattgccccaaagcgtaagagtgagaaaaatccaaatttgaattaaattctccctgagcctcgcagtggccgtcacacgttcccctcctgcttttcgcgtctctaggatctccgagtgtcttgactacaacaaaccgttcagagttctcaagacgcagggctcggtggcaagcaaagcgccacgggggacacacagcgcgtggaggctctggaagcagtggggtgcgtgggcccagacatacttccatggaggagaaagtgaccactgtatgctacaggaagcgtggctaattaggcttcctcagctggatggcaagctcccgggggtcttttttgtctcgcattgccctatagcgcggagtagatgcttagtctacagggaggacagcctgtgaaacagctgcagctgctgccacgacccacggcgttctgcaggacggaggagcaacgcgtcagcacacgtcccgggagtgacgtgggaagacctcgctctggccaccaaaccgtccttcctttctgtctttgcttccttcaccttcgattttttcctttctcctgtaatagtcataactaaagaacgtagaagaaagaatgaagtttgcacacagtctagaattgaaatggagaatacatcatcagaatcctaggtcatccaagcctcttgctggtccgtgtccacggagtggcagatatctttgtgaaatgtaaatgtgtcaggtgcagctccccattgcggtggccctcggtgacaagatatacggctgtcccttcacagccccaagctgagttcacgcagcccggaggatgctatcgctggacaagagaccagagaccgggatagacacgtgcgtcctagttctgaacaaaatggtatccggaaagagaaagcatcccatggggacagtttaaggaggtttagatagaaaaatgagtgtgcatattattcatgcttaaactgcttacatcatcaaaaacaccaatattcagaggaataaatgcacttaaaataattcttaaccaagaacaactttgaggcagtaggtcacatgcctcctgcatggagggatctccaagaacagaaactaaatccctcgttctcctctgcctgcctctcatctttccagaagcaccaggtctggcttaaaccattgctttcattctatttgtttgattataaataaaatatatcttttccatcatcaatgtatattttctagctcccagacataaaatccactccttgctttctaaattgaagtgtcattttcctaatcagaattgacaattgtaaataaccatttgggtttattcgttttaatgtcctattctcacaaacgtatttttcacgtgtcgcatgtatttaaaatggtgagttcaaacttaatcatctcaatttcaggccctcaaaaaactgtcaatgtagcaggtttgaaatggagacctcatgattcacctgcttctcaacatagttagaccccaaaccgtgcagggtcattgtttcagcatgaaaagtaaaggaggtgttccttttttggtcttttttctaccccaatgatacgcattctgcaaccacaaatattccaactccaactcactttttgaataagcaactcctattgtgttttgttcttttatcatttgaggttatacactgtggaaaaacaaaaaaagctacatagtttacttactcctatggtcaaattttttttaaaagtaagaacatgagataaagttctgcttgtcattgctgccttctggggcagtggaaaagcaggtgccttaagctttccattgtgtgcagatcttccacgccctttccctccatcaggaaaatatgtctgtctcctggtctattcagctcttgaccttctgactcatatgccgacaaaaggcaccatttatgagtgactaatgtatgtatctttgtccataaggaacttgatcacagcagccacaactcagcatcatcatcaactatcttttccgtgtgccctccaggggtttatgcaatgggctctgtcctatgcaaacaggccatgccaccttctccctaggtccacctctttcatgcctaggaggagtttatcagctataatttggggagaaggggcacacaaagatgagcccaactctgaggggacatttgtccctgctttggttggaatcctggaaagctgaagttgtttctaaaaagcacattctctgctgctgacctcccctgtcacgcagggtcctcccaccagcacctctgttcaaatcccctgttgcttttcatcctgcccaccttcttccttaacatcttttctttacacctgtagcaaatgtcaacaacgcctcctcccaacacgagcttcctcctcctctctcaatccaactcaaagtccttcgtggaaggctccccacaagcggagccaccgggcttcatctcccccgtgcagccattcctgcctgcaccttctcacgcctccgaacaccatgtcaatcttaagaaatataaacagaaaaaccggtggacttcaaatgcatatccatttacatgtttgtttttacaaagtgtatcgttgttttcctcaaaaacaatagggcaaggacccttttgtttcaaaatcttatctcttgtttatctgatatattctttttgttttgtttgtttgtttttgagacagggtcttactctttgcccaggctggagtgcagtggcgcgatcatggctcgttgcaacctcgaccacctgggctcaagtgatcctcccacctcagcctctcaagtagctgagattataggtacatgccaccacacctagctaattttttaatttcttttatagagatggggtcttgctgttgttgctcaggctggtctcaaactcctggtctcaagccatcctcccacatcagcctcccaaagtgctggtattacaggcatgagtcactgtatccagcatctctctctctctctctctctgttcctctctctcattcgtgtgtgtatatatatatacatatatatatataacattttgaatatttgggatgatcaaactttaaataaattgaaattcagctttacctgtgacagcacaaacacatgtactatgaggaacgaaaaacccacctaatcacaatggctttgtgaaccattttaaggtcatttattatgaataaatgacatgcactacagttgtgtgactcacaatctttttttttctgaaaattagtaatatatctgcctgccttcaccctcaccaaaagaaaagaataaggatagaaatttattgtgtgtatatcacagaagacagtgatatttctctaataagtttctggaaaaatcaagcaaaagaactgcttccctgtgctgtgtaggattgtaattgttatatttattctggtctgaaccattactaagtcttttttaaatgtctcgaatgactaattaaggataaaaggttggaaacaccatttttccctctattattttcacattcaaacaagataaacattgtgggtctacacttgaaatatgaataaaatgaattctttctctggtgaaatgcacattttcaagttgcactgaaggtccctggccccatggcactctctaggcctgagctgtcaccctcatcctactgggtcctcccagcccacctgtgtactttccttccaccatagataaggcaggacacactcatgacttgcttgctgggagaataaatgtcgttgaagcccttggtaacctaggagtggaatacaacagaaagcgtggaatgactatcgttagagaaaacaattgtggaatatctacacgcagaatggaaactaaggggccccatttttgtcagactccctcacccttggtaactcctgcagcttggatacaatcgcatatctctttccttagtgatttgagattgagtctgtggtgtagaggagaggctcttagccataggttcctggcctttgaaggccaccctaggaattgcttccctcgtagcatcagaggcagctgaagcggtcacttccagactctgcagctgacacacctccccggacttggggactccaaaactagcagtggcacaaactccctgcaaagccctgactgacaaatagctgtcatcccagcattgagtgatagttcgggagcagccagggcaggagaagcagcttcctcctgtcccacctgcacctggaatgagcaaaatgatttcaaggaactgaacacttggattactgggattcaggagaaagagtttgccatgtgttcaaaagcagcagagatgcgggtgggggctaagcctcattccaaagcagatccattttaaatcacacggaacgaacagcctgatctcacaatagactgttccttctaagtacaccgtgctgtgattttggaaaactcagggcccaagagaacactctgtatataatagatcaagaaagagagtccccgacttgtcatctttcttgtaactgtgattcacttacttttgtttactctgttattcctttattttaggttatttttcatcggctccaatctgggacttggtatttttgtacagttgccactgcttttaaaactccgcaagatcgtgtaaaaatcttgcatgtttgtgtctcctaataagcattcagagaaaatgcctagactgtgtaggacttttcgggaaattgcagagaagtaactggcctctttgtgtgtttgcatgcaccagtgaactccggagacggcattgactacagccagcagaagagggagaacattggggacttgatccaggagacactggaggccttcgagcgctacggaggagaaaatgcctttatcaacattaagtacgtggtcccaacctacgagtcttgcttgctaaactaacagtggcagcagctgggacttgaaacctcccgttggtgttgggatcatctgtctctgttgcttttagcatctcattccttgtgacttccacagctttcttttctacagctgctaaaatagtggcttatgggccattggactgttagccctattgagagcaaggctttccaatacataaatagtgtctgtttcttagattacaatagtgtactgtgcttatttgttctaagagaagaattgcttctttatacagctccgacagaagcaggagtccgagttaaaccttcagttgtatagacaataaactataattttcatatgcaattcagcaattgctgttctgtgtgtgcctgccctgggggtgatgtcagaggttgtaagggaagagtttatgctgactgcttactaggtgtttgtcatggaagagaagcatgggttcagcagtgcctctctagcagctgtgcggaataatgtgctttgacattcaataaaactgttgaatcta

SEQ ID NO: 369 - DNA, 67320 bp, Homo sapiens
ttgacagactagaccacttttttattacagcttaattggcacatggttcactgaagatacacttcacttttacataggcttgtaaatagaaaaatacattgatgcacaaaaaatatagtacttcaataccaaacttaaatgatttccaaaaagaatacaggttatttcaataattaaaggtggcttttgtgtgtgcactatatcatgtatacacttaattgtatgtttaaggccagtggaatctatagctaattactcatttggttcttgaaaactgaaacatgcaaacattcttatttttatgtttaaagacatttaatgtgttattctaacacaaatacaccatatagaatatgccctgatatgtagctgtaaaattatgttgtactgcactgaagtcttatggcaactatataaggcactgctgtgtgattatgaccctgctctttttttttttttttttttttgagacagagtctcctctgtcgcccaggctggagtgcagtggcgcaatctcggctcactgcaagctccgcctcccaggttcacgccattctcctgcctcagcctcctgagtagctgggactacaggtgcccaccaccacgcccagcccattttttttttttttttttttttagtagagatggggtttcactgtgttagccaggatggtctcgatctcctgacctcgtgatccgccctcctcggcctcccaaagtgctgggattacaggtgtgagccaccgcgcctggccaaccctgctcttgaaatgtctaaatcttttcctcactagcatatacaattcaaatgcacaggcctccatgacttctttggaatttaaaagaagccttcatttcaaggatagaaatatgtaaaattttaccaaccatggataagtttgttatgggagtagtggaaggacagtggaaaaaaaaataggttttttcatgatacttttatttttccttttttaaaaataaatttagggggtacaagtacagtttagatacatgaatatattgtgtagtcgtaaagtctgggcttctagtgtaaccatcacgcaaatatacttgtatttttctaattacagttctaccaaacatttgccaccacaaaatacaagtatttttattctttatttaaattatggtgagtgatatttcttcctatatagccattaagatctctggaagttttgatctactttattcaaaccactttaataaataagacttttcacctaaatgaaatacctttgaattttataaacaacttccatgaaacatatattaaaaccacctttaatttggtatgaagacactttggcaatgcagcggaataaatgatcttggcaagacccagcaagtacagtaaatgctcatgagctctatgaaaaatataggctacagaatacttcatttttcttttattgaactacagtacaaatgtgactgcttcaatatgaacatctatcttccaccaaatagcaaacaggcatcttatgtaattaaaaactaattatttcaattccaccaatggaaaagcaaaacaagttgcaaatatcaacaatacagagcctgctggtaaagatagagatgagtaagttataagctaataaagctgcagcctgaggatgccagatcaacattataaatatgaagaaaaagaaactaaatatttactcatcgcaaataactcggcataagcaccagctatgttcaggtgcggccagcacataggccaagtataaatgtacaatcacagtgaactaaagccataaaatctagttccctgacccttcaatcaaccattcagagcaatgggaatatagcggggagacagaagtcccactttggttgctcatattacattaagccagcctgccccaccccaatccccttcccaccaataaaaaagtcaccgtgagtgtataattggtcaatccagtttatccaaggtctatagatatagccatgatttgtcctatattcatgttaaatagaatgcttacataaaattaatactcaaagacattgagctgatgtgcatgtatattcttatttaacatttaagtggctttaatggtattttagaatgtcacctatggcatgagtcttcaaatctggattgaagactgtggcggttttataactgcatgtaagatcttaaatgtaagactctgggcctacctacattaaggcaggtgacagtaccctcattcattctacataataaatacactcttctgtgactgcaaaattctgaatccttgaatgatttactataataggctaaggttgtataaggcacttttggctctgaaatatttctcctaactctcaggctgaatcttaaagaaatatttacaaagctgcaacaaattaattttagaaccggatgctttattcgtaggtctaatggggatggtgagaagcaatttgtacacaatgcccattaatctctcactgtgccatgtatcaatcatagagaagatcccaggcatgggccacctgaactactatgtcgcttacttgacttctcaacagccacatgcccctttctccttttcttcacttaactgatccgtagaggcatgaccatttgatcgcaccactccttcaggaatccaggacttgtccacacaccgttccattcgcttcattatcaggtccagaagcatctcaattgcttggcttatgtttgtcccattggcagcactagtttcaaagtaggggattctggaagacagagacaactgaggtaacaacatgtggagggaaaggagagtgacctttgctcttgataattcaaattagagaatcgatagaatacaaatatacaagatgacaaacattttaccaccccagagtacattaaaaagttaaaaagacaataaaatactcacactgcatttccagtagatatgcaaaactggaaattttagactcttcaaaatatcaatttttggctgggcgcagtggctcacacctcccagcactctgggaggctcaggtgggcagatcacctgaggtcaggagtttaagaccagcctggccaacatgcggaaaccccatctctacaaaaaatacaaaaattagccaggaatggtggcatacacctgtaatcccagctactggggaggctgaggctcaagaatcacttgaacctgggaggcagaggttgcagtgagccaatattgtgccaccgcactccagcctgggcaatagagttagactgtctcaaaaaaaatcaattttcattttttaaaggaccatatatatattttggcaatacatactgatttactgtaaaaaatttataaaaagatataagtaggggattctggaagacagagacagaattaaatcttttttcgtttaagtttttggagggttttttgttttgagacagagtctctatcacccaggctggagtgcagtggcacgatctcagttcccaggcgacttcccaggcatcgatcctcctacctcagctttccaagtagctgggaccacaggcgcacaccaccacacctggctaattattgtatttttttgtagagacagggttttaccatgttgcccaggctggtttcgaactcctgagctcaagctacccacccgccttggcctccaaagtgctgggactacaggtgtgagctgctgcacccagcctagttttaagaatttaaaacttgattattggtatgaaagccgtttaaattcctctaagtgaaaagtaaaacttgaaaacttttagaagaacatacaacagtcttatctttttgacattggaataagaaaggatttcttaatatagctataaaagctcaaaccacagagaataagtttgataatcttgacaatgttaaagtttaaaactttggtgccacaacatatatcataagcaaagttaaaagatgagcgacaggccgaaatacatggcatttcatataacttgcaaacgggttagcatccgaaaaaataattcctcaaatgaattaaagtaataaacaagataatacaaaacagactaaggatatgcacgggaaattctaagaaattacatttgtgaaaaaatgttcaacctcacccaaaataagggaaatgcaagttaaaataatggtatattaactcacacccatcagattggcaaaaatatagaaatctcccaatattaagtattgccaaggagaagaaaagaggaacttgcacttactgcttatgtaagtataaactgttaataactactttggaaaataagacggtaatatctgataaaattgaaacatgcatgcactatgacccagcaacagcactcctgggtatacatctaaagcagagccaaggcatgttgatgggcaggaagtgagttacagggatacatgagacatcagcaatccctcagtccttagggcaactgagaaggtcttagggcagccagagtccctgaaccagtctcctccaaacttgagcagccttatctatttatcccagtgagctgtacaaatattatcattttctgcaggtgccatcctatgaaaaatattcagaaaccctgtgctggagcagcactatccaatagaacttcccacagtgacaggaactttccatatgtatatcatccagtacaataactactagccacatgtagctattgagcacttaaaatgtggctaatgcaaccaaaaatgcgacttttttgtttttgtttttgttttgttttgttttttagagatggagtctcactttgttgcccaggctggagtgtaatggtgtgatattggctcattgcaacctctgcctcccaagttcaagcgattctcgtccctcagcctcccaagtagctgggactacaggaacaggccaccactcccagctaattttatcatgttggccaggctggtctcaaactcctgacctcaagtgatctgtctgcctccactcccaaagtgctgggataacaggcatgagccaccacacctggccaaaaaacctgaacttttaattttaacttaaatagctacatgtgaccagtggctatcacactggatagtgcagccctagagaagctctcacatatgtgcacgtggcatcgtctaatggaatagatattgcagaactatttgtaatagggaaaaaatttacctaaacgtccatcaataagcgcatgaatagtgatatttttatacaatgaattatacaatgcttaaactgtatcaacatggcaaaaattaaacattgaattaaaaaaccaacttgtatgatacaagatcatttgtgtgaagacaacaattacacatcattataaaaacatctatgtagtaaaagtacaacttcttggactagaaatatataattttgactgcttttagctaaaagtaaccgaaaattgtggctcaaattggcatgaatcacaagtaggaatttattgtaatgcataatgaacacagaactagagagtttccagtgttaattcggttgccaaacggtagaaacaaagagcctagattcatatcatccttctgttctgccatcctccacatgtcagctttctccacaatctgactcccttcatgaccccagaagttaaaacattccaggcatcacatctcaacacaccgaagttccaaggaagaaaggactcttcctctgtgtgcctccctcaggagagaggaaatctttcccacaagtccctggaagactttccctcgtgtctcattggtcaaaactgtatcacatgccaatgcctaaaccaaactctggcaagaggaatggtacaccaccatcactggcttaaaccaatcagtcttcctgggctggtggctggcacctgcctctcttaagtagcatgtcctctagaagcagagtagatagctaaagaaaattgagattctataaataaaggcatgaatattgtctaggcaaccaacaacatctgctataggaagtagatatagtgtggttccctctgaggaggtaggaaggagaatggaatcagcaaggaattttaaaagggacttcaattgtatctgtaagaaaattttattttttatttatgcataatatagtttcagagtaaatatgatcatttaatacactgatataatgtgtaaagataagtatacttgggattgccataatcttaaatatttgtcttttctttatactagaacgattggaatttttccctcctagctatttcaagatatacaatagattgttgtaaactatagtcaccctactgatccttctaacactacatcttatttcttctatcaaaccatatgtttgtacctattaatcaatctctcttcatcctccactccctcctacccttcctggcctctggtattctccaatctactctctatcttcatgagatccacctttgtagctcccacatatgagtaagaacatgcaacatttgtctttctgtgtttggctatttcacataacataatgatctccagttccatccaagctgctgcaaatgatgggatttcattctttttatggtggaataacattccattgtatatataaaccatattttatttatccattcatccattgatgggtagattgattgcatatcttatctcttgtggatagtgctgcaataaacatgggagtacagagagcaaatacccttttgatatatctgatatacatctctatatatcttttgggatatatatatatctctctcctaagaaaacttacataaaacttttaagaaaacttccactaatatatatacacatatatatacacatatatatgtgtatgtgtgtacatatacatatatacacacatatgtgtgtatgtatacatatatacacacatgtgtgtatatatacatatatgtgtgtacacatatatgtgtgtatatacatatatacatatatgtgtgtgtatacatatatacacatatgtgtgtgtatgtatatacacacatatatgtatgtacatgtacacacatacgcatatatgtgcgtatgtgtgtacatgtacatatatacgcatatatgtgtgtacatgtacatatatacgcatatatatgtgtgtgtacatgtacatatatacacatatgtgtgtgtacatatacatatatacacatatatgtgtgtatatatacacacatacacatatgtatatatagtgtatatatgtatgtgtatgtatacatacacatacatatatacgtacacacatatgtatgtgtgtatacatacacacatgtatgtgtatgtatatatacacacatatatattagtggagttgctggatcatatggtagttctatttttagtttttttttttaagaacatccatacttttctccacagtgcttatgctaatttactttcccaccaacaatgtacgggttcacctttctctgcatcctcaccagcatccactattgcctgtatttaggtgtggtttttttttttttgagggggggggaattactgcctatattttggataaaagtcatgttaactggatgagaagttatctcattgcagttttgatttgcctttctctgagtagtgatattgagcattttttcatacacctgtttgccatttgcagatcttttgagaaatgtctattcagatcttttgcctatttttaaaacagattatttgtttttgctattgagttatttgagccccttatatattctcgttattaatccctgatcagatgggtagtttgcaaatattttatcccattctatgggttatctcttcattttgttgtttcctttgctgtgtagaagctttttagcttgatataaatcccatatttctattcttgtgttggttgcctgtgttttgtggtcttacacaaaaagtttttgtccagacgaatgacctggagtgtttcccaaatgttttcttctagtagtttcatagtttcaagtccgatatttaagttttaattcattttgagttgatttttatatatggtgagagataggggtctagttacattgttctgcatgtggctatgtagttttcccagcatcatttattgaagagaatgtcctttcccctctgttcttggtacttttgtccaagatgagttgtctgtaaatgcatggatttatatctgggttctctgttctgttccattggcctatgtgtctgttttatgccagtaccatgctgatttggttcctatagctttgtagtaaactttgaagtcagtgtgaggtctccagctttgggcttttttcctcaggattttgtcagttattgagggtcttttgtggttccatataaattttaggatttttttcgatatttgtgaagaatattattggtattttgatagggattgcattgagtcagtaaattgctttgggaagtgttatcattttaacaatattaattattccagtccaaaagtatggaatatttttccatttttggtgtcctcttcaatttctctcacctgtgttttatagttttccttgtatagatgcttcacttctttggttaaattgatttctaggtattttatattctttgcagctattgtaaatgagattgctttcttgatttctttttcagattgttccctgttggtgtatataaatgctaatgatttttgtatgttgattttgtatcctaaaactttactgaattcgttgatcagttctaaatgttttttggtgtaatctttaggttagaaaaaaactcttaaagcaggcctgtggcaagaaggcccagaaaagttaagcggtctgatcaatgttattcagctaataaatgacagagaagcaagtaggctcttcctgttttcttatacaggtcctcatatactatactatgtcttgtaaaacaaaataggaaatgtcttctcagtgtttagttcaaagaatactgatttccaaaactactaactagaagaaaaaaactgggtaaattcaaattttgcaacatgctattttattaaatgagtttcctggactataaccttttttttttttttttttttagcttttcccccttttttgcttcagggatttcttgtatatgctcttcagagtgttctggtttgcctgaattgaaactagctgatatatatgagtcatttaagattgaaggaaaaaataactaaaattatttcttgagctacccaatactatgtgtcttacatacatgattcactaaatataaccactactgtattcaggtacacaatattcccatttcacaaatgattaaactaaggctgagaaagatgaaaggaacttgcccaattcacaatgctagaaagtagcagagttaggatttgggtccacagctaattccaatgcagccagtttaaccataggttctactggttccaaactagtatgaggattttcaaaataaataaatcttatgcactgtacaagaagaaaacgctggctttggggagtattcagaggtcactggccatgtttatcaaaggctttgccacttaccaactccagactatatttctggaccatacacttgaagacattctgaattttacagcatcaagttgctcaagagcaacaaatctttttttttttttttttgagacagtctcactctgttgcccagcctggagtgcagtggcgccatcctggctcactgcaagctccgcctcccgggctcacgccattctcctgcctcagcctcccaagtagctgggattacaggcggctgccaccacgcccgtttaattttttgtatttttagtacagacggtgtttcaccatgttagacaggatggtctcgatctcctgacctcgtgatccacccgcctcggcctcccaaagtgctgggattacaggcatgagccaccgcacccagcccatcaaatcttaagtatacatttgttttgttatccaaagacctgtggtacaggtgtaatttttaaataactcacaaagcattgcttcaaaactgtatagctgtttttcacataatcttgagaaatcagacttcttgtcgaagtcatcctttatacatttgagatggtctttgcaacaggattaatcaagtgacaaattcaccttgcttttcaataaagccatgaaagtcgtgataacattgtatttccttcaactgttgacttcattgccaccacttgtgaggaatctaaccaaaatgttcttagatatcaaaacaacaaagcaaagttattttattatctcagggagtcctgcaattgaattcagtaaagtatttcttaaatttattagaactttaaagtcctccacgattactgttcttgaagaatgtttttgtttttctgtattctcatagcatgttaacaactacatcagttactctgattacaatttaccttactcttttattctttcttggctagtaacagcttctatatgagagcttggtaaagttttcttttttaacttgttaatgcttttacagatcttttcagaactctttcacttctgatgttactaagaagcatatttagatcaagggttcccaatccccaggccacagactggtaccaatccatggcctgttagcaaccaggccacacaacaggaggtaagcagggggccagcgagcaagccaagtttcatctgtatttacagctgctccccatcactcacattaccacctgagctctgtctcctgtcagattagcagcatcattagattctcataggagcacaagccatattgtgaactgcccatgtgagggatctaggttgcactctcctatgagaatctaatgcctgatgatctgtcactgtctcctatcacccccagatgggactgtccagttgcaggaaaacaagctcagggctcccactgattctacattatggtgagccgtataattatttcattatatatggcaatgtaatgataatagaaataaagtgcacaataaatgtaatatgtttgaatcattccaaaaccacccacacctccactggtccatggaaagattgtcttccatgaaaccagttcccagtgccaaaaaggttggggaccactgatttagaggatatatgtgtagggacataaggctatttttccagtatgattcctcagtaatgctgtcttattatttgataacttcctccaggaggtgataaggccttgcaactgaatctctgcaattctctgttttagcacagctattaaaaactggttgaggccgggcgcgatggctgatgcctgtaatcccagcactttgggaggccaaggcgggcggatcacgaagtcgggagatcgagaccatcctggctaacatggtgaaaccccgtctctactaaaaatacaaaaaattagccaggcatggtggtggacgcctgtagtcccagctactcgggaggctgaggcaggaggatggcatgaacccaggaggtggagcttgctgtgagccaagatcacgccactgcactccagcctgggcgacagagcgagactccgtctcaaaacaacaacaacaacaacaaaaactggttgagaaactatcacctcatttgagtgtttatccacccacctgtgagttctgcaaggcagagttgctcccctaactccaccatgctcatattctatcatccttttatttcctgactctaaaatatcttaatcagaaaaaagtttgttgggaaaaatgacatggtcttcgcagtttttaaacctcctgcttgcctcttagttactgtcaatcttttttcctccatctatcaccttgcacacaaaatgaagataatgcatctctgtccctcactagtcacatgtaatatttgattaacaacttgaagaggcaatcctttgtgactggagtcaatatgtgtttatttatcaagaatctataatattattgagctaaaatcctggggatagcttgtgatgccattgttacaagaatagaattttagaatgagatttttcaaaatgtaaattgttacattttcttcattatgatctttctcaattatatccattaaaaatcagttaatgtccacagaacatttcttatacttaaggagagggtttgaccattctatcacctttcagaaatacattacatgaaaaagcagttgaaaaactcagatctcccgcaacagaataaattggaaatttcttaaaaagtagttgaacagtaagcttttttaaaatgctaaatcacaataatgtatacttcattttaaaaattctctcaaaatcagttacaaatatctttccaactccagagtctccagcctcatttgattccttaattttcctccacagctcctgaaaattacttcaccatcatttttgaggaataaatgagaaaacatagtgaaagtactttgaaaactataaaacctgtgcatggaagttatcaacaacatggatcaatggttaagagtcataaccggccgggcgcggtggctcacgcctgtcatcccagcactttgggaggccgaggagggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaagagtcataacctcaggtcgggcgcggtagctcacgcctgtaatcccagcactttgggaggctgagacgggtggatcacctgaggtcaggagttcaagaccagaaaccccgtctctactaaaaatacaaaaattagccaggcgtggtggcaggcgcctataatcccagctactcaggaggctgaggcaggagaatcactttaacctgggaggcggaggttgcagtgagccgagatcgtgctacggcactcaaggctgggcaacagagggagacgccgtctcaaaaaaaaaaaaaaaaaaaaaaagaagtcataacctctggagtcatgctgcctggcttcaaatcctagtagtacatcttaccaactgtgattctgacaaaagtttaacctctgtgcctccgctgcttcatctgtaataccaaataacatcagtatcttcttgtaatgattaaatgagttaatatttaaagcacttagatcagaacctgacacatgtacaaacaataaatgtttcttatttccaacacagaattgggttaggtgataaaagcttatttgtaatgatgttatttaaaactcagaacacagccaggcaccgtggctcacacctgtaatcccagcactttgagaggccaaggcagggtcggagttgaggtcaggagttcaagatcagcctggccaacatggtgaaaccctgtctctactaaaaacacaaaaattagctgggcatggtggcacgtgcctgtagtcccagctactagggaggctgagacgggagatctcttgaacacaggaggcagaggttgcagtgagccgaggcggtgctactgcactccagcctgagcaacagagggagactctgtctcagaaaagaaaaacaaaaactcagaatacatcatcccaaaaaagcaatgtcactagcaacatggtaaacattaaattctcaatctgtgtgttgtgtgaaaaaaaaagaataaaaaataaaaataaatttgcaaactaacccatgaacattggtttaatccacaatgtagctgatctataaaatctacaatactgctctaattctggtacctgggaccacgcctccctacaccagagatgctgcactcagacctgtcctggccaaagtgctttgtgcctccaaagcatttgcctcccttactcctcattaaactcctcactttccaagcaatcttcatgaaatgctggaagacaatggatcttactctactgattaatactgacgtataaatgatgcttctagcagagctgtgagctactgtccaatgtttattaacttaagcaaatatttaattggtataatttcaaggtataagagctctaacttttcaagttactcatgctaaaagacacacaatattaacaagacatactttagatttgtaactccaaattcaagtaacaaacttctttcaattaaaagtatactttcttgccatttgtaaacctctaggtcatgggaccaggagtcaggttaacaactttaaaaatccttagactaatcactcagagttttctgagcaatttgaggcagtaagattttcatttctacaggaataagtgaatagagttcactccactctcagctctgtgccagtaattgggctgtaatctcatctagcaaactagatgagagccatagaaaagaccctgaattaagactttctttccataagaaaatgatgttccaggctggaggcggtggctcacctgtaatcccagcactttgggaggccgagacttgtgcatcacttgaggccaaaagttcaggatcaacctggccaacatggtgaaacctcgtctttactaaaaaaaatatataaaaattagctgggcacagtggtgcacacctgtagccccagctactcgggagggtgaggcaggagaatcgcttgaacctgggaggcagaggttacagtgagccaagatcgtgtcactgcactccagctgggtgacagagctacactccatctcaaaaaaaaaaaaaaaaaaaaaaaaaaaaaaaattcaagaggatgtattgttcccattttaaccatagaaagagtgctattgttccttttctccacatggtggtgctaatgtagcaccaccatggagccgtattgccaaagacgaaaaaattcagcactgctcatcgttattaccagtctgtaagtggccacttaaaggccatttggagtacatggagaccattaattataatgcatttccaaaaatagattaatcacaaattttaaaataaaaaatttaagtaaacagattcaaatcaatgagaggggcataagcatttgcagtttttcaccaagatcttgcttgtggcgtaggtcagcatcctgatttcttttccattatttattctcacaaaactaaaagatcctaaatctcagttagaggttgccaggaataacagcaagtatgtttggtggttctgtcaaatggctgtagatatttggctcacatgtagatctagaaattatgaacaaacgtctcactaaagtgagaagtgagtttcacactacttttcacagtctgttggatgctaattgaacaacatttccaggaaatggctggtgtgctgactgtttgaacctgggatattgcagcaaatgaaatccagatcctctgctgagttaaatggagctctgtgaatcagtcttgtatgtttgacttatttgtgtacttttcaaacatgcccaatgctacatcgctaagttatttctcaaatcaagaaaagatgtaatcaagttttaaaagactaaactattagagatcaagctatttgtaccgcatttcatctagttcaaactagagaaaacagtgagcatgctgttgaattaagctacttgaaatccctgaaatgatccatactgatattattaatgttgtaaataaatatttttaattcctctttcattccagaactcttgagcatcttcctcagcaataaccagcagccttcagcagggagaacatcatcttaaatttgctgcccatttctttgcacagtacacaaaatatgtacattcagttgtcattcttagttcacattctttttttttttttttttagaggcagagcctcgctcttttgctcaggctggagtgcaatggtgtgatcttggctcactgcaacctctgcctcctgggttcaagcaattctcctgcctcagcctcccaagtagctgggattacaggcacccaccatcatacccaggtaatttttatatttttgtagagacggggtttcaccatgttggccaggctggtctcgaactcctgagctcaggtgatccacccacctcaacctcccaaagtgctgggattacaggcatgagccaccatgcccagctttagatcatattcacatttttctctattttcctcaactctgaatcaagaacaaaggcttattatgaccaccaactatcctctgtgaataaagtatggacagacatttcaacgcaaccatatttagtcacagagtgaagcccttgtctgctcacttgtggttggtgctccctcactaccaatgccaaggtcccttcccagcctatatcataggtgatgtaattaactgggtgagaaaaaaaatcttcctctctttagcatggattttccaatgagaagtcattgagcatatttcactcactcatgcatggcacaagtagacaattggttcatatcctgtacaagaatgactttgtccaaagaaaatatctgctagcatgctcacctgtcaagcaaaatgtttgctagcatgcgtctttgataggaactcaaagtgttgtcttgaaccagcagcagcaacatctagaaactgatcatcagtatacatttgtgggctccaacccagacctactgaatcagaaactgcgggacccagtgttcaggtgattgattctgatgcacactgaagcttgagatctaatagtgtcttccaaaagaggaatgttgccaatatttcattcagctttctcttctacttgtcactgacttcgtagctatctttttaaagtgtttcagtaaccatgtgaactgtaatcacttggctggcaggagtgcaaatttgaacaactttctgttttgttctcttctccaacttcattgacaatatcactcaatataatacattggaaaccattatgttgcatttgttccaggaaaattcaattggtttaccacagagatcactttgatttgttaggaagtgacctaagagcttcatattacaatttaaccaagtttcacagcaaaaacaaacaaacaacaacaaaaaaaaaaacatggaaaattagcggtagactcttaggccactacaaattttttttctgatattcattatcatgcatacaatttgccctttacatttttgtctgttgtatgaagtcctcattctcaaatttacttgtcccagcacacacagattaacattccattttcgcactgtagtgttctttattaggcttacaaagttcttctgagacatggtgtttgattctttgatatgtctattccagagaaccaattgtaaaccaatgatctggggtttttttgtttgtttgtttgtttttgtttgtttgtttgttttgttttgagacagagttttgctcttgttgcccaggctggagtgcaatggtgcgatcttggctcactgcaacctctgccttaccagggttcaagcgattctcctgcctcagcctcccaagtagctggaattacaggtgcccgccaccacacctggctaattttttgtatttttagtagagatggggtttcaccatgttggccaggctggtctagaactcctgacctccggtgatccacctgccttggcctcccaaagtgctggcattgcaggtatgagccaccacacctggccccagtgatctgtttttatgaattgagaatagaagacagcataatagtaacaaaaaatgtaaatttatcaaacaacatacaaattatatgaagatatgccataaactttatcctgttttctgactgttagcacatggataaactaaacaatatagtcctttagtgcatgtgtaaccagtgtaaatgttctaagaatgaaacaaaacatctgtgaaaataatcattaaagttatatgccatatttgtgaaatgcatgtgaaccaaatttttccatcatattttcctctaaaagtgccaaacagcctaccaaactacatggtatgctttctgtatcctaagggactctgtttctagccctttcctttcttcaagggtttcaatcattatctgctaaatcctcttttctcattttaacccaattcaaaaactatagattgagctcctctctatgaaatactccataaccatcgtgacctgggcacaggtcaaagacagtcccccacacccctcagataccccatatgacagaaggcagggttaggctctgtgaaaccagacaggctgtggaatcctaagaccgagggcacaggaaacaagcaaagggctgaaaaagcccacaggggcaagaagtcaagcctgaccctcccccagtacttgagaatatacttgaatgtgcttgtttgatctagctaactcctctaactgcctttttcttttttttctttgcatttactgacatactctcaaaagaatgctctaggatccatggtttccattgcttcatcacttacttcctccttacccattgcaacatacctcacagcttcaacactacagcattctctgtggtaatcgttctctccctgtttcttttccactacgttacatgagtgcctctcaggggagcagggggacatttcagactggccggtaagactctgtcagcctccccctcagaatcacctaagtcactggttctcaaccattgcacatgaagatcacgtggggagattttaaaagataccaatgcccaggctttgtaatgagtcagcttggctaggctaaacaacatttcccagaatgccctttctggttagggtgggccacaaaagagatttgggggcaattttgggggtaggaagtgaagcaacctccatttcatagccctcatatattgtcgcttatctgctggctcatcttattgtcataaacctgcaactagacctgcacctgggccaggtgatgttgttagccctgtgacaaagggccccagtttctgcaggacacccacaccagccaggtcagaggcaacaggaagtgacatgggttttagtccctcattatgggcaccagctggttctcactttttccatccatcccccatttcacatccttctccccttcctgtctgactgtcctgtccttcaggcttcagcatcagacacaaagacaacaccttacagagactacttacccagctcccacaattgcatatgctcaaattcctgtaacagatcccttcatgtataggtatgcttcttcaagtgaaccctgcctgagaaactcctccaaaccaattatgtctgatggtcagaggtgaagcccagacatgagaatgtgttaaaagttctctggatgtttctaacatggttaaacaccatctgccctagggtaaaaacctctacatgcaattgcaaatccttgccagagtaagcctatagtggatgggaatccttcagctgagctagccttgagaaaaacctaaaatcctgccctactctatgtgtttttcctgatttattcttccttttcctttttcacaaagctagcctctgcccacctcacagaccactgcaatctatcaatctctagtctttcctccctccccacctatagcctatagactgatctggaaatgtaaacataacatccctccatgctcaaaggctttcagcaactccctgtcctccagggatcaaatctaatctccttacctggtattcaaacccctccagagtctggcttcttcctacctggccaacctatcctccccctcccttcccactataaaccctaccagctttctgaacctccatcaaccaaagaaagaataaagcagtgatcacacaataaaaagggaaaggttttctcttggccttcttggattctgctaaccaccaaagccacaaactaggtaacatcccctacaccatctacaccatctctatttccctcccctcccttctcaacccacttgcttccttcctcttttaatgctattaagggtttgaatttacatatgggttctcattgtgtgagaggcagaaagaaagtaaagtaaaaattccttttagaggcacccttaacactttaatactttaataagcagcagctgaccacttctttcatgtccagttcatgctgctgctgctgctgctgctgctatgatcctattcccagaactcaaggagaacgacagtattttgctgaccctccaccacaagaccatagactaagccaaaggagatctcacactcctctcccagaatagaaatttcaaaaccagcacctaatctgcaataaccaataagcccttcttatatgctagcattctctacaatagtacatgaagtggctttgaaatttccttgctgaggctgggtgtggtggctcatacctgtaatcccagcactttgggaggctgaggcgggtgggtcacaaggtcaggagttggagaccagcctggccaatatggtaccagaaaccccatctctactaaaaatacaaaaattagccgggcatgatggtggactcctgtagtcccagctacttgggaggctgaggtaggagaatcgcttgaacccgggaggtggaggttgcagtgagccgagattgtgccactgcactccagcctgggtgacagtgtgagactctgtctcaaaaaaaaaaaagaaaagaaatgaaaaaagaaatttcctcgctcaacatggaggatttctttaccccaggagtctcctatttgcatcttggaaagaaggccttacatacttaaggcgcctctgagacaactcaaagttgtctctctgcaaatgccaagagtttgagaaaatgggaccaaagcactgaaggaggcccttgccacatgcattgtcaatggatcctactatcatatcatataaaaaggacacattcaacatgccccaaggcctatggctgaggttttgctttaattgtccacttttatctttttcattaccattcacctgctaatgtttatattgaaaatgttttctctagacttctccacaaaaatactcacccatatttctctgcgagtgctatggcttcctcctctttcactactctctggtcctccagatcactcttgtttccacacagcactatatctgggttttcacaatatgcatgcatctgtagctggcctattaatataagaaagtttattatatatgtaaataataatgtaagtgtatgatcagtgaacaatacatgcaaaagtgctttgaagactataatgtatatatagatattgggaattgacataatgctttcaaagcatcagtaatcttatctgtaaagctgaatagttggggcagaaatataaaaccattcttaagcacataccccagtttattgatatcggagagtttataggagaatgtgctacctctcaagtgtgagggcccacatgtgcacacgcacacatatgcacacacacacatacaaaacacctttcttttttatgaaggctatttgaaaagaaagttgcaggagttcctagggtttactgctaatcttaaaactgtttttatgtgtttttttctccatagcaatgacatttctaaaagaattgtttttctccaaactaatctatttctatccaaaatgtttttcacatttttctattatcctagggcagaatcaactcatttaaaacaaacaagatacaggcttcaatgagaagaaaagacccagaataaacagtaagtgattctgtcaccagagccaagtggaagcagaggactataattcttattccgcagcttttatttcacctgaaaacctgcaaataggcacaattataaaaagcaattgactcaaaccaaagagcttcactaagctaaatagtttaatctttcaaagtaggaaaataacacctcatttcttacccatcacaccccagaataaaattaaggcctaaacgttcacagtaagacatacttcagagtttatggcctaatttattttttcatcatggttaaccagaaaagtgtggacattttagttcctcattatgaagtagtgttcatcatatcttatcatgagaaagtcaagtaggcaggtgtttactgagcattagcacaggcctgatactctgcatggaatttcacaacagttctttgccctcatggggcaactggggtaataagacctacagaggacagactaaactgtgtaccatttcatgaaaagccatgccctttctttcctccaggttgttacacatgctgttcccacatcactgaatacttaaccacaaccttccttcaagacttgcttcatggttacctcattatctttctggtctccagagtggctctgtgctctgttaatgccttataaggtgttataggtccatgcccagtgtcatgctatgagcacagactcaggatccagtgtacctagggatgaatcctggctctgccatttactagctgtgtgaccctgatgaagttatttgactgcctcaatttccccatctgtaaatggtgataatgatactacttactttatacagtcaaggtaaggattaaaatgaattaatccagtgattctgcaggtaaagactgtgagccaccagccttagcataacctaagaatttgttgacatgcaagtctcaggtcccactccagctctactgaatcaggaatgctggaaatggggctagaaatctgtgttttaaaaagtcctccaggtgactgagatgcacattcacatttgagaactactaagttaatatattaaagcatttagaagagcatgtaagtatcaccagtaattatggttaacagtatttattttgggtagtctaggaagtgtgattattggtgatttcttctttttgtctcatttttcctaatttttctactaagattgtgcttatctaaaaagcaaattaatcagttattttaaaaacttcactaagaaaaaagtcacctacataaacaactacagtctgataatggatgtaataaggaccctatacacagtataaaatgtaacaggggttaaaaggagggaaaacatctaacacaactaagtttattacagagaatctcacagaggccatctttgctaggttttaaagaataagcagaactccagttggttaaaaaatgggggcaggtgtggaaagggtttttcagacagagagaataatgggaataaaaaataaagaagtaaaaatatgtaaaatatatactgttgggtttttgcaccacttatgggactctacagaagaaagtttagaaatgtaggctactttaaagtttccttaggaaacacactagcactggatgaagagtgactctgggcatgacgtgcttactcctctgaactccaggaagacaggacagtgactaccacactaccaaattcctttcagatttcaatccaggcccagaggactcagcctctgttctgtctcctcatctgagtggggcttactttagacttttatcacccttctcaagagggcatggagagattgagtgagagggaggggtctgcaaggagcaaagggaaaggggagggtatatagacctgctctcctctcccaggccaatcagggcccacgagtcagctacttctttaatgcaacactgtgttctggcactcaccactgatttttatgtatttgtgtgtgtgtgtgtgtgtgtgtgtgagtgtgtatttgtgtgtattaagctattatttttattaaaaaataagaaatgggccgggcactgtggctcacgcctgtaatcccagcactttgggaggctgaggcgcgtggatcacctgaggtcaggagttggatgaaaccccgggagatgggtgaaaccccatctctacaaaaatacaaaaattagctgggggtgttggtgtgcgcctgtaatcccagctactcgggaggctgaggcaggagaattgcttgaacccaggaggcagaggttgcagtgagccgagactgcaccattgcactccagcaagggcaacaagagtagaaactccatctcaaaaaaaaaaaaaaaagataagaaatgaatgatcattgtaatactcaaaaggctgacaggaagaagaaaaaaataaaagtacagataattaacaaatgtttattcctaattaagatttgatattaccacttctgacactgaacattacacctttttgtttaaatggtagggggtggagaatactttctattaaatatataaaatcttcaatacgtataagtgttctttacctaactgagcaataaggattcttttactctctaaggaaaacaaaacaaaatacatacatatgtatacatattttcacataattttgttctttatccaactagttagccaggataggcaatatttatctaatgtctcagagttttagtgtctacctatgaaaaacaggtgcgttattttttgatgctaagattctatgcgcactctctagtgatccttataaaatagttgattttaaaaagccccagaacttgttctgatgatgcaaaggagggatgatgaacacgggctgagagtaagagaccataaacagccactgtcattcagctacaagggaaataatgaggcaacttagccaggcatctagcgaagtgaagccccagtaagcattactatatttggggaactcatatttaaagtaattaatagctcttcaactcttagtggccaactgacttgagaacgggcaaaaaaaaggccattaaaaaggaaagccaaagcttcatatccttggataagtctattactttttaaggctcaatgtccttctcctgaaataaggacacaacactgacccgaatctttgcccagggtgattgtgaggatcagatacaaagtatgtgaaaaccacagtgcactaaattatttttaaactcatttttaatctaagcttttctactatcaaaactacagccaattaccctttcataatcccaaaacagtaatgtttaagtagcagatctttttaaatcagtgttttaaagatttagatgttaagaatttaatattacagccttccctaatagattctctagggttacactaacatgaccaaacagggaaaatatacatttgaaagctgttatgcagtcaagtggcagaattcgaaatggctatgaaccaatcatttaggaggttaaaatctctccaaaataaaggttgacatatattgcactggtgaccacttttaccaatgcagttgtagagttttccatggcagaatcctcctgaaagatgctctaaccctaaaagctagaaggggactctaagcacagaaaagacatgaagccaggggtatgatccattaagtctttaaaagctatctgcatctatgtaatacccatttaatgtccagagatgatagaagaattgatagcatacaatagacaagcagatacttagagatttaacttctctaggcttctacttcctcatctacgaaatgggaataagagtctcttctgtgggatagactgaagaggagagcacacataaagtgctgccttgcacctggagcacaggaagtactcaacaaatcaaagttatcagtaccagggagaagcagagtatttcaattatctttgtccctaaactaaaaaccttgctccttaaaatagtatttgcactaagatctcctccaaaacgatttgtcacagaagtagagcataagagggcattctataaataagaggggactgtgtagcaggacactggggaacaataacacttacttatccagtttctgacattgaggaaactttgctcatttgtcagatcaaaaagtagaagaaaacccatagcatctctgaagaacgctgtcgttaagctacgaaacctaggaacataaaagcagaatggtcagttaaaccacggccccactcctgaaatataaaactacaagcaatgccttcagcctcttacaaaagtttaccaataacaagctacatggtgatatttcaaaagtatataggatagttatttatcacttatatcagtttaagtgttaacagaccatgtgatttgaaaaccgaggctgctggagagggatgacaagaaccagcttgtgatcttagtctcacccaagaatttatgtacaattatgagttaatttggccaaaagcaatatagtgtatgttttcctattgtgaaagcttgacttgacattacaatgtgttccatgatcttttaatttcagaatatgcagagatctcttatctctgatagccatttgtttggcttgaaggtaagaatctcttgactcagaccttattctgtcttggtactctgccttccaaggctttatccttctgtcttccctgtcttctctctctctctccccacccccaaccccaccctatcaccagtcagtttcctctcgtctttgcctatatgtaaaacctgtaactgacaggcaggctccagggaagaaaatattggtatgaatttgtcatctaatcagcaatattaggtttttctcaaatacttttaatcaatgtttttattaaaaagagttcttggccaggggccatggctcacacctgtaatcccagcactttgggaggtcaaggcaggcagatcacctgaagtcaggagttagagaccagcctgaccaacatggagaaaccccaactctactaaaaatacaaaattagctgtgtgtagtggtgcacatctgtaatcccagctaatcgggaggctgaggcaggagaatcacttgaaccagcaaggtagaggttgcggtgagctgagatcacgtcagcctgggcaacaagaatgaaactccgcccaaaaaaaaaacaaaaaagagctcttatcttttagagctacattaccacaagtattaaaaatgaaataatatagtgtctggaatttgcttctaaattatatggtaagggggtggggtgagaagaggtaaggggtataaatgaaattctgttggccacaatttcataattgttgaagctgagtaatgggtacataggtttatcatataatccttccacttttgaatatccttgaagttttccataataaaaagttaaaaaacaaaatccttcaaggtggctgtgaaagaaaacagaagttctagctaactgaaagcaactttatatcaagatttcatgtggcttattttggtcaagtaacccctggtcacatgaattaattccaaccagatatcccactagatttcaacagtcaggtaagaataatgcatgtaacttggccactttcttgtggttgagtaaatagcaaaaggaaatggagcaaagtatctaagcaaaaaaaaattaaaagaaggaaaagaaaaaagtccacaagtaagagtcataacctctcccttgaccttgtatgaaataaggccaccattctcatctcagacttgacaaatttcctgctaatttggcagcattcaagtgcaaaccaacgaattggctggctttttcctgctcaggtcactgtttgaagaatgtaactatttttccctttccttcagtaaggagcacataactgaagatctcatacctctcctgccctgctgtgtcccataactgcaggtggattctctggcctctgccagtggctccatccggcccactggctctgtacacctaaaacagcaaagtgaaagagaaaacaaaagagaacttctaacaccagcgaaccttctcacctttttgttcagtacaaatcccaaaggcatctaaaattccaaagagaatgccatctggaatacaaccatgtttgtatttatgtcaaataattatatccaggtaatgtaataagttatattgaaatatatacatatatatcttataaatatattgtaaaatatgaatacaaaacaacttgtataaaatataataattagtttacctttcctcaaagttctcttgggtcactagtttcaggaaatattacttttctatggcttttcccaatctcatcttttttgtttgtttaaccagggggtacatgtgcaggcttgttacgtagatagattgcataatgctggggtttgagcatctattgaattcatcacccaaacagtgaatgtagtacccaataagtagtttttcagcccctctcccactcccttcccccttttggagtccctagtgtctactgtttctgtctttatgtccatgcgtacccattgtttagttcccacttataagtgagaatgcatgtggcatttgattttctgtttctgcattaattcactgaggataatggtccccagctctatccatgttgctgcaaaagacataatttcacttttttatggctgcatagtattctatgatgtatatgtaccacattttctctatccaatccaccactgataagcacctagggttagttccatgactttgctattgtgaatagtgctgcaataaacatttgagtgcagatgtatttttggtagaacaattttcccttgtcccatcccaaattttaaaagtgctcttaaaagaattttatagacaacactcctagaacagcagagaacggaccatcaaaaatttcttcctccacaatagcaacaaaaacagtggtaaaaattgtccaaatcaactttttcagtactctaggaattaacaaagacttgcaacattccaaggagcatttattcaagaaaaacagccgaatatcagtaaaaacagtaagctttgaggtgttttttaccttgccctattcccatccccctcactcaagcttttagaagacttaaaaaccatgtgcacaaatgtggttgttgtgaaaacatcagcctagccaccactgtggacagcagaggaacaacaggtttggagctccctaaaagtcccatactgagaaaaattgtcaggaagccccttggaaagctccatgccccagctttgtctttctttgacctcactcaaagcttgctctttgagaacagccctatcccaagggcatttgttgaaaactatcagcagtaattatttaacatcacagctaccagaggtagcaataccagttagggctaacaaaagtctaacaacaacaacaaaaaaaaaatttaaagaaaaaaataggaaatgagatttctataatgctcccaaatattccttggaacctaaaaggccatgttcatgggcagggctctacaaatgcccaggaaagatctaaaaaggtcctaatctctcacttctgactgactttgaggttcttctcaggcagaaaataaaagctaaggcagagttgtaaactgcctgcagtagtattaaacacataccccaacaaacacacagagactctcagaaaaagctaagagacttattagttcaaggaatttaataaactctctccactcattagctgtccactaagttgactgagcagagacttcagtagctgcatacaaagaatacagattttgcagaattatcccagaaacataattaaacaaacagcaacgacaaaaataaataaatatgcagtaaaaacaagaaacccaggtaggggaaagaatctgagtttctagaatagacacattattttaaatgtccagttttcagcaaaacgtataagacacacaaagaaacaggaaagtatggctcatgcgcaggaaaaaaacaacgaatagaaattattcctgaggaggcccagatgttaaacttattagacaaagactttacatcaggaattataaatatattcaaagaacttaaaaatcagtaacatagcggtcctctaaaattaaaggataaattaagacaaaactgagaaaagtcatctctagcagacctatcctacaagaaatactacagacaactctcaagactaagctgaaaggaaactagacagtaacttaaatccacacaaagaaataataagcaccagtaaaaatgtaactgcatagtaaatataaaaaacagtataaacgtggtttttctttgtagcccttttcctccactagattaaaatttaactgcaggctgggagtgatagctcatgcctgtaatccctcagcactttgggaggctaagatgggtggatcacttgaggccaggagttcgagaccagcctggccaacatggcaaaaccccattactactaaaaatataaacaattagccgggtgtggtggcgggtgcctgtaatcctagctacttgggagactgaggcaggagaatcacttgaacctgggagacagaggttgcggtgagctgagatctcaccactgcactccagtctgagcaacagagagagaccctgtctcaaaaagaaaaaagaaaaaaaaattaactgcatacagcaataattgtaaagctgtattgatgatggcacacaatgtagaaagatgtcattcgtatagcaataatggcacaaaaatatgggagaaaacagagccacataagagcaaagttttacacagtattaaaattaagttgctattaatcaaaattagattgtgaaaaattaagataattgtaatccccaagggaatttttaaaaaagaactcaaaaacatataacaaaaaagggaattaaaatgatgcactagaaaatagaaaaagaaacaacagtatctatcaacagacaaatggataaacaaaatggtgtatcaatacaatagaatattatgtagctataataagtaatgaagtcctgatacatgctacaacatggaagatccttgaaaacatcaggctgaatgtaagaagccagacacaaaaggccatatattattccatttatatggtgtgtgcagaagccattgatagaaaattcatggtggctaaggggaggtagaaagaggaatgcctgctaataggtatgaggtttctttttaaagtgatgaaactattctaaaattgaatggctgtgatggccacacaactccgaatatattaaaaaccaccgaattttatactttagatggatggatttcctttttttgtgaattatatctcaacaaatctattttttaagttatacaataagtaaccaacaaaaataatcacatacatatatgtagattctatcaactacacgtcaatactaaaaatttcattagggccctactgttattcagtgggtcttaatctctataagcctctctggtagtagaataaaatactagaatgggcaaaagggaatgttcttctgtcttaaaagccagggacctttccccctgacagaatatgatccattaaaggacctttgtcattaatttcctgacaactggtttacctgcttcaggccaacaatggatttttcaacaagaaatgtagtctaaggagaaagccatctttcctcatctgcaactgtgacaccatgaccttctgccttcccctccaacactagaataactttcagtctcaaagtccttaaaaaataaataaataaaagtttctcccttcaacattctgcagaacatcacattcactactggcattccccactcctactccaacctcaccctcctggcagcagtgataagttctgccagttagtgttccatgtggaactgctgagactttattaggagaaatgccattaaaaataataagataccaaaggtggaagacacagcccataaaacaagagtatgaggggcaaggtggttggcaggcttcaagacaaaggtagacaaataactttcggagttcagagggaagatacaagccaaaagagtaccaaggtgacattttaaagaactgtccacttccactttgtctgcctggttttatatgaagtgctgtcagcacagccttttcaatcatgttgcctggattgaacataactcactttcatatgtacctttaatttcagatcccaacctttgtcctcctaattcctacaaagtaaactaaacagaccagcaaatgttgacttaacgattacatttttacatagaaggatatagaacttaccactcttttttccctgaaatcaatgcccactgttgtgataaatttggagttaaatttaccatctgtatattggtaaagtacactggtcttccctacaccagagtctcccaaagctaaaaacttgatgaggtaatcataatctccatcagacataatgaagaactcagtagttcacctgtaaaatacacacaaaattttttaattaaaatccattagaaaacattaattatccatttaaaaagtgacaacaatattcagtttaacacctaatgttaacctgtatgtctacgggttgtatgaaaagagagttacatacatattgttcaccatccttgaagacctaataactagctagatgagaagctattgaaatagtaattaacagtgtagttttaatttaacacacaggtaatcccagcactttgggaggccaaggtgggcagatcacctaaggttgggaattcgagaccagcctgaccaacatggagaaaccccatctctactgaaaatacaaaaattagccaggcatggtggtgcatgcctataatcccagctactcaggaggctgaggcaggagaatcacttgaacctgggaggtggaggttgcagtgagccaagattgcgccattgcactccagcctgggcaacaagagcaaaactctgtctcaaaataaaaaaataaataaaaataaaaataaaaataaaaacatacatattatagtaccattaggacaaaaatttcaagtgggaatgataatcaacaagaaggtaacagtcactaagtcttatctgtagaccatatagaacaaaaactaatacaagaaaaacagaggaaagagaatgttataaggaataacagtaatcattagagtgcaagtggttccaatttcccctcctttttcaaagtctcctagtgctaaaatttgcaattgcaaacataaggaaccagtccaaatgctcaccagtcaatgagtagataaagaaattgtggtacaccacaatttttttatctgtatatatatacacacaccacggaatactactcagccacaaaaaggaacgaaataatggcattcacagcaatctggatggaattgaagacaattattctaagtgaagtaagtcaggaatggaaaaccaaacatcatatgttctcactcatatgtaggagtgaagctatgaggaagcaaaggcataagaatgatacaatggactttggggactcgggtggaaagggtgggaggcgggtgagggataaaagactacagattgaatacagtgtacactgcttgggtgatgggtgcaccaaaatctcagaaatcaccactaaagaacttatccatgtaactaaacaccacctgttccccaaaaacctatggaaataaaaaaaaaagaaagaaagaaagtctcctagtgctagaaccttgccttttctctctttttacatggacatctaggcaatttcatttattctattcattttcacatgttattacggttccttcaaagacactgttatttcacaagtaaatttagtccctgcttccttacatattactattaatatgtactacatattaagccagacttctctagagtatcactgctcacttgggaactgagttccagatttgaacagtcactgctcagagaccacagtgccacaaccaagggctcgcttacctatgtttacctgggtactctatcaagaactgctaaaaattcagctcttcagtaccgactaaaacaaaagtccaccttaaagaagaaaaattcatttatatcagcaatacctaaccacggctatttttggttctttgcaatcagcacttttcatgatttgtatttaccttctaaatagattcaaacccaaaatatcagtccaactagaaatgggatctctctccaggggaggtttactttttcattaaaattttattgatacataatatttgtatatttttatggggtacatgtaatattttgttacatgcatagaatgtaatgatcacatgaaggtatttagggtatttatttcctcgagtatttatcatttctatgcattgagaacatttcaagtcctctcttctagctattttaaaatacacaatacatttttgttaactatagtcaccctagtctactgttgaacattagaacttattctttccatctaaccatatgcttgtacacattaaccaacctctctccgtttcccccgccaatgccaataaactctcctgaaaatcataaaaacaactagctatctcattaacactgacgactctacatgactattcaaacatacatatttatccatctatacacatgccagatgtcctacattggatgctactgactcccggcgttatcccctttttacccagcaccatatccagaaacttggctgccatattcagtgcttcctgtaggactatttctatatatccataaaattaataaaaactcagacaagaatatttactggttttcagtgttacctccctcaccccatcctcaacttggggactcaccttatgctgaaaactcctgaatgctgagccccaaaagccactgcagtgtgtttcctcagagtgcttcagtgcagatctgcaacctcacgtttcaggtatggctagcccgtggataagggcagagcctctacaaacattcaaaattctatttgcacactataaagagtgacacttcacagatgatgccttacctgtctttatagcttggatatttgcaagtataggtcaccagtattaatgacatataacagaattcctctccaaaaaacgacaacttggacatcaacattatagcacgtcatatcacagcatcacacctggctctaagttattggaaataagagctaagaattgaaaagcaagtccagataatgttgactcatttgagggcttcccctcaaactgaatggagcagcagataacaataccgatcctgcagtgagaatgatgcaagaagacactgtgactaccttatttcctatttatttttaatttgaaaaaaaagttggtataactatgttttttacatcacttagggtacaggaaaaaatgctgtcaccaatggcatcatattctagaattctctaaactcacttaagtggaattcaaagacttaaatgaaactatctctaatgtgtttcatttccatgggtaatcacacatgtaagtctacaaatgatcttcgtgagttttgttttctattcacaatagcaatactgaccaagtaatcataaagggactgttaacaaaccaaataccataaattgaaggtatagacaccaccatcaatattaatcatagtttgcacttttcagattgtatctttaagacaattatctgctttcttgatctgaaaataaatgttcagaccttccactctctgggttcagttttctaaagggtaaaacagaacccagagaggtagactgatttgcacgatctagaatctagatctcctagctccaagtccaatgcctattctaccccaagcttcatatccattattcatttttgttataaatgcacattgggctttaaagtgaccagtagtatggtatcttacaaggtaacctaataggaaactcaccaagtcaagcagagctgggtttgaatcccaaatctcccagataccaattacttggatgtctttgagccttagatttccaggtttctgttctataaaaaagaatatacactacctcacaccattattctgaggattcaatgagatactgtttatggagtgcccagcacaatggttggcatatactgggtacttaactgttggctcactttattctccccattgtggacgttcagactgggtctgaagatctagaacaaatttcagattgactctggccagcttaaaacatgtctttctagcacaaacgattgctaactggctcaaagtggtcggctgagtcaacaaagatcactttcaaataattctgatcctttttggctggttctaaccatttgcaattcatttaatacagatatgtttacttcaaaagagttctgatcaacttaaaaagaggttcaaatccatataaaatacaccatccattttagcaagttcatagttgttcaaaagaatctggttcatattattttacggtgagttaaaagaggttctcctacaaaactttctgactttggctaaaacctgatatatctaaccaaaattattggagtctcattgtaattagctttaattgcttcagactggttttagctagttccaataggctctgacttggacatgcaggttctgacaggcttctaaaagttttagttggttctgagtatattttactaaatcaaactgtgctgacaaattaaatccactttcaattgagtcacactggttctacctctatcgaactgctggaaactagtttgataactatagttatctgtaaaattgtttttactggtttagaccaatatagactggttcaaaacagtctgaaatgtttcaaattaatttcagatgttcaaacagttcaaaactagaaatgtaaaatgacaatcagaagcaacaaaaacaacagtttggtgtttaaaacttgtgccaaaccaacaaacttaaaattttatttttaaattacctcatttgtagatattctgtatccaaaaatttatctccaccattatatactgtataatcacactcgaacagcatgtatgtgttcgagtacagtaaaggattgggagaaaggagcactggcataggagaagatgacagataacagggaaatatgtgatgagtgacacaggcttcctgggttgagaattcacctcccattttacctgaaagacctggcagcaaaatattcacccatgacccaacaatgaagattctgattggggaaaacctttagcaaatttggaggctgtctagagtttgttcaaaactgatcacgctgaccaggctggtctgggttaaaagagaccagaattccaaagaataagaaaatttcagagaaataaagggagttgggggcaggcaggttttcaaaataacagatctttcaaggtttgggcatggtgttgagggcgacagccttcttatctgagcttgcagtccagttagtgaaagcctggagttagtggaattaccccatctttcagcagaaaatcattctagtctataccagactatactcccacctccatcctgcaagtccatacgtggctttctcatcactacttatcactactaggtgaagacaatttaatgttaagtctcaattgatggtatattttcatataaacaatttttgttctcttatttattattcaagtcctgagtagtattcctagggcctgttttccagaaagaaaatactccactcctcaaatacagaaatctaataacgtaaatgatttttgtgttggcatttcatttcaggaaggagtaaacagtgagaacacacagtaccagaatttgacatttggggcacccaaacaacgttgtatgctcaccatttcctgcttgtactccagcctactgaggtttgggaagccagttcacaagggcttccctctgacactctcttgctgaaaatgggtctgaaacctaggtcagatgcccacatgtcaagcactttacacacattagcacaacaatcctcatcactgccctatacatagcatatacactgtctccctcagaaagatctagagctgttctatcgtaagtgcttcagtgagggcataagtaactgagtcttggccagtctacccacatattagcatgggcacaattccaatctattgttgagagacaggaaaaaaaaatggaggttaaaggcagaaactctacaaccaagccacctgtatttgagtccagtcatgtaactttggaaaatttatttagtctcttttgccttgggctcctcacctgtaaaacaggaagagattctattttatcaattctaacatgctttcttattttaacttctttaaaattggggtgcatcttacatttcagtcttacaatccaagacatcttgcaattgctattattgcaattgcaatagagatacaactgtgtgaaagctttttgttagcatcttctagcaaggtcaagaatgcatcatcaatatattttagactcaatgaagcacaataataaagctatttctgagggctgttgtgaggactgagctagtgtatacacacaaagtttggaacagtgcacaggacatagtaagttctatgtaagtattagctgttattagcagcagcatccagcaatctggcttccaagggtcaatatgcaggcaatgttcttttctttcctagaagtataagaaagtacattgagcccctaaaccaaaaattaatttttaaaaataaggatctgctaagagtatttgaagccaaggttatatatttaaactctgtactgccttgagaaaagtgctgtctacctcaaggaaatatcttctaaaaagtcaagaatgaccttaatttgggatatgcaaaagactttcttattcagctcacttctctctctcctccttatacaaatattttttcaaagtgctctccaccctcactatcatcagattaacaatagaaagcaaggaacacccatttcctcaacatgtactatgtggtgttaattgcctggtgagagaaagtctatcatcttccttatttttaaaataaaacatattttcacctgtaataccagtgactgaggaggctgaggcagaaggatggcttgacgtcaggagttcaagactagcccaggcaactagcaagacctatttatatatatatatatatatatatatgtgtgtatatatatttgtttttttttttataaattaggcaggtgtggtggcattagcctgtagtcctagctacttgggaggctgaggcaggaggattgcttaagcccaggagttcaaggctgcagtaagatatgctcacatcactacattgtagcctgggcaacagattaacatcccatctttaaataaatttatttaataaataaaaataactgcacatgtacccctgaacttaagttgaaggaaaaaacacttaaagatttttaaatgtttttaaaaatactttttaagtgttttttaggaaataagatagaagagagtagatttagttaagaggaaagggaaagatctagttctatttctccctctctctctctctgctacacacacacagacatatcacagcccagattttccatgaagtgtcatattaaagtgaatcatagactccaaccttaggatcccccactattaggcagaatcattctaaaactactctagataggtcagccattttccgaaagccaaattttccctctattactcatatttagtacagagcaaaagaaaggggaggaataatattaactgaacagcaacatgtaataaatatacttgattttattttatctgctcatcatccttaaaaagaacttcatgtctggacaagactcataccatatagagactgatgttttctcagtgtgatggcaaataggcttgagttcaaattctgacttttctactttgtatgatctgatccaagttttttatactaagccttattctttaaactgtaaaatggagataataacagtactaatctcattgggttgttttaaggactaagtgagataacccacagaaagcttttagcacattgtttgccctgtgctaagtgttcaataattgagacttattaaaaatactattattaatagtttcaccacgttcttcattagcaaggcatgtaattttataacctattcttaatgtaaccagtacctgaaccttcagaaaaatcacagaaagaaatttaagttaagtacaatgattttggggcgccctatccatcacaaaatctaccttggcattccaatctaagaatgagttgtatctgggtgatttttggtaatttcagacctaggagtacccatcagttgaatgctctaatttccagaagaggaaactgaaactcagagaaggtaaatgaatagtctgaaataaaccagctagttagacatggggctaatctagatctcatgtctcctaaattctagtcatgtatgcatatttttcttctgtctgtattccttccttcagagtgagaaacctcagttacagctgcttgaattcaagaatcaaaagttttcttcagtgccagcagttatagcagtgataaaatgctttataattaaggcttgtgctctcagagaggttgggttgagggatctgtacttctgtgctcagagtccctctatcaagaagcccttcatcctgatgggctctgccaaggacagaagtcataaattgggagcttgtctgcttcttgctggtcattgcaaatccaagaaaaaaaaataactcttcttaatacttgtaccatatcccataaatcatctttctttcctatggtttcaaaatgaaaagcaagcagagcaatcatgaaatttttcatttacctgtagaattgctcggccccgttttctctcaaataagtattttcctctcgaataagattattttaggccaggtgcagtggctcacacctgtaatcccagcactttgggaggccgaggagggtggatcacctgaagtaaggagttcaagaccagcctggccaacatggtgaaacgctgtctctactaaaaatacaaaaaattggctgggcatggtggcaggcacctgtaatcccagcttcttgggaggctgaggcaagagaataacatcgagatcacaccactgcactacagcctgggcgacacagcgagactctatctcaaaaaaaaaaaaacattattttctctgacatcatgtctctgtaaggacacttctggccctctctctttttccttcattcaataaatattgattgaatacttattatatgctaggtgccagggtacaatggggatccaactcagttatattcaatgtggaaaatctcttactcttgcctaccttagaccttatagttttagccatgtcccagtctaacttctcccaacaactatacctgcctttgggttttcaaataagtccatctttctgaacattttaagcttctctcataaacataacacaatatgacatcaaaattcatatcctaagtcacatgtttgacaaagatgcaaaaggaataaacatggaaaaggaataaaagtgtgaagcttgggcgggcacagtggctcacacctgtaatcccagcactttgggaggctgaggcagatggatcacttgaggtcacgagttcgagaccagcctggctgatatggtgaaaccccatctctgctaaaaatacaaaaatacaaaaatacaaatggctaggcgtggtgatgggtgcctgtaatcccagctactcagcggggttgaggcaggagaatcacttgaacctgggaggtggaggttgcagtgagcagagatagcaccactgcattccggcctgggagacagagggagactccatctcaaaaaaacaaacaaacaaacaaaacaaaacaaaaaaacacataaagctcagtagagaagaaagagacagcctcaacctcctgggctcatgtgatcctccagtctcagcctcccaagcagctgggatcacagcagtgcacaacaccatacaccatgcccagctttttgttgttgttgttgttggggggagatgacgtctccctatgttgcccaggctggtctcaaactcccgagctcaagaggagaaatttttataaagagaaacataaggtatattataaagaattttttatctgaaaatattttgaattttttagaatggttcaatatttgagtgttcctatgtagcttatggacttcacttattgcagtgcaaaattatttttgcagagaaacaggagcagatgaatataactattacttttcaaatagcacagaacatcagcatttatgtgaattataacaccacatgttctttcatataatttaacatccccttgttcagtgattgatttggagaaaatgttcatatacaaatgactggcatagaaatataaaccttatcagtacttttatgtttaacgttaaaaagcagtaggcttttcttgctttttttgttttattttgtttttgttttaataatgccattgtggacccatacccggcattctggaaggaaacacataacagagacaccaaaagcaaggaagagaagtcacatggcatgaggcaggctagaagaggcattttataatgtaccaagatatatgagtagggacacttgtatttaccaaatgagccctggccacaactctcacagaccattacaattcctacaccctgaggtggaacacagctacttccacttcaaaagcaagatgcatactgcccaatagcaggaaccccatttccataagtggagacagcctatgtcttccgtgcagtttactcatctcaacttctggtctagatgtgcgtagatatggttgcgccctccctaatatgtcaagagtggaaaaaatgatgttataaacaaagagctcatcttgtttgtgcaaaatctcaggcggagagaagtggaaatctaacacctttgaaaagtagaaggaaacaggaatatgattctttcttgtttcttattaaaagatgagtttgattttatctaaattcagaatattagataactgcattttatattcacctataacctaagattcataagtgcattcctatcagtacagtattttataataataacataagtccatccttaacagtgatgttgaggcagcagagaagttcatggctagaaactgttgagatcttaagttctatagcatttggcttaatatttataaatgcacttgctacataggaatattccatttccctcaccaactgctagaaaactgctagaccaacttctagcagatggtgatattccactatagcaagttcttcagacaaaaaataaaattatctgtaaatactgttgaattaaatatacatttctgggccgggcatggtggctcatgccagtaactccagcactttgggaggccaaggcaggcagatcacttgaggtcaggagttcaaaaccaacatggcaaaacccttactttactaacaatacaaaacaattagcctgtagtcccagctactcaggagggtgaggcaggagaattacttgaatccggtaggttcacgggcgataatgccactgcactccagcctgggcgacagagtgagacttcgtctaagatatatatatgatatagatatatatataatacatataaatatatatacacatttataaatgcttccaaaacaccaaaacatacatcatttttaacagcatcttccagatgttcataatttttcttaaagagaaagaccaggatgaagaaaaaaataagcagtcatagcccagaaatccatcaactatttctgaaatgttaccatcacctcagtgggtgaccaacataacccagtaggcaaataacacaaacaactgtatgttaggaaacaagaggcgttgaaatgattcctgaaagcagaaaacgttctggaagaccaatgtcaataactcaaatgagatatcggcttttttttttaatttattgaaaccattgacttcatttacccaaaagacattatttgttgcccaaggctcttccaggatcagaatatgaatgtttatagagatttatggaaagtaaattcaccaaaacactgggtcttatagtacttatagtttgtgacaagtaccccttgctccatagatatagggtaatagaaaaaaaaaaagcacacatagaatatatgtcattggtaaaacataggcagtacagtggaaacaggtgtggctgtttgatttgcttagtaatatctcaaataatgtgacggcagtctcagaatggacacagccactcgacactccaaaagtctgctcaacccatagctaaacatgcctcttaccaccaccaagaagcaagcagtctccaagaatttggaatgagtgcaaaatctacaaagtatgctcccactgagtggttgctttttgtgagcacatagaagacagtgaaacacagacttcggagtcaagttctcctaaattcaaataatagtataccacctcctacctgtacaaactgaacagcaaaatgcctgatgaagatcaatgaatcatagctattcttatgattatgacagattaaggcttaaaccaggcttgagcactgatcctggggctttttccagtctaccttcaggatgacactgagacttcataaagctatcaaagaatggagtggaaatatttcctgaaaatgaaaaaggaggaacaacttaagctacctggaaggtagaacatctgcaagtccaactggtaagtacagggaattctggtattaacaagctctgaagaggtaaaatgaaaagctttggttatctcagagtgccaccaaacttgtgggcccaaggctcaaaggcagaaaaaaatagaaatgatagcactgctaccccagccaggactgagagaattacaaatcagatagcactcaaaagaaaaaaaaaaaatcagatagcactcaaaggacttcacattgcaaagagaatttccaagttgcaaaacacagacctaaaaacagtgtcaaggaatctgtcaagactcatcttcctagaacatgaaacatgcatggaaagcttttgaccaacacagactgactctcctattgcatctcaacttcctcaagttttctgtttgctgcaacacaggaaagatgttaatctgttagggaaatgcaccaactcaaaaagcaaaccctttgctttctgaaggagcaatgatacttctttccttccaagaaacatgatgaattagaagcagccagacgtgttaaacatgactgtccaaataataaaaacaattagacaaacatccatgagttggcagtaactggggaagagacgggcgcatttatcattgactttgtacaaaatgagaatatgagtaccatcaatttgacacatagatacttacaaagactactaagaggcaccaggtatggcttcatgcctcccttgtcctgcctacccaacaccctcttcctcactaaccacttttttttttttttttttgagactctcactctgtggcccaggcgtgagtgcagtggcgcaatctctgctcactgcaagctctgcctcaggggttcacgccattctcctgcctcagcctcccaagcagctgggactccaggcgcccatcacctcacccagactacaggcactaatcacatttaagcagatacattctctgcccacaggaatatgttcttcaggtacatggtggcatgctaaagcacacaggacttccatctcttcacagctgattttcatttccatagtcaaacatccaccctaccacaccccatgctgtgttccaacagcctcacttccaaccatcatctgggtgccataacctctctacagtcttcttcctctcctggctttcctgtccctcatctccaggtactattgccaaactccggtttgcatgtgcaaaaagtgacatgaaactaacaatattagtgcttttcttgtaacacactgagttgctatatcaacttcaaggtgttcaaccctcctcaataaattcataatgctgctgtgtcttcaggtactcccacttttccaatcaggaagagtttttcccctgcaaagtatgggaaaagagccattctggaaaaccaagtgtttctaatactatgccagttttggtttcaccataatgttaatgaaaaggtagcattctgatacaaatagatcacgtgtttaaaatattagtatctataaatatgtttattatatgccaacttagttcttttaaaaacattaaactaggctcagaaaaatcaaggcttttcctgatgttttaataccactaaatcaatgatgccaggattcttagcttcttccatttgttgtcaataagctgtagacagccagctatatataggtctttttggtatttgtcaagtctactgtctccattaatatatatttacaacacatgtttaaatgtttccctaaatatcatattctttaactgaaccaaaaaaaaaggaaactcacctaatggacaaggtcaaatcagatatatttcttattgcttctcaaagtctttccttatttcacctattattcagtatgcagagtctcagaactgactgtttgcatttctatcagcagctgtttatagaatggggtgtgacttgcgtttgcttatgcaaaatgactgaggaacaacaatgcacagccatccagccagtttctaactcagcctgtcagattacagttggcttttttgctattattgttgtccatctctaattttattgcattgtgatcactaaatgtggtctgcttaacaacaaatttggtggaatttaagaggaattaagtgtatttatttagaggcagggtctcactctgtcacccaggctggagtgcactggcgcaattatgtctcaccgcagccttgacctccccagcttaagcaatcctctcacctcagcctcctaagtagctgggatcacaggtatgcaccaccaaaaatggataattctttttaattctttttggaagacaaggtgtcactatgttgctgcccaggctggtcctgaactcctgggctcaagtgatcctcctatctcagcctcccaaagtggtgaaattacaggcatgagccaccatgcccgggctgaattaagttttataaatgttccacgattatgtgaaaacaatctgtacaccctgttagttggatgcaaaattacatacattctagtcaagctagttagttgtggtttttgatctgatatatccttatttatctttttgctacttcatctgtttctaagaaaggtgtgttgaaactcctagatcatattcatttttagaaaataagcccaaggtcatgtcttaaagaggatgaatataaagcataataaaagaacaagcattgcagtccttattcagagaagcattaaatttgtgcttttcagtctgttttctatgaaacgctgggattcatgaaaatactttaagagttctgtaaacttattaagatttttttttctatgtttgttttttgtttttttgagacagaatctcactctgtcacccaggccggagtgcagtggcctgatctcgggctcactgaaaccaccacctcccgggtttaagcaattctcatgcctcagcctccctagtggctgcgactaaaggcctgcgcaaccacgcccagctaatttttgtattttttagtagagatggcgtttcactatgttggccaggctggtctcaaactcctgatctcaagtgatctgcctacctcagccttccaaggtgctgggattacagacttgagccactgcgcctggactccttctattatgttttttaaaaactggaataaaaaaaagtatatagtcaaataagttacataccaaatttagagacctccaagttatttacttatgctactttgttaagctatttatggctacctttaacgtatacatgttatttggaattcctataattattagttgagaagactgtactttgcactagacttctctcctttgcttaatcagaatggattaatttgtctattgtgaaattatttaaggaagtacatgtgaactacattcagtaaacggcagtcaaagctcaggcacatgtttcagcagatgtttgctttcatcctgttacaacagtcaattgagcaataaagaatgaacacaacatgttgcatcacaacattttattacagatcactatagagattattctttgggaagtttgttgtctgacttctagaagcatgaaagggctattctgggtttgggctacttctttttcatagcagatgagtgtcttcacagtcagttcctgcataggaaacctacataatgtcattgcaacaaacctttcattgcctcagaaaactgctctggcccagctggttgcaaactttctttagcaataaaactgtttcttcaaataaaatcttacatggcaccccaacatataaaacagatggcagcagagtgatattctaatgaaaggagtgaaggtcaagacaccaacgcccatagacccaacaaggacataagaagaatctcactgtacacatttagaaaatcattgcagaaaggtctacctacaatgcagctctgaatcgtctcatttgcctttggctttgtccctaaacacttcctctctgcctaaccacttcagttgacagctcatttgtaagatctgccacactcttttattcagcgtctcctaaagatgccacctctcagatatcaccttaacacacttcttatctgggagggatttgaaatgctttgggtgtccctggtgagaactgcaagaggagctatttaaagcttaagagaatgaaagaagaccataggaagagtcttgagaacaaccatcattgcgtcattcctggggaaagggtcctggaaatgagtcctggaaaaatcgaggccaaactgcccaaaaggcaaccaaagaagcagcatcgaccatgggataggaaactggtgtccttaaaggggcaagagagaaaactgcagggaggatgtctgtaaccagctacattggtgatcctttcttgtatctaaatggacactttgaggccatcagaaaatatgaccagattagtcctgatgggctcaaaaatctatatatggatgaaccctcaaaagtcaagatgtggtttgaagaacacaatgaaatgttggtatagcaactttaagataactgagaatatattattttgtgctgtatcagaagccactttatactaaattatagcacagaagggaataaagaggtacaaaaattttttaaaatactgatcaaagtaaaagttcagattttctctactaacttcattttctttctatgaattcagaagaaatttctagtattaggctcagctaatgtctgtgtcatgaggagtgttttacatgaaagtacccttgcttgaaaccattacaaagttccagggaaggagaaagcggcatgaggtagaggggacagagaaacccctagcactccctacctggcttcatgtcaaggcagcacaaaatcaactccaacccacagggattaagtacaaagggagttttcagacaggtgttcaaagtcataccaaggtcaaacaccaagagactaaggagcaggtcaacaaaggggaagagtagtttatggatctgggagtcttggaggtcagcattccaagaattcaagaggacatctgggcagacaacacagttcattagagcccacagcaacagtagctagaaaagaccgggggagggtggtgagggatataaaaactacatattgggtacaatgtacactattcaggtgatgggtgcactaaaatctcggaatttaccactatattattcatccaagtggctggatacagtggctcacacttgtaatcccagcactttggcaggccaaggcaggtggatcacttgaggccaggagttcaacagcctggccaacatggggaaaccccatctctactaaaaaatacaaaaattagctaggcgtggggacacgtgcctgtaatcctagctactctgaaggctgaggcacgagaatggcttgaacctgggaggcggaagctgcagtgagccaagatcgcactactgtactccagcctgggcgacagagtgagattccatctcaaaaaaacgtacagaataaaataataattcatccatgcagccaaaaaccccaaaagctattgattgatagacagacagacagacagatagatacagatatacgtatctatctatctatatacaaaaaaaaagacccatagtagttgttgctttatcaaaagccagagaaatgttctaaccttctaagttacagcaatttattcaatcaacttgctttcctctactctgccaaccagtttgaaaggctccctggccgggcgcggtggctcacacctgtaatcccagcactttgggaggccaaggcgggtggatcacgaggtcaagagatcgagaccagctggccaacatggtgaaaccccagccctactaaaattacaaaaattagttgggcatggtggcatgtgcctgtaatcccagctactcaggaggctgaggcagtagaatcacttgaacccaggaggcggaggttgcagtgagccaagatcgtgccactgcactccagcctgggtgacagagcaagactctgtctctgaaaaaaaaaaaaagaaagaaaggctccctaatggccaggcgtggtggctcatgcctataatcccagcactttggaaagccaaggctgacagatcacctgaggtcaggtattcgagaccagcctggccaacatggtgaaacccatctctactaaaaatacaaaaattagccgggcacggtggcgggtgcctataattccagctaccccagaggctaaggcaggagaatcgcttgaaccagggaggcagaggttgcagtgagccaagatcgtgccaccgcactccagcctgggtgacagagcgagactccgtctcaaaggaaaaaaaaaaagaaaggctccctaagtattccaactaggttccttcactaagtttcgttttcctacctaggcagatggaaagccaagcatccaggttagaacttagtcccccaaggccataccttgtctctgtcctcagctaagcccaggataaggccatctatggaaacaaagctcctattttcttaacatgcctctgagaaagatatttgaagcctagaggttaagaacataagggctaaaataagcaggcaagagggtgactcagaaagaacaagagccttgtttaaaaaaaaaaaagagtcggggaataaacctcaatacagatttactaacacagaaataaagactttgtgttagcaaagagactatgaatcagcaagagaacaacgcaagaggataaaggaaattgtagacaagagcagcataaaccatgaagatgtaagtatccacgtgtttataacatggataattgataagtaataagtaagtcttcagaaactatgtttgagtgttcaggggaaatcacaaaaacaagtaacagtacacttaattttttaaatgaggttgaaatgagattctgcatgagagataactgtaaagtagtaaaaaaggtttcagaagtcacacatgaaaatcaatctcataattctacaatcacattttagtatgtccacattttaaagtataaagttagactttatataccaacaaatttggctgcaaggtttgtaagttgagttttgacctcgagaaataccttcctattttttaaagaaagaaatattataatgacattccttttaagttattactttcctatacatacttgcttatcacataaaaaatataattgctatatagccatcaagcattaaaaataaaccaacacatctaacaataggcctcaatggtactaatctattttcctagatatatcactttaaaaccacatatgaatgtctaagaaataaaagttttttatttttcttttagaatctacagcatacaacatgataaaattattttgtataaaaattataatttttaattaatttgaaataatttccattaatttctgatgcttgtaagcattttagatatacattcctttagctcttataatatacttataaactgtgaaaaattctgagacaggaaggaacagatattaaaattctattacttctaatctaaaagccctccatcttatgttctctgtaggagacagaaactcacaaaagaaaatgtttggcttctactattaagaaattggacatttttcacatatattacagtggaaggggttttacatttctttcaggcacaaaatatttatgaactcgggagcagcccaaacataaagataaaatgcagcatgactttccaaaccaaaatctgcggcttatgtctatggatttttgtgacccttttgggaaaaggcagagttggaaacacaatttagttgtccaagtattagaacttttaaagcatctctttgatttatgaagaaaatgcacaaaaatacgttaaaggaggcagtaccagaaaatccagcaagttgctcatcactacacacctctatgcacagatgacatgagcaattatttgtctttccttcacttctgactgccagggctcagggctgaggtcctattgactgcacatagtataagaaagggaagagaaagttgtttcaacggcaacatcctcacctacttatgtctcttttctcctggttccagtaattaacagaatgatcacaaactgaaaccaaactgcaactctatcccttccactctcaccctggaagcctgttctcataaatccatcctcctcggggtattcctttaatcaatgtttattaatatgaatgaatgctttggctaacttgtacaggtcatctgccacttttaagtactccattcccacctcatgggtgtgtttcatctctttggtacagttgcatatttcctgaagagtctcattttgtgtattgcttctccactacccctcaccactggacagacaactggccagctgtcactcaaatgctaattgtgtctatcatctgctttctctaatagccttttccttccgctggttccctccattccctgccaattttatttagaagtgactcaaaaagtgtttggggactccactgatagctgtgcttttttgataattaaaccatatttacatccaattcaacagtatttggtaagcaattactacctttccagtacggtgctagcaactacgaatggcatgaaagaaacacaggatccaactgctcccttcaagaagttggtaattagggtgaggtggaatgatgtactcatttacgaaaaaggacggataagacaatattatcagggagaaaaacgtctggtacaccatgtgcaccagccagcacaagaaatcaaaagtgaaaggggcttcaagtcaaaagacctgaactctgctacttccttcctagctatgtgtcctgtggtgagccagacagcttccccacactgtttcctcaatatgggaatatttatctagcaagattattggaaggattaaagggtacattatgtgaaatgcattttataaactgtaaactactgggtacatgtaagatcgttgttttacaagtcaagtagaggctgggaggtcagaaaaggggagcaatctgtcgggcatggaggctcatacctgtaatcccacctattcaagagactgaggtaggaggatcacttgagcccaagagatcaaaaccaacctgggcaacataatgagatgctgttgtacaaaaatttttttaattagcaaggtgaggtggcctgtgccagtagtcccggctactcagaaggctgaggtgggaggatcacttgagcccaagagttcaaggctgcagtgagccatgactatgtcaccacactccagcctgggtgacagagtgagaccctgtctcaaaaaaagaaagaaagagggagcaatctgaccgtgactcaaagcaagagccaggacctgagctgagcaccttcttcaaagccaggcaagatttagctagatagtgaagaataggatacacagcatgtttcatgcaagggcatgttttgacttcaatttaacaagtattgaggaggcttgctaatcatttcaaaggatacaaatgtgcctcagatataatcctctaagtacaaaactggctgtaaactcaaaggaatgcttatgaggtaatgtgacaaattgaggagagcaggacgactaatccattggtatatggggttcctctgccaccatctgtttagacccaggataggtcaccatccctctgcaggccttgttttatcaaatatgaaataagaggtttgaccacaatggtctctttccaacacagacattctatgctgtatgattccaggttcaaagttcaaagcttagtcatgagaaatttaagtggggtcatggtgacagttgtcccttctatcacctctcactccttgaagatgagagcctagatgagggcagccgcatgggaatgggaagaaggggatccaagatacactaattttaaaataatagaacagagttccacatcaggtggaaaaggacacagcaaagagaacaccaaagaataaagcctagggggccaggaggccaaaataatgttgccaacagaagcaggacatttgaagtggggaagggaaagagttggaatgggcataaggtgtttgtgggtggtatcagatttttggaagggaaggatgatgagattggatcggggcaggttcagcatgagagatcatcaaagccacatgaccaagaaatgcttgaaaatcatccccagtccctgtggcccacatttacctctgcccttgagacagaggcagagtagccaacagtgaaagctccaaaaagagggccatgactgtacaagccacagaagagggaacatgctgttagttcaggatgaacaagaccaaggataacagcagggtgctctcagccaaactcaattacacaggacatgatgggcagtccctgctgctctgattaaactcagtttccagatactatctccctgttgtaaagttctttatctggcagtgagtaaaaaggaaatgtcagggaagacagctagatgtcctgcacagcattcactcctcttaggagcctgcaataggcacctcctcagattccaaacttaggccttgcccatcatcatccaccacccatctgaatgtatctcaatgaaaacacacactggctgggcatggtggctcacgcctgtaatcccagcactttggcaggccaaagctggcggatcacctgaggtcaagagatcgagaccagcctggccaacgtggtaaaaccctgtctctactaaaaatacaaaaattagccaggcgtgcaggtgggcacctataatcccggctactcaggaggctaaggcatgagaattgcttgaacctgggaggcaaaggttacagtgagctgagatcatgccactgcactccaggctgaggcacgagaattgcttgaacctgggaggcgcaggttgcagtgagctgagatcgcaccactgcactccagcctgggcgatacagcgagactcagtctcaaaaaaaaaaaaaaaaaaaaggaaacacacagtgaggaggagttgtagtatcactttcctccagctccttctctgcacctctcactctccttgaaaccactgacactaagaaataagaggttagaacccttctcttattacccttatctaattacttaatgtctctgtgttttcctagaagaagaattcactacctataccaggtctatcctgtttttggtctcacttaacactgctatatgtatgtgcctgtctcctaatgcacaccagcaagagtttctctagaaaattgctttccaaccttgttcatgatatttgtatgacctaccagggcatatgctcttgatcaaaggcaataggttttagggccccagaaaggccaggccctgtccagccaccctgagggacaaagggttcaacatctcaacacatctgaaccaattcagtgcacaccagggggagtcacctcctctagggtaggcgtcaaagcgtgaaattcctgggctatacctatgcacacatgttcagtaatacaagataatgtcaaattgctgtccaatatagttgttttacactcccaacttcatatcttcaccaacatttggtgcttgttgtcagacttctcaaaatggtaacacattgtgatctaaattcacatttctctgagtgctaatgagtgtgagcatcttttattagtttcttggccatctagtttcctcttattaaaatgcacatttgtatctttctcctatttttctattgggttctttttctttaagacagagtctcgctccgttgcccaggctggtgtgcaatggcacaatctcatctcactgcaacctctgcctcctgcattcaagtgattctcatccctcagcctcccaagtagctggggctacaagcacgcaccaccatacctggctaatttttgtagagatggggttttcccatgttagccaggctggtctcgaactcctagcggcaagtgatccgcccaccttggccgtccaaagtgctgagattatagacataagccaccatgcccagccaggttctttttctatggatgtgcagttcttcatatattctggatactatttataagttatgtatgttgcaaatatattcttactgtttttggtttgtcttttcacttttttagtggctcttaatcttaaaatagtcaaatttattcttttttatagttatttattttatatcatatcaagaaagtctcttttttttttaatggagacacggtctcactccagtgcaatggcacaatcatagctcactacagcctcaacttctcaggctcaagtgatcctcccacctcagcctcccaataactgggactacaagcatgagtcgccacgcccagctaattttcttttcttttttgtagagatggggtctcactatgttgcccaagctagtcttgaactcctagtctcaagtgatcctcccacctcagcctcccaaagtgctaggattacaggtgtgagccaccatgcccagccaagaaattcttatctaaagcaataaagatattcttttatattatgtttataaagatactgcctttttatttaagtctttaatacactgagaattcaaggtatatgtagggatccaatttcattatttttcccttaagtatatacaatcgtcatagcaccatttattgcataaaattatcttttgcccagtgatatgcaataaatgaatggatctgtttcagggctttacatttggtttcgctggtcattttgaccatccctgggccagtgccacaatgccttaatcactatgaccctaaaatataacttcatacctgttacgactggtacccaccttaccaaggacatgaacccttcacatttccatctgagttcctcaaaaaccatatggggattcttattggaattgcattgcattgcattgggatcacataaatctatagatcaaattaagaagattgacatgttcatgatgtttaatttacctacctaagtacatgcatatttctccatctatttacgtatttttagtgcctttaaaaatattctcaaatctcacaaaagaagatatacaaatggcaaatatgcatatgagaagatgctcaatatcatatgttattagagaattgcaaattaaaacaagaatgagatatcactatacacctatcagaatgaccaaaatccaaaacactgacaacatcaaatgctggtgaggatgtggaaacccagaactctccttcattgctggtaggaatgcaaaatggtacaagccctttgttatagacagtttggcagttgtttacaaagctaaacttactcttaccgtacaatccaatcacattctttggtatttacccaaatgaagggagaactcatgtccacacaaaaacctgcacactgatatttattatagcagctttattcataattgccagaactcagaagcaacaagatgttcgtcagtagatgaatggataaataaactgtggtacattcagacaatggaaaattattcagcactaaaaagaaatgagctatcaagccatgaaaaaacatggaagaaccttaaatgcatattactaactgaaagaagccaatctgtatgattccaactatgtggcattctaggaaaggctaaactgtggagatagtacaaagatcagtggttattaggggttggagtgggggaagtgaaagagatgaataggcagagaacagacgatttttagggcagtgaaactattttgtgtgacactataacatagatagatgtcattatacatttgtatacatacccatagaatgtacaacaccaagagtgaactccaatctaaactatggactttggatgataatgtgtcaatagaggttcatcatgtgtaacaaacgtaccactctggtatgggatgttgatagtgggggaggctatgcatgttggggggtttgggagggaagggaatatatggaaactgtactttctactcagtattactgtgaacctaaaactgctctaaaaactaaaactcggccaggcatggtggctcatggtggcctgtaatcccagcactttgggaggccgaggcgggtggatcacgaggtcaggagttcaaaaccagcctggccaagatggtgaaacccccatctctactaaaatataaaaattagccaggcgcggtggcaggcacctgtaatcccagctactcaggaggctgaggtgggagaattgctggaacccgggcagcagaggtttcagtgagccatgatcgtgccactgcactccagcctgggtgacagagttagactctgtctcaaaaaaaaataaaaataataaataaataaactctaagaaaagaatatttttggctgggtactgtggcttacacctgtaatcccagcactttgggaagccaaggcagccagattatgagatcaggagttcaagaccagcctggccaacacggtgaaaccccatctctcctaaaaataccaaaaaaaaaaaaaaaagttagctaggcttgggggcgtgtgcccgtagtcccagctacttgggaggctaaggtagaagaatagcttgaacccaggaggcggaggttgcagtgagccgagatcactcactgcatctcaaaaaaaaaaaaaaaaaaaaaaaaaagcatctttttgaaaagttttcgggccaggcacagtggctcatgcctgtaatcccagcactttggaaggccgaggtgggtggatcatgaggtcaggagttcaaaaccagcctggccaacatggtgcaatcccatctctactaaagatacaaaattagctgggcatggtggcatgcacctgtaatcccagctactcgggaggctgaggcagaagaattgcttgaactcaggagacagaggttgcagtgagccaaaatggcacaattgcactctggcctgggtgacagggcgagactccatcccaaaaaaaaaaaaaaaagttttcaataaactcttttcatgaagatattgtacatctttcaacttattgatactttgtttttgtcactactgtgataacttttaaacatgtatcttctatttcttacatagccatactaattccagcaatctgttaaacatattaggtaaaaataaattacttcttcctttctaatcttaccttttagtctaattataaaaagtcggccaggcgcggtggctcatgcatgtaatcctagcaatttgggaggccaaggtgggcgaatcacaatgtcaggagatccagaccatcctggctaacacagtgaaacctcgtctctactcaaaatacaaaaaaattagccgggcgtggtggtaggcacctgtagtctcaggtactcgggaggctgaggcaggagaatggcgtgaacccgggaggcagagcttgcagtgagccgagatcacgccactgcactccagcctgggcaacagagtgagactctgactcaaagaaaaaaaaaaaataggtaagaacaaaacaaaacaaaaaaacagtgaatagacatggtgatacaggtagtcttatctcttttttttctttttttttgtttttttttgagacaagatctcactctgttgtccaggctggagtgcaatggcacaatcacagctcactgcagcctcggcctcccaggctcaggtgactgtcccgccccagcctcccttgtccaggctggtctggaactcctgggctcaagccacccacctgcctcagccttctaaagtgctgggattataggtgtgagccaccacgcccagcccagtctcgtcatgtcttgattctaacatttcactgttaagaatgacatttgctgtagatttttggtacatatttttatcaggtcaaggaagttcatctatcctagtttgctaagtacgagtattatgaatgggtgtcaactttatcacattttgtttcagcatgtatcaaggagactgctacttttttcccttaatctgttaatttaccagcttttatatttattccgcctttgatatttttctttcctttcttctagcttcttctctcactttcctggtttctgctcttttctcatactttctacctagaatttctctttcaaagtaattctgtttcttccttttgcattcgccagggggtaggggagagcaaagggaggtagttctcagggtaattaataaatatttgaatggctaaaaagtgaaatacctaataggtgccaggtccttgaggtgaccttacccaaaaccagtcttcaaatgtgccatattacatttatataagtcgctcccgtcttgggcttaaaaaaaaaagttacttgagatgcagtcactagaggaagaattatagtagaatgctttaaacagaaatggtgtttcaccctctagagaaacatcgaaaatgcattagctatcatccgaattttcttttgaacacagtactatatttaattttaactactagcacttgggttcccccatttaatacctagaaagtagggcactagattataaaaatgccaagtatctgaagagagacaaggaataacgtttatgcattctgtaattcaacactgtatgttaaagaggccagcccatgtctcttcttaattttaaaattaaagaagccgaacccaaatttctgaattctagctaataatttaggacccacttaaaaaaactttgccaagtttttccattagtctgtttaattgtcctaaagtctgtatttcatttaactccatgaaatgcatatatttgaggaacgatgttagagtaaccatgatctagaaatgaaaagggcacttacacaaaagaaacaaatcagcaaacaactctgtaacagaattctggagtctttagtcttacaaaaaaccacattaaacatcgtaagagaatacaacatttagtccacacctgactccaaagagtctctcaactatagccagggttattttttctgtttgtttgtttgtttttgttttttgagacaagagtctcactctgtcacccaggctggagttggagtgcagtggtccgatcttggctcattgcaacctctgcctctggattcaggtgattctcatgcctcagcctcccaagtagttgggagtacaggcatgcaccaccacatccggttaatttttctatttttagtatagacagggtttcgccatgttgcccaggctggtctcaaactcttgaccttaggtgatcagccggcctcggcctcccaaagtactgggattactttgggtgtgagccactgtgcccagccaaaatctttattttgtgatttctacaaacctttaatcacgtttagattttaaacatttttccaacctctataagctagaatagatggggatctgttttttaacagaaattttaagctgttttagagaaaaataaacttggctcaaatgacaaatgtgaaattatcaaaattacgaagcataggaggatgtgggaaagggttgtagtgttcacaacacataggaaagtatttcccaaaaaatatatattaaatgtacttcaaatataacagaagttaaatgcagaatagcatacatatacctctccaaaatctgttaataattttaaatgaggtttgataagtaaattggcctccaccaatgatccaaagatatactagtaaagcttgatgccactgaggagggagagagcctggtttaaatgactgaaattcattcagtcatttaagcagtagctcatgagcacatcaattaaacatctaacaaacaagaattgtggatgtgccactatgttaagcaccaagaatgtggctctagaagagcaacagtctaataggtaagctgtttgtggaaatgcccaaggaaaatgcatggaaacaagaactatagggcccggcatggtggctcatgcctgtaatcctagcactttgggaggccgaggtgggcggatcacctggggttgagagttcaagaccagcctgaccaacatggtgaaaccccatctctactaaaaatacaaaattagccgggcgtggcggcgcatgcctgtaatcccagctacttgggaggctgaggcaggagaaacatttgaacccaggaggcggaggttgcagccagccgagatcgcacattgcactccagcctgggcgacaagagtaaaactctgtctcaaagaaaaaaagaagaagaagaagaactgtaacagaagtatgcacaagccgttggggagatgggagggctggggagatagcacaagagggagaagaaggagcccacaatgtctaaggagggaatcagaaaaacttcacacaggggcatctgagctaaggactaaagtcagaatgtgagtgtacaggcacacataaggacaagtgacagatgtgaatggacaaaaattacacagtgcactagataatgtggggaacgactttacctcacatgtcagccaaataagcattatcctttcaagataacagaaactataagcaaataattcttgatgccaatccaaaacatgtaactgagttttgatggaatttggtaaggaatgcctgatgctcaaaattaaaaaaaaaaaaaagaccaggtttcgaaccgtcaggagggaacacatcttgggctgactgatgcgggcaggtaagggtttgagggtttgcgcttgcaaaggtgtaagaggctaaggttacttaggatgcattaaaggacttcagcagtggatgtggctgaagggatgcatggaggtaggggagaatgtatccagaacagaggctgaaaacatgggaaagtgtttgagacctgggtctaaaaggactgtgacatggcactaaaaagtttgtgtgttatcctctgggcaacagaaggccaccacgggctctttatgcaggagaggaccatgagatgtgtgccttagaaagatctctatggcagccacatggagactggaaatacacagagcatcagaaggctctaatgttaccgactgaatgtttgtgtctccccaaaatttgtatgttgaaatctaatccccaatgtgatggtataaggaggcaggtctttgggaagtaattaggttttgaggatagatccttcatgaaggggattagtgcccctataagaagaggccagagagctacctttctgccttgtgagaatacagtgaaaagtcaagtgtctgcaacctggaagagagctctcaccaaaatctgagcatgctgataccctgatctcagactttcagcctctagaacaatgaggaataaatttccgttgtttgcaagctatccagtctatggtactttgttataacagtttgaactggttaagacatatggagagagattttgagggtttgaattgtgttggtgacagtagggatgaagaagaagtgattaatttgagatatatttaggaggtagaaatcaatataacttcttaacagactagtatagaaattaaagataaccaaaacttttagtttggtaaataaatggtataacattaactgaaaaaggaaaagatggtttgagaagatgataattattataactaacactaagcactattctaaatcctttaaagcactaactcatttagtcttcacaacaaccgtataaggtccctaaatctacagatgaaaaataccaatgcacagaaaggttaataaagttgcccaaggtcacacagccagaaatggcagaaccaagatgtgatctcagacacactctcaactaccacattacactgtacggtacacaaccagttaaacatctctcatgtctgagggacatcaagggagttgtgtttaatttgcatttggaaaacagacctagggctcacaagaagaatatggctatgaattttagtgtcatcaacataatagtatttccttaggccatgggaaaaatgagatggacatttagagtgaagagagaacaaaaatgtaaggagcagcaagacagatacaagaaggacactaggaaggagatttttcaagcagtgattgtccacaggctggctcagttgccacaccacagaggtacaaacttgaagtggtctgggccttctccgtgtgaaaatggcaaatccattcactgtttgctggatgaatggacttatcattgagctatttgctggatttaccatctagctaaaagatagctaaaagattccagcttagactatgtcatcaagaaaggaggcctgatagggtatgaaacggggaaaacaagaaaaacaaacaaaaatggatgctctcagctcttgaaaggatgatttatacccgtgtttgagcaaagcagattctgccttcagagaagcagcagcaaagatagctcatttctcaagcagcaccccatctcatccatcacccacttcccctacctgccccccagcctacaccacaggacctctgctctgccaagagggcagggccccagccacgctgcagcaacaccagaagcgcaaaagaaaatgtgctgttgcatagacagcgcaaataaataatggttcttgtgataatcagcttttgcttttaatgggcttcacatgactcatcagctatcacgtatgctatagcctgagctctggctctaaatcaaacaagttcaaagggagaagaaaggaataatagcaaaagatgagcagatatctcaagaagccttaatcctactgaggaaaaacagaaatggaggcaggaagaagacagtttcccctatgagcactcaggtaccgagggtccagagagggcggaagctgaaacagccgcagagagaggcagcctagttgccgtgacgccatcctgccagccagcaagatttcaccagaccgttccctttctgccacagttcctgtcttgtgggcagcagaagcaccaagaaagaagaaaaatggttgtttgtattcttatggctgcagggtcatacctctgtgacttaactatttcaacaagtgacaaggagaaagtggtaagagacagagagagcagccaagatgggggtaaactcctttggaatgtattaaatccaacttcattctatggataaaatgccctcatgaataaacactcatccccaaaacatcttttttttttttttggtatttataatccaagaaccttgacagagaatgtcagctttttatcaaggctctttcccacaatgacttctgataatgggggttggggttcattcccaggtgaaaagcatgagtttgtggcaaagaaaacagtattgtttggtcaccacactggaatggaagccaggatattctgaaggatgccttggcactaatacaaattagcaaatgactttagcacttctgagcctcaatttcttcatctgtaaaatgagaagaatggactgggtgaatatgaagtccttccactctcttaatctatgcttatgggtgctcagagcacgggaacccttccaggtgtctcttgtggttaggctgtccatgtgtcaggaccctgattgtgctcccagggacacacaagtgtgagagtggctacaactcaatggaagcaataagtaaacacgtacacactcacaaagctagatccctatatttgattaaaccatgggttagtagacaggaaccatgtcttatgcatcttcacacactcaaaatccagcccagtccaggcactgggcttaacaaatgtttactgcatgcattttgaggcaaatctttaaaatgtcatattaagaagcttttcagacatgtcggttatggattgaattgtgtccccctaaaattcacatgttgaagccctaactcccagtacctcagaatacaatgttttttggagctaggacctttatagagggaatcaagttaaaaagaggtcattagggtgggtcctaatccaccctcatggtctcttcacaagaaaggaactgggatcacagacatgaacacagggaggatggcatgaagagacatagggagaagacagccatccacagctaagcagaaaggcctggaacggattctccctcacagtcctcaaaagggaccaaccccgctgacatcttgatcttagactttcaggctccagaactgtgaggcaataaatttctgtttttgaaatcacacagttttaaagccacccagtttatggtactttgttatggcagctctagtaaactaatacaatatccagaagtagaattatataatgaaatctcccatcacactcaccactcagatctttcactccggcatacttcatttcgtatttctaaaatatatggacatttccttacataacaatacccttatcaaacctaacagaattaacactaatttaaaagcagatttaattcccagaagaaataaaccttatactaaaacacacacttacattcctccattaaaactattaacacttttaggccgggcacggtggctcatgcctgtaatcccagcactttgggaggcccaggtgggaagatcacttgaggtcaggagttagaaagcaggctggccaacatggtgaaaccccatctctactaaaaatacaaaaattagccaggcatggtagcgtggggtcccagctactcaggatgctgaggcaggagaatcacttgatcctgggaggcagaggttgcagtgacccgagattgtaccactgcactcaagcctgggcgacagagcaagactctgtctcaaatttaaaaaacaaaacaaaacaaaacaaaagctattaatactatcaaaaacaaaacaccaataagcttgaatttttgtcaaacaaccctcagaggataagcaagactctcagaataattcaatttcctaatcagctctcatattcaacaatttcctgaaagtaaaaacctatgtttctttattcaagtacagaaaagaaaggaagaatgcggtcagtattcatacccactccgtggtcactgaaaatgcacttttcaaactaatcccaagaaatttagtagacatcattaagtctttagtttaaaaacagtacgtgcaatggtattgtatgttatattgcacataatttaagcgcatgaaaattgacatgacagagctcaaaaccactaccaaaaaaaaaaaagataaatacaaaaccatacctttacagggtagagaaccgcttgttatgattttctaaaacgttagagactggagttaccaatgcttcaacaattgacaacttccaatcacatgtcctcttcaggaaggttactttttgtct

SEQ ID NO: 370 - DNA, 67428 bp, Homo sapiens
ttgacagactagaccacttttttattacagcttaattggcacatggttcactgaagatacacttcacttttacataggcttgtaaatagaaaaatacattgatgcacaaaaaatatagtacttcaataccaaacttaaatgatttccaaaaagaatacaggttatttcaataattaaaggtggcttttgtgtgtgcactatatcatgtatacacttaattgtatgtttaaggccagtggaatctatagctaattactcatttggttcttgaaaactgaaacatgcaaacattcttatttttatgtttaaagacatttaatgtgttattctaacacaaatacaccatatagaatatgccctgatatgtagctgtaaaattatgttgtactgcactgaagtcttatggcaactatataaggcactgctgtgtgattatgaccctgctctttttttttttttttttttttgagacagagtctcctctgtcgcccaggctggagtgcagtggcgcaatctcggctcactgcaagctccgcctcccaggttcacgccattctcctgcctcagcctcctgagtagctgggactacaggtgcccaccaccacgcccagcccattttttttttttttttttttttagtagagatggggtttcactgtgttagccaggatggtctcgatctcctgacctcgtgatccgccctcctcggcctcccaaagtgctgggattacaggtgtgagccaccgcgcctggccaaccctgctcttgaaatgtctaaatcttttcctcactagcatatacaattcaaatgcacaggcctccatgacttctttggaatttaaaagaagccttcatttcaaggatagaaatatgtaaaattttaccaaccatggataagtttgttatgggagtagtggaaggacagtggaaaaaaaaataggttttttcatgatacttttatttttccttttttaaaaataaatttagggggtacaagtacagtttagatacatgaatatattgtgtagtcgtaaagtctgggcttctagtgtaaccatcacgcaaatatacttgtatttttctaattacagttctaccaaacatttgccaccacaaaatacaagtatttttattctttatttaaattatggtgagtgatatttcttcctatatagccattaagatctctggaagttttgatctactttattcaaaccactttaataaataagacttttcacctaaatgaaatacctttgaattttataaacaacttccatgaaacatatattaaaaccacctttaatttggtatgaagacactttggcaatgcagcggaataaatgatcttggcaagacccagcaagtacagtaaatgctcatgagctctatgaaaaatataggctacagaatacttcatttttcttttattgaactacagtacaaatgtgactgcttcaatatgaacatctatcttccaccaaatagcaaacaggcatcttatgtaattaaaaactaattatttcaattccaccaatggaaaagcaaaacaagttgcaaatatcaacaatacagagcctgctggtaaagatagagatgagtaagttataagctaataaagctgcagcctgaggatgccagatcaacattataaatatgaagaaaaagaaactaaatatttactcatcgcaaataactcggcataagcaccagctatgttcaggtgcggccagcacataggccaagtataaatgtacaatcacagtgaactaaagccataaaatctagttccctgacccttcaatcaaccattcagagcaatgggaatatagcggggagacagaagtcccactttggttgctcatattacattaagccagcctgccccaccccaatccccttcccaccaataaaaaagtcaccgtgagtgtataattggtcaatccagtttatccaaggtctatagatatagccatgatttgtcctatattcatgttaaatagaatgcttacataaaattaatactcaaagacattgagctgatgtgcatgtatattcttatttaacatttaagtggctttaatggtattttagaatgtcacctatggcatgagtcttcaaatctggattgaagactgtggcggttttataactgcatgtaagatcttaaatgtaagactctgggcctacctacattaaggcaggtgacagtaccctcattcattctacataataaatacactcttctgtgactgcaaaattctgaatccttgaatgatttactataataggctaaggttgtataaggcacttttggctctgaaatatttctcctaactctcaggctgaatcttaaagaaatatttacaaagctgcaacaaattaattttagaaccggatgctttattcgtaggtctaatggggatggtgagaagcaatttgtacacaatgcccattaatctctcactgtgccatgtatcaatcatagagaagatcccaggcatgggccacctgaactactatgtcgcttacttgacttctcaacagccacatgcccctttctccttttcttcacttaactgatccgtagaggcatgaccatttgatcgcaccactccttcaggaatccaggacttgtccacacaccgttccattcgcttcattatcaggtccagaagcatctcaattgcttggcttatgtttgtcccattggcagcactagtttcaaagtaggggattctggaagacagagacaactgaggtaacaacatgtggagggaaaggagagtgacctttgctcttgataattcaaattagagaatcgatagaatacaaatatacaagatgacaaacattttaccaccccagagtacattaaaaagttaaaaagacaataaaatactcacactgcatttccagtagatatgcaaaactggaaattttagactcttcaaaatatcaatttttggctgggcgcagtggctcacacctcccagcactctgggaggctcaggtgggcagatcacctgaggtcaggagtttaagaccagcctggccaacatgcggaaaccccatctctacaaaaaatacaaaaattagccaggaatggtggcatacacctgtaatcccagctactggggaggctgaggctcaagaatcacttgaacctgggaggcagaggttgcagtgagccaatattgtgccaccgcactccagcctgggcaatagagttagactgtctcaaaaaaaatcaattttcattttttaaaggaccatatatatattttggcaatacatactgatttactgtaaaaaatttataaaaagatataagtaggggattctggaagacagagacagaattaaatcttttttcgtttaagtttttggagggttttttgttttgagacagagtctctatcacccaggctggagtgcagtggcacgatctcagttcccaggcgacttcccaggcatcgatcctcctacctcagctttccaagtagctgggaccacaggcgcacaccaccacacctggctaattattgtatttttttgtagagacagggttttaccatgttgcccaggctggtttcgaactcctgagctcaagctacccacccgccttggcctccaaagtgctgggactacaggtgtgagctgctgcacccagcctagttttaagaatttaaaacttgattattggtatgaaagccgtttaaattcctctaagtgaaaagtaaaacttgaaaacttttagaagaacatacaacagtcttatctttttgacattggaataagaaaggatttcttaatatagctataaaagctcaaaccacagagaataagtttgataatcttgacaatgttaaagtttaaaactttggtgccacaacatatatcataagcaaagttaaaagatgagcgacaggccgaaatacatggcatttcatataacttgcaaacgggttagcatccgaaaaaataattcctcaaatgaattaaagtaataaacaagataatacaaaacagactaaggatatgcacgggaaattctaagaaattacatttgtgaaaaaatgttcaacctcacccaaaataagggaaatgcaagttaaaataatggtatattaactcacacccatcagattggcaaaaatatagaaatctcccaatattaagtattgccaaggagaagaaaagaggaacttgcacttactgcttatgtaagtataaactgttaataactactttggaaaataagacggtaatatctgataaaattgaaacatgcatgcactatgacccagcaacagcactcctgggtatacatctaaagcagagccaaggcatgttgatgggcaggaagtgagttacagggatacatgagacatcagcaatccctcagtccttagggcaactgagaaggtcttagggcagccagagtccctgaaccagtctcctccaaacttgagcagccttatctatttatcccagtgagctgtacaaatattatcattttctgcaggtgccatcctatgaaaaatattcagaaaccctgtgctggagcagcactatccaatagaacttcccacagtgacaggaactttccatatgtatatcatccagtacaataactactagccacatgtagctattgagcacttaaaatgtggctaatgcaaccaaaaatgcgacttttttgtttttgtttttgttttgttttgttttttagagatggagtctcactttgttgcccaggctggagtgtaatggtgtgatattggctcattgcaacctctgcctcccaagttcaagcgattctcgtccctcagcctcccaagtagctgggactacaggaacaggccaccactcccagctaattttatcatgttggccaggctggtctcaaactcctgacctcaagtgatctgtctgcctccactcccaaagtgctgggataacaggcatgagccaccacacctggccaaaaaacctgaacttttaattttaacttaaatagctacatgtgaccagtggctatcacactggatagtgcagccctagagaagctctcacatatgtgcacgtggcatcgtctaatggaatagatattgcagaactatttgtaatagggaaaaaatttacctaaacgtccatcaataagcgcatgaatagtgatatttttatacaatgaattatacaatgcttaaactgtatcaacatggcaaaaattaaacattgaattaaaaaaccaacttgtatgatacaagatcatttgtgtgaagacaacaattacacatcattataaaaacatctatgtagtaaaagtacaacttcttggactagaaatatataattttgactgcttttagctaaaagtaaccgaaaattgtggctcaaattggcatgaatcacaagtaggaatttattgtaatgcataatgaacacagaactagagagtttccagtgttaattcggttgccaaacggtagaaacaaagagcctagattcatatcatccttctgttctgccatcctccacatgtcagctttctccacaatctgactcccttcatgaccccagaagttaaaacattccaggcatcacatctcaacacaccgaagttccaaggaagaaaggactcttcctctgtgtgcctccctcaggagagaggaaatctttcccacaagtccctggaagactttccctcgtgtctcattggtcaaaactgtatcacatgccaatgcctaaaccaaactctggcaagaggaatggtacaccaccatcactggcttaaaccaatcagtcttcctgggctggtggctggcacctgcctctcttaagtagcatgtcctctagaagcagagtagatagctaaagaaaattgagattctataaataaaggcatgaatattgtctaggcaaccaacaacatctgctataggaagtagatatagtgtggttccctctgaggaggtaggaaggagaatggaatcagcaaggaattttaaaagggacttcaattgtatctgtaagaaaattttattttttatttatgcataatatagtttcagagtaaatatgatcatttaatacactgatataatgtgtaaagataagtatacttgggattgccataatcttaaatatttgtcttttctttatactagaacgattggaatttttccctcctagctatttcaagatatacaatagattgttgtaaactatagtcaccctactgatccttctaacactacatcttatttcttctatcaaaccatatgtttgtacctattaatcaatctctcttcatcctccactccctcctacccttcctggcctctggtattctccaatctactctctatcttcatgagatccacctttgtagctcccacatatgagtaagaacatgcaacatttgtctttctgtgtttggctatttcacataacataatgatctccagttccatccaagctgctgcaaatgatgggatttcattctttttatggtggaataacattccattgtatatataaaccatattttatttatccattcatccattgatgggtagattgattgcatatcttatctcttgtggatagtgctgcaataaacatgggagtacagagagcaaatacccttttgatatatctgatatacatctctatatatcttttgggatatatatatatctctctcctaagaaaacttacataaaacttttaagaaaacttccactaatatatatacacatatatatacacatatatatgtgtatgtgtgtacatatacatatatacacacatatgtgtgtatgtatacatatatacacacatgtgtgtatatatacatatatgtgtgtacacatatatgtgtgtatatacatatatacatatatgtgtgtgtatacatatatacacatatgtgtgtgtatgtatatacacacatatatgtatgtacatgtacacacatacgcatatatgtgcgtatgtgtgtacatgtacatatatacgcatatatgtgtgtacatgtacatatatacgcatatatatgtgtgtgtacatgtacatatatacacatatgtgtgtgtacatatacatatatacacatatatgtgtgtatatatacacacatacacatatgtatatatagtgtatatatgtatgtgtatgtatacatacacatacatatatacgtacacacatatgtatgtgtgtatacatacacacatgtatgtgtatgtatatatacacacatatatattagtggagttgctggatcatatggtagttctatttttagtttttttttttaagaacatccatacttttctccacagtgcttatgctaatttactttcccaccaacaatgtacgggttcacctttctctgcatcctcaccagcatccactattgcctgtatttaggtgtggtttttttttttttgagggggggggaattactgcctatattttggataaaagtcatgttaactggatgagaagttatctcattgcagttttgatttgcctttctctgagtagtgatattgagcattttttcatacacctgtttgccatttgcagatcttttgagaaatgtctattcagatcttttgcctatttttaaaacagattatttgtttttgctattgagttatttgagccccttatatattctcgttattaatccctgatcagatgggtagtttgcaaatattttatcccattctatgggttatctcttcattttgttgtttcctttgctgtgtagaagctttttagcttgatataaatcccatatttctattcttgtgttggttgcctgtgttttgtggtcttacacaaaaagtttttgtccagacgaatgacctggagtgtttcccaaatgttttcttctagtagtttcatagtttcaagtccgatatttaagttttaattcattttgagttgatttttatatatggtgagagataggggtctagttacattgttctgcatgtggctatgtagttttcccagcatcatttattgaagagaatgtcctttcccctctgttcttggtacttttgtccaagatgagttgtctgtaaatgcatggatttatatctgggttctctgttctgttccattggcctatgtgtctgttttatgccagtaccatgctgatttggttcctatagctttgtagtaaactttgaagtcagtgtgaggtctccagctttgggcttttttcctcaggattttgtcagttattgagggtcttttgtggttccatataaattttaggatttttttcgatatttgtgaagaatattattggtattttgatagggattgcattgagtcagtaaattgctttgggaagtgttatcattttaacaatattaattattccagtccaaaagtatggaatatttttccatttttggtgtcctcttcaatttctctcacctgtgttttatagttttccttgtatagatgcttcacttctttggttaaattgatttctaggtattttatattctttgcagctattgtaaatgagattgctttcttgatttctttttcagattgttccctgttggtgtatataaatgctaatgatttttgtatgttgattttgtatcctaaaactttactgaattcgttgatcagttctaaatgttttttggtgtaatctttaggttagaaaaaaactcttaaagcaggcctgtggcaagaaggcccagaaaagttaagcggtctgatcaatgttattcagctaataaatgacagagaagcaagtaggctcttcctgttttcttatacaggtcctcatatactatactatgtcttgtaaaacaaaataggaaatgtcttctcagtgtttagttcaaagaatactgatttccaaaactactaactagaagaaaaaaactgggtaaattcaaattttgcaacatgctattttattaaatgagtttcctggactataaccttttttttttttttttttttagcttttcccccttttttgcttcagggatttcttgtatatgctcttcagagtgttctggtttgcctgaattgaaactagctgatatatatgagtcatttaagattgaaggaaaaaataactaaaattatttcttgagctacccaatactatgtgtcttacatacatgattcactaaatataaccactactgtattcaggtacacaatattcccatttcacaaatgattaaactaaggctgagaaagatgaaaggaacttgcccaattcacaatgctagaaagtagcagagttaggatttgggtccacagctaattccaatgcagccagtttaaccataggttctactggttccaaactagtatgaggattttcaaaataaataaatcttatgcactgtacaagaagaaaacgctggctttggggagtattcagaggtcactggccatgtttatcaaaggctttgccacttaccaactccagactatatttctggaccatacacttgaagacattctgaattttacagcatcaagttgctcaagagcaacaaatctttttttttttttttttgagacagtctcactctgttgcccagcctggagtgcagtggcgccatcctggctcactgcaagctccgcctcccgggctcacgccattctcctgcctcagcctcccaagtagctgggattacaggcggctgccaccacgcccgtttaattttttgtatttttagtacagacggtgtttcaccatgttagacaggatggtctcgatctcctgacctcgtgatccacccgcctcggcctcccaaagtgctgggattacaggcatgagccaccgcacccagcccatcaaatcttaagtatacatttgttttgttatccaaagacctgtggtacaggtgtaatttttaaataactcacaaagcattgcttcaaaactgtatagctgtttttcacataatcttgagaaatcagacttcttgtcgaagtcatcctttatacatttgagatggtctttgcaacaggattaatcaagtgacaaattcaccttgcttttcaataaagccatgaaagtcgtgataacattgtatttccttcaactgttgacttcattgccaccacttgtgaggaatctaaccaaaatgttcttagatatcaaaacaacaaagcaaagttattttattatctcagggagtcctgcaattgaattcagtaaagtatttcttaaatttattagaactttaaagtcctccacgattactgttcttgaagaatgtttttgtttttctgtattctcatagcatgttaacaactacatcagttactctgattacaatttaccttactcttttattctttcttggctagtaacagcttctatatgagagcttggtaaagttttcttttttaacttgttaatgcttttacagatcttttcagaactctttcacttctgatgttactaagaagcatatttagatcaagggttcccaatccccaggccacagactggtaccaatccatggcctgttagcaaccaggccacacaacaggaggtaagcagggggccagcgagcaagccaagtttcatctgtatttacagctgctccccatcactcacattaccacctgagctctgtctcctgtcagattagcagcatcattagattctcataggagcacaagccatattgtgaactgcccatgtgagggatctaggttgcactctcctatgagaatctaatgcctgatgatctgtcactgtctcctatcacccccagatgggactgtccagttgcaggaaaacaagctcagggctcccactgattctacattatggtgagccgtataattatttcattatatatggcaatgtaatgataatagaaataaagtgcacaataaatgtaatatgtttgaatcattccaaaaccacccacacctccactggtccatggaaagattgtcttccatgaaaccagttcccagtgccaaaaaggttggggaccactgatttagaggatatatgtgtagggacataaggctatttttccagtatgattcctcagtaatgctgtcttattatttgataacttcctccaggaggtgataaggccttgcaactgaatctctgcaattctctgttttagcacagctattaaaaactggttgaggccgggcgcgatggctgatgcctgtaatcccagcactttgggaggccaaggcgggcggatcacgaagtcgggagatcgagaccatcctggctaacatggtgaaaccccgtctctactaaaaatacaaaaaattagccaggcatggtggtggacgcctgtagtcccagctactcgggaggctgaggcaggaggatggcatgaacccaggaggtggagcttgctgtgagccaagatcacgccactgcactccagcctgggcgacagagcgagactccgtctcaaaacaacaacaacaacaacaaaaactggttgagaaactatcacctcatttgagtgtttatccacccacctgtgagttctgcaaggcagagttgctcccctaactccaccatgctcatattctatcatccttttatttcctgactctaaaatatcttaatcagaaaaaagtttgttgggaaaaatgacatggtcttcgcagtttttaaacctcctgcttgcctcttagttactgtcaatcttttttcctccatctatcaccttgcacacaaaatgaagataatgcatctctgtccctcactagtcacatgtaatatttgattaacaacttgaagaggcaatcctttgtgactggagtcaatatgtgtttatttatcaagaatctataatattattgagctaaaatcctggggatagcttgtgatgccattgttacaagaatagaattttagaatgagatttttcaaaatgtaaattgttacattttcttcattatgatctttctcaattatatccattaaaaatcagttaatgtccacagaacatttcttatacttaaggagagggtttgaccattctatcacctttcagaaatacattacatgaaaaagcagttgaaaaactcagatctcccgcaacagaataaattggaaatttcttaaaaagtagttgaacagtaagcttttttaaaatgctaaatcacaataatgtatacttcattttaaaaattctctcaaaatcagttacaaatatctttccaactccagagtctccagcctcatttgattccttaattttcctccacagctcctgaaaattacttcaccatcatttttgaggaataaatgagaaaacatagtgaaagtactttgaaaactataaaacctgtgcatggaagttatcaacaacatggatcaatggttaagagtcataaccggccgggcgcggtggctcacgcctgtcatcccagcactttgggaggccgaggagggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaagagtcataacctcaggtcgggcgcggtagctcacgcctgtaatcccagcactttgggaggctgagacgggtggatcacctgaggtcaggagttcaagaccagaaaccccgtctctactaaaaatacaaaaattagccaggcgtggtggcaggcgcctataatcccagctactcaggaggctgaggcaggagaatcactttaacctgggaggcggaggttgcagtgagccgagatcgtgctacggcactcaaggctgggcaacagagggagacgccgtctcaaaaaaaaaaaaaaaaaaaaaaagaagtcataacctctggagtcatgctgcctggcttcaaatcctagtagtacatcttaccaactgtgattctgacaaaagtttaacctctgtgcctccgctgcttcatctgtaataccaaataacatcagtatcttcttgtaatgattaaatgagttaatatttaaagcacttagatcagaacctgacacatgtacaaacaataaatgtttcttatttccaacacagaattgggttaggtgataaaagcttatttgtaatgatgttatttaaaactcagaacacagccaggcaccgtggctcacacctgtaatcccagcactttgagaggccaaggcagggtcggagttgaggtcaggagttcaagatcagcctggccaacatggtgaaaccctgtctctactaaaaacacaaaaattagctgggcatggtggcacgtgcctgtagtcccagctactagggaggctgagacgggagatctcttgaacacaggaggcagaggttgcagtgagccgaggcggtgctactgcactccagcctgagcaacagagggagactctgtctcagaaaagaaaaacaaaaactcagaatacatcatcccaaaaaagcaatgtcactagcaacatggtaaacattaaattctcaatctgtgtgttgtgtgaaaaaaaaagaataaaaaataaaaataaatttgcaaactaacccatgaacattggtttaatccacaatgtagctgatctataaaatctacaatactgctctaattctggtacctgggaccacgcctccctacaccagagatgctgcactcagacctgtcctggccaaagtgctttgtgcctccaaagcatttgcctcccttactcctcattaaactcctcactttccaagcaatcttcatgaaatgctggaagacaatggatcttactctactgattaatactgacgtataaatgatgcttctagcagagctgtgagctactgtccaatgtttattaacttaagcaaatatttaattggtataatttcaaggtataagagctctaacttttcaagttactcatgctaaaagacacacaatattaacaagacatactttagatttgtaactccaaattcaagtaacaaacttctttcaattaaaagtatactttcttgccatttgtaaacctctaggtcatgggaccaggagtcaggttaacaactttaaaaatccttagactaatcactcagagttttctgagcaatttgaggcagtaagattttcatttctacaggaataagtgaatagagttcactccactctcagctctgtgccagtaattgggctgtaatctcatctagcaaactagatgagagccatagaaaagaccctgaattaagactttctttccataagaaaatgatgttccaggctggaggcggtggctcacctgtaatcccagcactttgggaggccgagacttgtgcatcacttgaggccaaaagttcaggatcaacctggccaacatggtgaaacctcgtctttactaaaaaaaatatataaaaattagctgggcacagtggtgcacacctgtagccccagctactcgggagggtgaggcaggagaatcgcttgaacctgggaggcagaggttacagtgagccaagatcgtgtcactgcactccagctgggtgacagagctacactccatctcaaaaaaaaaaaaaaaaaaaaaaaaaaaaaaaattcaagaggatgtattgttcccattttaaccatagaaagagtgctattgttccttttctccacatggtggtgctaatgtagcaccaccatggagccgtattgccaaagacgaaaaaattcagcactgctcatcgttattaccagtctgtaagtggccacttaaaggccatttggagtacatggagaccattaattataatgcatttccaaaaatagattaatcacaaattttaaaataaaaaatttaagtaaacagattcaaatcaatgagaggggcataagcatttgcagtttttcaccaagatcttgcttgtggcgtaggtcagcatcctgatttcttttccattatttattctcacaaaactaaaagatcctaaatctcagttagaggttgccaggaataacagcaagtatgtttggtggttctgtcaaatggctgtagatatttggctcacatgtagatctagaaattatgaacaaacgtctcactaaagtgagaagtgagtttcacactacttttcacagtctgttggatgctaattgaacaacatttccaggaaatggctggtgtgctgactgtttgaacctgggatattgcagcaaatgaaatccagatcctctgctgagttaaatggagctctgtgaatcagtcttgtatgtttgacttatttgtgtacttttcaaacatgcccaatgctacatcgctaagttatttctcaaatcaagaaaagatgtaatcaagttttaaaagactaaactattagagatcaagctatttgtaccgcatttcatctagttcaaactagagaaaacagtgagcatgctgttgaattaagctacttgaaatccctgaaatgatccatactgatattattaatgttgtaaataaatatttttaattcctctttcattccagaactcttgagcatcttcctcagcaataaccagcagccttcagcagggagaacatcatcttaaatttgctgcccatttctttgcacagtacacaaaatatgtacattcagttgtcattcttagttcacattctttttttttttttttttagaggcagagcctcgctcttttgctcaggctggagtgcaatggtgtgatcttggctcactgcaacctctgcctcctgggttcaagcaattctcctgcctcagcctcccaagtagctgggattacaggcacccaccatcatacccaggtaatttttatatttttgtagagacggggtttcaccatgttggccaggctggtctcgaactcctgagctcaggtgatccacccacctcaacctcccaaagtgctgggattacaggcatgagccaccatgcccagctttagatcatattcacatttttctctattttcctcaactctgaatcaagaacaaaggcttattatgaccaccaactatcctctgtgaataaagtatggacagacatttcaacgcaaccatatttagtcacagagtgaagcccttgtctgctcacttgtggttggtgctccctcactaccaatgccaaggtcccttcccagcctatatcataggtgatgtaattaactgggtgagaaaaaaaatcttcctctctttagcatggattttccaatgagaagtcattgagcatatttcactcactcatgcatggcacaagtagacaattggttcatatcctgtacaagaatgactttgtccaaagaaaatatctgctagcatgctcacctgtcaagcaaaatgtttgctagcatgcgtctttgataggaactcaaagtgttgtcttgaaccagcagcagcaacatctagaaactgatcatcagtatacatttgtgggctccaacccagacctactgaatcagaaactgcgggacccagtgttcaggtgattgattctgatgcacactgaagcttgagatctaatagtgtcttccaaaagaggaatgttgccaatatttcattcagctttctcttctacttgtcactgacttcgtagctatctttttaaagtgtttcagtaaccatgtgaactgtaatcacttggctggcaggagtgcaaatttgaacaactttctgttttgttctcttctccaacttcattgacaatatcactcaatataatacattggaaaccattatgttgcatttgttccaggaaaattcaattggtttaccacagagatcactttgatttgttaggaagtgacctaagagcttcatattacaatttaaccaagtttcacagcaaaaacaaacaaacaacaacaaaaaaaaaaacatggaaaattagcggtagactcttaggccactacaaattttttttctgatattcattatcatgcatacaatttgccctttacatttttgtctgttgtatgaagtcctcattctcaaatttacttgtcccagcacacacagattaacattccattttcgcactgtagtgttctttattaggcttacaaagttcttctgagacatggtgtttgattctttgatatgtctattccagagaaccaattgtaaaccaatgatctggggtttttttgtttgtttgtttgtttttgtttgtttgtttgttttgttttgagacagagttttgctcttgttgcccaggctggagtgcaatggtgcgatcttggctcactgcaacctctgccttaccagggttcaagcgattctcctgcctcagcctcccaagtagctggaattacaggtgcccgccaccacacctggctaattttttgtatttttagtagagatggggtttcaccatgttggccaggctggtctagaactcctgacctccggtgatccacctgccttggcctcccaaagtgctggcattgcaggtatgagccaccacacctggccccagtgatctgtttttatgaattgagaatagaagacagcataatagtaacaaaaaatgtaaatttatcaaacaacatacaaattatatgaagatatgccataaactttatcctgttttctgactgttagcacatggataaactaaacaatatagtcctttagtgcatgtgtaaccagtgtaaatgttctaagaatgaaacaaaacatctgtgaaaataatcattaaagttatatgccatatttgtgaaatgcatgtgaaccaaatttttccatcatattttcctctaaaagtgccaaacagcctaccaaactacatggtatgctttctgtatcctaagggactctgtttctagccctttcctttcttcaagggtttcaatcattatctgctaaatcctcttttctcattttaacccaattcaaaaactatagattgagctcctctctatgaaatactccataaccatcgtgacctgggcacaggtcaaagacagtcccccacacccctcagataccccatatgacagaaggcagggttaggctctgtgaaaccagacaggctgtggaatcctaagaccgagggcacaggaaacaagcaaagggctgaaaaagcccacaggggcaagaagtcaagcctgaccctcccccagtacttgagaatatacttgaatgtgcttgtttgatctagctaactcctctaactgcctttttcttttttttctttgcatttactgacatactctcaaaagaatgctctaggatccatggtttccattgcttcatcacttacttcctccttacccattgcaacatacctcacagcttcaacactacagcattctctgtggtaatcgttctctccctgtttcttttccactacgttacatgagtgcctctcaggggagcagggggacatttcagactggccggtaagactctgtcagcctccccctcagaatcacctaagtcactggttctcaaccattgcacatgaagatcacgtggggagattttaaaagataccaatgcccaggctttgtaatgagtcagcttggctaggctaaacaacatttcccagaatgccctttctggttagggtgggccacaaaagagatttgggggcaattttgggggtaggaagtgaagcaacctccatttcatagccctcatatattgtcgcttatctgctggctcatcttattgtcataaacctgcaactagacctgcacctgggccaggtgatgttgttagccctgtgacaaagggccccagtttctgcaggacacccacaccagccaggtcagaggcaacaggaagtgacatgggttttagtccctcattatgggcaccagctggttctcactttttccatccatcccccatttcacatccttctccccttcctgtctgactgtcctgtccttcaggcttcagcatcagacacaaagacaacaccttacagagactacttacccagctcccacaattgcatatgctcaaattcctgtaacagatcccttcatgtataggtatgcttcttcaagtgaaccctgcctgagaaactcctccaaaccaattatgtctgatggtcagaggtgaagcccagacatgagaatgtgttaaaagttctctggatgtttctaacatggttaaacaccatctgccctagggtaaaaacctctacatgcaattgcaaatccttgccagagtaagcctatagtggatgggaatccttcagctgagctagccttgagaaaaacctaaaatcctgccctactctatgtgtttttcctgatttattcttccttttcctttttcacaaagctagcctctgcccacctcacagaccactgcaatctatcaatctctagtctttcctccctccccacctatagcctatagactgatctggaaatgtaaacataacatccctccatgctcaaaggctttcagcaactccctgtcctccagggatcaaatctaatctccttacctggtattcaaacccctccagagtctggcttcttcctacctggccaacctatcctccccctcccttcccactataaaccctaccagctttctgaacctccatcaaccaaagaaagaataaagcagtgatcacacaataaaaagggaaaggttttctcttggccttcttggattctgctaaccaccaaagccacaaactaggtaacatcccctacaccatctacaccatctctatttccctcccctcccttctcaacccacttgcttccttcctcttttaatgctattaagggtttgaatttacatatgggttctcattgtgtgagaggcagaaagaaagtaaagtaaaaattccttttagaggcacccttaacactttaatactttaataagcagcagctgaccacttctttcatgtccagttcatgctgctgctgctgctgctgctgctatgatcctattcccagaactcaaggagaacgacagtattttgctgaccctccaccacaagaccatagactaagccaaaggagatctcacactcctctcccagaatagaaatttcaaaaccagcacctaatctgcaataaccaataagcccttcttatatgctagcattctctacaatagtacatgaagtggctttgaaatttccttgctgaggctgggtgtggtggctcatacctgtaatcccagcactttgggaggctgaggcgggtgggtcacaaggtcaggagttggagaccagcctggccaatatggtaccagaaaccccatctctactaaaaatacaaaaattagccgggcatgatggtggactcctgtagtcccagctacttgggaggctgaggtaggagaatcgcttgaacccgggaggtggaggttgcagtgagccgagattgtgccactgcactccagcctgggtgacagtgtgagactctgtctcaaaaaaaaaaaagaaaagaaatgaaaaaagaaatttcctcgctcaacatggaggatttctttaccccaggagtctcctatttgcatcttggaaagaaggccttacatacttaaggcgcctctgagacaactcaaagttgtctctctgcaaatgccaagagtttgagaaaatgggaccaaagcactgaaggaggcccttgccacatgcattgtcaatggatcctactatcatatcatataaaaaggacacattcaacatgccccaaggcctatggctgaggttttgctttaattgtccacttttatctttttcattaccattcacctgctaatgtttatattgaaaatgttttctctagacttctccacaaaaatactcacccatatttctctgcgagtgctatggcttcctcctctttcactactctctggtcctccagatcactcttgtttccacacagcactatatctgggttttcacaatatgcatgcatctgtagctggcctattaatataagaaagtttattatatatgtaaataataatgtaagtgtatgatcagtgaacaatacatgcaaaagtgctttgaagactataatgtatatatagatattgggaattgacataatgctttcaaagcatcagtaatcttatctgtaaagctgaatagttggggcagaaatataaaaccattcttaagcacataccccagtttattgatatcggagagtttataggagaatgtgctacctctcaagtgtgagggcccacatgtgcacacgcacacatatgcacacacacacatacaaaacacctttcttttttatgaaggctatttgaaaagaaagttgcaggagttcctagggtttactgctaatcttaaaactgtttttatgtgtttttttctccatagcaatgacatttctaaaagaattgtttttctccaaactaatctatttctatccaaaatgtttttcacatttttctattatcctagggcagaatcaactcatttaaaacaaacaagatacaggcttcaatgagaagaaaagacccagaataaacagtaagtgattctgtcaccagagccaagtggaagcagaggactataattcttattccgcagcttttatttcacctgaaaacctgcaaataggcacaattataaaaagcaattgactcaaaccaaagagcttcactaagctaaatagtttaatctttcaaagtaggaaaataacacctcatttcttacccatcacaccccagaataaaattaaggcctaaacgttcacagtaagacatacttcagagtttatggcctaatttattttttcatcatggttaaccagaaaagtgtggacattttagttcctcattatgaagtagtgttcatcatatcttatcatgagaaagtcaagtaggcaggtgtttactgagcattagcacaggcctgatactctgcatggaatttcacaacagttctttgccctcatggggcaactggggtaataagacctacagaggacagactaaactgtgtaccatttcatgaaaagccatgccctttctttcctccaggttgttacacatgctgttcccacatcactgaatacttaaccacaaccttccttcaagacttgcttcatggttacctcattatctttctggtctccagagtggctctgtgctctgttaatgccttataaggtgttataggtccatgcccagtgtcatgctatgagcacagactcaggatccagtgtacctagggatgaatcctggctctgccatttactagctgtgtgaccctgatgaagttatttgactgcctcaatttccccatctgtaaatggtgataatgatactacttactttatacagtcaaggtaaggattaaaatgaattaatccagtgattctgcaggtaaagactgtgagccaccagccttagcataacctaagaatttgttgacatgcaagtctcaggtcccactccagctctactgaatcaggaatgctggaaatggggctagaaatctgtgttttaaaaagtcctccaggtgactgagatgcacattcacatttgagaactactaagttaatatattaaagcatttagaagagcatgtaagtatcaccagtaattatggttaacagtatttattttgggtagtctaggaagtgtgattattggtgatttcttctttttgtctcatttttcctaatttttctactaagattgtgcttatctaaaaagcaaattaatcagttattttaaaaacttcactaagaaaaaagtcacctacataaacaactacagtctgataatggatgtaataaggaccctatacacagtataaaatgtaacaggggttaaaaggagggaaaacatctaacacaactaagtttattacagagaatctcacagaggccatctttgctaggttttaaagaataagcagaactccagttggttaaaaaatgggggcaggtgtggaaagggtttttcagacagagagaataatgggaataaaaaataaagaagtaaaaatatgtaaaatatatactgttgggtttttgcaccacttatgggactctacagaagaaagtttagaaatgtaggctactttaaagtttccttaggaaacacactagcactggatgaagagtgactctgggcatgacgtgcttactcctctgaactccaggaagacaggacagtgactaccacactaccaaattcctttcagatttcaatccaggcccagaggactcagcctctgttctgtctcctcatctgagtggggcttactttagacttttatcacccttctcaagagggcatggagagattgagtgagagggaggggtctgcaaggagcaaagggaaaggggagggtatatagacctgctctcctctcccaggccaatcagggcccacgagtcagctacttctttaatgcaacactgtgttctggcactcaccactgatttttatgtatttgtgtgtgtgtgtgtgtgtgtgtgtgagtgtgtatttgtgtgtattaagctattatttttattaaaaaataagaaatgggccgggcactgtggctcacgcctgtaatcccagcactttgggaggctgaggcgcgtggatcacctgaggtcaggagttggatgaaaccccgggagatgggtgaaaccccatctctacaaaaatacaaaaattagctgggggtgttggtgtgcgcctgtaatcccagctactcgggaggctgaggcaggagaattgcttgaacccaggaggcagaggttgcagtgagccgagactgcaccattgcactccagcaagggcaacaagagtagaaactccatctcaaaaaaaaaaaaaaaagataagaaatgaatgatcattgtaatactcaaaaggctgacaggaagaagaaaaaaataaaagtacagataattaacaaatgtttattcctaattaagatttgatattaccacttctgacactgaacattacacctttttgtttaaatggtagggggtggagaatactttctattaaatatataaaatcttcaatacgtataagtgttctttacctaactgagcaataaggattcttttactctctaaggaaaacaaaacaaaatacatacatatgtatacatattttcacataattttgttctttatccaactagttagccaggataggcaatatttatctaatgtctcagagttttagtgtctacctatgaaaaacaggtgcgttattttttgatgctaagattctatgcgcactctctagtgatccttataaaatagttgattttaaaaagccccagaacttgttctgatgatgcaaaggagggatgatgaacacgggctgagagtaagagaccataaacagccactgtcattcagctacaagggaaataatgaggcaacttagccaggcatctagcgaagtgaagccccagtaagcattactatatttggggaactcatatttaaagtaattaatagctcttcaactcttagtggccaactgacttgagaacgggcaaaaaaaaggccattaaaaaggaaagccaaagcttcatatccttggataagtctattactttttaaggctcaatgtccttctcctgaaataaggacacaacactgacccgaatctttgcccagggtgattgtgaggatcagatacaaagtatgtgaaaaccacagtgcactaaattatttttaaactcatttttaatctaagcttttctactatcaaaactacagccaattaccctttcataatcccaaaacagtaatgtttaagtagcagatctttttaaatcagtgttttaaagatttagatgttaagaatttaatattacagccttccctaatagattctctagggttacactaacatgaccaaacagggaaaatatacatttgaaagctgttatgcagtcaagtggcagaattcgaaatggctatgaaccaatcatttaggaggttaaaatctctccaaaataaaggttgacatatattgcactggtgaccacttttaccaatgcagttgtagagttttccatggcagaatcctcctgaaagatgctctaaccctaaaagctagaaggggactctaagcacagaaaagacatgaagccaggggtatgatccattaagtctttaaaagctatctgcatctatgtaatacccatttaatgtccagagatgatagaagaattgatagcatacaatagacaagcagatacttagagatttaacttctctaggcttctacttcctcatctacgaaatgggaataagagtctcttctgtgggatagactgaagaggagagcacacataaagtgctgccttgcacctggagcacaggaagtactcaacaaatcaaagttatcagtaccagggagaagcagagtatttcaattatctttgtccctaaactaaaaaccttgctccttaaaatagtatttgcactaagatctcctccaaaacgatttgtcacagaagtagagcataagagggcattctataaataagaggggactgtgtagcaggacactggggaacaataacacttacttatccagtttctgacattgaggaaactttgctcatttgtcagatcaaaaagtagaagaaaacccatagcatctctgaagaacgctgtcgttaagctacgaaacctaggaacataaaagcagaatggtcagttaaaccacggccccactcctgaaatataaaactacaagcaatgccttcagcctcttacaaaagtttaccaataacaagctacatggtgatatttcaaaagtatataggatagttatttatcacttatatcagtttaagtgttaacagaccatgtgatttgaaaaccgaggctgctggagagggatgacaagaaccagcttgtgatcttagtctcacccaagaatttatgtacaattatgagttaatttggccaaaagcaatatagtgtatgttttcctattgtgaaagcttgacttgacattacaatgtgttccatgatcttttaatttcagaatatgcagagatctcttatctctgatagccatttgtttggcttgaaggtaagaatctcttgactcagaccttattctgtcttggtactctgccttccaaggctttatccttctgtcttccctgtcttctctctctctctccccacccccaaccccaccctatcaccagtcagtttcctctcgtctttgcctatatgtaaaacctgtaactgacaggcaggctccagggaagaaaatattggtatgaatttgtcatctaatcagcaatattaggtttttctcaaatacttttaatcaatgtttttattaaaaagagttcttggccaggggccatggctcacacctgtaatcccagcactttgggaggtcaaggcaggcagatcacctgaagtcaggagttagagaccagcctgaccaacatggagaaaccccaactctactaaaaatacaaaattagctgtgtgtagtggtgcacatctgtaatcccagctaatcgggaggctgaggcaggagaatcacttgaaccagcaaggtagaggttgcggtgagctgagatcacgtcagcctgggcaacaagaatgaaactccgcccaaaaaaaaaacaaaaaagagctcttatcttttagagctacattaccacaagtattaaaaatgaaataatatagtgtctggaatttgcttctaaattatatggtaagggggtggggtgagaagaggtaaggggtataaatgaaattctgttggccacaatttcataattgttgaagctgagtaatgggtacataggtttatcatataatccttccacttttgaatatccttgaagttttccataataaaaagttaaaaaacaaaatccttcaaggtggctgtgaaagaaaacagaagttctagctaactgaaagcaactttatatcaagatttcatgtggcttattttggtcaagtaacccctggtcacatgaattaattccaaccagatatcccactagatttcaacagtcaggtaagaataatgcatgtaacttggccactttcttgtggttgagtaaatagcaaaaggaaatggagcaaagtatctaagcaaaaaaaaattaaaagaaggaaaagaaaaaagtccacaagtaagagtcataacctctcccttgaccttgtatgaaataaggccaccattctcatctcagacttgacaaatttcctgctaatttggcagcattcaagtgcaaaccaacgaattggctggctttttcctgctcaggtcactgtttgaagaatgtaactatttttccctttccttcagtaaggagcacataactgaagatctcatacctctcctgccctgctgtgtcccataactgcaggtggattctctggcctctgccagtggctccatccggcccactggctctgtacacctaaaacagcaaagtgaaagagaaaacaaaagagaacttctaacaccagcgaaccttctcacctttttgttcagtacaaatcccaaaggcatctaaaattccaaagagaatgccatctggaatacaaccatgtttgtatttatgtcaaataattatatccaggtaatgtaataagttatattgaaatatatacatatatatcttataaatatattgtaaaatatgaatacaaaacaacttgtataaaatataataattagtttacctttcctcaaagttctcttgggtcactagtttcaggaaatattacttttctatggcttttcccaatctcatcttttttgtttgtttaaccagggggtacatgtgcaggcttgttacgtagatagattgcataatgctggggtttgagcatctattgaattcatcacccaaacagtgaatgtagtacccaataagtagtttttcagcccctctcccactcccttcccccttttggagtccctagtgtctactgtttctgtctttatgtccatgcgtacccattgtttagttcccacttataagtgagaatgcatgtggcatttgattttctgtttctgcattaattcactgaggataatggtccccagctctatccatgttgctgcaaaagacataatttcacttttttatggctgcatagtattctatgatgtatatgtaccacattttctctatccaatccaccactgataagcacctagggttagttccatgactttgctattgtgaatagtgctgcaataaacatttgagtgcagatgtatttttggtagaacaattttcccttgtcccatcccaaattttaaaagtgctcttaaaagaattttatagacaacactcctagaacagcagagaacggaccatcaaaaatttcttcctccacaatagcaacaaaaacagtggtaaaaattgtccaaatcaactttttcagtactctaggaattaacaaagacttgcaacattccaaggagcatttattcaagaaaaacagccgaatatcagtaaaaacagtaagctttgaggtgttttttaccttgccctattcccatccccctcactcaagcttttagaagacttaaaaaccatgtgcacaaatgtggttgttgtgaaaacatcagcctagccaccactgtggacagcagaggaacaacaggtttggagctccctaaaagtcccatactgagaaaaattgtcaggaagccccttggaaagctccatgccccagctttgtctttctttgacctcactcaaagcttgctctttgagaacagccctatcccaagggcatttgttgaaaactatcagcagtaattatttaacatcacagctaccagaggtagcaataccagttagggctaacaaaagtctaacaacaacaacaaaaaaaaaatttaaagaaaaaaataggaaatgagatttctataatgctcccaaatattccttggaacctaaaaggccatgttcatgggcagggctctacaaatgcccaggaaagatctaaaaaggtcctaatctctcacttctgactgactttgaggttcttctcaggcagaaaataaaagctaaggcagagttgtaaactgcctgcagtagtattaaacacataccccaacaaacacacagagactctcagaaaaagctaagagacttattagttcaaggaatttaataaactctctccactcattagctgtccactaagttgactgagcagagacttcagtagctgcatacaaagaatacagattttgcagaattatcccagaaacataattaaacaaacagcaacgacaaaaataaataaatatgcagtaaaaacaagaaacccaggtaggggaaagaatctgagtttctagaatagacacattattttaaatgtccagttttcagcaaaacgtataagacacacaaagaaacaggaaagtatggctcatgcgcaggaaaaaaacaacgaatagaaattattcctgaggaggcccagatgttaaacttattagacaaagactttacatcaggaattataaatatattcaaagaacttaaaaatcagtaacatagcggtcctctaaaattaaaggataaattaagacaaaactgagaaaagtcatctctagcagacctatcctacaagaaatactacagacaactctcaagactaagctgaaaggaaactagacagtaacttaaatccacacaaagaaataataagcaccagtaaaaatgtaactgcatagtaaatataaaaaacagtataaacgtggtttttctttgtagcccttttcctccactagattaaaatttaactgcaggctgggagtgatagctcatgcctgtaatccctcagcactttgggaggctaagatgggtggatcacttgaggccaggagttcgagaccagcctggccaacatggcaaaaccccattactactaaaaatataaacaattagccgggtgtggtggcgggtgcctgtaatcctagctacttgggagactgaggcaggagaatcacttgaacctgggagacagaggttgcggtgagctgagatctcaccactgcactccagtctgagcaacagagagagaccctgtctcaaaaagaaaaaagaaaaaaaaattaactgcatacagcaataattgtaaagctgtattgatgatggcacacaatgtagaaagatgtcattcgtatagcaataatggcacaaaaatatgggagaaaacagagccacataagagcaaagttttacacagtattaaaattaagttgctattaatcaaaattagattgtgaaaaattaagataattgtaatccccaagggaatttttaaaaaagaactcaaaaacatataacaaaaaagggaattaaaatgatgcactagaaaatagaaaaagaaacaacagtatctatcaacagacaaatggataaacaaaatggtgtatcaatacaatagaatattatgtagctataataagtaatgaagtcctgatacatgctacaacatggaagatccttgaaaacatcaggctgaatgtaagaagccagacacaaaaggccatatattattccatttatatggtgtgtgcagaagccattgatagaaaattcatggtggctaaggggaggtagaaagaggaatgcctgctaataggtatgaggtttctttttaaagtgatgaaactattctaaaattgaatggctgtgatggccacacaactccgaatatattaaaaaccaccgaattttatactttagatggatggatttcctttttttgtgaattatatctcaacaaatctattttttaagttatacaataagtaaccaacaaaaataatcacatacatatatgtagattctatcaactacacgtcaatactaaaaatttcattagggccctactgttattcagtgggtcttaatctctataagcctctctggtagtagaataaaatactagaatgggcaaaagggaatgttcttctgtcttaaaagccagggacctttccccctgacagaatatgatccattaaaggacctttgtcattaatttcctgacaactggtttacctgcttcaggccaacaatggatttttcaacaagaaatgtagtctaaggagaaagccatctttcctcatctgcaactgtgacaccatgaccttctgccttcccctccaacactagaataactttcagtctcaaagtccttaaaaaataaataaataaaagtttctcccttcaacattctgcagaacatcacattcactactggcattccccactcctactccaacctcaccctcctggcagcagtgataagttctgccagttagtgttccatgtggaactgctgagactttattaggagaaatgccattaaaaataataagataccaaaggtggaagacacagcccataaaacaagagtatgaggggcaaggtggttggcaggcttcaagacaaaggtagacaaataactttcggagttcagagggaagatacaagccaaaagagtaccaaggtgacattttaaagaactgtccacttccactttgtctgcctggttttatatgaagtgctgtcagcacagccttttcaatcatgttgcctggattgaacataactcactttcatatgtacctttaatttcagatcccaacctttgtcctcctaattcctacaaagtaaactaaacagaccagcaaatgttgacttaacgattacatttttacatagaaggatatagaacttaccactcttttttccctgaaatcaatgcccactgttgtgataaatttggagttaaatttaccatctgtatattggtaaagtacactggtcttccctacaccagagtctcccaaagctaaaaacttgatgaggtaatcataatctccatcagacataatgaagaactcagtagttcacctgtaaaatacacacaaaattttttaattaaaatccattagaaaacattaattatccatttaaaaagtgacaacaatattcagtttaacacctaatgttaacctgtatgtctacgggttgtatgaaaagagagttacatacatattgttcaccatccttgaagacctaataactagctagatgagaagctattgaaatagtaattaacagtgtagttttaatttaacacacaggtaatcccagcactttgggaggccaaggtgggcagatcacctaaggttgggaattcgagaccagcctgaccaacatggagaaaccccatctctactgaaaatacaaaaattagccaggcatggtggtgcatgcctataatcccagctactcaggaggctgaggcaggagaatcacttgaacctgggaggtggaggttgcagtgagccaagattgcgccattgcactccagcctgggcaacaagagcaaaactctgtctcaaaataaaaaaataaataaaaataaaaataaaaataaaaacatacatattatagtaccattaggacaaaaatttcaagtgggaatgataatcaacaagaaggtaacagtcactaagtcttatctgtagaccatatagaacaaaaactaatacaagaaaaacagaggaaagagaatgttataaggaataacagtaatcattagagtgcaagtggttccaatttcccctcctttttcaaagtctcctagtgctaaaatttgcaattgcaaacataaggaaccagtccaaatgctcaccagtcaatgagtagataaagaaattgtggtacaccacaatttttttatctgtatatatatacacacaccacggaatactactcagccacaaaaaggaacgaaataatggcattcacagcaatctggatggaattgaagacaattattctaagtgaagtaagtcaggaatggaaaaccaaacatcatatgttctcactcatatgtaggagtgaagctatgaggaagcaaaggcataagaatgatacaatggactttggggactcgggtggaaagggtgggaggcgggtgagggataaaagactacagattgaatacagtgtacactgcttgggtgatgggtgcaccaaaatctcagaaatcaccactaaagaacttatccatgtaactaaacaccacctgttccccaaaaacctatggaaataaaaaaaaaagaaagaaagaaagtctcctagtgctagaaccttgccttttctctctttttacatggacatctaggcaatttcatttattctattcattttcacatgttattacggttccttcaaagacactgttatttcacaagtaaatttagtccctgcttccttacatattactattaatatgtactacatattaagccagacttctctagagtatcactgctcacttgggaactgagttccagatttgaacagtcactgctcagagaccacagtgccacaaccaagggctcgcttacctatgtttacctgggtactctatcaagaactgctaaaaattcagctcttcagtaccgactaaaacaaaagtccaccttaaagaagaaaaattcatttatatcagcaatacctaaccacggctatttttggttctttgcaatcagcacttttcatgatttgtatttaccttctaaatagattcaaacccaaaatatcagtccaactagaaatgggatctctctccaggggaggtttactttttcattaaaattttattgatacataatatttgtatatttttatggggtacatgtaatattttgttacatgcatagaatgtaatgatcacatgaaggtatttagggtatttatttcctcgagtatttatcatttctatgcattgagaacatttcaagtcctctcttctagctattttaaaatacacaatacatttttgttaactatagtcaccctagtctactgttgaacattagaacttattctttccatctaaccatatgcttgtacacattaaccaacctctctccgtttcccccgccaatgccaataaactctcctgaaaatcataaaaacaactagctatctcattaacactgacgactctacatgactattcaaacatacatatttatccatctatacacatgccagatgtcctacattggatgctactgactcccggcgttatcccctttttacccagcaccatatccagaaacttggctgccatattcagtgcttcctgtaggactatttctatatatccataaaattaataaaaactcagacaagaatatttactggttttcagtgttacctccctcaccccatcctcaacttggggactcaccttatgctgaaaactcctgaatgctgagccccaaaagccactgcagtgtgtttcctcagagtgcttcagtgcagatctgcaacctcacgtttcaggtatggctagcccgtggataagggcagagcctctacaaacattcaaaattctatttgcacactataaagagtgacacttcacagatgatgccttacctgtctttatagcttggatatttgcaagtataggtcaccagtattaatgacatataacagaattcctctccaaaaaacgacaacttggacatcaacattatagcacgtcatatcacagcatcacacctggctctaagttattggaaataagagctaagaattgaaaagcaagtccagataatgttgactcatttgagggcttcccctcaaactgaatggagcagcagataacaataccgatcctgcagtgagaatgatgcaagaagacactgtgactaccttatttcctatttatttttaatttgaaaaaaaagttggtataactatgttttttacatcacttagggtacaggaaaaaatgctgtcaccaatggcatcatattctagaattctctaaactcacttaagtggaattcaaagacttaaatgaaactatctctaatgtgtttcatttccatgggtaatcacacatgtaagtctacaaatgatcttcgtgagttttgttttctattcacaatagcaatactgaccaagtaatcataaagggactgttaacaaaccaaataccataaattgaaggtatagacaccaccatcaatattaatcatagtttgcacttttcagattgtatctttaagacaattatctgctttcttgatctgaaaataaatgttcagaccttccactctctgggttcagttttctaaagggtaaaacagaacccagagaggtagactgatttgcacgatctagaatctagatctcctagctccaagtccaatgcctattctaccccaagcttcatatccattattcatttttgttataaatgcacattgggctttaaagtgaccagtagtatggtatcttacaaggtaacctaataggaaactcaccaagtcaagcagagctgggtttgaatcccaaatctcccagataccaattacttggatgtctttgagccttagatttccaggtttctgttctataaaaaagaatatacactacctcacaccattattctgaggattcaatgagatactgtttatggagtgcccagcacaatggttggcatatactgggtacttaactgttggctcactttattctccccattgtggacgttcagactgggtctgaagatctagaacaaatttcagattgactctggccagcttaaaacatgtctttctagcacaaacgattgctaactggctcaaagtggtcggctgagtcaacaaagatcactttcaaataattctgatcctttttggctggttctaaccatttgcaattcatttaatacagatatgtttacttcaaaagagttctgatcaacttaaaaagaggttcaaatccatataaaatacaccatccattttagcaagttcatagttgttcaaaagaatctggttcatattattttacggtgagttaaaagaggttctcctacaaaactttctgactttggctaaaacctgatatatctaaccaaaattattggagtctcattgtaattagctttaattgcttcagactggttttagctagttccaataggctctgacttggacatgcaggttctgacaggcttctaaaagttttagttggttctgagtatattttactaaatcaaactgtgctgacaaattaaatccactttcaattgagtcacactggttctacctctatcgaactgctggaaactagtttgataactatagttatctgtaaaattgtttttactggtttagaccaatatagactggttcaaaacagtctgaaatgtttcaaattaatttcagatgttcaaacagttcaaaactagaaatgtaaaatgacaatcagaagcaacaaaaacaacagtttggtgtttaaaacttgtgccaaaccaacaaacttaaaattttatttttaaattacctcatttgtagatattctgtatccaaaaatttatctccaccattatatactgtataatcacactcgaacagcatgtatgtgttcgagtacagtaaaggattgggagaaaggagcactggcataggagaagatgacagataacagggaaatatgtgatgagtgacacaggcttcctgggttgagaattcacctcccattttacctgaaagacctggcagcaaaatattcacccatgacccaacaatgaagattctgattggggaaaacctttagcaaatttggaggctgtctagagtttgttcaaaactgatcacgctgaccaggctggtctgggttaaaagagaccagaattccaaagaataagaaaatttcagagaaataaagggagttgggggcaggcaggttttcaaaataacagatctttcaaggtttgggcatggtgttgagggcgacagccttcttatctgagcttgcagtccagttagtgaaagcctggagttagtggaattaccccatctttcagcagaaaatcattctagtctataccagactatactcccacctccatcctgcaagtccatacgtggctttctcatcactacttatcactactaggtgaagacaatttaatgttaagtctcaattgatggtatattttcatataaacaatttttgttctcttatttattattcaagtcctgagtagtattcctagggcctgttttccagaaagaaaatactccactcctcaaatacagaaatctaataacgtaaatgatttttgtgttggcatttcatttcaggaaggagtaaacagtgagaacacacagtaccagaatttgacatttggggcacccaaacaacgttgtatgctcaccatttcctgcttgtactccagcctactgaggtttgggaagccagttcacaagggcttccctctgacactctcttgctgaaaatgggtctgaaacctaggtcagatgcccacatgtcaagcactttacacacattagcacaacaatcctcatcactgccctatacatagcatatacactgtctccctcagaaagatctagagctgttctatcgtaagtgcttcagtgagggcataagtaactgagtcttggccagtctacccacatattagcatgggcacaattccaatctattgttgagagacaggaaaaaaaaatggaggttaaaggcagaaactctacaaccaagccacctgtatttgagtccagtcatgtaactttggaaaatttatttagtctcttttgccttgggctcctcacctgtaaaacaggaagagattctattttatcaattctaacatgctttcttattttaacttctttaaaattggggtgcatcttacatttcagtcttacaatccaagacatcttgcaattgctattattgcaattgcaatagagatacaactgtgtgaaagctttttgttagcatcttctagcaaggtcaagaatgcatcatcaatatattttagactcaatgaagcacaataataaagctatttctgagggctgttgtgaggactgagctagtgtatacacacaaagtttggaacagtgcacaggacatagtaagttctatgtaagtattagctgttattagcagcagcatccagcaatctggcttccaagggtcaatatgcaggcaatgttcttttctttcctagaagtataagaaagtacattgagcccctaaaccaaaaattaatttttaaaaataaggatctgctaagagtatttgaagccaaggttatatatttaaactctgtactgccttgagaaaagtgctgtctacctcaaggaaatatcttctaaaaagtcaagaatgaccttaatttgggatatgcaaaagactttcttattcagctcacttctctctctcctccttatacaaatattttttcaaagtgctctccaccctcactatcatcagattaacaatagaaagcaaggaacacccatttcctcaacatgtactatgtggtgttaattgcctggtgagagaaagtctatcatcttccttatttttaaaataaaacatattttcacctgtaataccagtgactgaggaggctgaggcagaaggatggcttgacgtcaggagttcaagactagcccaggcaactagcaagacctatttatatatatatatatatatatatatgtgtgtatatatatttgtttttttttttataaattaggcaggtgtggtggcattagcctgtagtcctagctacttgggaggctgaggcaggaggattgcttaagcccaggagttcaaggctgcagtaagatatgctcacatcactacattgtagcctgggcaacagattaacatcccatctttaaataaatttatttaataaataaaaataactgcacatgtacccctgaacttaagttgaaggaaaaaacacttaaagatttttaaatgtttttaaaaatactttttaagtgttttttaggaaataagatagaagagagtagatttagttaagaggaaagggaaagatctagttctatttctccctctctctctctctgctacacacacacagacatatcacagcccagattttccatgaagtgtcatattaaagtgaatcatagactccaaccttaggatcccccactattaggcagaatcattctaaaactactctagataggtcagccattttccgaaagccaaattttccctctattactcatatttagtacagagcaaaagaaaggggaggaataatattaactgaacagcaacatgtaataaatatacttgattttattttatctgctcatcatccttaaaaagaacttcatgtctggacaagactcataccatatagagactgatgttttctcagtgtgatggcaaataggcttgagttcaaattctgacttttctactttgtatgatctgatccaagttttttatactaagccttattctttaaactgtaaaatggagataataacagtactaatctcattgggttgttttaaggactaagtgagataacccacagaaagcttttagcacattgtttgccctgtgctaagtgttcaataattgagacttattaaaaatactattattaatagtttcaccacgttcttcattagcaaggcatgtaattttataacctattcttaatgtaaccagtacctgaaccttcagaaaaatcacagaaagaaatttaagttaagtacaatgattttggggcgccctatccatcacaaaatctaccttggcattccaatctaagaatgagttgtatctgggtgatttttggtaatttcagacctaggagtacccatcagttgaatgctctaatttccagaagaggaaactgaaactcagagaaggtaaatgaatagtctgaaataaaccagctagttagacatggggctaatctagatctcatgtctcctaaattctagtcatgtatgcatatttttcttctgtctgtattccttccttcagagtgagaaacctcagttacagctgcttgaattcaagaatcaaaagttttcttcagtgccagcagttatagcagtgataaaatgctttataattaaggcttgtgctctcagagaggttgggttgagggatctgtacttctgtgctcagagtccctctatcaagaagcccttcatcctgatgggctctgccaaggacagaagtcataaattgggagcttgtctgcttcttgctggtcattgcaaatccaagaaaaaaaaataactcttcttaatacttgtaccatatcccataaatcatctttctttcctatggtttcaaaatgaaaagcaagcagagcaatcatgaaatttttcatttacctgtagaattgctcggccccgttttctctcaaataagtattttcctctcgaataagattattttaggccaggtgcagtggctcacacctgtaatcccagcactttgggaggccgaggagggtggatcacctgaagtaaggagttcaagaccagcctggccaacatggtgaaacgctgtctctactaaaaatacaaaaaattggctgggcatggtggcaggcacctgtaatcccagcttcttgggaggctgaggcaagagaataacatcgagatcacaccactgcactacagcctgggcgacacagcgagactctatctcaaaaaaaaaaaaacattattttctctgacatcatgtctctgtaaggacacttctggccctctctctttttccttcattcaataaatattgattgaatacttattatatgctaggtgccagggtacaatggggatccaactcagttatattcaatgtggaaaatctcttactcttgcctaccttagaccttatagttttagccatgtcccagtctaacttctcccaacaactatacctgcctttgggttttcaaataagtccatctttctgaacattttaagcttctctcataaacataacacaatatgacatcaaaattcatatcctaagtcacatgtttgacaaagatgcaaaaggaataaacatggaaaaggaataaaagtgtgaagcttgggcgggcacagtggctcacacctgtaatcccagcactttgggaggctgaggcagatggatcacttgaggtcacgagttcgagaccagcctggctgatatggtgaaaccccatctctgctaaaaatacaaaaatacaaaaatacaaatggctaggcgtggtgatgggtgcctgtaatcccagctactcagcggggttgaggcaggagaatcacttgaacctgggaggtggaggttgcagtgagcagagatagcaccactgcattccggcctgggagacagagggagactccatctcaaaaaaacaaacaaacaaacaaaacaaaacaaaaaaacacataaagctcagtagagaagaaagagacagcctcaacctcctgggctcatgtgatcctccagtctcagcctcccaagcagctgggatcacagcagtgcacaacaccatacaccatgcccagctttttgttgttgttgttgttggggggagatgacgtctccctatgttgcccaggctggtctcaaactcccgagctcaagaggagaaatttttataaagagaaacataaggtatattataaagaattttttatctgaaaatattttgaattttttagaatggttcaatatttgagtgttcctatgtagcttatggacttcacttattgcagtgcaaaattatttttgcagagaaacaggagcagatgaatataactattacttttcaaatagcacagaacatcagcatttatgtgaattataacaccacatgttctttcatataatttaacatccccttgttcagtgattgatttggagaaaatgttcatatacaaatgactggcatagaaatataaaccttatcagtacttttatgtttaacgttaaaaagcagtaggcttttcttgctttttttgttttattttgtttttgttttaataatgccattgtggacccatacccggcattctggaaggaaacacataacagagacaccaaaagcaaggaagagaagtcacatggcatgaggcaggctagaagaggcattttataatgtaccaagatatatgagtagggacacttgtatttaccaaatgagccctggccacaactctcacagaccattacaattcctacaccctgaggtggaacacagctacttccacttcaaaagcaagatgcatactgcccaatagcaggaaccccatttccataagtggagacagcctatgtcttccgtgcagtttactcatctcaacttctggtctagatgtgcgtagatatggttgcgccctccctaatatgtcaagagtggaaaaaatgatgttataaacaaagagctcatcttgtttgtgcaaaatctcaggcggagagaagtggaaatctaacacctttgaaaagtagaaggaaacaggaatatgattctttcttgtttcttattaaaagatgagtttgattttatctaaattcagaatattagataactgcattttatattcacctataacctaagattcataagtgcattcctatcagtacagtattttataataataacataagtccatccttaacagtgatgttgaggcagcagagaagttcatggctagaaactgttgagatcttaagttctatagcatttggcttaatatttataaatgcacttgctacataggaatattccatttccctcaccaactgctagaaaactgctagaccaacttctagcagatggtgatattccactatagcaagttcttcagacaaaaaataaaattatctgtaaatactgttgaattaaatatacatttctgggccgggcatggtggctcatgccagtaactccagcactttgggaggccaaggcaggcagatcacttgaggtcaggagttcaaaaccaacatggcaaaacccttactttactaacaatacaaaacaattagcctgtagtcccagctactcaggagggtgaggcaggagaattacttgaatccggtaggttcacgggcgataatgccactgcactccagcctgggcgacagagtgagacttcgtctaagatatatatatgatatagatatatatataatacatataaatatatatacacatttataaatgcttccaaaacaccaaaacatacatcatttttaacagcatcttccagatgttcataatttttcttaaagagaaagaccaggatgaagaaaaaaataagcagtcatagcccagaaatccatcaactatttctgaaatgttaccatcacctcagtgggtgaccaacataacccagtaggcaaataacacaaacaactgtatgttaggaaacaagaggcgttgaaatgattcctgaaagcagaaaacgttctggaagaccaatgtcaataactcaaatgagatatcggcttttttttttaatttattgaaaccattgacttcatttacccaaaagacattatttgttgcccaaggctcttccaggatcagaatatgaatgtttatagagatttatggaaagtaaattcaccaaaacactgggtcttatagtacttatagtttgtgacaagtaccccttgctccatagatatagggtaatagaaaaaaaaaaagcacacatagaatatatgtcattggtaaaacataggcagtacagtggaaacaggtgtggctgtttgatttgcttagtaatatctcaaataatgtgacggcagtctcagaatggacacagccactcgacactccaaaagtctgctcaacccatagctaaacatgcctcttaccaccaccaagaagcaagcagtctccaagaatttggaatgagtgcaaaatctacaaagtatgctcccactgagtggttgctttttgtgagcacatagaagacagtgaaacacagacttcggagtcaagttctcctaaattcaaataatagtataccacctcctacctgtacaaactgaacagcaaaatgcctgatgaagatcaatgaatcatagctattcttatgattatgacagattaaggcttaaaccaggcttgagcactgatcctggggctttttccagtctaccttcaggatgacactgagacttcataaagctatcaaagaatggagtggaaatatttcctgaaaatgaaaaaggaggaacaacttaagctacctggaaggtagaacatctgcaagtccaactggtaagtacagggaattctggtattaacaagctctgaagaggtaaaatgaaaagctttggttatctcagagtgccaccaaacttgtgggcccaaggctcaaaggcagaaaaaaatagaaatgatagcactgctaccccagccaggactgagagaattacaaatcagatagcactcaaaagaaaaaaaaaaaatcagatagcactcaaaggacttcacattgcaaagagaatttccaagttgcaaaacacagacctaaaaacagtgtcaaggaatctgtcaagactcatcttcctagaacatgaaacatgcatggaaagcttttgaccaacacagactgactctcctattgcatctcaacttcctcaagttttctgtttgctgcaacacaggaaagatgttaatctgttagggaaatgcaccaactcaaaaagcaaaccctttgctttctgaaggagcaatgatacttctttccttccaagaaacatgatgaattagaagcagccagacgtgttaaacatgactgtccaaataataaaaacaattagacaaacatccatgagttggcagtaactggggaagagacgggcgcatttatcattgactttgtacaaaatgagaatatgagtaccatcaatttgacacatagatacttacaaagactactaagaggcaccaggtatggcttcatgcctcccttgtcctgcctacccaacaccctcttcctcactaaccacttttttttttttttttttgagactctcactctgtggcccaggcgtgagtgcagtggcgcaatctctgctcactgcaagctctgcctcaggggttcacgccattctcctgcctcagcctcccaagcagctgggactccaggcgcccatcacctcacccagactacaggcactaatcacatttaagcagatacattctctgcccacaggaatatgttcttcaggtacatggtggcatgctaaagcacacaggacttccatctcttcacagctgattttcatttccatagtcaaacatccaccctaccacaccccatgctgtgttccaacagcctcacttccaaccatcatctgggtgccataacctctctacagtcttcttcctctcctggctttcctgtccctcatctccaggtactattgccaaactccggtttgcatgtgcaaaaagtgacatgaaactaacaatattagtgcttttcttgtaacacactgagttgctatatcaacttcaaggtgttcaaccctcctcaataaattcataatgctgctgtgtcttcaggtactcccacttttccaatcaggaagagtttttcccctgcaaagtatgggaaaagagccattctggaaaaccaagtgtttctaatactatgccagttttggtttcaccataatgttaatgaaaaggtagcattctgatacaaatagatcacgtgtttaaaatattagtatctataaatatgtttattatatgccaacttagttcttttaaaaacattaaactaggctcagaaaaatcaaggcttttcctgatgttttaataccactaaatcaatgatgccaggattcttagcttcttccatttgttgtcaataagctgtagacagccagctatatataggtctttttggtatttgtcaagtctactgtctccattaatatatatttacaacacatgtttaaatgtttccctaaatatcatattctttaactgaaccaaaaaaaaaggaaactcacctaatggacaaggtcaaatcagatatatttcttattgcttctcaaagtctttccttatttcacctattattcagtatgcagagtctcagaactgactgtttgcatttctatcagcagctgtttatagaatggggtgtgacttgcgtttgcttatgcaaaatgactgaggaacaacaatgcacagccatccagccagtttctaactcagcctgtcagattacagttggcttttttgctattattgttgtccatctctaattttattgcattgtgatcactaaatgtggtctgcttaacaacaaatttggtggaatttaagaggaattaagtgtatttatttagaggcagggtctcactctgtcacccaggctggagtgcactggcgcaattatgtctcaccgcagccttgacctccccagcttaagcaatcctctcacctcagcctcctaagtagctgggatcacaggtatgcaccaccaaaaatggataattctttttaattctttttggaagacaaggtgtcactatgttgctgcccaggctggtcctgaactcctgggctcaagtgatcctcctatctcagcctcccaaagtggtgaaattacaggcatgagccaccatgcccgggctgaattaagttttataaatgttccacgattatgtgaaaacaatctgtacaccctgttagttggatgcaaaattacatacattctagtcaagctagttagttgtggtttttgatctgatatatccttatttatctttttgctacttcatctgtttctaagaaaggtgtgttgaaactcctagatcatattcatttttagaaaataagcccaaggtcatgtcttaaagaggatgaatataaagcataataaaagaacaagcattgcagtccttattcagagaagcattaaatttgtgcttttcagtctgttttctatgaaacgctgggattcatgaaaatactttaagagttctgtaaacttattaagatttttttttctatgtttgttttttgtttttttgagacagaatctcactctgtcacccaggccggagtgcagtggcctgatctcgggctcactgaaaccaccacctcccgggtttaagcaattctcatgcctcagcctccctagtggctgcgactaaaggcctgcgcaaccacgcccagctaatttttgtattttttagtagagatggcgtttcactatgttggccaggctggtctcaaactcctgatctcaagtgatctgcctacctcagccttccaaggtgctgggattacagacttgagccactgcgcctggactccttctattatgttttttaaaaactggaataaaaaaaagtatatagtcaaataagttacataccaaatttagagacctccaagttatttacttatgctactttgttaagctatttatggctacctttaacgtatacatgttatttggaattcctataattattagttgagaagactgtactttgcactagacttctctcctttgcttaatcagaatggattaatttgtctattgtgaaattatttaaggaagtacatgtgaactacattcagtaaacggcagtcaaagctcaggcacatgtttcagcagatgtttgctttcatcctgttacaacagtcaattgagcaataaagaatgaacacaacatgttgcatcacaacattttattacagatcactatagagattattctttgggaagtttgttgtctgacttctagaagcatgaaagggctattctgggtttgggctacttctttttcatagcagatgagtgtcttcacagtcagttcctgcataggaaacctacataatgtcattgcaacaaacctttcattgcctcagaaaactgctctggcccagctggttgcaaactttctttagcaataaaactgtttcttcaaataaaatcttacatggcaccccaacatataaaacagatggcagcagagtgatattctaatgaaaggagtgaaggtcaagacaccaacgcccatagacccaacaaggacataagaagaatctcactgtacacatttagaaaatcattgcagaaaggtctacctacaatgcagctctgaatcgtctcatttgcctttggctttgtccctaaacacttcctctctgcctaaccacttcagttgacagctcatttgtaagatctgccacactcttttattcagcgtctcctaaagatgccacctctcagatatcaccttaacacacttcttatctgggagggatttgaaatgctttgggtgtccctggtgagaactgcaagaggagctatttaaagcttaagagaatgaaagaagaccataggaagagtcttgagaacaaccatcattgcgtcattcctggggaaagggtcctggaaatgagtcctggaaaaatcgaggccaaactgcccaaaaggcaaccaaagaagcagcatcgaccatgggataggaaactggtgtccttaaaggggcaagagagaaaactgcagggaggatgtctgtaaccagctacattggtgatcctttcttgtatctaaatggacactttgaggccatcagaaaatatgaccagattagtcctgatgggctcaaaaatctatatatggatgaaccctcaaaagtcaagatgtggtttgaagaacacaatgaaatgttggtatagcaactttaagataactgagaatatattattttgtgctgtatcagaagccactttatactaaattatagcacagaagggaataaagaggtacaaaaattttttaaaatactgatcaaagtaaaagttcagattttctctactaacttcattttctttctatgaattcagaagaaatttctagtattaggctcagctaatgtctgtgtcatgaggagtgttttacatgaaagtacccttgcttgaaaccattacaaagttccagggaaggagaaagcggcatgaggtagaggggacagagaaacccctagcactccctacctggcttcatgtcaaggcagcacaaaatcaactccaacccacagggattaagtacaaagggagttttcagacaggtgttcaaagtcataccaaggtcaaacaccaagagactaaggagcaggtcaacaaaggggaagagtagtttatggatctgggagtcttggaggtcagcattccaagaattcaagaggacatctgggcagacaacacagttcattagagcccacagcaacagtagctagaaaagaccgggggagggtggtgagggatataaaaactacatattgggtacaatgtacactattcaggtgatgggtgcactaaaatctcggaatttaccactatattattcatccaagtggctggatacagtggctcacacttgtaatcccagcactttggcaggccaaggcaggtggatcacttgaggccaggagttcaacagcctggccaacatggggaaaccccatctctactaaaaaatacaaaaattagctaggcgtggggacacgtgcctgtaatcctagctactctgaaggctgaggcacgagaatggcttgaacctgggaggcggaagctgcagtgagccaagatcgcactactgtactccagcctgggcgacagagtgagattccatctcaaaaaaacgtacagaataaaataataattcatccatgcagccaaaaaccccaaaagctattgattgatagacagacagacagacagatagatacagatatacgtatctatctatctatatacaaaaaaaaagacccatagtagttgttgctttatcaaaagccagagaaatgttctaaccttctaagttacagcaatttattcaatcaacttgctttcctctactctgccaaccagtttgaaaggctccctggccgggcgcggtggctcacacctgtaatcccagcactttgggaggccaaggcgggtggatcacgaggtcaagagatcgagaccagctggccaacatggtgaaaccccagccctactaaaattacaaaaattagttgggcatggtggcatgtgcctgtaatcccagctactcaggaggctgaggcagtagaatcacttgaacccaggaggcggaggttgcagtgagccaagatcgtgccactgcactccagcctgggtgacagagcaagactctgtctctgaaaaaaaaaaaaagaaagaaaggctccctaatggccaggcgtggtggctcatgcctataatcccagcactttggaaagccaaggctgacagatcacctgaggtcaggtattcgagaccagcctggccaacatggtgaaacccatctctactaaaaatacaaaaattagccgggcacggtggcgggtgcctataattccagctaccccagaggctaaggcaggagaatcgcttgaaccagggaggcagaggttgcagtgagccaagatcgtgccaccgcactccagcctgggtgacagagcgagactccgtctcaaaggaaaaaaaaaaagaaaggctccctaagtattccaactaggttccttcactaagtttcgttttcctacctaggcagatggaaagccaagcatccaggttagaacttagtcccccaaggccataccttgtctctgtcctcagctaagcccaggataaggccatctatggaaacaaagctcctattttcttaacatgcctctgagaaagatatttgaagcctagaggttaagaacataagggctaaaataagcaggcaagagggtgactcagaaagaacaagagccttgtttaaaaaaaaaaaagagtcggggaataaacctcaatacagatttactaacacagaaataaagactttgtgttagcaaagagactatgaatcagcaagagaacaacgcaagaggataaaggaaattgtagacaagagcagcataaaccatgaagatgtaagtatccacgtgtttataacatggataattgataagtaataagtaagtcttcagaaactatgtttgagtgttcaggggaaatcacaaaaacaagtaacagtacacttaattttttaaatgaggttgaaatgagattctgcatgagagataactgtaaagtagtaaaaaaggtttcagaagtcacacatgaaaatcaatctcataattctacaatcacattttagtatgtccacattttaaagtataaagttagactttatataccaacaaatttggctgcaaggtttgtaagttgagttttgacctcgagaaataccttcctattttttaaagaaagaaatattataatgacattccttttaagttattactttcctatacatacttgcttatcacataaaaaatataattgctatatagccatcaagcattaaaaataaaccaacacatctaacaataggcctcaatggtactaatctattttcctagatatatcactttaaaaccacatatgaatgtctaagaaataaaagttttttatttttcttttagaatctacagcatacaacatgataaaattattttgtataaaaattataatttttaattaatttgaaataatttccattaatttctgatgcttgtaagcattttagatatacattcctttagctcttataatatacttataaactgtgaaaaattctgagacaggaaggaacagatattaaaattctattacttctaatctaaaagccctccatcttatgttctctgtaggagacagaaactcacaaaagaaaatgtttggcttctactattaagaaattggacatttttcacatatattacagtggaaggggttttacatttctttcaggcacaaaatatttatgaactcgggagcagcccaaacataaagataaaatgcagcatgactttccaaaccaaaatctgcggcttatgtctatggatttttgtgacccttttgggaaaaggcagagttggaaacacaatttagttgtccaagtattagaacttttaaagcatctctttgatttatgaagaaaatgcacaaaaatacgttaaaggaggcagtaccagaaaatccagcaagttgctcatcactacacacctctatgcacagatgacatgagcaattatttgtctttccttcacttctgactgccagggctcagggctgaggtcctattgactgcacatagtataagaaagggaagagaaagttgtttcaacggcaacatcctcacctacttatgtctcttttctcctggttccagtaattaacagaatgatcacaaactgaaaccaaactgcaactctatcccttccactctcaccctggaagcctgttctcataaatccatcctcctcggggtattcctttaatcaatgtttattaatatgaatgaatgctttggctaacttgtacaggtcatctgccacttttaagtactccattcccacctcatgggtgtgtttcatctctttggtacagttgcatatttcctgaagagtctcattttgtgtattgcttctccactacccctcaccactggacagacaactggccagctgtcactcaaatgctaattgtgtctatcatctgctttctctaatagccttttccttccgctggttccctccattccctgccaattttatttagaagtgactcaaaaagtgtttggggactccactgatagctgtgcttttttgataattaaaccatatttacatccaattcaacagtatttggtaagcaattactacctttccagtacggtgctagcaactacgaatggcatgaaagaaacacaggatccaactgctcccttcaagaagttggtaattagggtgaggtggaatgatgtactcatttacgaaaaaggacggataagacaatattatcagggagaaaaacgtctggtacaccatgtgcaccagccagcacaagaaatcaaaagtgaaaggggcttcaagtcaaaagacctgaactctgctacttccttcctagctatgtgtcctgtggtgagccagacagcttccccacactgtttcctcaatatgggaatatttatctagcaagattattggaaggattaaagggtacattatgtgaaatgcattttataaactgtaaactactgggtacatgtaagatcgttgttttacaagtcaagtagaggctgggaggtcagaaaaggggagcaatctgtcgggcatggaggctcatacctgtaatcccacctattcaagagactgaggtaggaggatcacttgagcccaagagatcaaaaccaacctgggcaacataatgagatgctgttgtacaaaaatttttttaattagcaaggtgaggtggcctgtgccagtagtcccggctactcagaaggctgaggtgggaggatcacttgagcccaagagttcaaggctgcagtgagccatgactatgtcaccacactccagcctgggtgacagagtgagaccctgtctcaaaaaaagaaagaaagagggagcaatctgaccgtgactcaaagcaagagccaggacctgagctgagcaccttcttcaaagccaggcaagatttagctagatagtgaagaataggatacacagcatgtttcatgcaagggcatgttttgacttcaatttaacaagtattgaggaggcttgctaatcatttcaaaggatacaaatgtgcctcagatataatcctctaagtacaaaactggctgtaaactcaaaggaatgcttatgaggtaatgtgacaaattgaggagagcaggacgactaatccattggtatatggggttcctctgccaccatctgtttagacccaggataggtcaccatccctctgcaggccttgttttatcaaatatgaaataagaggtttgaccacaatggtctctttccaacacagacattctatgctgtatgattccaggttcaaagttcaaagcttagtcatgagaaatttaagtggggtcatggtgacagttgtcccttctatcacctctcactccttgaagatgagagcctagatgagggcagccgcatgggaatgggaagaaggggatccaagatacactaattttaaaataatagaacagagttccacatcaggtggaaaaggacacagcaaagagaacaccaaagaataaagcctagggggccaggaggccaaaataatgttgccaacagaagcaggacatttgaagtggggaagggaaagagttggaatgggcataaggtgtttgtgggtggtatcagatttttggaagggaaggatgatgagattggatcggggcaggttcagcatgagagatcatcaaagccacatgaccaagaaatgcttgaaaatcatccccagtccctgtggcccacatttacctctgcccttgagacagaggcagagtagccaacagtgaaagctccaaaaagagggccatgactgtacaagccacagaagagggaacatgctgttagttcaggatgaacaagaccaaggataacagcagggtgctctcagccaaactcaattacacaggacatgatgggcagtccctgctgctctgattaaactcagtttccagatactatctccctgttgtaaagttctttatctggcagtgagtaaaaaggaaatgtcagggaagacagctagatgtcctgcacagcattcactcctcttaggagcctgcaataggcacctcctcagattccaaacttaggccttgcccatcatcatccaccacccatctgaatgtatctcaatgaaaacacacactggctgggcatggtggctcacgcctgtaatcccagcactttggcaggccaaagctggcggatcacctgaggtcaagagatcgagaccagcctggccaacgtggtaaaaccctgtctctactaaaaatacaaaaattagccaggcgtgcaggtgggcacctataatcccggctactcaggaggctaaggcatgagaattgcttgaacctgggaggcaaaggttacagtgagctgagatcatgccactgcactccaggctgaggcacgagaattgcttgaacctgggaggcgcaggttgcagtgagctgagatcgcaccactgcactccagcctgggcgatacagcgagactcagtctcaaaaaaaaaaaaaaaaaaaaggaaacacacagtgaggaggagttgtagtatcactttcctccagctccttctctgcacctctcactctccttgaaaccactgacactaagaaataagaggttagaacccttctcttattacccttatctaattacttaatgtctctgtgttttcctagaagaagaattcactacctataccaggtctatcctgtttttggtctcacttaacactgctatatgtatgtgcctgtctcctaatgcacaccagcaagagtttctctagaaaattgctttccaaccttgttcatgatatttgtatgacctaccagggcatatgctcttgatcaaaggcaataggttttagggccccagaaaggccaggccctgtccagccaccctgagggacaaagggttcaacatctcaacacatctgaaccaattcagtgcacaccagggggagtcacctcctctagggtaggcgtcaaagcgtgaaattcctgggctatacctatgcacacatgttcagtaatacaagataatgtcaaattgctgtccaatatagttgttttacactcccaacttcatatcttcaccaacatttggtgcttgttgtcagacttctcaaaatggtaacacattgtgatctaaattcacatttctctgagtgctaatgagtgtgagcatcttttattagtttcttggccatctagtttcctcttattaaaatgcacatttgtatctttctcctatttttctattgggttctttttctttaagacagagtctcgctccgttgcccaggctggtgtgcaatggcacaatctcatctcactgcaacctctgcctcctgcattcaagtgattctcatccctcagcctcccaagtagctggggctacaagcacgcaccaccatacctggctaatttttgtagagatggggttttcccatgttagccaggctggtctcgaactcctagcggcaagtgatccgcccaccttggccgtccaaagtgctgagattatagacataagccaccatgcccagccaggttctttttctatggatgtgcagttcttcatatattctggatactatttataagttatgtatgttgcaaatatattcttactgtttttggtttgtcttttcacttttttagtggctcttaatcttaaaatagtcaaatttattcttttttatagttatttattttatatcatatcaagaaagtctcttttttttttaatggagacacggtctcactccagtgcaatggcacaatcatagctcactacagcctcaacttctcaggctcaagtgatcctcccacctcagcctcccaataactgggactacaagcatgagtcgccacgcccagctaattttcttttcttttttgtagagatggggtctcactatgttgcccaagctagtcttgaactcctagtctcaagtgatcctcccacctcagcctcccaaagtgctaggattacaggtgtgagccaccatgcccagccaagaaattcttatctaaagcaataaagatattcttttatattatgtttataaagatactgcctttttatttaagtctttaatacactgagaattcaaggtatatgtagggatccaatttcattatttttcccttaagtatatacaatcgtcatagcaccatttattgcataaaattatcttttgcccagtgatatgcaataaatgaatggatctgtttcagggctttacatttggtttcgctggtcattttgaccatccctgggccagtgccacaatgccttaatcactatgaccctaaaatataacttcatacctgttacgactggtacccaccttaccaaggacatgaacccttcacatttccatctgagttcctcaaaaaccatatggggattcttattggaattgcattgcattgcattgggatcacataaatctatagatcaaattaagaagattgacatgttcatgatgtttaatttacctacctaagtacatgcatatttctccatctatttacgtatttttagtgcctttaaaaatattctcaaatctcacaaaagaagatatacaaatggcaaatatgcatatgagaagatgctcaatatcatatgttattagagaattgcaaattaaaacaagaatgagatatcactatacacctatcagaatgaccaaaatccaaaacactgacaacatcaaatgctggtgaggatgtggaaacccagaactctccttcattgctggtaggaatgcaaaatggtacaagccctttgttatagacagtttggcagttgtttacaaagctaaacttactcttaccgtacaatccaatcacattctttggtatttacccaaatgaagggagaactcatgtccacacaaaaacctgcacactgatatttattatagcagctttattcataattgccagaactcagaagcaacaagatgttcgtcagtagatgaatggataaataaactgtggtacattcagacaatggaaaattattcagcactaaaaagaaatgagctatcaagccatgaaaaaacatggaagaaccttaaatgcatattactaactgaaagaagccaatctgtatgattccaactatgtggcattctaggaaaggctaaactgtggagatagtacaaagatcagtggttattaggggttggagtgggggaagtgaaagagatgaataggcagagaacagacgatttttagggcagtgaaactattttgtgtgacactataacatagatagatgtcattatacatttgtatacatacccatagaatgtacaacaccaagagtgaactccaatctaaactatggactttggatgataatgtgtcaatagaggttcatcatgtgtaacaaacgtaccactctggtatgggatgttgatagtgggggaggctatgcatgttggggggtttgggagggaagggaatatatggaaactgtactttctactcagtattactgtgaacctaaaactgctctaaaaactaaaactcggccaggcatggtggctcatggtggcctgtaatcccagcactttgggaggccgaggcgggtggatcacgaggtcaggagttcaaaaccagcctggccaagatggtgaaacccccatctctactaaaatataaaaattagccaggcgcggtggcaggcacctgtaatcccagctactcaggaggctgaggtgggagaattgctggaacccgggcagcagaggtttcagtgagccatgatcgtgccactgcactccagcctgggtgacagagttagactctgtctcaaaaaaaaataaaaataataaataaataaactctaagaaaagaatatttttggctgggtactgtggcttacacctgtaatcccagcactttgggaagccaaggcagccagattatgagatcaggagttcaagaccagcctggccaacacggtgaaaccccatctctcctaaaaataccaaaaaaaaaaaaaaaagttagctaggcttgggggcgtgtgcccgtagtcccagctacttgggaggctaaggtagaagaatagcttgaacccaggaggcggaggttgcagtgagccgagatcactcactgcatctcaaaaaaaaaaaaaaaaaaaaaaaaaagcatctttttgaaaagttttcgggccaggcacagtggctcatgcctgtaatcccagcactttggaaggccgaggtgggtggatcatgaggtcaggagttcaaaaccagcctggccaacatggtgcaatcccatctctactaaagatacaaaattagctgggcatggtggcatgcacctgtaatcccagctactcgggaggctgaggcagaagaattgcttgaactcaggagacagaggttgcagtgagccaaaatggcacaattgcactctggcctgggtgacagggcgagactccatcccaaaaaaaaaaaaaaaagttttcaataaactcttttcatgaagatattgtacatctttcaacttattgatactttgtttttgtcactactgtgataacttttaaacatgtatcttctatttcttacatagccatactaattccagcaatctgttaaacatattaggtaaaaataaattacttcttcctttctaatcttaccttttagtctaattataaaaagtcggccaggcgcggtggctcatgcatgtaatcctagcaatttgggaggccaaggtgggcgaatcacaatgtcaggagatccagaccatcctggctaacacagtgaaacctcgtctctactcaaaatacaaaaaaattagccgggcgtggtggtaggcacctgtagtctcaggtactcgggaggctgaggcaggagaatggcgtgaacccgggaggcagagcttgcagtgagccgagatcacgccactgcactccagcctgggcaacagagtgagactctgactcaaagaaaaaaaaaaaataggtaagaacaaaacaaaacaaaaaaacagtgaatagacatggtgatacaggtagtcttatctcttttttttctttttttttgtttttttttgagacaagatctcactctgttgtccaggctggagtgcaatggcacaatcacagctcactgcagcctcggcctcccaggctcaggtgactgtcccgccccagcctcccttgtccaggctggtctggaactcctgggctcaagccacccacctgcctcagccttctaaagtgctgggattataggtgtgagccaccacgcccagcccagtctcgtcatgtcttgattctaacatttcactgttaagaatgacatttgctgtagatttttggtacatatttttatcaggtcaaggaagttcatctatcctagtttgctaagtacgagtattatgaatgggtgtcaactttatcacattttgtttcagcatgtatcaaggagactgctacttttttcccttaatctgttaatttaccagcttttatatttattccgcctttgatatttttctttcctttcttctagcttcttctctcactttcctggtttctgctcttttctcatactttctacctagaatttctctttcaaagtaattctgtttcttccttttgcattcgccagggggtaggggagagcaaagggaggtagttctcagggtaattaataaatatttgaatggctaaaaagtgaaatacctaataggtgccaggtccttgaggtgaccttacccaaaaccagtcttcaaatgtgccatattacatttatataagtcgctcccgtcttgggcttaaaaaaaaaagttacttgagatgcagtcactagaggaagaattatagtagaatgctttaaacagaaatggtgtttcaccctctagagaaacatcgaaaatgcattagctatcatccgaattttcttttgaacacagtactatatttaattttaactactagcacttgggttcccccatttaatacctagaaagtagggcactagattataaaaatgccaagtatctgaagagagacaaggaataacgtttatgcattctgtaattcaacactgtatgttaaagaggccagcccatgtctcttcttaattttaaaattaaagaagccgaacccaaatttctgaattctagctaataatttaggacccacttaaaaaaactttgccaagtttttccattagtctgtttaattgtcctaaagtctgtatttcatttaactccatgaaatgcatatatttgaggaacgatgttagagtaaccatgatctagaaatgaaaagggcacttacacaaaagaaacaaatcagcaaacaactctgtaacagaattctggagtctttagtcttacaaaaaaccacattaaacatcgtaagagaatacaacatttagtccacacctgactccaaagagtctctcaactatagccagggttattttttctgtttgtttgtttgtttttgttttttgagacaagagtctcactctgtcacccaggctggagttggagtgcagtggtccgatcttggctcattgcaacctctgcctctggattcaggtgattctcatgcctcagcctcccaagtagttgggagtacaggcatgcaccaccacatccggttaatttttctatttttagtatagacagggtttcgccatgttgcccaggctggtctcaaactcttgaccttaggtgatcagccggcctcggcctcccaaagtactgggattactttgggtgtgagccactgtgcccagccaaaatctttattttgtgatttctacaaacctttaatcacgtttagattttaaacatttttccaacctctataagctagaatagatggggatctgttttttaacagaaattttaagctgttttagagaaaaataaacttggctcaaatgacaaatgtgaaattatcaaaattacgaagcataggaggatgtgggaaagggttgtagtgttcacaacacataggaaagtatttcccaaaaaatatatattaaatgtacttcaaatataacagaagttaaatgcagaatagcatacatatacctctccaaaatctgttaataattttaaatgaggtttgataagtaaattggcctccaccaatgatccaaagatatactagtaaagcttgatgccactgaggagggagagagcctggtttaaatgactgaaattcattcagtcatttaagcagtagctcatgagcacatcaattaaacatctaacaaacaagaattgtggatgtgccactatgttaagcaccaagaatgtggctctagaagagcaacagtctaataggtaagctgtttgtggaaatgcccaaggaaaatgcatggaaacaagaactatagggcccggcatggtggctcatgcctgtaatcctagcactttgggaggccgaggtgggcggatcacctggggttgagagttcaagaccagcctgaccaacatggtgaaaccccatctctactaaaaatacaaaattagccgggcgtggcggcgcatgcctgtaatcccagctacttgggaggctgaggcaggagaaacatttgaacccaggaggcggaggttgcagccagccgagatcgcacattgcactccagcctgggcgacaagagtaaaactctgtctcaaagaaaaaaagaagaagaagaagaactgtaacagaagtatgcacaagccgttggggagatgggagggctggggagatagcacaagagggagaagaaggagcccacaatgtctaaggagggaatcagaaaaacttcacacaggggcatctgagctaaggactaaagtcagaatgtgagtgtacaggcacacataaggacaagtgacagatgtgaatggacaaaaattacacagtgcactagataatgtggggaacgactttacctcacatgtcagccaaataagcattatcctttcaagataacagaaactataagcaaataattcttgatgccaatccaaaacatgtaactgagttttgatggaatttggtaaggaatgcctgatgctcaaaattaaaaaaaaaaaaaagaccaggtttcgaaccgtcaggagggaacacatcttgggctgactgatgcgggcaggtaagggtttgagggtttgcgcttgcaaaggtgtaagaggctaaggttacttaggatgcattaaaggacttcagcagtggatgtggctgaagggatgcatggaggtaggggagaatgtatccagaacagaggctgaaaacatgggaaagtgtttgagacctgggtctaaaaggactgtgacatggcactaaaaagtttgtgtgttatcctctgggcaacagaaggccaccacgggctctttatgcaggagaggaccatgagatgtgtgccttagaaagatctctatggcagccacatggagactggaaatacacagagcatcagaaggctctaatgttaccgactgaatgtttgtgtctccccaaaatttgtatgttgaaatctaatccccaatgtgatggtataaggaggcaggtctttgggaagtaattaggttttgaggatagatccttcatgaaggggattagtgcccctataagaagaggccagagagctacctttctgccttgtgagaatacagtgaaaagtcaagtgtctgcaacctggaagagagctctcaccaaaatctgagcatgctgataccctgatctcagactttcagcctctagaacaatgaggaataaatttccgttgtttgcaagctatccagtctatggtactttgttataacagtttgaactggttaagacatatggagagagattttgagggtttgaattgtgttggtgacagtagggatgaagaagaagtgattaatttgagatatatttaggaggtagaaatcaatataacttcttaacagactagtatagaaattaaagataaccaaaacttttagtttggtaaataaatggtataacattaactgaaaaaggaaaagatggtttgagaagatgataattattataactaacactaagcactattctaaatcctttaaagcactaactcatttagtcttcacaacaaccgtataaggtccctaaatctacagatgaaaaataccaatgcacagaaaggttaataaagttgcccaaggtcacacagccagaaatggcagaaccaagatgtgatctcagacacactctcaactaccacattacactgtacggtacacaaccagttaaacatctctcatgtctgagggacatcaagggagttgtgtttaatttgcatttggaaaacagacctagggctcacaagaagaatatggctatgaattttagtgtcatcaacataatagtatttccttaggccatgggaaaaatgagatggacatttagagtgaagagagaacaaaaatgtaaggagcagcaagacagatacaagaaggacactaggaaggagatttttcaagcagtgattgtccacaggctggctcagttgccacaccacagaggtacaaacttgaagtggtctgggccttctccgtgtgaaaatggcaaatccattcactgtttgctggatgaatggacttatcattgagctatttgctggatttaccatctagctaaaagatagctaaaagattccagcttagactatgtcatcaagaaaggaggcctgatagggtatgaaacggggaaaacaagaaaaacaaacaaaaatggatgctctcagctcttgaaaggatgatttatacccgtgtttgagcaaagcagattctgccttcagagaagcagcagcaaagatagctcatttctcaagcagcaccccatctcatccatcacccacttcccctacctgccccccagcctacaccacaggacctctgctctgccaagagggcagggccccagccacgctgcagcaacaccagaagcgcaaaagaaaatgtgctgttgcatagacagcgcaaataaataatggttcttgtgataatcagcttttgcttttaatgggcttcacatgactcatcagctatcacgtatgctatagcctgagctctggctctaaatcaaacaagttcaaagggagaagaaaggaataatagcaaaagatgagcagatatctcaagaagccttaatcctactgaggaaaaacagaaatggaggcaggaagaagacagtttcccctatgagcactcaggtaccgagggtccagagagggcggaagctgaaacagccgcagagagaggcagcctagttgccgtgacgccatcctgccagccagcaagatttcaccagaccgttccctttctgccacagttcctgtcttgtgggcagcagaagcaccaagaaagaagaaaaatggttgtttgtattcttatggctgcagggtcatacctctgtgacttaactatttcaacaagtgacaaggagaaagtggtaagagacagagagagcagccaagatgggggtaaactcctttggaatgtattaaatccaacttcattctatggataaaatgccctcatgaataaacactcatccccaaaacatcttttttttttttttggtatttataatccaagaaccttgacagagaatgtcagctttttatcaaggctctttcccacaatgacttctgataatgggggttggggttcattcccaggtgaaaagcatgagtttgtggcaaagaaaacagtattgtttggtcaccacactggaatggaagccaggatattctgaaggatgccttggcactaatacaaattagcaaatgactttagcacttctgagcctcaatttcttcatctgtaaaatgagaagaatggactgggtgaatatgaagtccttccactctcttaatctatgcttatgggtgctcagagcacgggaacccttccaggtgtctcttgtggttaggctgtccatgtgtcaggaccctgattgtgctcccagggacacacaagtgtgagagtggctacaactcaatggaagcaataagtaaacacgtacacactcacaaagctagatccctatatttgattaaaccatgggttagtagacaggaaccatgtcttatgcatcttcacacactcaaaatccagcccagtccaggcactgggcttaacaaatgtttactgcatgcattttgaggcaaatctttaaaatgtcatattaagaagcttttcagacatgtcggttatggattgaattgtgtccccctaaaattcacatgttgaagccctaactcccagtacctcagaatacaatgttttttggagctaggacctttatagagggaatcaagttaaaaagaggtcattagggtgggtcctaatccaccctcatggtctcttcacaagaaaggaactgggatcacagacatgaacacagggaggatggcatgaagagacatagggagaagacagccatccacagctaagcagaaaggcctggaacggattctccctcacagtcctcaaaagggaccaaccccgctgacatcttgatcttagactttcaggctccagaactgtgaggcaataaatttctgtttttgaaatcacacagttttaaagccacccagtttatggtactttgttatggcagctctagtaaactaatacaatatccagaagtagaattatataatgaaatctcccatcacactcaccactcagatctttcactccggcatacttcatttcgtatttctaaaatatatggacatttccttacataacaatacccttatcaaacctaacagaattaacactaatttaaaagcagatttaattcccagaagaaataaaccttatactaaaacacacacttacattcctccattaaaactattaacacttttaggccgggcacggtggctcatgcctgtaatcccagcactttgggaggcccaggtgggaagatcacttgaggtcaggagttagaaagcaggctggccaacatggtgaaaccccatctctactaaaaatacaaaaattagccaggcatggtagcgtggggtcccagctactcaggatgctgaggcaggagaatcacttgatcctgggaggcagaggttgcagtgacccgagattgtaccactgcactcaagcctgggcgacagagcaagactctgtctcaaatttaaaaaacaaaacaaaacaaaacaaaagctattaatactatcaaaaacaaaacaccaataagcttgaatttttgtcaaacaaccctcagaggataagcaagactctcagaataattcaatttcctaatcagctctcatattcaacaatttcctgaaagtaaaaacctatgtttctttattcaagtacagaaaagaaaggaagaatgcggtcagtattcatacccactccgtggtcactgaaaatgcacttttcaaactaatcccaagaaatttagtagacatcattaagtctttagtttaaaaacagtacgtgcaatggtattgtatgttatattgcacataatttaagcgcatgaaaattgacatgacagagctcaaaaccactaccaaaaaaaaaaaagataaatacaaaaccatacctttacagggtagagaaccgcttgttatgattttctaaaacgttagagactggagttaccaatgcttcaacaattgacaacttccaatcacatgtcctcttcaggaaggttactttttgtctaatgttaagacaaagagaaatgttaaagtcagaatggcctacttaaaaagtttttcaaaagagtctttggaaaagcagttcgctccatcaactttcaaaacaggcatc

SEQ ID NO: 371 - DNA, 67943 bp, Homo sapiens
ttgacagactagaccacttttttattacagcttaattggcacatggttcactgaagatacacttcacttttacataggcttgtaaatagaaaaatacattgatgcacaaaaaatatagtacttcaataccaaacttaaatgatttccaaaaagaatacaggttatttcaataattaaaggtggcttttgtgtgtgcactatatcatgtatacacttaattgtatgtttaaggccagtggaatctatagctaattactcatttggttcttgaaaactgaaacatgcaaacattcttatttttatgtttaaagacatttaatgtgttattctaacacaaatacaccatatagaatatgccctgatatgtagctgtaaaattatgttgtactgcactgaagtcttatggcaactatataaggcactgctgtgtgattatgaccctgctctttttttttttttttttttttgagacagagtctcctctgtcgcccaggctggagtgcagtggcgcaatctcggctcactgcaagctccgcctcccaggttcacgccattctcctgcctcagcctcctgagtagctgggactacaggtgcccaccaccacgcccagcccattttttttttttttttttttttagtagagatggggtttcactgtgttagccaggatggtctcgatctcctgacctcgtgatccgccctcctcggcctcccaaagtgctgggattacaggtgtgagccaccgcgcctggccaaccctgctcttgaaatgtctaaatcttttcctcactagcatatacaattcaaatgcacaggcctccatgacttctttggaatttaaaagaagccttcatttcaaggatagaaatatgtaaaattttaccaaccatggataagtttgttatgggagtagtggaaggacagtggaaaaaaaaataggttttttcatgatacttttatttttccttttttaaaaataaatttagggggtacaagtacagtttagatacatgaatatattgtgtagtcgtaaagtctgggcttctagtgtaaccatcacgcaaatatacttgtatttttctaattacagttctaccaaacatttgccaccacaaaatacaagtatttttattctttatttaaattatggtgagtgatatttcttcctatatagccattaagatctctggaagttttgatctactttattcaaaccactttaataaataagacttttcacctaaatgaaatacctttgaattttataaacaacttccatgaaacatatattaaaaccacctttaatttggtatgaagacactttggcaatgcagcggaataaatgatcttggcaagacccagcaagtacagtaaatgctcatgagctctatgaaaaatataggctacagaatacttcatttttcttttattgaactacagtacaaatgtgactgcttcaatatgaacatctatcttccaccaaatagcaaacaggcatcttatgtaattaaaaactaattatttcaattccaccaatggaaaagcaaaacaagttgcaaatatcaacaatacagagcctgctggtaaagatagagatgagtaagttataagctaataaagctgcagcctgaggatgccagatcaacattataaatatgaagaaaaagaaactaaatatttactcatcgcaaataactcggcataagcaccagctatgttcaggtgcggccagcacataggccaagtataaatgtacaatcacagtgaactaaagccataaaatctagttccctgacccttcaatcaaccattcagagcaatgggaatatagcggggagacagaagtcccactttggttgctcatattacattaagccagcctgccccaccccaatccccttcccaccaataaaaaagtcaccgtgagtgtataattggtcaatccagtttatccaaggtctatagatatagccatgatttgtcctatattcatgttaaatagaatgcttacataaaattaatactcaaagacattgagctgatgtgcatgtatattcttatttaacatttaagtggctttaatggtattttagaatgtcacctatggcatgagtcttcaaatctggattgaagactgtggcggttttataactgcatgtaagatcttaaatgtaagactctgggcctacctacattaaggcaggtgacagtaccctcattcattctacataataaatacactcttctgtgactgcaaaattctgaatccttgaatgatttactataataggctaaggttgtataaggcacttttggctctgaaatatttctcctaactctcaggctgaatcttaaagaaatatttacaaagctgcaacaaattaattttagaaccggatgctttattcgtaggtctaatggggatggtgagaagcaatttgtacacaatgcccattaatctctcactgtgccatgtatcaatcatagagaagatcccaggcatgggccacctgaactactatgtcgcttacttgacttctcaacagccacatgcccctttctccttttcttcacttaactgatccgtagaggcatgaccatttgatcgcaccactccttcaggaatccaggacttgtccacacaccgttccattcgcttcattatcaggtccagaagcatctcaattgcttggcttatgtttgtcccattggcagcactagtttcaaagtaggggattctggaagacagagacaactgaggtaacaacatgtggagggaaaggagagtgacctttgctcttgataattcaaattagagaatcgatagaatacaaatatacaagatgacaaacattttaccaccccagagtacattaaaaagttaaaaagacaataaaatactcacactgcatttccagtagatatgcaaaactggaaattttagactcttcaaaatatcaatttttggctgggcgcagtggctcacacctcccagcactctgggaggctcaggtgggcagatcacctgaggtcaggagtttaagaccagcctggccaacatgcggaaaccccatctctacaaaaaatacaaaaattagccaggaatggtggcatacacctgtaatcccagctactggggaggctgaggctcaagaatcacttgaacctgggaggcagaggttgcagtgagccaatattgtgccaccgcactccagcctgggcaatagagttagactgtctcaaaaaaaatcaattttcattttttaaaggaccatatatatattttggcaatacatactgatttactgtaaaaaatttataaaaagatataagtaggggattctggaagacagagacagaattaaatcttttttcgtttaagtttttggagggttttttgttttgagacagagtctctatcacccaggctggagtgcagtggcacgatctcagttcccaggcgacttcccaggcatcgatcctcctacctcagctttccaagtagctgggaccacaggcgcacaccaccacacctggctaattattgtatttttttgtagagacagggttttaccatgttgcccaggctggtttcgaactcctgagctcaagctacccacccgccttggcctccaaagtgctgggactacaggtgtgagctgctgcacccagcctagttttaagaatttaaaacttgattattggtatgaaagccgtttaaattcctctaagtgaaaagtaaaacttgaaaacttttagaagaacatacaacagtcttatctttttgacattggaataagaaaggatttcttaatatagctataaaagctcaaaccacagagaataagtttgataatcttgacaatgttaaagtttaaaactttggtgccacaacatatatcataagcaaagttaaaagatgagcgacaggccgaaatacatggcatttcatataacttgcaaacgggttagcatccgaaaaaataattcctcaaatgaattaaagtaataaacaagataatacaaaacagactaaggatatgcacgggaaattctaagaaattacatttgtgaaaaaatgttcaacctcacccaaaataagggaaatgcaagttaaaataatggtatattaactcacacccatcagattggcaaaaatatagaaatctcccaatattaagtattgccaaggagaagaaaagaggaacttgcacttactgcttatgtaagtataaactgttaataactactttggaaaataagacggtaatatctgataaaattgaaacatgcatgcactatgacccagcaacagcactcctgggtatacatctaaagcagagccaaggcatgttgatgggcaggaagtgagttacagggatacatgagacatcagcaatccctcagtccttagggcaactgagaaggtcttagggcagccagagtccctgaaccagtctcctccaaacttgagcagccttatctatttatcccagtgagctgtacaaatattatcattttctgcaggtgccatcctatgaaaaatattcagaaaccctgtgctggagcagcactatccaatagaacttcccacagtgacaggaactttccatatgtatatcatccagtacaataactactagccacatgtagctattgagcacttaaaatgtggctaatgcaaccaaaaatgcgacttttttgtttttgtttttgttttgttttgttttttagagatggagtctcactttgttgcccaggctggagtgtaatggtgtgatattggctcattgcaacctctgcctcccaagttcaagcgattctcgtccctcagcctcccaagtagctgggactacaggaacaggccaccactcccagctaattttatcatgttggccaggctggtctcaaactcctgacctcaagtgatctgtctgcctccactcccaaagtgctgggataacaggcatgagccaccacacctggccaaaaaacctgaacttttaattttaacttaaatagctacatgtgaccagtggctatcacactggatagtgcagccctagagaagctctcacatatgtgcacgtggcatcgtctaatggaatagatattgcagaactatttgtaatagggaaaaaatttacctaaacgtccatcaataagcgcatgaatagtgatatttttatacaatgaattatacaatgcttaaactgtatcaacatggcaaaaattaaacattgaattaaaaaaccaacttgtatgatacaagatcatttgtgtgaagacaacaattacacatcattataaaaacatctatgtagtaaaagtacaacttcttggactagaaatatataattttgactgcttttagctaaaagtaaccgaaaattgtggctcaaattggcatgaatcacaagtaggaatttattgtaatgcataatgaacacagaactagagagtttccagtgttaattcggttgccaaacggtagaaacaaagagcctagattcatatcatccttctgttctgccatcctccacatgtcagctttctccacaatctgactcccttcatgaccccagaagttaaaacattccaggcatcacatctcaacacaccgaagttccaaggaagaaaggactcttcctctgtgtgcctccctcaggagagaggaaatctttcccacaagtccctggaagactttccctcgtgtctcattggtcaaaactgtatcacatgccaatgcctaaaccaaactctggcaagaggaatggtacaccaccatcactggcttaaaccaatcagtcttcctgggctggtggctggcacctgcctctcttaagtagcatgtcctctagaagcagagtagatagctaaagaaaattgagattctataaataaaggcatgaatattgtctaggcaaccaacaacatctgctataggaagtagatatagtgtggttccctctgaggaggtaggaaggagaatggaatcagcaaggaattttaaaagggacttcaattgtatctgtaagaaaattttattttttatttatgcataatatagtttcagagtaaatatgatcatttaatacactgatataatgtgtaaagataagtatacttgggattgccataatcttaaatatttgtcttttctttatactagaacgattggaatttttccctcctagctatttcaagatatacaatagattgttgtaaactatagtcaccctactgatccttctaacactacatcttatttcttctatcaaaccatatgtttgtacctattaatcaatctctcttcatcctccactccctcctacccttcctggcctctggtattctccaatctactctctatcttcatgagatccacctttgtagctcccacatatgagtaagaacatgcaacatttgtctttctgtgtttggctatttcacataacataatgatctccagttccatccaagctgctgcaaatgatgggatttcattctttttatggtggaataacattccattgtatatataaaccatattttatttatccattcatccattgatgggtagattgattgcatatcttatctcttgtggatagtgctgcaataaacatgggagtacagagagcaaatacccttttgatatatctgatatacatctctatatatcttttgggatatatatatatctctctcctaagaaaacttacataaaacttttaagaaaacttccactaatatatatacacatatatatacacatatatatgtgtatgtgtgtacatatacatatatacacacatatgtgtgtatgtatacatatatacacacatgtgtgtatatatacatatatgtgtgtacacatatatgtgtgtatatacatatatacatatatgtgtgtgtatacatatatacacatatgtgtgtgtatgtatatacacacatatatgtatgtacatgtacacacatacgcatatatgtgcgtatgtgtgtacatgtacatatatacgcatatatgtgtgtacatgtacatatatacgcatatatatgtgtgtgtacatgtacatatatacacatatgtgtgtgtacatatacatatatacacatatatgtgtgtatatatacacacatacacatatgtatatatagtgtatatatgtatgtgtatgtatacatacacatacatatatacgtacacacatatgtatgtgtgtatacatacacacatgtatgtgtatgtatatatacacacatatatattagtggagttgctggatcatatggtagttctatttttagtttttttttttaagaacatccatacttttctccacagtgcttatgctaatttactttcccaccaacaatgtacgggttcacctttctctgcatcctcaccagcatccactattgcctgtatttaggtgtggtttttttttttttgagggggggggaattactgcctatattttggataaaagtcatgttaactggatgagaagttatctcattgcagttttgatttgcctttctctgagtagtgatattgagcattttttcatacacctgtttgccatttgcagatcttttgagaaatgtctattcagatcttttgcctatttttaaaacagattatttgtttttgctattgagttatttgagccccttatatattctcgttattaatccctgatcagatgggtagtttgcaaatattttatcccattctatgggttatctcttcattttgttgtttcctttgctgtgtagaagctttttagcttgatataaatcccatatttctattcttgtgttggttgcctgtgttttgtggtcttacacaaaaagtttttgtccagacgaatgacctggagtgtttcccaaatgttttcttctagtagtttcatagtttcaagtccgatatttaagttttaattcattttgagttgatttttatatatggtgagagataggggtctagttacattgttctgcatgtggctatgtagttttcccagcatcatttattgaagagaatgtcctttcccctctgttcttggtacttttgtccaagatgagttgtctgtaaatgcatggatttatatctgggttctctgttctgttccattggcctatgtgtctgttttatgccagtaccatgctgatttggttcctatagctttgtagtaaactttgaagtcagtgtgaggtctccagctttgggcttttttcctcaggattttgtcagttattgagggtcttttgtggttccatataaattttaggatttttttcgatatttgtgaagaatattattggtattttgatagggattgcattgagtcagtaaattgctttgggaagtgttatcattttaacaatattaattattccagtccaaaagtatggaatatttttccatttttggtgtcctcttcaatttctctcacctgtgttttatagttttccttgtatagatgcttcacttctttggttaaattgatttctaggtattttatattctttgcagctattgtaaatgagattgctttcttgatttctttttcagattgttccctgttggtgtatataaatgctaatgatttttgtatgttgattttgtatcctaaaactttactgaattcgttgatcagttctaaatgttttttggtgtaatctttaggttagaaaaaaactcttaaagcaggcctgtggcaagaaggcccagaaaagttaagcggtctgatcaatgttattcagctaataaatgacagagaagcaagtaggctcttcctgttttcttatacaggtcctcatatactatactatgtcttgtaaaacaaaataggaaatgtcttctcagtgtttagttcaaagaatactgatttccaaaactactaactagaagaaaaaaactgggtaaattcaaattttgcaacatgctattttattaaatgagtttcctggactataaccttttttttttttttttttttagcttttcccccttttttgcttcagggatttcttgtatatgctcttcagagtgttctggtttgcctgaattgaaactagctgatatatatgagtcatttaagattgaaggaaaaaataactaaaattatttcttgagctacccaatactatgtgtcttacatacatgattcactaaatataaccactactgtattcaggtacacaatattcccatttcacaaatgattaaactaaggctgagaaagatgaaaggaacttgcccaattcacaatgctagaaagtagcagagttaggatttgggtccacagctaattccaatgcagccagtttaaccataggttctactggttccaaactagtatgaggattttcaaaataaataaatcttatgcactgtacaagaagaaaacgctggctttggggagtattcagaggtcactggccatgtttatcaaaggctttgccacttaccaactccagactatatttctggaccatacacttgaagacattctgaattttacagcatcaagttgctcaagagcaacaaatctttttttttttttttttgagacagtctcactctgttgcccagcctggagtgcagtggcgccatcctggctcactgcaagctccgcctcccgggctcacgccattctcctgcctcagcctcccaagtagctgggattacaggcggctgccaccacgcccgtttaattttttgtatttttagtacagacggtgtttcaccatgttagacaggatggtctcgatctcctgacctcgtgatccacccgcctcggcctcccaaagtgctgggattacaggcatgagccaccgcacccagcccatcaaatcttaagtatacatttgttttgttatccaaagacctgtggtacaggtgtaatttttaaataactcacaaagcattgcttcaaaactgtatagctgtttttcacataatcttgagaaatcagacttcttgtcgaagtcatcctttatacatttgagatggtctttgcaacaggattaatcaagtgacaaattcaccttgcttttcaataaagccatgaaagtcgtgataacattgtatttccttcaactgttgacttcattgccaccacttgtgaggaatctaaccaaaatgttcttagatatcaaaacaacaaagcaaagttattttattatctcagggagtcctgcaattgaattcagtaaagtatttcttaaatttattagaactttaaagtcctccacgattactgttcttgaagaatgtttttgtttttctgtattctcatagcatgttaacaactacatcagttactctgattacaatttaccttactcttttattctttcttggctagtaacagcttctatatgagagcttggtaaagttttcttttttaacttgttaatgcttttacagatcttttcagaactctttcacttctgatgttactaagaagcatatttagatcaagggttcccaatccccaggccacagactggtaccaatccatggcctgttagcaaccaggccacacaacaggaggtaagcagggggccagcgagcaagccaagtttcatctgtatttacagctgctccccatcactcacattaccacctgagctctgtctcctgtcagattagcagcatcattagattctcataggagcacaagccatattgtgaactgcccatgtgagggatctaggttgcactctcctatgagaatctaatgcctgatgatctgtcactgtctcctatcacccccagatgggactgtccagttgcaggaaaacaagctcagggctcccactgattctacattatggtgagccgtataattatttcattatatatggcaatgtaatgataatagaaataaagtgcacaataaatgtaatatgtttgaatcattccaaaaccacccacacctccactggtccatggaaagattgtcttccatgaaaccagttcccagtgccaaaaaggttggggaccactgatttagaggatatatgtgtagggacataaggctatttttccagtatgattcctcagtaatgctgtcttattatttgataacttcctccaggaggtgataaggccttgcaactgaatctctgcaattctctgttttagcacagctattaaaaactggttgaggccgggcgcgatggctgatgcctgtaatcccagcactttgggaggccaaggcgggcggatcacgaagtcgggagatcgagaccatcctggctaacatggtgaaaccccgtctctactaaaaatacaaaaaattagccaggcatggtggtggacgcctgtagtcccagctactcgggaggctgaggcaggaggatggcatgaacccaggaggtggagcttgctgtgagccaagatcacgccactgcactccagcctgggcgacagagcgagactccgtctcaaaacaacaacaacaacaacaaaaactggttgagaaactatcacctcatttgagtgtttatccacccacctgtgagttctgcaaggcagagttgctcccctaactccaccatgctcatattctatcatccttttatttcctgactctaaaatatcttaatcagaaaaaagtttgttgggaaaaatgacatggtcttcgcagtttttaaacctcctgcttgcctcttagttactgtcaatcttttttcctccatctatcaccttgcacacaaaatgaagataatgcatctctgtccctcactagtcacatgtaatatttgattaacaacttgaagaggcaatcctttgtgactggagtcaatatgtgtttatttatcaagaatctataatattattgagctaaaatcctggggatagcttgtgatgccattgttacaagaatagaattttagaatgagatttttcaaaatgtaaattgttacattttcttcattatgatctttctcaattatatccattaaaaatcagttaatgtccacagaacatttcttatacttaaggagagggtttgaccattctatcacctttcagaaatacattacatgaaaaagcagttgaaaaactcagatctcccgcaacagaataaattggaaatttcttaaaaagtagttgaacagtaagcttttttaaaatgctaaatcacaataatgtatacttcattttaaaaattctctcaaaatcagttacaaatatctttccaactccagagtctccagcctcatttgattccttaattttcctccacagctcctgaaaattacttcaccatcatttttgaggaataaatgagaaaacatagtgaaagtactttgaaaactataaaacctgtgcatggaagttatcaacaacatggatcaatggttaagagtcataaccggccgggcgcggtggctcacgcctgtcatcccagcactttgggaggccgaggagggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaagagtcataacctcaggtcgggcgcggtagctcacgcctgtaatcccagcactttgggaggctgagacgggtggatcacctgaggtcaggagttcaagaccagaaaccccgtctctactaaaaatacaaaaattagccaggcgtggtggcaggcgcctataatcccagctactcaggaggctgaggcaggagaatcactttaacctgggaggcggaggttgcagtgagccgagatcgtgctacggcactcaaggctgggcaacagagggagacgccgtctcaaaaaaaaaaaaaaaaaaaaaaagaagtcataacctctggagtcatgctgcctggcttcaaatcctagtagtacatcttaccaactgtgattctgacaaaagtttaacctctgtgcctccgctgcttcatctgtaataccaaataacatcagtatcttcttgtaatgattaaatgagttaatatttaaagcacttagatcagaacctgacacatgtacaaacaataaatgtttcttatttccaacacagaattgggttaggtgataaaagcttatttgtaatgatgttatttaaaactcagaacacagccaggcaccgtggctcacacctgtaatcccagcactttgagaggccaaggcagggtcggagttgaggtcaggagttcaagatcagcctggccaacatggtgaaaccctgtctctactaaaaacacaaaaattagctgggcatggtggcacgtgcctgtagtcccagctactagggaggctgagacgggagatctcttgaacacaggaggcagaggttgcagtgagccgaggcggtgctactgcactccagcctgagcaacagagggagactctgtctcagaaaagaaaaacaaaaactcagaatacatcatcccaaaaaagcaatgtcactagcaacatggtaaacattaaattctcaatctgtgtgttgtgtgaaaaaaaaagaataaaaaataaaaataaatttgcaaactaacccatgaacattggtttaatccacaatgtagctgatctataaaatctacaatactgctctaattctggtacctgggaccacgcctccctacaccagagatgctgcactcagacctgtcctggccaaagtgctttgtgcctccaaagcatttgcctcccttactcctcattaaactcctcactttccaagcaatcttcatgaaatgctggaagacaatggatcttactctactgattaatactgacgtataaatgatgcttctagcagagctgtgagctactgtccaatgtttattaacttaagcaaatatttaattggtataatttcaaggtataagagctctaacttttcaagttactcatgctaaaagacacacaatattaacaagacatactttagatttgtaactccaaattcaagtaacaaacttctttcaattaaaagtatactttcttgccatttgtaaacctctaggtcatgggaccaggagtcaggttaacaactttaaaaatccttagactaatcactcagagttttctgagcaatttgaggcagtaagattttcatttctacaggaataagtgaatagagttcactccactctcagctctgtgccagtaattgggctgtaatctcatctagcaaactagatgagagccatagaaaagaccctgaattaagactttctttccataagaaaatgatgttccaggctggaggcggtggctcacctgtaatcccagcactttgggaggccgagacttgtgcatcacttgaggccaaaagttcaggatcaacctggccaacatggtgaaacctcgtctttactaaaaaaaatatataaaaattagctgggcacagtggtgcacacctgtagccccagctactcgggagggtgaggcaggagaatcgcttgaacctgggaggcagaggttacagtgagccaagatcgtgtcactgcactccagctgggtgacagagctacactccatctcaaaaaaaaaaaaaaaaaaaaaaaaaaaaaaaattcaagaggatgtattgttcccattttaaccatagaaagagtgctattgttccttttctccacatggtggtgctaatgtagcaccaccatggagccgtattgccaaagacgaaaaaattcagcactgctcatcgttattaccagtctgtaagtggccacttaaaggccatttggagtacatggagaccattaattataatgcatttccaaaaatagattaatcacaaattttaaaataaaaaatttaagtaaacagattcaaatcaatgagaggggcataagcatttgcagtttttcaccaagatcttgcttgtggcgtaggtcagcatcctgatttcttttccattatttattctcacaaaactaaaagatcctaaatctcagttagaggttgccaggaataacagcaagtatgtttggtggttctgtcaaatggctgtagatatttggctcacatgtagatctagaaattatgaacaaacgtctcactaaagtgagaagtgagtttcacactacttttcacagtctgttggatgctaattgaacaacatttccaggaaatggctggtgtgctgactgtttgaacctgggatattgcagcaaatgaaatccagatcctctgctgagttaaatggagctctgtgaatcagtcttgtatgtttgacttatttgtgtacttttcaaacatgcccaatgctacatcgctaagttatttctcaaatcaagaaaagatgtaatcaagttttaaaagactaaactattagagatcaagctatttgtaccgcatttcatctagttcaaactagagaaaacagtgagcatgctgttgaattaagctacttgaaatccctgaaatgatccatactgatattattaatgttgtaaataaatatttttaattcctctttcattccagaactcttgagcatcttcctcagcaataaccagcagccttcagcagggagaacatcatcttaaatttgctgcccatttctttgcacagtacacaaaatatgtacattcagttgtcattcttagttcacattctttttttttttttttttagaggcagagcctcgctcttttgctcaggctggagtgcaatggtgtgatcttggctcactgcaacctctgcctcctgggttcaagcaattctcctgcctcagcctcccaagtagctgggattacaggcacccaccatcatacccaggtaatttttatatttttgtagagacggggtttcaccatgttggccaggctggtctcgaactcctgagctcaggtgatccacccacctcaacctcccaaagtgctgggattacaggcatgagccaccatgcccagctttagatcatattcacatttttctctattttcctcaactctgaatcaagaacaaaggcttattatgaccaccaactatcctctgtgaataaagtatggacagacatttcaacgcaaccatatttagtcacagagtgaagcccttgtctgctcacttgtggttggtgctccctcactaccaatgccaaggtcccttcccagcctatatcataggtgatgtaattaactgggtgagaaaaaaaatcttcctctctttagcatggattttccaatgagaagtcattgagcatatttcactcactcatgcatggcacaagtagacaattggttcatatcctgtacaagaatgactttgtccaaagaaaatatctgctagcatgctcacctgtcaagcaaaatgtttgctagcatgcgtctttgataggaactcaaagtgttgtcttgaaccagcagcagcaacatctagaaactgatcatcagtatacatttgtgggctccaacccagacctactgaatcagaaactgcgggacccagtgttcaggtgattgattctgatgcacactgaagcttgagatctaatagtgtcttccaaaagaggaatgttgccaatatttcattcagctttctcttctacttgtcactgacttcgtagctatctttttaaagtgtttcagtaaccatgtgaactgtaatcacttggctggcaggagtgcaaatttgaacaactttctgttttgttctcttctccaacttcattgacaatatcactcaatataatacattggaaaccattatgttgcatttgttccaggaaaattcaattggtttaccacagagatcactttgatttgttaggaagtgacctaagagcttcatattacaatttaaccaagtttcacagcaaaaacaaacaaacaacaacaaaaaaaaaaacatggaaaattagcggtagactcttaggccactacaaattttttttctgatattcattatcatgcatacaatttgccctttacatttttgtctgttgtatgaagtcctcattctcaaatttacttgtcccagcacacacagattaacattccattttcgcactgtagtgttctttattaggcttacaaagttcttctgagacatggtgtttgattctttgatatgtctattccagagaaccaattgtaaaccaatgatctggggtttttttgtttgtttgtttgtttttgtttgtttgtttgttttgttttgagacagagttttgctcttgttgcccaggctggagtgcaatggtgcgatcttggctcactgcaacctctgccttaccagggttcaagcgattctcctgcctcagcctcccaagtagctggaattacaggtgcccgccaccacacctggctaattttttgtatttttagtagagatggggtttcaccatgttggccaggctggtctagaactcctgacctccggtgatccacctgccttggcctcccaaagtgctggcattgcaggtatgagccaccacacctggccccagtgatctgtttttatgaattgagaatagaagacagcataatagtaacaaaaaatgtaaatttatcaaacaacatacaaattatatgaagatatgccataaactttatcctgttttctgactgttagcacatggataaactaaacaatatagtcctttagtgcatgtgtaaccagtgtaaatgttctaagaatgaaacaaaacatctgtgaaaataatcattaaagttatatgccatatttgtgaaatgcatgtgaaccaaatttttccatcatattttcctctaaaagtgccaaacagcctaccaaactacatggtatgctttctgtatcctaagggactctgtttctagccctttcctttcttcaagggtttcaatcattatctgctaaatcctcttttctcattttaacccaattcaaaaactatagattgagctcctctctatgaaatactccataaccatcgtgacctgggcacaggtcaaagacagtcccccacacccctcagataccccatatgacagaaggcagggttaggctctgtgaaaccagacaggctgtggaatcctaagaccgagggcacaggaaacaagcaaagggctgaaaaagcccacaggggcaagaagtcaagcctgaccctcccccagtacttgagaatatacttgaatgtgcttgtttgatctagctaactcctctaactgcctttttcttttttttctttgcatttactgacatactctcaaaagaatgctctaggatccatggtttccattgcttcatcacttacttcctccttacccattgcaacatacctcacagcttcaacactacagcattctctgtggtaatcgttctctccctgtttcttttccactacgttacatgagtgcctctcaggggagcagggggacatttcagactggccggtaagactctgtcagcctccccctcagaatcacctaagtcactggttctcaaccattgcacatgaagatcacgtggggagattttaaaagataccaatgcccaggctttgtaatgagtcagcttggctaggctaaacaacatttcccagaatgccctttctggttagggtgggccacaaaagagatttgggggcaattttgggggtaggaagtgaagcaacctccatttcatagccctcatatattgtcgcttatctgctggctcatcttattgtcataaacctgcaactagacctgcacctgggccaggtgatgttgttagccctgtgacaaagggccccagtttctgcaggacacccacaccagccaggtcagaggcaacaggaagtgacatgggttttagtccctcattatgggcaccagctggttctcactttttccatccatcccccatttcacatccttctccccttcctgtctgactgtcctgtccttcaggcttcagcatcagacacaaagacaacaccttacagagactacttacccagctcccacaattgcatatgctcaaattcctgtaacagatcccttcatgtataggtatgcttcttcaagtgaaccctgcctgagaaactcctccaaaccaattatgtctgatggtcagaggtgaagcccagacatgagaatgtgttaaaagttctctggatgtttctaacatggttaaacaccatctgccctagggtaaaaacctctacatgcaattgcaaatccttgccagagtaagcctatagtggatgggaatccttcagctgagctagccttgagaaaaacctaaaatcctgccctactctatgtgtttttcctgatttattcttccttttcctttttcacaaagctagcctctgcccacctcacagaccactgcaatctatcaatctctagtctttcctccctccccacctatagcctatagactgatctggaaatgtaaacataacatccctccatgctcaaaggctttcagcaactccctgtcctccagggatcaaatctaatctccttacctggtattcaaacccctccagagtctggcttcttcctacctggccaacctatcctccccctcccttcccactataaaccctaccagctttctgaacctccatcaaccaaagaaagaataaagcagtgatcacacaataaaaagggaaaggttttctcttggccttcttggattctgctaaccaccaaagccacaaactaggtaacatcccctacaccatctacaccatctctatttccctcccctcccttctcaacccacttgcttccttcctcttttaatgctattaagggtttgaatttacatatgggttctcattgtgtgagaggcagaaagaaagtaaagtaaaaattccttttagaggcacccttaacactttaatactttaataagcagcagctgaccacttctttcatgtccagttcatgctgctgctgctgctgctgctgctatgatcctattcccagaactcaaggagaacgacagtattttgctgaccctccaccacaagaccatagactaagccaaaggagatctcacactcctctcccagaatagaaatttcaaaaccagcacctaatctgcaataaccaataagcccttcttatatgctagcattctctacaatagtacatgaagtggctttgaaatttccttgctgaggctgggtgtggtggctcatacctgtaatcccagcactttgggaggctgaggcgggtgggtcacaaggtcaggagttggagaccagcctggccaatatggtaccagaaaccccatctctactaaaaatacaaaaattagccgggcatgatggtggactcctgtagtcccagctacttgggaggctgaggtaggagaatcgcttgaacccgggaggtggaggttgcagtgagccgagattgtgccactgcactccagcctgggtgacagtgtgagactctgtctcaaaaaaaaaaaagaaaagaaatgaaaaaagaaatttcctcgctcaacatggaggatttctttaccccaggagtctcctatttgcatcttggaaagaaggccttacatacttaaggcgcctctgagacaactcaaagttgtctctctgcaaatgccaagagtttgagaaaatgggaccaaagcactgaaggaggcccttgccacatgcattgtcaatggatcctactatcatatcatataaaaaggacacattcaacatgccccaaggcctatggctgaggttttgctttaattgtccacttttatctttttcattaccattcacctgctaatgtttatattgaaaatgttttctctagacttctccacaaaaatactcacccatatttctctgcgagtgctatggcttcctcctctttcactactctctggtcctccagatcactcttgtttccacacagcactatatctgggttttcacaatatgcatgcatctgtagctggcctattaatataagaaagtttattatatatgtaaataataatgtaagtgtatgatcagtgaacaatacatgcaaaagtgctttgaagactataatgtatatatagatattgggaattgacataatgctttcaaagcatcagtaatcttatctgtaaagctgaatagttggggcagaaatataaaaccattcttaagcacataccccagtttattgatatcggagagtttataggagaatgtgctacctctcaagtgtgagggcccacatgtgcacacgcacacatatgcacacacacacatacaaaacacctttcttttttatgaaggctatttgaaaagaaagttgcaggagttcctagggtttactgctaatcttaaaactgtttttatgtgtttttttctccatagcaatgacatttctaaaagaattgtttttctccaaactaatctatttctatccaaaatgtttttcacatttttctattatcctagggcagaatcaactcatttaaaacaaacaagatacaggcttcaatgagaagaaaagacccagaataaacagtaagtgattctgtcaccagagccaagtggaagcagaggactataattcttattccgcagcttttatttcacctgaaaacctgcaaataggcacaattataaaaagcaattgactcaaaccaaagagcttcactaagctaaatagtttaatctttcaaagtaggaaaataacacctcatttcttacccatcacaccccagaataaaattaaggcctaaacgttcacagtaagacatacttcagagtttatggcctaatttattttttcatcatggttaaccagaaaagtgtggacattttagttcctcattatgaagtagtgttcatcatatcttatcatgagaaagtcaagtaggcaggtgtttactgagcattagcacaggcctgatactctgcatggaatttcacaacagttctttgccctcatggggcaactggggtaataagacctacagaggacagactaaactgtgtaccatttcatgaaaagccatgccctttctttcctccaggttgttacacatgctgttcccacatcactgaatacttaaccacaaccttccttcaagacttgcttcatggttacctcattatctttctggtctccagagtggctctgtgctctgttaatgccttataaggtgttataggtccatgcccagtgtcatgctatgagcacagactcaggatccagtgtacctagggatgaatcctggctctgccatttactagctgtgtgaccctgatgaagttatttgactgcctcaatttccccatctgtaaatggtgataatgatactacttactttatacagtcaaggtaaggattaaaatgaattaatccagtgattctgcaggtaaagactgtgagccaccagccttagcataacctaagaatttgttgacatgcaagtctcaggtcccactccagctctactgaatcaggaatgctggaaatggggctagaaatctgtgttttaaaaagtcctccaggtgactgagatgcacattcacatttgagaactactaagttaatatattaaagcatttagaagagcatgtaagtatcaccagtaattatggttaacagtatttattttgggtagtctaggaagtgtgattattggtgatttcttctttttgtctcatttttcctaatttttctactaagattgtgcttatctaaaaagcaaattaatcagttattttaaaaacttcactaagaaaaaagtcacctacataaacaactacagtctgataatggatgtaataaggaccctatacacagtataaaatgtaacaggggttaaaaggagggaaaacatctaacacaactaagtttattacagagaatctcacagaggccatctttgctaggttttaaagaataagcagaactccagttggttaaaaaatgggggcaggtgtggaaagggtttttcagacagagagaataatgggaataaaaaataaagaagtaaaaatatgtaaaatatatactgttgggtttttgcaccacttatgggactctacagaagaaagtttagaaatgtaggctactttaaagtttccttaggaaacacactagcactggatgaagagtgactctgggcatgacgtgcttactcctctgaactccaggaagacaggacagtgactaccacactaccaaattcctttcagatttcaatccaggcccagaggactcagcctctgttctgtctcctcatctgagtggggcttactttagacttttatcacccttctcaagagggcatggagagattgagtgagagggaggggtctgcaaggagcaaagggaaaggggagggtatatagacctgctctcctctcccaggccaatcagggcccacgagtcagctacttctttaatgcaacactgtgttctggcactcaccactgatttttatgtatttgtgtgtgtgtgtgtgtgtgtgtgtgagtgtgtatttgtgtgtattaagctattatttttattaaaaaataagaaatgggccgggcactgtggctcacgcctgtaatcccagcactttgggaggctgaggcgcgtggatcacctgaggtcaggagttggatgaaaccccgggagatgggtgaaaccccatctctacaaaaatacaaaaattagctgggggtgttggtgtgcgcctgtaatcccagctactcgggaggctgaggcaggagaattgcttgaacccaggaggcagaggttgcagtgagccgagactgcaccattgcactccagcaagggcaacaagagtagaaactccatctcaaaaaaaaaaaaaaaagataagaaatgaatgatcattgtaatactcaaaaggctgacaggaagaagaaaaaaataaaagtacagataattaacaaatgtttattcctaattaagatttgatattaccacttctgacactgaacattacacctttttgtttaaatggtagggggtggagaatactttctattaaatatataaaatcttcaatacgtataagtgttctttacctaactgagcaataaggattcttttactctctaaggaaaacaaaacaaaatacatacatatgtatacatattttcacataattttgttctttatccaactagttagccaggataggcaatatttatctaatgtctcagagttttagtgtctacctatgaaaaacaggtgcgttattttttgatgctaagattctatgcgcactctctagtgatccttataaaatagttgattttaaaaagccccagaacttgttctgatgatgcaaaggagggatgatgaacacgggctgagagtaagagaccataaacagccactgtcattcagctacaagggaaataatgaggcaacttagccaggcatctagcgaagtgaagccccagtaagcattactatatttggggaactcatatttaaagtaattaatagctcttcaactcttagtggccaactgacttgagaacgggcaaaaaaaaggccattaaaaaggaaagccaaagcttcatatccttggataagtctattactttttaaggctcaatgtccttctcctgaaataaggacacaacactgacccgaatctttgcccagggtgattgtgaggatcagatacaaagtatgtgaaaaccacagtgcactaaattatttttaaactcatttttaatctaagcttttctactatcaaaactacagccaattaccctttcataatcccaaaacagtaatgtttaagtagcagatctttttaaatcagtgttttaaagatttagatgttaagaatttaatattacagccttccctaatagattctctagggttacactaacatgaccaaacagggaaaatatacatttgaaagctgttatgcagtcaagtggcagaattcgaaatggctatgaaccaatcatttaggaggttaaaatctctccaaaataaaggttgacatatattgcactggtgaccacttttaccaatgcagttgtagagttttccatggcagaatcctcctgaaagatgctctaaccctaaaagctagaaggggactctaagcacagaaaagacatgaagccaggggtatgatccattaagtctttaaaagctatctgcatctatgtaatacccatttaatgtccagagatgatagaagaattgatagcatacaatagacaagcagatacttagagatttaacttctctaggcttctacttcctcatctacgaaatgggaataagagtctcttctgtgggatagactgaagaggagagcacacataaagtgctgccttgcacctggagcacaggaagtactcaacaaatcaaagttatcagtaccagggagaagcagagtatttcaattatctttgtccctaaactaaaaaccttgctccttaaaatagtatttgcactaagatctcctccaaaacgatttgtcacagaagtagagcataagagggcattctataaataagaggggactgtgtagcaggacactggggaacaataacacttacttatccagtttctgacattgaggaaactttgctcatttgtcagatcaaaaagtagaagaaaacccatagcatctctgaagaacgctgtcgttaagctacgaaacctaggaacataaaagcagaatggtcagttaaaccacggccccactcctgaaatataaaactacaagcaatgccttcagcctcttacaaaagtttaccaataacaagctacatggtgatatttcaaaagtatataggatagttatttatcacttatatcagtttaagtgttaacagaccatgtgatttgaaaaccgaggctgctggagagggatgacaagaaccagcttgtgatcttagtctcacccaagaatttatgtacaattatgagttaatttggccaaaagcaatatagtgtatgttttcctattgtgaaagcttgacttgacattacaatgtgttccatgatcttttaatttcagaatatgcagagatctcttatctctgatagccatttgtttggcttgaaggtaagaatctcttgactcagaccttattctgtcttggtactctgccttccaaggctttatccttctgtcttccctgtcttctctctctctctccccacccccaaccccaccctatcaccagtcagtttcctctcgtctttgcctatatgtaaaacctgtaactgacaggcaggctccagggaagaaaatattggtatgaatttgtcatctaatcagcaatattaggtttttctcaaatacttttaatcaatgtttttattaaaaagagttcttggccaggggccatggctcacacctgtaatcccagcactttgggaggtcaaggcaggcagatcacctgaagtcaggagttagagaccagcctgaccaacatggagaaaccccaactctactaaaaatacaaaattagctgtgtgtagtggtgcacatctgtaatcccagctaatcgggaggctgaggcaggagaatcacttgaaccagcaaggtagaggttgcggtgagctgagatcacgtcagcctgggcaacaagaatgaaactccgcccaaaaaaaaaacaaaaaagagctcttatcttttagagctacattaccacaagtattaaaaatgaaataatatagtgtctggaatttgcttctaaattatatggtaagggggtggggtgagaagaggtaaggggtataaatgaaattctgttggccacaatttcataattgttgaagctgagtaatgggtacataggtttatcatataatccttccacttttgaatatccttgaagttttccataataaaaagttaaaaaacaaaatccttcaaggtggctgtgaaagaaaacagaagttctagctaactgaaagcaactttatatcaagatttcatgtggcttattttggtcaagtaacccctggtcacatgaattaattccaaccagatatcccactagatttcaacagtcaggtaagaataatgcatgtaacttggccactttcttgtggttgagtaaatagcaaaaggaaatggagcaaagtatctaagcaaaaaaaaattaaaagaaggaaaagaaaaaagtccacaagtaagagtcataacctctcccttgaccttgtatgaaataaggccaccattctcatctcagacttgacaaatttcctgctaatttggcagcattcaagtgcaaaccaacgaattggctggctttttcctgctcaggtcactgtttgaagaatgtaactatttttccctttccttcagtaaggagcacataactgaagatctcatacctctcctgccctgctgtgtcccataactgcaggtggattctctggcctctgccagtggctccatccggcccactggctctgtacacctaaaacagcaaagtgaaagagaaaacaaaagagaacttctaacaccagcgaaccttctcacctttttgttcagtacaaatcccaaaggcatctaaaattccaaagagaatgccatctggaatacaaccatgtttgtatttatgtcaaataattatatccaggtaatgtaataagttatattgaaatatatacatatatatcttataaatatattgtaaaatatgaatacaaaacaacttgtataaaatataataattagtttacctttcctcaaagttctcttgggtcactagtttcaggaaatattacttttctatggcttttcccaatctcatcttttttgtttgtttaaccagggggtacatgtgcaggcttgttacgtagatagattgcataatgctggggtttgagcatctattgaattcatcacccaaacagtgaatgtagtacccaataagtagtttttcagcccctctcccactcccttcccccttttggagtccctagtgtctactgtttctgtctttatgtccatgcgtacccattgtttagttcccacttataagtgagaatgcatgtggcatttgattttctgtttctgcattaattcactgaggataatggtccccagctctatccatgttgctgcaaaagacataatttcacttttttatggctgcatagtattctatgatgtatatgtaccacattttctctatccaatccaccactgataagcacctagggttagttccatgactttgctattgtgaatagtgctgcaataaacatttgagtgcagatgtatttttggtagaacaattttcccttgtcccatcccaaattttaaaagtgctcttaaaagaattttatagacaacactcctagaacagcagagaacggaccatcaaaaatttcttcctccacaatagcaacaaaaacagtggtaaaaattgtccaaatcaactttttcagtactctaggaattaacaaagacttgcaacattccaaggagcatttattcaagaaaaacagccgaatatcagtaaaaacagtaagctttgaggtgttttttaccttgccctattcccatccccctcactcaagcttttagaagacttaaaaaccatgtgcacaaatgtggttgttgtgaaaacatcagcctagccaccactgtggacagcagaggaacaacaggtttggagctccctaaaagtcccatactgagaaaaattgtcaggaagccccttggaaagctccatgccccagctttgtctttctttgacctcactcaaagcttgctctttgagaacagccctatcccaagggcatttgttgaaaactatcagcagtaattatttaacatcacagctaccagaggtagcaataccagttagggctaacaaaagtctaacaacaacaacaaaaaaaaaatttaaagaaaaaaataggaaatgagatttctataatgctcccaaatattccttggaacctaaaaggccatgttcatgggcagggctctacaaatgcccaggaaagatctaaaaaggtcctaatctctcacttctgactgactttgaggttcttctcaggcagaaaataaaagctaaggcagagttgtaaactgcctgcagtagtattaaacacataccccaacaaacacacagagactctcagaaaaagctaagagacttattagttcaaggaatttaataaactctctccactcattagctgtccactaagttgactgagcagagacttcagtagctgcatacaaagaatacagattttgcagaattatcccagaaacataattaaacaaacagcaacgacaaaaataaataaatatgcagtaaaaacaagaaacccaggtaggggaaagaatctgagtttctagaatagacacattattttaaatgtccagttttcagcaaaacgtataagacacacaaagaaacaggaaagtatggctcatgcgcaggaaaaaaacaacgaatagaaattattcctgaggaggcccagatgttaaacttattagacaaagactttacatcaggaattataaatatattcaaagaacttaaaaatcagtaacatagcggtcctctaaaattaaaggataaattaagacaaaactgagaaaagtcatctctagcagacctatcctacaagaaatactacagacaactctcaagactaagctgaaaggaaactagacagtaacttaaatccacacaaagaaataataagcaccagtaaaaatgtaactgcatagtaaatataaaaaacagtataaacgtggtttttctttgtagcccttttcctccactagattaaaatttaactgcaggctgggagtgatagctcatgcctgtaatccctcagcactttgggaggctaagatgggtggatcacttgaggccaggagttcgagaccagcctggccaacatggcaaaaccccattactactaaaaatataaacaattagccgggtgtggtggcgggtgcctgtaatcctagctacttgggagactgaggcaggagaatcacttgaacctgggagacagaggttgcggtgagctgagatctcaccactgcactccagtctgagcaacagagagagaccctgtctcaaaaagaaaaaagaaaaaaaaattaactgcatacagcaataattgtaaagctgtattgatgatggcacacaatgtagaaagatgtcattcgtatagcaataatggcacaaaaatatgggagaaaacagagccacataagagcaaagttttacacagtattaaaattaagttgctattaatcaaaattagattgtgaaaaattaagataattgtaatccccaagggaatttttaaaaaagaactcaaaaacatataacaaaaaagggaattaaaatgatgcactagaaaatagaaaaagaaacaacagtatctatcaacagacaaatggataaacaaaatggtgtatcaatacaatagaatattatgtagctataataagtaatgaagtcctgatacatgctacaacatggaagatccttgaaaacatcaggctgaatgtaagaagccagacacaaaaggccatatattattccatttatatggtgtgtgcagaagccattgatagaaaattcatggtggctaaggggaggtagaaagaggaatgcctgctaataggtatgaggtttctttttaaagtgatgaaactattctaaaattgaatggctgtgatggccacacaactccgaatatattaaaaaccaccgaattttatactttagatggatggatttcctttttttgtgaattatatctcaacaaatctattttttaagttatacaataagtaaccaacaaaaataatcacatacatatatgtagattctatcaactacacgtcaatactaaaaatttcattagggccctactgttattcagtgggtcttaatctctataagcctctctggtagtagaataaaatactagaatgggcaaaagggaatgttcttctgtcttaaaagccagggacctttccccctgacagaatatgatccattaaaggacctttgtcattaatttcctgacaactggtttacctgcttcaggccaacaatggatttttcaacaagaaatgtagtctaaggagaaagccatctttcctcatctgcaactgtgacaccatgaccttctgccttcccctccaacactagaataactttcagtctcaaagtccttaaaaaataaataaataaaagtttctcccttcaacattctgcagaacatcacattcactactggcattccccactcctactccaacctcaccctcctggcagcagtgataagttctgccagttagtgttccatgtggaactgctgagactttattaggagaaatgccattaaaaataataagataccaaaggtggaagacacagcccataaaacaagagtatgaggggcaaggtggttggcaggcttcaagacaaaggtagacaaataactttcggagttcagagggaagatacaagccaaaagagtaccaaggtgacattttaaagaactgtccacttccactttgtctgcctggttttatatgaagtgctgtcagcacagccttttcaatcatgttgcctggattgaacataactcactttcatatgtacctttaatttcagatcccaacctttgtcctcctaattcctacaaagtaaactaaacagaccagcaaatgttgacttaacgattacatttttacatagaaggatatagaacttaccactcttttttccctgaaatcaatgcccactgttgtgataaatttggagttaaatttaccatctgtatattggtaaagtacactggtcttccctacaccagagtctcccaaagctaaaaacttgatgaggtaatcataatctccatcagacataatgaagaactcagtagttcacctgtaaaatacacacaaaattttttaattaaaatccattagaaaacattaattatccatttaaaaagtgacaacaatattcagtttaacacctaatgttaacctgtatgtctacgggttgtatgaaaagagagttacatacatattgttcaccatccttgaagacctaataactagctagatgagaagctattgaaatagtaattaacagtgtagttttaatttaacacacaggtaatcccagcactttgggaggccaaggtgggcagatcacctaaggttgggaattcgagaccagcctgaccaacatggagaaaccccatctctactgaaaatacaaaaattagccaggcatggtggtgcatgcctataatcccagctactcaggaggctgaggcaggagaatcacttgaacctgggaggtggaggttgcagtgagccaagattgcgccattgcactccagcctgggcaacaagagcaaaactctgtctcaaaataaaaaaataaataaaaataaaaataaaaataaaaacatacatattatagtaccattaggacaaaaatttcaagtgggaatgataatcaacaagaaggtaacagtcactaagtcttatctgtagaccatatagaacaaaaactaatacaagaaaaacagaggaaagagaatgttataaggaataacagtaatcattagagtgcaagtggttccaatttcccctcctttttcaaagtctcctagtgctaaaatttgcaattgcaaacataaggaaccagtccaaatgctcaccagtcaatgagtagataaagaaattgtggtacaccacaatttttttatctgtatatatatacacacaccacggaatactactcagccacaaaaaggaacgaaataatggcattcacagcaatctggatggaattgaagacaattattctaagtgaagtaagtcaggaatggaaaaccaaacatcatatgttctcactcatatgtaggagtgaagctatgaggaagcaaaggcataagaatgatacaatggactttggggactcgggtggaaagggtgggaggcgggtgagggataaaagactacagattgaatacagtgtacactgcttgggtgatgggtgcaccaaaatctcagaaatcaccactaaagaacttatccatgtaactaaacaccacctgttccccaaaaacctatggaaataaaaaaaaaagaaagaaagaaagtctcctagtgctagaaccttgccttttctctctttttacatggacatctaggcaatttcatttattctattcattttcacatgttattacggttccttcaaagacactgttatttcacaagtaaatttagtccctgcttccttacatattactattaatatgtactacatattaagccagacttctctagagtatcactgctcacttgggaactgagttccagatttgaacagtcactgctcagagaccacagtgccacaaccaagggctcgcttacctatgtttacctgggtactctatcaagaactgctaaaaattcagctcttcagtaccgactaaaacaaaagtccaccttaaagaagaaaaattcatttatatcagcaatacctaaccacggctatttttggttctttgcaatcagcacttttcatgatttgtatttaccttctaaatagattcaaacccaaaatatcagtccaactagaaatgggatctctctccaggggaggtttactttttcattaaaattttattgatacataatatttgtatatttttatggggtacatgtaatattttgttacatgcatagaatgtaatgatcacatgaaggtatttagggtatttatttcctcgagtatttatcatttctatgcattgagaacatttcaagtcctctcttctagctattttaaaatacacaatacatttttgttaactatagtcaccctagtctactgttgaacattagaacttattctttccatctaaccatatgcttgtacacattaaccaacctctctccgtttcccccgccaatgccaataaactctcctgaaaatcataaaaacaactagctatctcattaacactgacgactctacatgactattcaaacatacatatttatccatctatacacatgccagatgtcctacattggatgctactgactcccggcgttatcccctttttacccagcaccatatccagaaacttggctgccatattcagtgcttcctgtaggactatttctatatatccataaaattaataaaaactcagacaagaatatttactggttttcagtgttacctccctcaccccatcctcaacttggggactcaccttatgctgaaaactcctgaatgctgagccccaaaagccactgcagtgtgtttcctcagagtgcttcagtgcagatctgcaacctcacgtttcaggtatggctagcccgtggataagggcagagcctctacaaacattcaaaattctatttgcacactataaagagtgacacttcacagatgatgccttacctgtctttatagcttggatatttgcaagtataggtcaccagtattaatgacatataacagaattcctctccaaaaaacgacaacttggacatcaacattatagcacgtcatatcacagcatcacacctggctctaagttattggaaataagagctaagaattgaaaagcaagtccagataatgttgactcatttgagggcttcccctcaaactgaatggagcagcagataacaataccgatcctgcagtgagaatgatgcaagaagacactgtgactaccttatttcctatttatttttaatttgaaaaaaaagttggtataactatgttttttacatcacttagggtacaggaaaaaatgctgtcaccaatggcatcatattctagaattctctaaactcacttaagtggaattcaaagacttaaatgaaactatctctaatgtgtttcatttccatgggtaatcacacatgtaagtctacaaatgatcttcgtgagttttgttttctattcacaatagcaatactgaccaagtaatcataaagggactgttaacaaaccaaataccataaattgaaggtatagacaccaccatcaatattaatcatagtttgcacttttcagattgtatctttaagacaattatctgctttcttgatctgaaaataaatgttcagaccttccactctctgggttcagttttctaaagggtaaaacagaacccagagaggtagactgatttgcacgatctagaatctagatctcctagctccaagtccaatgcctattctaccccaagcttcatatccattattcatttttgttataaatgcacattgggctttaaagtgaccagtagtatggtatcttacaaggtaacctaataggaaactcaccaagtcaagcagagctgggtttgaatcccaaatctcccagataccaattacttggatgtctttgagccttagatttccaggtttctgttctataaaaaagaatatacactacctcacaccattattctgaggattcaatgagatactgtttatggagtgcccagcacaatggttggcatatactgggtacttaactgttggctcactttattctccccattgtggacgttcagactgggtctgaagatctagaacaaatttcagattgactctggccagcttaaaacatgtctttctagcacaaacgattgctaactggctcaaagtggtcggctgagtcaacaaagatcactttcaaataattctgatcctttttggctggttctaaccatttgcaattcatttaatacagatatgtttacttcaaaagagttctgatcaacttaaaaagaggttcaaatccatataaaatacaccatccattttagcaagttcatagttgttcaaaagaatctggttcatattattttacggtgagttaaaagaggttctcctacaaaactttctgactttggctaaaacctgatatatctaaccaaaattattggagtctcattgtaattagctttaattgcttcagactggttttagctagttccaataggctctgacttggacatgcaggttctgacaggcttctaaaagttttagttggttctgagtatattttactaaatcaaactgtgctgacaaattaaatccactttcaattgagtcacactggttctacctctatcgaactgctggaaactagtttgataactatagttatctgtaaaattgtttttactggtttagaccaatatagactggttcaaaacagtctgaaatgtttcaaattaatttcagatgttcaaacagttcaaaactagaaatgtaaaatgacaatcagaagcaacaaaaacaacagtttggtgtttaaaacttgtgccaaaccaacaaacttaaaattttatttttaaattacctcatttgtagatattctgtatccaaaaatttatctccaccattatatactgtataatcacactcgaacagcatgtatgtgttcgagtacagtaaaggattgggagaaaggagcactggcataggagaagatgacagataacagggaaatatgtgatgagtgacacaggcttcctgggttgagaattcacctcccattttacctgaaagacctggcagcaaaatattcacccatgacccaacaatgaagattctgattggggaaaacctttagcaaatttggaggctgtctagagtttgttcaaaactgatcacgctgaccaggctggtctgggttaaaagagaccagaattccaaagaataagaaaatttcagagaaataaagggagttgggggcaggcaggttttcaaaataacagatctttcaaggtttgggcatggtgttgagggcgacagccttcttatctgagcttgcagtccagttagtgaaagcctggagttagtggaattaccccatctttcagcagaaaatcattctagtctataccagactatactcccacctccatcctgcaagtccatacgtggctttctcatcactacttatcactactaggtgaagacaatttaatgttaagtctcaattgatggtatattttcatataaacaatttttgttctcttatttattattcaagtcctgagtagtattcctagggcctgttttccagaaagaaaatactccactcctcaaatacagaaatctaataacgtaaatgatttttgtgttggcatttcatttcaggaaggagtaaacagtgagaacacacagtaccagaatttgacatttggggcacccaaacaacgttgtatgctcaccatttcctgcttgtactccagcctactgaggtttgggaagccagttcacaagggcttccctctgacactctcttgctgaaaatgggtctgaaacctaggtcagatgcccacatgtcaagcactttacacacattagcacaacaatcctcatcactgccctatacatagcatatacactgtctccctcagaaagatctagagctgttctatcgtaagtgcttcagtgagggcataagtaactgagtcttggccagtctacccacatattagcatgggcacaattccaatctattgttgagagacaggaaaaaaaaatggaggttaaaggcagaaactctacaaccaagccacctgtatttgagtccagtcatgtaactttggaaaatttatttagtctcttttgccttgggctcctcacctgtaaaacaggaagagattctattttatcaattctaacatgctttcttattttaacttctttaaaattggggtgcatcttacatttcagtcttacaatccaagacatcttgcaattgctattattgcaattgcaatagagatacaactgtgtgaaagctttttgttagcatcttctagcaaggtcaagaatgcatcatcaatatattttagactcaatgaagcacaataataaagctatttctgagggctgttgtgaggactgagctagtgtatacacacaaagtttggaacagtgcacaggacatagtaagttctatgtaagtattagctgttattagcagcagcatccagcaatctggcttccaagggtcaatatgcaggcaatgttcttttctttcctagaagtataagaaagtacattgagcccctaaaccaaaaattaatttttaaaaataaggatctgctaagagtatttgaagccaaggttatatatttaaactctgtactgccttgagaaaagtgctgtctacctcaaggaaatatcttctaaaaagtcaagaatgaccttaatttgggatatgcaaaagactttcttattcagctcacttctctctctcctccttatacaaatattttttcaaagtgctctccaccctcactatcatcagattaacaatagaaagcaaggaacacccatttcctcaacatgtactatgtggtgttaattgcctggtgagagaaagtctatcatcttccttatttttaaaataaaacatattttcacctgtaataccagtgactgaggaggctgaggcagaaggatggcttgacgtcaggagttcaagactagcccaggcaactagcaagacctatttatatatatatatatatatatatatgtgtgtatatatatttgtttttttttttataaattaggcaggtgtggtggcattagcctgtagtcctagctacttgggaggctgaggcaggaggattgcttaagcccaggagttcaaggctgcagtaagatatgctcacatcactacattgtagcctgggcaacagattaacatcccatctttaaataaatttatttaataaataaaaataactgcacatgtacccctgaacttaagttgaaggaaaaaacacttaaagatttttaaatgtttttaaaaatactttttaagtgttttttaggaaataagatagaagagagtagatttagttaagaggaaagggaaagatctagttctatttctccctctctctctctctgctacacacacacagacatatcacagcccagattttccatgaagtgtcatattaaagtgaatcatagactccaaccttaggatcccccactattaggcagaatcattctaaaactactctagataggtcagccattttccgaaagccaaattttccctctattactcatatttagtacagagcaaaagaaaggggaggaataatattaactgaacagcaacatgtaataaatatacttgattttattttatctgctcatcatccttaaaaagaacttcatgtctggacaagactcataccatatagagactgatgttttctcagtgtgatggcaaataggcttgagttcaaattctgacttttctactttgtatgatctgatccaagttttttatactaagccttattctttaaactgtaaaatggagataataacagtactaatctcattgggttgttttaaggactaagtgagataacccacagaaagcttttagcacattgtttgccctgtgctaagtgttcaataattgagacttattaaaaatactattattaatagtttcaccacgttcttcattagcaaggcatgtaattttataacctattcttaatgtaaccagtacctgaaccttcagaaaaatcacagaaagaaatttaagttaagtacaatgattttggggcgccctatccatcacaaaatctaccttggcattccaatctaagaatgagttgtatctgggtgatttttggtaatttcagacctaggagtacccatcagttgaatgctctaatttccagaagaggaaactgaaactcagagaaggtaaatgaatagtctgaaataaaccagctagttagacatggggctaatctagatctcatgtctcctaaattctagtcatgtatgcatatttttcttctgtctgtattccttccttcagagtgagaaacctcagttacagctgcttgaattcaagaatcaaaagttttcttcagtgccagcagttatagcagtgataaaatgctttataattaaggcttgtgctctcagagaggttgggttgagggatctgtacttctgtgctcagagtccctctatcaagaagcccttcatcctgatgggctctgccaaggacagaagtcataaattgggagcttgtctgcttcttgctggtcattgcaaatccaagaaaaaaaaataactcttcttaatacttgtaccatatcccataaatcatctttctttcctatggtttcaaaatgaaaagcaagcagagcaatcatgaaatttttcatttacctgtagaattgctcggccccgttttctctcaaataagtattttcctctcgaataagattattttaggccaggtgcagtggctcacacctgtaatcccagcactttgggaggccgaggagggtggatcacctgaagtaaggagttcaagaccagcctggccaacatggtgaaacgctgtctctactaaaaatacaaaaaattggctgggcatggtggcaggcacctgtaatcccagcttcttgggaggctgaggcaagagaataacatcgagatcacaccactgcactacagcctgggcgacacagcgagactctatctcaaaaaaaaaaaaacattattttctctgacatcatgtctctgtaaggacacttctggccctctctctttttccttcattcaataaatattgattgaatacttattatatgctaggtgccagggtacaatggggatccaactcagttatattcaatgtggaaaatctcttactcttgcctaccttagaccttatagttttagccatgtcccagtctaacttctcccaacaactatacctgcctttgggttttcaaataagtccatctttctgaacattttaagcttctctcataaacataacacaatatgacatcaaaattcatatcctaagtcacatgtttgacaaagatgcaaaaggaataaacatggaaaaggaataaaagtgtgaagcttgggcgggcacagtggctcacacctgtaatcccagcactttgggaggctgaggcagatggatcacttgaggtcacgagttcgagaccagcctggctgatatggtgaaaccccatctctgctaaaaatacaaaaatacaaaaatacaaatggctaggcgtggtgatgggtgcctgtaatcccagctactcagcggggttgaggcaggagaatcacttgaacctgggaggtggaggttgcagtgagcagagatagcaccactgcattccggcctgggagacagagggagactccatctcaaaaaaacaaacaaacaaacaaaacaaaacaaaaaaacacataaagctcagtagagaagaaagagacagcctcaacctcctgggctcatgtgatcctccagtctcagcctcccaagcagctgggatcacagcagtgcacaacaccatacaccatgcccagctttttgttgttgttgttgttggggggagatgacgtctccctatgttgcccaggctggtctcaaactcccgagctcaagaggagaaatttttataaagagaaacataaggtatattataaagaattttttatctgaaaatattttgaattttttagaatggttcaatatttgagtgttcctatgtagcttatggacttcacttattgcagtgcaaaattatttttgcagagaaacaggagcagatgaatataactattacttttcaaatagcacagaacatcagcatttatgtgaattataacaccacatgttctttcatataatttaacatccccttgttcagtgattgatttggagaaaatgttcatatacaaatgactggcatagaaatataaaccttatcagtacttttatgtttaacgttaaaaagcagtaggcttttcttgctttttttgttttattttgtttttgttttaataatgccattgtggacccatacccggcattctggaaggaaacacataacagagacaccaaaagcaaggaagagaagtcacatggcatgaggcaggctagaagaggcattttataatgtaccaagatatatgagtagggacacttgtatttaccaaatgagccctggccacaactctcacagaccattacaattcctacaccctgaggtggaacacagctacttccacttcaaaagcaagatgcatactgcccaatagcaggaaccccatttccataagtggagacagcctatgtcttccgtgcagtttactcatctcaacttctggtctagatgtgcgtagatatggttgcgccctccctaatatgtcaagagtggaaaaaatgatgttataaacaaagagctcatcttgtttgtgcaaaatctcaggcggagagaagtggaaatctaacacctttgaaaagtagaaggaaacaggaatatgattctttcttgtttcttattaaaagatgagtttgattttatctaaattcagaatattagataactgcattttatattcacctataacctaagattcataagtgcattcctatcagtacagtattttataataataacataagtccatccttaacagtgatgttgaggcagcagagaagttcatggctagaaactgttgagatcttaagttctatagcatttggcttaatatttataaatgcacttgctacataggaatattccatttccctcaccaactgctagaaaactgctagaccaacttctagcagatggtgatattccactatagcaagttcttcagacaaaaaataaaattatctgtaaatactgttgaattaaatatacatttctgggccgggcatggtggctcatgccagtaactccagcactttgggaggccaaggcaggcagatcacttgaggtcaggagttcaaaaccaacatggcaaaacccttactttactaacaatacaaaacaattagcctgtagtcccagctactcaggagggtgaggcaggagaattacttgaatccggtaggttcacgggcgataatgccactgcactccagcctgggcgacagagtgagacttcgtctaagatatatatatgatatagatatatatataatacatataaatatatatacacatttataaatgcttccaaaacaccaaaacatacatcatttttaacagcatcttccagatgttcataatttttcttaaagagaaagaccaggatgaagaaaaaaataagcagtcatagcccagaaatccatcaactatttctgaaatgttaccatcacctcagtgggtgaccaacataacccagtaggcaaataacacaaacaactgtatgttaggaaacaagaggcgttgaaatgattcctgaaagcagaaaacgttctggaagaccaatgtcaataactcaaatgagatatcggcttttttttttaatttattgaaaccattgacttcatttacccaaaagacattatttgttgcccaaggctcttccaggatcagaatatgaatgtttatagagatttatggaaagtaaattcaccaaaacactgggtcttatagtacttatagtttgtgacaagtaccccttgctccatagatatagggtaatagaaaaaaaaaaagcacacatagaatatatgtcattggtaaaacataggcagtacagtggaaacaggtgtggctgtttgatttgcttagtaatatctcaaataatgtgacggcagtctcagaatggacacagccactcgacactccaaaagtctgctcaacccatagctaaacatgcctcttaccaccaccaagaagcaagcagtctccaagaatttggaatgagtgcaaaatctacaaagtatgctcccactgagtggttgctttttgtgagcacatagaagacagtgaaacacagacttcggagtcaagttctcctaaattcaaataatagtataccacctcctacctgtacaaactgaacagcaaaatgcctgatgaagatcaatgaatcatagctattcttatgattatgacagattaaggcttaaaccaggcttgagcactgatcctggggctttttccagtctaccttcaggatgacactgagacttcataaagctatcaaagaatggagtggaaatatttcctgaaaatgaaaaaggaggaacaacttaagctacctggaaggtagaacatctgcaagtccaactggtaagtacagggaattctggtattaacaagctctgaagaggtaaaatgaaaagctttggttatctcagagtgccaccaaacttgtgggcccaaggctcaaaggcagaaaaaaatagaaatgatagcactgctaccccagccaggactgagagaattacaaatcagatagcactcaaaagaaaaaaaaaaaatcagatagcactcaaaggacttcacattgcaaagagaatttccaagttgcaaaacacagacctaaaaacagtgtcaaggaatctgtcaagactcatcttcctagaacatgaaacatgcatggaaagcttttgaccaacacagactgactctcctattgcatctcaacttcctcaagttttctgtttgctgcaacacaggaaagatgttaatctgttagggaaatgcaccaactcaaaaagcaaaccctttgctttctgaaggagcaatgatacttctttccttccaagaaacatgatgaattagaagcagccagacgtgttaaacatgactgtccaaataataaaaacaattagacaaacatccatgagttggcagtaactggggaagagacgggcgcatttatcattgactttgtacaaaatgagaatatgagtaccatcaatttgacacatagatacttacaaagactactaagaggcaccaggtatggcttcatgcctcccttgtcctgcctacccaacaccctcttcctcactaaccacttttttttttttttttttgagactctcactctgtggcccaggcgtgagtgcagtggcgcaatctctgctcactgcaagctctgcctcaggggttcacgccattctcctgcctcagcctcccaagcagctgggactccaggcgcccatcacctcacccagactacaggcactaatcacatttaagcagatacattctctgcccacaggaatatgttcttcaggtacatggtggcatgctaaagcacacaggacttccatctcttcacagctgattttcatttccatagtcaaacatccaccctaccacaccccatgctgtgttccaacagcctcacttccaaccatcatctgggtgccataacctctctacagtcttcttcctctcctggctttcctgtccctcatctccaggtactattgccaaactccggtttgcatgtgcaaaaagtgacatgaaactaacaatattagtgcttttcttgtaacacactgagttgctatatcaacttcaaggtgttcaaccctcctcaataaattcataatgctgctgtgtcttcaggtactcccacttttccaatcaggaagagtttttcccctgcaaagtatgggaaaagagccattctggaaaaccaagtgtttctaatactatgccagttttggtttcaccataatgttaatgaaaaggtagcattctgatacaaatagatcacgtgtttaaaatattagtatctataaatatgtttattatatgccaacttagttcttttaaaaacattaaactaggctcagaaaaatcaaggcttttcctgatgttttaataccactaaatcaatgatgccaggattcttagcttcttccatttgttgtcaataagctgtagacagccagctatatataggtctttttggtatttgtcaagtctactgtctccattaatatatatttacaacacatgtttaaatgtttccctaaatatcatattctttaactgaaccaaaaaaaaaggaaactcacctaatggacaaggtcaaatcagatatatttcttattgcttctcaaagtctttccttatttcacctattattcagtatgcagagtctcagaactgactgtttgcatttctatcagcagctgtttatagaatggggtgtgacttgcgtttgcttatgcaaaatgactgaggaacaacaatgcacagccatccagccagtttctaactcagcctgtcagattacagttggcttttttgctattattgttgtccatctctaattttattgcattgtgatcactaaatgtggtctgcttaacaacaaatttggtggaatttaagaggaattaagtgtatttatttagaggcagggtctcactctgtcacccaggctggagtgcactggcgcaattatgtctcaccgcagccttgacctccccagcttaagcaatcctctcacctcagcctcctaagtagctgggatcacaggtatgcaccaccaaaaatggataattctttttaattctttttggaagacaaggtgtcactatgttgctgcccaggctggtcctgaactcctgggctcaagtgatcctcctatctcagcctcccaaagtggtgaaattacaggcatgagccaccatgcccgggctgaattaagttttataaatgttccacgattatgtgaaaacaatctgtacaccctgttagttggatgcaaaattacatacattctagtcaagctagttagttgtggtttttgatctgatatatccttatttatctttttgctacttcatctgtttctaagaaaggtgtgttgaaactcctagatcatattcatttttagaaaataagcccaaggtcatgtcttaaagaggatgaatataaagcataataaaagaacaagcattgcagtccttattcagagaagcattaaatttgtgcttttcagtctgttttctatgaaacgctgggattcatgaaaatactttaagagttctgtaaacttattaagatttttttttctatgtttgttttttgtttttttgagacagaatctcactctgtcacccaggccggagtgcagtggcctgatctcgggctcactgaaaccaccacctcccgggtttaagcaattctcatgcctcagcctccctagtggctgcgactaaaggcctgcgcaaccacgcccagctaatttttgtattttttagtagagatggcgtttcactatgttggccaggctggtctcaaactcctgatctcaagtgatctgcctacctcagccttccaaggtgctgggattacagacttgagccactgcgcctggactccttctattatgttttttaaaaactggaataaaaaaaagtatatagtcaaataagttacataccaaatttagagacctccaagttatttacttatgctactttgttaagctatttatggctacctttaacgtatacatgttatttggaattcctataattattagttgagaagactgtactttgcactagacttctctcctttgcttaatcagaatggattaatttgtctattgtgaaattatttaaggaagtacatgtgaactacattcagtaaacggcagtcaaagctcaggcacatgtttcagcagatgtttgctttcatcctgttacaacagtcaattgagcaataaagaatgaacacaacatgttgcatcacaacattttattacagatcactatagagattattctttgggaagtttgttgtctgacttctagaagcatgaaagggctattctgggtttgggctacttctttttcatagcagatgagtgtcttcacagtcagttcctgcataggaaacctacataatgtcattgcaacaaacctttcattgcctcagaaaactgctctggcccagctggttgcaaactttctttagcaataaaactgtttcttcaaataaaatcttacatggcaccccaacatataaaacagatggcagcagagtgatattctaatgaaaggagtgaaggtcaagacaccaacgcccatagacccaacaaggacataagaagaatctcactgtacacatttagaaaatcattgcagaaaggtctacctacaatgcagctctgaatcgtctcatttgcctttggctttgtccctaaacacttcctctctgcctaaccacttcagttgacagctcatttgtaagatctgccacactcttttattcagcgtctcctaaagatgccacctctcagatatcaccttaacacacttcttatctgggagggatttgaaatgctttgggtgtccctggtgagaactgcaagaggagctatttaaagcttaagagaatgaaagaagaccataggaagagtcttgagaacaaccatcattgcgtcattcctggggaaagggtcctggaaatgagtcctggaaaaatcgaggccaaactgcccaaaaggcaaccaaagaagcagcatcgaccatgggataggaaactggtgtccttaaaggggcaagagagaaaactgcagggaggatgtctgtaaccagctacattggtgatcctttcttgtatctaaatggacactttgaggccatcagaaaatatgaccagattagtcctgatgggctcaaaaatctatatatggatgaaccctcaaaagtcaagatgtggtttgaagaacacaatgaaatgttggtatagcaactttaagataactgagaatatattattttgtgctgtatcagaagccactttatactaaattatagcacagaagggaataaagaggtacaaaaattttttaaaatactgatcaaagtaaaagttcagattttctctactaacttcattttctttctatgaattcagaagaaatttctagtattaggctcagctaatgtctgtgtcatgaggagtgttttacatgaaagtacccttgcttgaaaccattacaaagttccagggaaggagaaagcggcatgaggtagaggggacagagaaacccctagcactccctacctggcttcatgtcaaggcagcacaaaatcaactccaacccacagggattaagtacaaagggagttttcagacaggtgttcaaagtcataccaaggtcaaacaccaagagactaaggagcaggtcaacaaaggggaagagtagtttatggatctgggagtcttggaggtcagcattccaagaattcaagaggacatctgggcagacaacacagttcattagagcccacagcaacagtagctagaaaagaccgggggagggtggtgagggatataaaaactacatattgggtacaatgtacactattcaggtgatgggtgcactaaaatctcggaatttaccactatattattcatccaagtggctggatacagtggctcacacttgtaatcccagcactttggcaggccaaggcaggtggatcacttgaggccaggagttcaacagcctggccaacatggggaaaccccatctctactaaaaaatacaaaaattagctaggcgtggggacacgtgcctgtaatcctagctactctgaaggctgaggcacgagaatggcttgaacctgggaggcggaagctgcagtgagccaagatcgcactactgtactccagcctgggcgacagagtgagattccatctcaaaaaaacgtacagaataaaataataattcatccatgcagccaaaaaccccaaaagctattgattgatagacagacagacagacagatagatacagatatacgtatctatctatctatatacaaaaaaaaagacccatagtagttgttgctttatcaaaagccagagaaatgttctaaccttctaagttacagcaatttattcaatcaacttgctttcctctactctgccaaccagtttgaaaggctccctggccgggcgcggtggctcacacctgtaatcccagcactttgggaggccaaggcgggtggatcacgaggtcaagagatcgagaccagctggccaacatggtgaaaccccagccctactaaaattacaaaaattagttgggcatggtggcatgtgcctgtaatcccagctactcaggaggctgaggcagtagaatcacttgaacccaggaggcggaggttgcagtgagccaagatcgtgccactgcactccagcctgggtgacagagcaagactctgtctctgaaaaaaaaaaaaagaaagaaaggctccctaatggccaggcgtggtggctcatgcctataatcccagcactttggaaagccaaggctgacagatcacctgaggtcaggtattcgagaccagcctggccaacatggtgaaacccatctctactaaaaatacaaaaattagccgggcacggtggcgggtgcctataattccagctaccccagaggctaaggcaggagaatcgcttgaaccagggaggcagaggttgcagtgagccaagatcgtgccaccgcactccagcctgggtgacagagcgagactccgtctcaaaggaaaaaaaaaaagaaaggctccctaagtattccaactaggttccttcactaagtttcgttttcctacctaggcagatggaaagccaagcatccaggttagaacttagtcccccaaggccataccttgtctctgtcctcagctaagcccaggataaggccatctatggaaacaaagctcctattttcttaacatgcctctgagaaagatatttgaagcctagaggttaagaacataagggctaaaataagcaggcaagagggtgactcagaaagaacaagagccttgtttaaaaaaaaaaaagagtcggggaataaacctcaatacagatttactaacacagaaataaagactttgtgttagcaaagagactatgaatcagcaagagaacaacgcaagaggataaaggaaattgtagacaagagcagcataaaccatgaagatgtaagtatccacgtgtttataacatggataattgataagtaataagtaagtcttcagaaactatgtttgagtgttcaggggaaatcacaaaaacaagtaacagtacacttaattttttaaatgaggttgaaatgagattctgcatgagagataactgtaaagtagtaaaaaaggtttcagaagtcacacatgaaaatcaatctcataattctacaatcacattttagtatgtccacattttaaagtataaagttagactttatataccaacaaatttggctgcaaggtttgtaagttgagttttgacctcgagaaataccttcctattttttaaagaaagaaatattataatgacattccttttaagttattactttcctatacatacttgcttatcacataaaaaatataattgctatatagccatcaagcattaaaaataaaccaacacatctaacaataggcctcaatggtactaatctattttcctagatatatcactttaaaaccacatatgaatgtctaagaaataaaagttttttatttttcttttagaatctacagcatacaacatgataaaattattttgtataaaaattataatttttaattaatttgaaataatttccattaatttctgatgcttgtaagcattttagatatacattcctttagctcttataatatacttataaactgtgaaaaattctgagacaggaaggaacagatattaaaattctattacttctaatctaaaagccctccatcttatgttctctgtaggagacagaaactcacaaaagaaaatgtttggcttctactattaagaaattggacatttttcacatatattacagtggaaggggttttacatttctttcaggcacaaaatatttatgaactcgggagcagcccaaacataaagataaaatgcagcatgactttccaaaccaaaatctgcggcttatgtctatggatttttgtgacccttttgggaaaaggcagagttggaaacacaatttagttgtccaagtattagaacttttaaagcatctctttgatttatgaagaaaatgcacaaaaatacgttaaaggaggcagtaccagaaaatccagcaagttgctcatcactacacacctctatgcacagatgacatgagcaattatttgtctttccttcacttctgactgccagggctcagggctgaggtcctattgactgcacatagtataagaaagggaagagaaagttgtttcaacggcaacatcctcacctacttatgtctcttttctcctggttccagtaattaacagaatgatcacaaactgaaaccaaactgcaactctatcccttccactctcaccctggaagcctgttctcataaatccatcctcctcggggtattcctttaatcaatgtttattaatatgaatgaatgctttggctaacttgtacaggtcatctgccacttttaagtactccattcccacctcatgggtgtgtttcatctctttggtacagttgcatatttcctgaagagtctcattttgtgtattgcttctccactacccctcaccactggacagacaactggccagctgtcactcaaatgctaattgtgtctatcatctgctttctctaatagccttttccttccgctggttccctccattccctgccaattttatttagaagtgactcaaaaagtgtttggggactccactgatagctgtgcttttttgataattaaaccatatttacatccaattcaacagtatttggtaagcaattactacctttccagtacggtgctagcaactacgaatggcatgaaagaaacacaggatccaactgctcccttcaagaagttggtaattagggtgaggtggaatgatgtactcatttacgaaaaaggacggataagacaatattatcagggagaaaaacgtctggtacaccatgtgcaccagccagcacaagaaatcaaaagtgaaaggggcttcaagtcaaaagacctgaactctgctacttccttcctagctatgtgtcctgtggtgagccagacagcttccccacactgtttcctcaatatgggaatatttatctagcaagattattggaaggattaaagggtacattatgtgaaatgcattttataaactgtaaactactgggtacatgtaagatcgttgttttacaagtcaagtagaggctgggaggtcagaaaaggggagcaatctgtcgggcatggaggctcatacctgtaatcccacctattcaagagactgaggtaggaggatcacttgagcccaagagatcaaaaccaacctgggcaacataatgagatgctgttgtacaaaaatttttttaattagcaaggtgaggtggcctgtgccagtagtcccggctactcagaaggctgaggtgggaggatcacttgagcccaagagttcaaggctgcagtgagccatgactatgtcaccacactccagcctgggtgacagagtgagaccctgtctcaaaaaaagaaagaaagagggagcaatctgaccgtgactcaaagcaagagccaggacctgagctgagcaccttcttcaaagccaggcaagatttagctagatagtgaagaataggatacacagcatgtttcatgcaagggcatgttttgacttcaatttaacaagtattgaggaggcttgctaatcatttcaaaggatacaaatgtgcctcagatataatcctctaagtacaaaactggctgtaaactcaaaggaatgcttatgaggtaatgtgacaaattgaggagagcaggacgactaatccattggtatatggggttcctctgccaccatctgtttagacccaggataggtcaccatccctctgcaggccttgttttatcaaatatgaaataagaggtttgaccacaatggtctctttccaacacagacattctatgctgtatgattccaggttcaaagttcaaagcttagtcatgagaaatttaagtggggtcatggtgacagttgtcccttctatcacctctcactccttgaagatgagagcctagatgagggcagccgcatgggaatgggaagaaggggatccaagatacactaattttaaaataatagaacagagttccacatcaggtggaaaaggacacagcaaagagaacaccaaagaataaagcctagggggccaggaggccaaaataatgttgccaacagaagcaggacatttgaagtggggaagggaaagagttggaatgggcataaggtgtttgtgggtggtatcagatttttggaagggaaggatgatgagattggatcggggcaggttcagcatgagagatcatcaaagccacatgaccaagaaatgcttgaaaatcatccccagtccctgtggcccacatttacctctgcccttgagacagaggcagagtagccaacagtgaaagctccaaaaagagggccatgactgtacaagccacagaagagggaacatgctgttagttcaggatgaacaagaccaaggataacagcagggtgctctcagccaaactcaattacacaggacatgatgggcagtccctgctgctctgattaaactcagtttccagatactatctccctgttgtaaagttctttatctggcagtgagtaaaaaggaaatgtcagggaagacagctagatgtcctgcacagcattcactcctcttaggagcctgcaataggcacctcctcagattccaaacttaggccttgcccatcatcatccaccacccatctgaatgtatctcaatgaaaacacacactggctgggcatggtggctcacgcctgtaatcccagcactttggcaggccaaagctggcggatcacctgaggtcaagagatcgagaccagcctggccaacgtggtaaaaccctgtctctactaaaaatacaaaaattagccaggcgtgcaggtgggcacctataatcccggctactcaggaggctaaggcatgagaattgcttgaacctgggaggcaaaggttacagtgagctgagatcatgccactgcactccaggctgaggcacgagaattgcttgaacctgggaggcgcaggttgcagtgagctgagatcgcaccactgcactccagcctgggcgatacagcgagactcagtctcaaaaaaaaaaaaaaaaaaaaggaaacacacagtgaggaggagttgtagtatcactttcctccagctccttctctgcacctctcactctccttgaaaccactgacactaagaaataagaggttagaacccttctcttattacccttatctaattacttaatgtctctgtgttttcctagaagaagaattcactacctataccaggtctatcctgtttttggtctcacttaacactgctatatgtatgtgcctgtctcctaatgcacaccagcaagagtttctctagaaaattgctttccaaccttgttcatgatatttgtatgacctaccagggcatatgctcttgatcaaaggcaataggttttagggccccagaaaggccaggccctgtccagccaccctgagggacaaagggttcaacatctcaacacatctgaaccaattcagtgcacaccagggggagtcacctcctctagggtaggcgtcaaagcgtgaaattcctgggctatacctatgcacacatgttcagtaatacaagataatgtcaaattgctgtccaatatagttgttttacactcccaacttcatatcttcaccaacatttggtgcttgttgtcagacttctcaaaatggtaacacattgtgatctaaattcacatttctctgagtgctaatgagtgtgagcatcttttattagtttcttggccatctagtttcctcttattaaaatgcacatttgtatctttctcctatttttctattgggttctttttctttaagacagagtctcgctccgttgcccaggctggtgtgcaatggcacaatctcatctcactgcaacctctgcctcctgcattcaagtgattctcatccctcagcctcccaagtagctggggctacaagcacgcaccaccatacctggctaatttttgtagagatggggttttcccatgttagccaggctggtctcgaactcctagcggcaagtgatccgcccaccttggccgtccaaagtgctgagattatagacataagccaccatgcccagccaggttctttttctatggatgtgcagttcttcatatattctggatactatttataagttatgtatgttgcaaatatattcttactgtttttggtttgtcttttcacttttttagtggctcttaatcttaaaatagtcaaatttattcttttttatagttatttattttatatcatatcaagaaagtctcttttttttttaatggagacacggtctcactccagtgcaatggcacaatcatagctcactacagcctcaacttctcaggctcaagtgatcctcccacctcagcctcccaataactgggactacaagcatgagtcgccacgcccagctaattttcttttcttttttgtagagatggggtctcactatgttgcccaagctagtcttgaactcctagtctcaagtgatcctcccacctcagcctcccaaagtgctaggattacaggtgtgagccaccatgcccagccaagaaattcttatctaaagcaataaagatattcttttatattatgtttataaagatactgcctttttatttaagtctttaatacactgagaattcaaggtatatgtagggatccaatttcattatttttcccttaagtatatacaatcgtcatagcaccatttattgcataaaattatcttttgcccagtgatatgcaataaatgaatggatctgtttcagggctttacatttggtttcgctggtcattttgaccatccctgggccagtgccacaatgccttaatcactatgaccctaaaatataacttcatacctgttacgactggtacccaccttaccaaggacatgaacccttcacatttccatctgagttcctcaaaaaccatatggggattcttattggaattgcattgcattgcattgggatcacataaatctatagatcaaattaagaagattgacatgttcatgatgtttaatttacctacctaagtacatgcatatttctccatctatttacgtatttttagtgcctttaaaaatattctcaaatctcacaaaagaagatatacaaatggcaaatatgcatatgagaagatgctcaatatcatatgttattagagaattgcaaattaaaacaagaatgagatatcactatacacctatcagaatgaccaaaatccaaaacactgacaacatcaaatgctggtgaggatgtggaaacccagaactctccttcattgctggtaggaatgcaaaatggtacaagccctttgttatagacagtttggcagttgtttacaaagctaaacttactcttaccgtacaatccaatcacattctttggtatttacccaaatgaagggagaactcatgtccacacaaaaacctgcacactgatatttattatagcagctttattcataattgccagaactcagaagcaacaagatgttcgtcagtagatgaatggataaataaactgtggtacattcagacaatggaaaattattcagcactaaaaagaaatgagctatcaagccatgaaaaaacatggaagaaccttaaatgcatattactaactgaaagaagccaatctgtatgattccaactatgtggcattctaggaaaggctaaactgtggagatagtacaaagatcagtggttattaggggttggagtgggggaagtgaaagagatgaataggcagagaacagacgatttttagggcagtgaaactattttgtgtgacactataacatagatagatgtcattatacatttgtatacatacccatagaatgtacaacaccaagagtgaactccaatctaaactatggactttggatgataatgtgtcaatagaggttcatcatgtgtaacaaacgtaccactctggtatgggatgttgatagtgggggaggctatgcatgttggggggtttgggagggaagggaatatatggaaactgtactttctactcagtattactgtgaacctaaaactgctctaaaaactaaaactcggccaggcatggtggctcatggtggcctgtaatcccagcactttgggaggccgaggcgggtggatcacgaggtcaggagttcaaaaccagcctggccaagatggtgaaacccccatctctactaaaatataaaaattagccaggcgcggtggcaggcacctgtaatcccagctactcaggaggctgaggtgggagaattgctggaacccgggcagcagaggtttcagtgagccatgatcgtgccactgcactccagcctgggtgacagagttagactctgtctcaaaaaaaaataaaaataataaataaataaactctaagaaaagaatatttttggctgggtactgtggcttacacctgtaatcccagcactttgggaagccaaggcagccagattatgagatcaggagttcaagaccagcctggccaacacggtgaaaccccatctctcctaaaaataccaaaaaaaaaaaaaaaagttagctaggcttgggggcgtgtgcccgtagtcccagctacttgggaggctaaggtagaagaatagcttgaacccaggaggcggaggttgcagtgagccgagatcactcactgcatctcaaaaaaaaaaaaaaaaaaaaaaaaaagcatctttttgaaaagttttcgggccaggcacagtggctcatgcctgtaatcccagcactttggaaggccgaggtgggtggatcatgaggtcaggagttcaaaaccagcctggccaacatggtgcaatcccatctctactaaagatacaaaattagctgggcatggtggcatgcacctgtaatcccagctactcgggaggctgaggcagaagaattgcttgaactcaggagacagaggttgcagtgagccaaaatggcacaattgcactctggcctgggtgacagggcgagactccatcccaaaaaaaaaaaaaaaagttttcaataaactcttttcatgaagatattgtacatctttcaacttattgatactttgtttttgtcactactgtgataacttttaaacatgtatcttctatttcttacatagccatactaattccagcaatctgttaaacatattaggtaaaaataaattacttcttcctttctaatcttaccttttagtctaattataaaaagtcggccaggcgcggtggctcatgcatgtaatcctagcaatttgggaggccaaggtgggcgaatcacaatgtcaggagatccagaccatcctggctaacacagtgaaacctcgtctctactcaaaatacaaaaaaattagccgggcgtggtggtaggcacctgtagtctcaggtactcgggaggctgaggcaggagaatggcgtgaacccgggaggcagagcttgcagtgagccgagatcacgccactgcactccagcctgggcaacagagtgagactctgactcaaagaaaaaaaaaaaataggtaagaacaaaacaaaacaaaaaaacagtgaatagacatggtgatacaggtagtcttatctcttttttttctttttttttgtttttttttgagacaagatctcactctgttgtccaggctggagtgcaatggcacaatcacagctcactgcagcctcggcctcccaggctcaggtgactgtcccgccccagcctcccttgtccaggctggtctggaactcctgggctcaagccacccacctgcctcagccttctaaagtgctgggattataggtgtgagccaccacgcccagcccagtctcgtcatgtcttgattctaacatttcactgttaagaatgacatttgctgtagatttttggtacatatttttatcaggtcaaggaagttcatctatcctagtttgctaagtacgagtattatgaatgggtgtcaactttatcacattttgtttcagcatgtatcaaggagactgctacttttttcccttaatctgttaatttaccagcttttatatttattccgcctttgatatttttctttcctttcttctagcttcttctctcactttcctggtttctgctcttttctcatactttctacctagaatttctctttcaaagtaattctgtttcttccttttgcattcgccagggggtaggggagagcaaagggaggtagttctcagggtaattaataaatatttgaatggctaaaaagtgaaatacctaataggtgccaggtccttgaggtgaccttacccaaaaccagtcttcaaatgtgccatattacatttatataagtcgctcccgtcttgggcttaaaaaaaaaagttacttgagatgcagtcactagaggaagaattatagtagaatgctttaaacagaaatggtgtttcaccctctagagaaacatcgaaaatgcattagctatcatccgaattttcttttgaacacagtactatatttaattttaactactagcacttgggttcccccatttaatacctagaaagtagggcactagattataaaaatgccaagtatctgaagagagacaaggaataacgtttatgcattctgtaattcaacactgtatgttaaagaggccagcccatgtctcttcttaattttaaaattaaagaagccgaacccaaatttctgaattctagctaataatttaggacccacttaaaaaaactttgccaagtttttccattagtctgtttaattgtcctaaagtctgtatttcatttaactccatgaaatgcatatatttgaggaacgatgttagagtaaccatgatctagaaatgaaaagggcacttacacaaaagaaacaaatcagcaaacaactctgtaacagaattctggagtctttagtcttacaaaaaaccacattaaacatcgtaagagaatacaacatttagtccacacctgactccaaagagtctctcaactatagccagggttattttttctgtttgtttgtttgtttttgttttttgagacaagagtctcactctgtcacccaggctggagttggagtgcagtggtccgatcttggctcattgcaacctctgcctctggattcaggtgattctcatgcctcagcctcccaagtagttgggagtacaggcatgcaccaccacatccggttaatttttctatttttagtatagacagggtttcgccatgttgcccaggctggtctcaaactcttgaccttaggtgatcagccggcctcggcctcccaaagtactgggattactttgggtgtgagccactgtgcccagccaaaatctttattttgtgatttctacaaacctttaatcacgtttagattttaaacatttttccaacctctataagctagaatagatggggatctgttttttaacagaaattttaagctgttttagagaaaaataaacttggctcaaatgacaaatgtgaaattatcaaaattacgaagcataggaggatgtgggaaagggttgtagtgttcacaacacataggaaagtatttcccaaaaaatatatattaaatgtacttcaaatataacagaagttaaatgcagaatagcatacatatacctctccaaaatctgttaataattttaaatgaggtttgataagtaaattggcctccaccaatgatccaaagatatactagtaaagcttgatgccactgaggagggagagagcctggtttaaatgactgaaattcattcagtcatttaagcagtagctcatgagcacatcaattaaacatctaacaaacaagaattgtggatgtgccactatgttaagcaccaagaatgtggctctagaagagcaacagtctaataggtaagctgtttgtggaaatgcccaaggaaaatgcatggaaacaagaactatagggcccggcatggtggctcatgcctgtaatcctagcactttgggaggccgaggtgggcggatcacctggggttgagagttcaagaccagcctgaccaacatggtgaaaccccatctctactaaaaatacaaaattagccgggcgtggcggcgcatgcctgtaatcccagctacttgggaggctgaggcaggagaaacatttgaacccaggaggcggaggttgcagccagccgagatcgcacattgcactccagcctgggcgacaagagtaaaactctgtctcaaagaaaaaaagaagaagaagaagaactgtaacagaagtatgcacaagccgttggggagatgggagggctggggagatagcacaagagggagaagaaggagcccacaatgtctaaggagggaatcagaaaaacttcacacaggggcatctgagctaaggactaaagtcagaatgtgagtgtacaggcacacataaggacaagtgacagatgtgaatggacaaaaattacacagtgcactagataatgtggggaacgactttacctcacatgtcagccaaataagcattatcctttcaagataacagaaactataagcaaataattcttgatgccaatccaaaacatgtaactgagttttgatggaatttggtaaggaatgcctgatgctcaaaattaaaaaaaaaaaaaagaccaggtttcgaaccgtcaggagggaacacatcttgggctgactgatgcgggcaggtaagggtttgagggtttgcgcttgcaaaggtgtaagaggctaaggttacttaggatgcattaaaggacttcagcagtggatgtggctgaagggatgcatggaggtaggggagaatgtatccagaacagaggctgaaaacatgggaaagtgtttgagacctgggtctaaaaggactgtgacatggcactaaaaagtttgtgtgttatcctctgggcaacagaaggccaccacgggctctttatgcaggagaggaccatgagatgtgtgccttagaaagatctctatggcagccacatggagactggaaatacacagagcatcagaaggctctaatgttaccgactgaatgtttgtgtctccccaaaatttgtatgttgaaatctaatccccaatgtgatggtataaggaggcaggtctttgggaagtaattaggttttgaggatagatccttcatgaaggggattagtgcccctataagaagaggccagagagctacctttctgccttgtgagaatacagtgaaaagtcaagtgtctgcaacctggaagagagctctcaccaaaatctgagcatgctgataccctgatctcagactttcagcctctagaacaatgaggaataaatttccgttgtttgcaagctatccagtctatggtactttgttataacagtttgaactggttaagacatatggagagagattttgagggtttgaattgtgttggtgacagtagggatgaagaagaagtgattaatttgagatatatttaggaggtagaaatcaatataacttcttaacagactagtatagaaattaaagataaccaaaacttttagtttggtaaataaatggtataacattaactgaaaaaggaaaagatggtttgagaagatgataattattataactaacactaagcactattctaaatcctttaaagcactaactcatttagtcttcacaacaaccgtataaggtccctaaatctacagatgaaaaataccaatgcacagaaaggttaataaagttgcccaaggtcacacagccagaaatggcagaaccaagatgtgatctcagacacactctcaactaccacattacactgtacggtacacaaccagttaaacatctctcatgtctgagggacatcaagggagttgtgtttaatttgcatttggaaaacagacctagggctcacaagaagaatatggctatgaattttagtgtcatcaacataatagtatttccttaggccatgggaaaaatgagatggacatttagagtgaagagagaacaaaaatgtaaggagcagcaagacagatacaagaaggacactaggaaggagatttttcaagcagtgattgtccacaggctggctcagttgccacaccacagaggtacaaacttgaagtggtctgggccttctccgtgtgaaaatggcaaatccattcactgtttgctggatgaatggacttatcattgagctatttgctggatttaccatctagctaaaagatagctaaaagattccagcttagactatgtcatcaagaaaggaggcctgatagggtatgaaacggggaaaacaagaaaaacaaacaaaaatggatgctctcagctcttgaaaggatgatttatacccgtgtttgagcaaagcagattctgccttcagagaagcagcagcaaagatagctcatttctcaagcagcaccccatctcatccatcacccacttcccctacctgccccccagcctacaccacaggacctctgctctgccaagagggcagggccccagccacgctgcagcaacaccagaagcgcaaaagaaaatgtgctgttgcatagacagcgcaaataaataatggttcttgtgataatcagcttttgcttttaatgggcttcacatgactcatcagctatcacgtatgctatagcctgagctctggctctaaatcaaacaagttcaaagggagaagaaaggaataatagcaaaagatgagcagatatctcaagaagccttaatcctactgaggaaaaacagaaatggaggcaggaagaagacagtttcccctatgagcactcaggtaccgagggtccagagagggcggaagctgaaacagccgcagagagaggcagcctagttgccgtgacgccatcctgccagccagcaagatttcaccagaccgttccctttctgccacagttcctgtcttgtgggcagcagaagcaccaagaaagaagaaaaatggttgtttgtattcttatggctgcagggtcatacctctgtgacttaactatttcaacaagtgacaaggagaaagtggtaagagacagagagagcagccaagatgggggtaaactcctttggaatgtattaaatccaacttcattctatggataaaatgccctcatgaataaacactcatccccaaaacatcttttttttttttttggtatttataatccaagaaccttgacagagaatgtcagctttttatcaaggctctttcccacaatgacttctgataatgggggttggggttcattcccaggtgaaaagcatgagtttgtggcaaagaaaacagtattgtttggtcaccacactggaatggaagccaggatattctgaaggatgccttggcactaatacaaattagcaaatgactttagcacttctgagcctcaatttcttcatctgtaaaatgagaagaatggactgggtgaatatgaagtccttccactctcttaatctatgcttatgggtgctcagagcacgggaacccttccaggtgtctcttgtggttaggctgtccatgtgtcaggaccctgattgtgctcccagggacacacaagtgtgagagtggctacaactcaatggaagcaataagtaaacacgtacacactcacaaagctagatccctatatttgattaaaccatgggttagtagacaggaaccatgtcttatgcatcttcacacactcaaaatccagcccagtccaggcactgggcttaacaaatgtttactgcatgcattttgaggcaaatctttaaaatgtcatattaagaagcttttcagacatgtcggttatggattgaattgtgtccccctaaaattcacatgttgaagccctaactcccagtacctcagaatacaatgttttttggagctaggacctttatagagggaatcaagttaaaaagaggtcattagggtgggtcctaatccaccctcatggtctcttcacaagaaaggaactgggatcacagacatgaacacagggaggatggcatgaagagacatagggagaagacagccatccacagctaagcagaaaggcctggaacggattctccctcacagtcctcaaaagggaccaaccccgctgacatcttgatcttagactttcaggctccagaactgtgaggcaataaatttctgtttttgaaatcacacagttttaaagccacccagtttatggtactttgttatggcagctctagtaaactaatacaatatccagaagtagaattatataatgaaatctcccatcacactcaccactcagatctttcactccggcatacttcatttcgtatttctaaaatatatggacatttccttacataacaatacccttatcaaacctaacagaattaacactaatttaaaagcagatttaattcccagaagaaataaaccttatactaaaacacacacttacattcctccattaaaactattaacacttttaggccgggcacggtggctcatgcctgtaatcccagcactttgggaggcccaggtgggaagatcacttgaggtcaggagttagaaagcaggctggccaacatggtgaaaccccatctctactaaaaatacaaaaattagccaggcatggtagcgtggggtcccagctactcaggatgctgaggcaggagaatcacttgatcctgggaggcagaggttgcagtgacccgagattgtaccactgcactcaagcctgggcgacagagcaagactctgtctcaaatttaaaaaacaaaacaaaacaaaacaaaagctattaatactatcaaaaacaaaacaccaataagcttgaatttttgtcaaacaaccctcagaggataagcaagactctcagaataattcaatttcctaatcagctctcatattcaacaatttcctgaaagtaaaaacctatgtttctttattcaagtacagaaaagaaaggaagaatgcggtcagtattcatacccactccgtggtcactgaaaatgcacttttcaaactaatcccaagaaatttagtagacatcattaagtctttagtttaaaaacagtacgtgcaatggtattgtatgttatattgcacataatttaagcgcatgaaaattgacatgacagagctcaaaaccactaccaaaaaaaaaaaagataaatacaaaaccatacctttacagggtagagaaccgcttgttatgattttctaaaacgttagagactggagttaccaatgcttcaacaattgacaacttccaatcacatgtcctcttcaggaaggttactttttgtctaatgttaagacaaagagaaatgttaaagtcagaatggcctacttaaaaagtttttcaaaagagtctttggaaaagcagttcgctccatcaactttcaaaacaggcatcgctgtaaaaacccacaatccagctaattagtctcagctgtttgtcatatggcactgcagaccagtcaagtgatttttgcccctttcaagcttaccaagttccagttcgactggccactcagagggcggctttattaacctcttctggtgttagaagactctgcacttcagctctttcttccgcccacctaccccgtgaatcaaaacagtagaacatttgttttcttgagaaagtgccttgtattctcaaggcccttaaaggttatattcatattgttgcttacaaatacaatgcctgatccaaacaaacaatatgggggatcaaatggaagtggcaggagggatggggctagattacttaccagaccttgcagctggcctccaatttcataagtaaaactgcctacaagggagtccacccagatatcttgctggcatctcaaatccagcatgtcccgtactcacctcctttgcttttctccacaaccttgcttcaaacccacttctcttcctgtg

SEQ ID NO: 372 - DNA, 86849 bp, Homo sapiens
ttgacagactagaccacttttttattacagcttaattggcacatggttcactgaagatacacttcacttttacataggcttgtaaatagaaaaatacattgatgcacaaaaaatatagtacttcaataccaaacttaaatgatttccaaaaagaatacaggttatttcaataattaaaggtggcttttgtgtgtgcactatatcatgtatacacttaattgtatgtttaaggccagtggaatctatagctaattactcatttggttcttgaaaactgaaacatgcaaacattcttatttttatgtttaaagacatttaatgtgttattctaacacaaatacaccatatagaatatgccctgatatgtagctgtaaaattatgttgtactgcactgaagtcttatggcaactatataaggcactgctgtgtgattatgaccctgctctttttttttttttttttttttgagacagagtctcctctgtcgcccaggctggagtgcagtggcgcaatctcggctcactgcaagctccgcctcccaggttcacgccattctcctgcctcagcctcctgagtagctgggactacaggtgcccaccaccacgcccagcccattttttttttttttttttttttagtagagatggggtttcactgtgttagccaggatggtctcgatctcctgacctcgtgatccgccctcctcggcctcccaaagtgctgggattacaggtgtgagccaccgcgcctggccaaccctgctcttgaaatgtctaaatcttttcctcactagcatatacaattcaaatgcacaggcctccatgacttctttggaatttaaaagaagccttcatttcaaggatagaaatatgtaaaattttaccaaccatggataagtttgttatgggagtagtggaaggacagtggaaaaaaaaataggttttttcatgatacttttatttttccttttttaaaaataaatttagggggtacaagtacagtttagatacatgaatatattgtgtagtcgtaaagtctgggcttctagtgtaaccatcacgcaaatatacttgtatttttctaattacagttctaccaaacatttgccaccacaaaatacaagtatttttattctttatttaaattatggtgagtgatatttcttcctatatagccattaagatctctggaagttttgatctactttattcaaaccactttaataaataagacttttcacctaaatgaaatacctttgaattttataaacaacttccatgaaacatatattaaaaccacctttaatttggtatgaagacactttggcaatgcagcggaataaatgatcttggcaagacccagcaagtacagtaaatgctcatgagctctatgaaaaatataggctacagaatacttcatttttcttttattgaactacagtacaaatgtgactgcttcaatatgaacatctatcttccaccaaatagcaaacaggcatcttatgtaattaaaaactaattatttcaattccaccaatggaaaagcaaaacaagttgcaaatatcaacaatacagagcctgctggtaaagatagagatgagtaagttataagctaataaagctgcagcctgaggatgccagatcaacattataaatatgaagaaaaagaaactaaatatttactcatcgcaaataactcggcataagcaccagctatgttcaggtgcggccagcacataggccaagtataaatgtacaatcacagtgaactaaagccataaaatctagttccctgacccttcaatcaaccattcagagcaatgggaatatagcggggagacagaagtcccactttggttgctcatattacattaagccagcctgccccaccccaatccccttcccaccaataaaaaagtcaccgtgagtgtataattggtcaatccagtttatccaaggtctatagatatagccatgatttgtcctatattcatgttaaatagaatgcttacataaaattaatactcaaagacattgagctgatgtgcatgtatattcttatttaacatttaagtggctttaatggtattttagaatgtcacctatggcatgagtcttcaaatctggattgaagactgtggcggttttataactgcatgtaagatcttaaatgtaagactctgggcctacctacattaaggcaggtgacagtaccctcattcattctacataataaatacactcttctgtgactgcaaaattctgaatccttgaatgatttactataataggctaaggttgtataaggcacttttggctctgaaatatttctcctaactctcaggctgaatcttaaagaaatatttacaaagctgcaacaaattaattttagaaccggatgctttattcgtaggtctaatggggatggtgagaagcaatttgtacacaatgcccattaatctctcactgtgccatgtatcaatcatagagaagatcccaggcatgggccacctgaactactatgtcgcttacttgacttctcaacagccacatgcccctttctccttttcttcacttaactgatccgtagaggcatgaccatttgatcgcaccactccttcaggaatccaggacttgtccacacaccgttccattcgcttcattatcaggtccagaagcatctcaattgcttggcttatgtttgtcccattggcagcactagtttcaaagtaggggattctggaagacagagacaactgaggtaacaacatgtggagggaaaggagagtgacctttgctcttgataattcaaattagagaatcgatagaatacaaatatacaagatgacaaacattttaccaccccagagtacattaaaaagttaaaaagacaataaaatactcacactgcatttccagtagatatgcaaaactggaaattttagactcttcaaaatatcaatttttggctgggcgcagtggctcacacctcccagcactctgggaggctcaggtgggcagatcacctgaggtcaggagtttaagaccagcctggccaacatgcggaaaccccatctctacaaaaaatacaaaaattagccaggaatggtggcatacacctgtaatcccagctactggggaggctgaggctcaagaatcacttgaacctgggaggcagaggttgcagtgagccaatattgtgccaccgcactccagcctgggcaatagagttagactgtctcaaaaaaaatcaattttcattttttaaaggaccatatatatattttggcaatacatactgatttactgtaaaaaatttataaaaagatataagtaggggattctggaagacagagacagaattaaatcttttttcgtttaagtttttggagggttttttgttttgagacagagtctctatcacccaggctggagtgcagtggcacgatctcagttcccaggcgacttcccaggcatcgatcctcctacctcagctttccaagtagctgggaccacaggcgcacaccaccacacctggctaattattgtatttttttgtagagacagggttttaccatgttgcccaggctggtttcgaactcctgagctcaagctacccacccgccttggcctccaaagtgctgggactacaggtgtgagctgctgcacccagcctagttttaagaatttaaaacttgattattggtatgaaagccgtttaaattcctctaagtgaaaagtaaaacttgaaaacttttagaagaacatacaacagtcttatctttttgacattggaataagaaaggatttcttaatatagctataaaagctcaaaccacagagaataagtttgataatcttgacaatgttaaagtttaaaactttggtgccacaacatatatcataagcaaagttaaaagatgagcgacaggccgaaatacatggcatttcatataacttgcaaacgggttagcatccgaaaaaataattcctcaaatgaattaaagtaataaacaagataatacaaaacagactaaggatatgcacgggaaattctaagaaattacatttgtgaaaaaatgttcaacctcacccaaaataagggaaatgcaagttaaaataatggtatattaactcacacccatcagattggcaaaaatatagaaatctcccaatattaagtattgccaaggagaagaaaagaggaacttgcacttactgcttatgtaagtataaactgttaataactactttggaaaataagacggtaatatctgataaaattgaaacatgcatgcactatgacccagcaacagcactcctgggtatacatctaaagcagagccaaggcatgttgatgggcaggaagtgagttacagggatacatgagacatcagcaatccctcagtccttagggcaactgagaaggtcttagggcagccagagtccctgaaccagtctcctccaaacttgagcagccttatctatttatcccagtgagctgtacaaatattatcattttctgcaggtgccatcctatgaaaaatattcagaaaccctgtgctggagcagcactatccaatagaacttcccacagtgacaggaactttccatatgtatatcatccagtacaataactactagccacatgtagctattgagcacttaaaatgtggctaatgcaaccaaaaatgcgacttttttgtttttgtttttgttttgttttgttttttagagatggagtctcactttgttgcccaggctggagtgtaatggtgtgatattggctcattgcaacctctgcctcccaagttcaagcgattctcgtccctcagcctcccaagtagctgggactacaggaacaggccaccactcccagctaattttatcatgttggccaggctggtctcaaactcctgacctcaagtgatctgtctgcctccactcccaaagtgctgggataacaggcatgagccaccacacctggccaaaaaacctgaacttttaattttaacttaaatagctacatgtgaccagtggctatcacactggatagtgcagccctagagaagctctcacatatgtgcacgtggcatcgtctaatggaatagatattgcagaactatttgtaatagggaaaaaatttacctaaacgtccatcaataagcgcatgaatagtgatatttttatacaatgaattatacaatgcttaaactgtatcaacatggcaaaaattaaacattgaattaaaaaaccaacttgtatgatacaagatcatttgtgtgaagacaacaattacacatcattataaaaacatctatgtagtaaaagtacaacttcttggactagaaatatataattttgactgcttttagctaaaagtaaccgaaaattgtggctcaaattggcatgaatcacaagtaggaatttattgtaatgcataatgaacacagaactagagagtttccagtgttaattcggttgccaaacggtagaaacaaagagcctagattcatatcatccttctgttctgccatcctccacatgtcagctttctccacaatctgactcccttcatgaccccagaagttaaaacattccaggcatcacatctcaacacaccgaagttccaaggaagaaaggactcttcctctgtgtgcctccctcaggagagaggaaatctttcccacaagtccctggaagactttccctcgtgtctcattggtcaaaactgtatcacatgccaatgcctaaaccaaactctggcaagaggaatggtacaccaccatcactggcttaaaccaatcagtcttcctgggctggtggctggcacctgcctctcttaagtagcatgtcctctagaagcagagtagatagctaaagaaaattgagattctataaataaaggcatgaatattgtctaggcaaccaacaacatctgctataggaagtagatatagtgtggttccctctgaggaggtaggaaggagaatggaatcagcaaggaattttaaaagggacttcaattgtatctgtaagaaaattttattttttatttatgcataatatagtttcagagtaaatatgatcatttaatacactgatataatgtgtaaagataagtatacttgggattgccataatcttaaatatttgtcttttctttatactagaacgattggaatttttccctcctagctatttcaagatatacaatagattgttgtaaactatagtcaccctactgatccttctaacactacatcttatttcttctatcaaaccatatgtttgtacctattaatcaatctctcttcatcctccactccctcctacccttcctggcctctggtattctccaatctactctctatcttcatgagatccacctttgtagctcccacatatgagtaagaacatgcaacatttgtctttctgtgtttggctatttcacataacataatgatctccagttccatccaagctgctgcaaatgatgggatttcattctttttatggtggaataacattccattgtatatataaaccatattttatttatccattcatccattgatgggtagattgattgcatatcttatctcttgtggatagtgctgcaataaacatgggagtacagagagcaaatacccttttgatatatctgatatacatctctatatatcttttgggatatatatatatctctctcctaagaaaacttacataaaacttttaagaaaacttccactaatatatatacacatatatatacacatatatatgtgtatgtgtgtacatatacatatatacacacatatgtgtgtatgtatacatatatacacacatgtgtgtatatatacatatatgtgtgtacacatatatgtgtgtatatacatatatacatatatgtgtgtgtatacatatatacacatatgtgtgtgtatgtatatacacacatatatgtatgtacatgtacacacatacgcatatatgtgcgtatgtgtgtacatgtacatatatacgcatatatgtgtgtacatgtacatatatacgcatatatatgtgtgtgtacatgtacatatatacacatatgtgtgtgtacatatacatatatacacatatatgtgtgtatatatacacacatacacatatgtatatatagtgtatatatgtatgtgtatgtatacatacacatacatatatacgtacacacatatgtatgtgtgtatacatacacacatgtatgtgtatgtatatatacacacatatatattagtggagttgctggatcatatggtagttctatttttagtttttttttttaagaacatccatacttttctccacagtgcttatgctaatttactttcccaccaacaatgtacgggttcacctttctctgcatcctcaccagcatccactattgcctgtatttaggtgtggtttttttttttttgagggggggggaattactgcctatattttggataaaagtcatgttaactggatgagaagttatctcattgcagttttgatttgcctttctctgagtagtgatattgagcattttttcatacacctgtttgccatttgcagatcttttgagaaatgtctattcagatcttttgcctatttttaaaacagattatttgtttttgctattgagttatttgagccccttatatattctcgttattaatccctgatcagatgggtagtttgcaaatattttatcccattctatgggttatctcttcattttgttgtttcctttgctgtgtagaagctttttagcttgatataaatcccatatttctattcttgtgttggttgcctgtgttttgtggtcttacacaaaaagtttttgtccagacgaatgacctggagtgtttcccaaatgttttcttctagtagtttcatagtttcaagtccgatatttaagttttaattcattttgagttgatttttatatatggtgagagataggggtctagttacattgttctgcatgtggctatgtagttttcccagcatcatttattgaagagaatgtcctttcccctctgttcttggtacttttgtccaagatgagttgtctgtaaatgcatggatttatatctgggttctctgttctgttccattggcctatgtgtctgttttatgccagtaccatgctgatttggttcctatagctttgtagtaaactttgaagtcagtgtgaggtctccagctttgggcttttttcctcaggattttgtcagttattgagggtcttttgtggttccatataaattttaggatttttttcgatatttgtgaagaatattattggtattttgatagggattgcattgagtcagtaaattgctttgggaagtgttatcattttaacaatattaattattccagtccaaaagtatggaatatttttccatttttggtgtcctcttcaatttctctcacctgtgttttatagttttccttgtatagatgcttcacttctttggttaaattgatttctaggtattttatattctttgcagctattgtaaatgagattgctttcttgatttctttttcagattgttccctgttggtgtatataaatgctaatgatttttgtatgttgattttgtatcctaaaactttactgaattcgttgatcagttctaaatgttttttggtgtaatctttaggttagaaaaaaactcttaaagcaggcctgtggcaagaaggcccagaaaagttaagcggtctgatcaatgttattcagctaataaatgacagagaagcaagtaggctcttcctgttttcttatacaggtcctcatatactatactatgtcttgtaaaacaaaataggaaatgtcttctcagtgtttagttcaaagaatactgatttccaaaactactaactagaagaaaaaaactgggtaaattcaaattttgcaacatgctattttattaaatgagtttcctggactataaccttttttttttttttttttttagcttttcccccttttttgcttcagggatttcttgtatatgctcttcagagtgttctggtttgcctgaattgaaactagctgatatatatgagtcatttaagattgaaggaaaaaataactaaaattatttcttgagctacccaatactatgtgtcttacatacatgattcactaaatataaccactactgtattcaggtacacaatattcccatttcacaaatgattaaactaaggctgagaaagatgaaaggaacttgcccaattcacaatgctagaaagtagcagagttaggatttgggtccacagctaattccaatgcagccagtttaaccataggttctactggttccaaactagtatgaggattttcaaaataaataaatcttatgcactgtacaagaagaaaacgctggctttggggagtattcagaggtcactggccatgtttatcaaaggctttgccacttaccaactccagactatatttctggaccatacacttgaagacattctgaattttacagcatcaagttgctcaagagcaacaaatctttttttttttttttttgagacagtctcactctgttgcccagcctggagtgcagtggcgccatcctggctcactgcaagctccgcctcccgggctcacgccattctcctgcctcagcctcccaagtagctgggattacaggcggctgccaccacgcccgtttaattttttgtatttttagtacagacggtgtttcaccatgttagacaggatggtctcgatctcctgacctcgtgatccacccgcctcggcctcccaaagtgctgggattacaggcatgagccaccgcacccagcccatcaaatcttaagtatacatttgttttgttatccaaagacctgtggtacaggtgtaatttttaaataactcacaaagcattgcttcaaaactgtatagctgtttttcacataatcttgagaaatcagacttcttgtcgaagtcatcctttatacatttgagatggtctttgcaacaggattaatcaagtgacaaattcaccttgcttttcaataaagccatgaaagtcgtgataacattgtatttccttcaactgttgacttcattgccaccacttgtgaggaatctaaccaaaatgttcttagatatcaaaacaacaaagcaaagttattttattatctcagggagtcctgcaattgaattcagtaaagtatttcttaaatttattagaactttaaagtcctccacgattactgttcttgaagaatgtttttgtttttctgtattctcatagcatgttaacaactacatcagttactctgattacaatttaccttactcttttattctttcttggctagtaacagcttctatatgagagcttggtaaagttttcttttttaacttgttaatgcttttacagatcttttcagaactctttcacttctgatgttactaagaagcatatttagatcaagggttcccaatccccaggccacagactggtaccaatccatggcctgttagcaaccaggccacacaacaggaggtaagcagggggccagcgagcaagccaagtttcatctgtatttacagctgctccccatcactcacattaccacctgagctctgtctcctgtcagattagcagcatcattagattctcataggagcacaagccatattgtgaactgcccatgtgagggatctaggttgcactctcctatgagaatctaatgcctgatgatctgtcactgtctcctatcacccccagatgggactgtccagttgcaggaaaacaagctcagggctcccactgattctacattatggtgagccgtataattatttcattatatatggcaatgtaatgataatagaaataaagtgcacaataaatgtaatatgtttgaatcattccaaaaccacccacacctccactggtccatggaaagattgtcttccatgaaaccagttcccagtgccaaaaaggttggggaccactgatttagaggatatatgtgtagggacataaggctatttttccagtatgattcctcagtaatgctgtcttattatttgataacttcctccaggaggtgataaggccttgcaactgaatctctgcaattctctgttttagcacagctattaaaaactggttgaggccgggcgcgatggctgatgcctgtaatcccagcactttgggaggccaaggcgggcggatcacgaagtcgggagatcgagaccatcctggctaacatggtgaaaccccgtctctactaaaaatacaaaaaattagccaggcatggtggtggacgcctgtagtcccagctactcgggaggctgaggcaggaggatggcatgaacccaggaggtggagcttgctgtgagccaagatcacgccactgcactccagcctgggcgacagagcgagactccgtctcaaaacaacaacaacaacaacaaaaactggttgagaaactatcacctcatttgagtgtttatccacccacctgtgagttctgcaaggcagagttgctcccctaactccaccatgctcatattctatcatccttttatttcctgactctaaaatatcttaatcagaaaaaagtttgttgggaaaaatgacatggtcttcgcagtttttaaacctcctgcttgcctcttagttactgtcaatcttttttcctccatctatcaccttgcacacaaaatgaagataatgcatctctgtccctcactagtcacatgtaatatttgattaacaacttgaagaggcaatcctttgtgactggagtcaatatgtgtttatttatcaagaatctataatattattgagctaaaatcctggggatagcttgtgatgccattgttacaagaatagaattttagaatgagatttttcaaaatgtaaattgttacattttcttcattatgatctttctcaattatatccattaaaaatcagttaatgtccacagaacatttcttatacttaaggagagggtttgaccattctatcacctttcagaaatacattacatgaaaaagcagttgaaaaactcagatctcccgcaacagaataaattggaaatttcttaaaaagtagttgaacagtaagcttttttaaaatgctaaatcacaataatgtatacttcattttaaaaattctctcaaaatcagttacaaatatctttccaactccagagtctccagcctcatttgattccttaattttcctccacagctcctgaaaattacttcaccatcatttttgaggaataaatgagaaaacatagtgaaagtactttgaaaactataaaacctgtgcatggaagttatcaacaacatggatcaatggttaagagtcataaccggccgggcgcggtggctcacgcctgtcatcccagcactttgggaggccgaggagggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaagagtcataacctcaggtcgggcgcggtagctcacgcctgtaatcccagcactttgggaggctgagacgggtggatcacctgaggtcaggagttcaagaccagaaaccccgtctctactaaaaatacaaaaattagccaggcgtggtggcaggcgcctataatcccagctactcaggaggctgaggcaggagaatcactttaacctgggaggcggaggttgcagtgagccgagatcgtgctacggcactcaaggctgggcaacagagggagacgccgtctcaaaaaaaaaaaaaaaaaaaaaaagaagtcataacctctggagtcatgctgcctggcttcaaatcctagtagtacatcttaccaactgtgattctgacaaaagtttaacctctgtgcctccgctgcttcatctgtaataccaaataacatcagtatcttcttgtaatgattaaatgagttaatatttaaagcacttagatcagaacctgacacatgtacaaacaataaatgtttcttatttccaacacagaattgggttaggtgataaaagcttatttgtaatgatgttatttaaaactcagaacacagccaggcaccgtggctcacacctgtaatcccagcactttgagaggccaaggcagggtcggagttgaggtcaggagttcaagatcagcctggccaacatggtgaaaccctgtctctactaaaaacacaaaaattagctgggcatggtggcacgtgcctgtagtcccagctactagggaggctgagacgggagatctcttgaacacaggaggcagaggttgcagtgagccgaggcggtgctactgcactccagcctgagcaacagagggagactctgtctcagaaaagaaaaacaaaaactcagaatacatcatcccaaaaaagcaatgtcactagcaacatggtaaacattaaattctcaatctgtgtgttgtgtgaaaaaaaaagaataaaaaataaaaataaatttgcaaactaacccatgaacattggtttaatccacaatgtagctgatctataaaatctacaatactgctctaattctggtacctgggaccacgcctccctacaccagagatgctgcactcagacctgtcctggccaaagtgctttgtgcctccaaagcatttgcctcccttactcctcattaaactcctcactttccaagcaatcttcatgaaatgctggaagacaatggatcttactctactgattaatactgacgtataaatgatgcttctagcagagctgtgagctactgtccaatgtttattaacttaagcaaatatttaattggtataatttcaaggtataagagctctaacttttcaagttactcatgctaaaagacacacaatattaacaagacatactttagatttgtaactccaaattcaagtaacaaacttctttcaattaaaagtatactttcttgccatttgtaaacctctaggtcatgggaccaggagtcaggttaacaactttaaaaatccttagactaatcactcagagttttctgagcaatttgaggcagtaagattttcatttctacaggaataagtgaatagagttcactccactctcagctctgtgccagtaattgggctgtaatctcatctagcaaactagatgagagccatagaaaagaccctgaattaagactttctttccataagaaaatgatgttccaggctggaggcggtggctcacctgtaatcccagcactttgggaggccgagacttgtgcatcacttgaggccaaaagttcaggatcaacctggccaacatggtgaaacctcgtctttactaaaaaaaatatataaaaattagctgggcacagtggtgcacacctgtagccccagctactcgggagggtgaggcaggagaatcgcttgaacctgggaggcagaggttacagtgagccaagatcgtgtcactgcactccagctgggtgacagagctacactccatctcaaaaaaaaaaaaaaaaaaaaaaaaaaaaaaaattcaagaggatgtattgttcccattttaaccatagaaagagtgctattgttccttttctccacatggtggtgctaatgtagcaccaccatggagccgtattgccaaagacgaaaaaattcagcactgctcatcgttattaccagtctgtaagtggccacttaaaggccatttggagtacatggagaccattaattataatgcatttccaaaaatagattaatcacaaattttaaaataaaaaatttaagtaaacagattcaaatcaatgagaggggcataagcatttgcagtttttcaccaagatcttgcttgtggcgtaggtcagcatcctgatttcttttccattatttattctcacaaaactaaaagatcctaaatctcagttagaggttgccaggaataacagcaagtatgtttggtggttctgtcaaatggctgtagatatttggctcacatgtagatctagaaattatgaacaaacgtctcactaaagtgagaagtgagtttcacactacttttcacagtctgttggatgctaattgaacaacatttccaggaaatggctggtgtgctgactgtttgaacctgggatattgcagcaaatgaaatccagatcctctgctgagttaaatggagctctgtgaatcagtcttgtatgtttgacttatttgtgtacttttcaaacatgcccaatgctacatcgctaagttatttctcaaatcaagaaaagatgtaatcaagttttaaaagactaaactattagagatcaagctatttgtaccgcatttcatctagttcaaactagagaaaacagtgagcatgctgttgaattaagctacttgaaatccctgaaatgatccatactgatattattaatgttgtaaataaatatttttaattcctctttcattccagaactcttgagcatcttcctcagcaataaccagcagccttcagcagggagaacatcatcttaaatttgctgcccatttctttgcacagtacacaaaatatgtacattcagttgtcattcttagttcacattctttttttttttttttttagaggcagagcctcgctcttttgctcaggctggagtgcaatggtgtgatcttggctcactgcaacctctgcctcctgggttcaagcaattctcctgcctcagcctcccaagtagctgggattacaggcacccaccatcatacccaggtaatttttatatttttgtagagacggggtttcaccatgttggccaggctggtctcgaactcctgagctcaggtgatccacccacctcaacctcccaaagtgctgggattacaggcatgagccaccatgcccagctttagatcatattcacatttttctctattttcctcaactctgaatcaagaacaaaggcttattatgaccaccaactatcctctgtgaataaagtatggacagacatttcaacgcaaccatatttagtcacagagtgaagcccttgtctgctcacttgtggttggtgctccctcactaccaatgccaaggtcccttcccagcctatatcataggtgatgtaattaactgggtgagaaaaaaaatcttcctctctttagcatggattttccaatgagaagtcattgagcatatttcactcactcatgcatggcacaagtagacaattggttcatatcctgtacaagaatgactttgtccaaagaaaatatctgctagcatgctcacctgtcaagcaaaatgtttgctagcatgcgtctttgataggaactcaaagtgttgtcttgaaccagcagcagcaacatctagaaactgatcatcagtatacatttgtgggctccaacccagacctactgaatcagaaactgcgggacccagtgttcaggtgattgattctgatgcacactgaagcttgagatctaatagtgtcttccaaaagaggaatgttgccaatatttcattcagctttctcttctacttgtcactgacttcgtagctatctttttaaagtgtttcagtaaccatgtgaactgtaatcacttggctggcaggagtgcaaatttgaacaactttctgttttgttctcttctccaacttcattgacaatatcactcaatataatacattggaaaccattatgttgcatttgttccaggaaaattcaattggtttaccacagagatcactttgatttgttaggaagtgacctaagagcttcatattacaatttaaccaagtttcacagcaaaaacaaacaaacaacaacaaaaaaaaaaacatggaaaattagcggtagactcttaggccactacaaattttttttctgatattcattatcatgcatacaatttgccctttacatttttgtctgttgtatgaagtcctcattctcaaatttacttgtcccagcacacacagattaacattccattttcgcactgtagtgttctttattaggcttacaaagttcttctgagacatggtgtttgattctttgatatgtctattccagagaaccaattgtaaaccaatgatctggggtttttttgtttgtttgtttgtttttgtttgtttgtttgttttgttttgagacagagttttgctcttgttgcccaggctggagtgcaatggtgcgatcttggctcactgcaacctctgccttaccagggttcaagcgattctcctgcctcagcctcccaagtagctggaattacaggtgcccgccaccacacctggctaattttttgtatttttagtagagatggggtttcaccatgttggccaggctggtctagaactcctgacctccggtgatccacctgccttggcctcccaaagtgctggcattgcaggtatgagccaccacacctggccccagtgatctgtttttatgaattgagaatagaagacagcataatagtaacaaaaaatgtaaatttatcaaacaacatacaaattatatgaagatatgccataaactttatcctgttttctgactgttagcacatggataaactaaacaatatagtcctttagtgcatgtgtaaccagtgtaaatgttctaagaatgaaacaaaacatctgtgaaaataatcattaaagttatatgccatatttgtgaaatgcatgtgaaccaaatttttccatcatattttcctctaaaagtgccaaacagcctaccaaactacatggtatgctttctgtatcctaagggactctgtttctagccctttcctttcttcaagggtttcaatcattatctgctaaatcctcttttctcattttaacccaattcaaaaactatagattgagctcctctctatgaaatactccataaccatcgtgacctgggcacaggtcaaagacagtcccccacacccctcagataccccatatgacagaaggcagggttaggctctgtgaaaccagacaggctgtggaatcctaagaccgagggcacaggaaacaagcaaagggctgaaaaagcccacaggggcaagaagtcaagcctgaccctcccccagtacttgagaatatacttgaatgtgcttgtttgatctagctaactcctctaactgcctttttcttttttttctttgcatttactgacatactctcaaaagaatgctctaggatccatggtttccattgcttcatcacttacttcctccttacccattgcaacatacctcacagcttcaacactacagcattctctgtggtaatcgttctctccctgtttcttttccactacgttacatgagtgcctctcaggggagcagggggacatttcagactggccggtaagactctgtcagcctccccctcagaatcacctaagtcactggttctcaaccattgcacatgaagatcacgtggggagattttaaaagataccaatgcccaggctttgtaatgagtcagcttggctaggctaaacaacatttcccagaatgccctttctggttagggtgggccacaaaagagatttgggggcaattttgggggtaggaagtgaagcaacctccatttcatagccctcatatattgtcgcttatctgctggctcatcttattgtcataaacctgcaactagacctgcacctgggccaggtgatgttgttagccctgtgacaaagggccccagtttctgcaggacacccacaccagccaggtcagaggcaacaggaagtgacatgggttttagtccctcattatgggcaccagctggttctcactttttccatccatcccccatttcacatccttctccccttcctgtctgactgtcctgtccttcaggcttcagcatcagacacaaagacaacaccttacagagactacttacccagctcccacaattgcatatgctcaaattcctgtaacagatcccttcatgtataggtatgcttcttcaagtgaaccctgcctgagaaactcctccaaaccaattatgtctgatggtcagaggtgaagcccagacatgagaatgtgttaaaagttctctggatgtttctaacatggttaaacaccatctgccctagggtaaaaacctctacatgcaattgcaaatccttgccagagtaagcctatagtggatgggaatccttcagctgagctagccttgagaaaaacctaaaatcctgccctactctatgtgtttttcctgatttattcttccttttcctttttcacaaagctagcctctgcccacctcacagaccactgcaatctatcaatctctagtctttcctccctccccacctatagcctatagactgatctggaaatgtaaacataacatccctccatgctcaaaggctttcagcaactccctgtcctccagggatcaaatctaatctccttacctggtattcaaacccctccagagtctggcttcttcctacctggccaacctatcctccccctcccttcccactataaaccctaccagctttctgaacctccatcaaccaaagaaagaataaagcagtgatcacacaataaaaagggaaaggttttctcttggccttcttggattctgctaaccaccaaagccacaaactaggtaacatcccctacaccatctacaccatctctatttccctcccctcccttctcaacccacttgcttccttcctcttttaatgctattaagggtttgaatttacatatgggttctcattgtgtgagaggcagaaagaaagtaaagtaaaaattccttttagaggcacccttaacactttaatactttaataagcagcagctgaccacttctttcatgtccagttcatgctgctgctgctgctgctgctgctatgatcctattcccagaactcaaggagaacgacagtattttgctgaccctccaccacaagaccatagactaagccaaaggagatctcacactcctctcccagaatagaaatttcaaaaccagcacctaatctgcaataaccaataagcccttcttatatgctagcattctctacaatagtacatgaagtggctttgaaatttccttgctgaggctgggtgtggtggctcatacctgtaatcccagcactttgggaggctgaggcgggtgggtcacaaggtcaggagttggagaccagcctggccaatatggtaccagaaaccccatctctactaaaaatacaaaaattagccgggcatgatggtggactcctgtagtcccagctacttgggaggctgaggtaggagaatcgcttgaacccgggaggtggaggttgcagtgagccgagattgtgccactgcactccagcctgggtgacagtgtgagactctgtctcaaaaaaaaaaaagaaaagaaatgaaaaaagaaatttcctcgctcaacatggaggatttctttaccccaggagtctcctatttgcatcttggaaagaaggccttacatacttaaggcgcctctgagacaactcaaagttgtctctctgcaaatgccaagagtttgagaaaatgggaccaaagcactgaaggaggcccttgccacatgcattgtcaatggatcctactatcatatcatataaaaaggacacattcaacatgccccaaggcctatggctgaggttttgctttaattgtccacttttatctttttcattaccattcacctgctaatgtttatattgaaaatgttttctctagacttctccacaaaaatactcacccatatttctctgcgagtgctatggcttcctcctctttcactactctctggtcctccagatcactcttgtttccacacagcactatatctgggttttcacaatatgcatgcatctgtagctggcctattaatataagaaagtttattatatatgtaaataataatgtaagtgtatgatcagtgaacaatacatgcaaaagtgctttgaagactataatgtatatatagatattgggaattgacataatgctttcaaagcatcagtaatcttatctgtaaagctgaatagttggggcagaaatataaaaccattcttaagcacataccccagtttattgatatcggagagtttataggagaatgtgctacctctcaagtgtgagggcccacatgtgcacacgcacacatatgcacacacacacatacaaaacacctttcttttttatgaaggctatttgaaaagaaagttgcaggagttcctagggtttactgctaatcttaaaactgtttttatgtgtttttttctccatagcaatgacatttctaaaagaattgtttttctccaaactaatctatttctatccaaaatgtttttcacatttttctattatcctagggcagaatcaactcatttaaaacaaacaagatacaggcttcaatgagaagaaaagacccagaataaacagtaagtgattctgtcaccagagccaagtggaagcagaggactataattcttattccgcagcttttatttcacctgaaaacctgcaaataggcacaattataaaaagcaattgactcaaaccaaagagcttcactaagctaaatagtttaatctttcaaagtaggaaaataacacctcatttcttacccatcacaccccagaataaaattaaggcctaaacgttcacagtaagacatacttcagagtttatggcctaatttattttttcatcatggttaaccagaaaagtgtggacattttagttcctcattatgaagtagtgttcatcatatcttatcatgagaaagtcaagtaggcaggtgtttactgagcattagcacaggcctgatactctgcatggaatttcacaacagttctttgccctcatggggcaactggggtaataagacctacagaggacagactaaactgtgtaccatttcatgaaaagccatgccctttctttcctccaggttgttacacatgctgttcccacatcactgaatacttaaccacaaccttccttcaagacttgcttcatggttacctcattatctttctggtctccagagtggctctgtgctctgttaatgccttataaggtgttataggtccatgcccagtgtcatgctatgagcacagactcaggatccagtgtacctagggatgaatcctggctctgccatttactagctgtgtgaccctgatgaagttatttgactgcctcaatttccccatctgtaaatggtgataatgatactacttactttatacagtcaaggtaaggattaaaatgaattaatccagtgattctgcaggtaaagactgtgagccaccagccttagcataacctaagaatttgttgacatgcaagtctcaggtcccactccagctctactgaatcaggaatgctggaaatggggctagaaatctgtgttttaaaaagtcctccaggtgactgagatgcacattcacatttgagaactactaagttaatatattaaagcatttagaagagcatgtaagtatcaccagtaattatggttaacagtatttattttgggtagtctaggaagtgtgattattggtgatttcttctttttgtctcatttttcctaatttttctactaagattgtgcttatctaaaaagcaaattaatcagttattttaaaaacttcactaagaaaaaagtcacctacataaacaactacagtctgataatggatgtaataaggaccctatacacagtataaaatgtaacaggggttaaaaggagggaaaacatctaacacaactaagtttattacagagaatctcacagaggccatctttgctaggttttaaagaataagcagaactccagttggttaaaaaatgggggcaggtgtggaaagggtttttcagacagagagaataatgggaataaaaaataaagaagtaaaaatatgtaaaatatatactgttgggtttttgcaccacttatgggactctacagaagaaagtttagaaatgtaggctactttaaagtttccttaggaaacacactagcactggatgaagagtgactctgggcatgacgtgcttactcctctgaactccaggaagacaggacagtgactaccacactaccaaattcctttcagatttcaatccaggcccagaggactcagcctctgttctgtctcctcatctgagtggggcttactttagacttttatcacccttctcaagagggcatggagagattgagtgagagggaggggtctgcaaggagcaaagggaaaggggagggtatatagacctgctctcctctcccaggccaatcagggcccacgagtcagctacttctttaatgcaacactgtgttctggcactcaccactgatttttatgtatttgtgtgtgtgtgtgtgtgtgtgtgtgagtgtgtatttgtgtgtattaagctattatttttattaaaaaataagaaatgggccgggcactgtggctcacgcctgtaatcccagcactttgggaggctgaggcgcgtggatcacctgaggtcaggagttggatgaaaccccgggagatgggtgaaaccccatctctacaaaaatacaaaaattagctgggggtgttggtgtgcgcctgtaatcccagctactcgggaggctgaggcaggagaattgcttgaacccaggaggcagaggttgcagtgagccgagactgcaccattgcactccagcaagggcaacaagagtagaaactccatctcaaaaaaaaaaaaaaaagataagaaatgaatgatcattgtaatactcaaaaggctgacaggaagaagaaaaaaataaaagtacagataattaacaaatgtttattcctaattaagatttgatattaccacttctgacactgaacattacacctttttgtttaaatggtagggggtggagaatactttctattaaatatataaaatcttcaatacgtataagtgttctttacctaactgagcaataaggattcttttactctctaaggaaaacaaaacaaaatacatacatatgtatacatattttcacataattttgttctttatccaactagttagccaggataggcaatatttatctaatgtctcagagttttagtgtctacctatgaaaaacaggtgcgttattttttgatgctaagattctatgcgcactctctagtgatccttataaaatagttgattttaaaaagccccagaacttgttctgatgatgcaaaggagggatgatgaacacgggctgagagtaagagaccataaacagccactgtcattcagctacaagggaaataatgaggcaacttagccaggcatctagcgaagtgaagccccagtaagcattactatatttggggaactcatatttaaagtaattaatagctcttcaactcttagtggccaactgacttgagaacgggcaaaaaaaaggccattaaaaaggaaagccaaagcttcatatccttggataagtctattactttttaaggctcaatgtccttctcctgaaataaggacacaacactgacccgaatctttgcccagggtgattgtgaggatcagatacaaagtatgtgaaaaccacagtgcactaaattatttttaaactcatttttaatctaagcttttctactatcaaaactacagccaattaccctttcataatcccaaaacagtaatgtttaagtagcagatctttttaaatcagtgttttaaagatttagatgttaagaatttaatattacagccttccctaatagattctctagggttacactaacatgaccaaacagggaaaatatacatttgaaagctgttatgcagtcaagtggcagaattcgaaatggctatgaaccaatcatttaggaggttaaaatctctccaaaataaaggttgacatatattgcactggtgaccacttttaccaatgcagttgtagagttttccatggcagaatcctcctgaaagatgctctaaccctaaaagctagaaggggactctaagcacagaaaagacatgaagccaggggtatgatccattaagtctttaaaagctatctgcatctatgtaatacccatttaatgtccagagatgatagaagaattgatagcatacaatagacaagcagatacttagagatttaacttctctaggcttctacttcctcatctacgaaatgggaataagagtctcttctgtgggatagactgaagaggagagcacacataaagtgctgccttgcacctggagcacaggaagtactcaacaaatcaaagttatcagtaccagggagaagcagagtatttcaattatctttgtccctaaactaaaaaccttgctccttaaaatagtatttgcactaagatctcctccaaaacgatttgtcacagaagtagagcataagagggcattctataaataagaggggactgtgtagcaggacactggggaacaataacacttacttatccagtttctgacattgaggaaactttgctcatttgtcagatcaaaaagtagaagaaaacccatagcatctctgaagaacgctgtcgttaagctacgaaacctaggaacataaaagcagaatggtcagttaaaccacggccccactcctgaaatataaaactacaagcaatgccttcagcctcttacaaaagtttaccaataacaagctacatggtgatatttcaaaagtatataggatagttatttatcacttatatcagtttaagtgttaacagaccatgtgatttgaaaaccgaggctgctggagagggatgacaagaaccagcttgtgatcttagtctcacccaagaatttatgtacaattatgagttaatttggccaaaagcaatatagtgtatgttttcctattgtgaaagcttgacttgacattacaatgtgttccatgatcttttaatttcagaatatgcagagatctcttatctctgatagccatttgtttggcttgaaggtaagaatctcttgactcagaccttattctgtcttggtactctgccttccaaggctttatccttctgtcttccctgtcttctctctctctctccccacccccaaccccaccctatcaccagtcagtttcctctcgtctttgcctatatgtaaaacctgtaactgacaggcaggctccagggaagaaaatattggtatgaatttgtcatctaatcagcaatattaggtttttctcaaatacttttaatcaatgtttttattaaaaagagttcttggccaggggccatggctcacacctgtaatcccagcactttgggaggtcaaggcaggcagatcacctgaagtcaggagttagagaccagcctgaccaacatggagaaaccccaactctactaaaaatacaaaattagctgtgtgtagtggtgcacatctgtaatcccagctaatcgggaggctgaggcaggagaatcacttgaaccagcaaggtagaggttgcggtgagctgagatcacgtcagcctgggcaacaagaatgaaactccgcccaaaaaaaaaacaaaaaagagctcttatcttttagagctacattaccacaagtattaaaaatgaaataatatagtgtctggaatttgcttctaaattatatggtaagggggtggggtgagaagaggtaaggggtataaatgaaattctgttggccacaatttcataattgttgaagctgagtaatgggtacataggtttatcatataatccttccacttttgaatatccttgaagttttccataataaaaagttaaaaaacaaaatccttcaaggtggctgtgaaagaaaacagaagttctagctaactgaaagcaactttatatcaagatttcatgtggcttattttggtcaagtaacccctggtcacatgaattaattccaaccagatatcccactagatttcaacagtcaggtaagaataatgcatgtaacttggccactttcttgtggttgagtaaatagcaaaaggaaatggagcaaagtatctaagcaaaaaaaaattaaaagaaggaaaagaaaaaagtccacaagtaagagtcataacctctcccttgaccttgtatgaaataaggccaccattctcatctcagacttgacaaatttcctgctaatttggcagcattcaagtgcaaaccaacgaattggctggctttttcctgctcaggtcactgtttgaagaatgtaactatttttccctttccttcagtaaggagcacataactgaagatctcatacctctcctgccctgctgtgtcccataactgcaggtggattctctggcctctgccagtggctccatccggcccactggctctgtacacctaaaacagcaaagtgaaagagaaaacaaaagagaacttctaacaccagcgaaccttctcacctttttgttcagtacaaatcccaaaggcatctaaaattccaaagagaatgccatctggaatacaaccatgtttgtatttatgtcaaataattatatccaggtaatgtaataagttatattgaaatatatacatatatatcttataaatatattgtaaaatatgaatacaaaacaacttgtataaaatataataattagtttacctttcctcaaagttctcttgggtcactagtttcaggaaatattacttttctatggcttttcccaatctcatcttttttgtttgtttaaccagggggtacatgtgcaggcttgttacgtagatagattgcataatgctggggtttgagcatctattgaattcatcacccaaacagtgaatgtagtacccaataagtagtttttcagcccctctcccactcccttcccccttttggagtccctagtgtctactgtttctgtctttatgtccatgcgtacccattgtttagttcccacttataagtgagaatgcatgtggcatttgattttctgtttctgcattaattcactgaggataatggtccccagctctatccatgttgctgcaaaagacataatttcacttttttatggctgcatagtattctatgatgtatatgtaccacattttctctatccaatccaccactgataagcacctagggttagttccatgactttgctattgtgaatagtgctgcaataaacatttgagtgcagatgtatttttggtagaacaattttcccttgtcccatcccaaattttaaaagtgctcttaaaagaattttatagacaacactcctagaacagcagagaacggaccatcaaaaatttcttcctccacaatagcaacaaaaacagtggtaaaaattgtccaaatcaactttttcagtactctaggaattaacaaagacttgcaacattccaaggagcatttattcaagaaaaacagccgaatatcagtaaaaacagtaagctttgaggtgttttttaccttgccctattcccatccccctcactcaagcttttagaagacttaaaaaccatgtgcacaaatgtggttgttgtgaaaacatcagcctagccaccactgtggacagcagaggaacaacaggtttggagctccctaaaagtcccatactgagaaaaattgtcaggaagccccttggaaagctccatgccccagctttgtctttctttgacctcactcaaagcttgctctttgagaacagccctatcccaagggcatttgttgaaaactatcagcagtaattatttaacatcacagctaccagaggtagcaataccagttagggctaacaaaagtctaacaacaacaacaaaaaaaaaatttaaagaaaaaaataggaaatgagatttctataatgctcccaaatattccttggaacctaaaaggccatgttcatgggcagggctctacaaatgcccaggaaagatctaaaaaggtcctaatctctcacttctgactgactttgaggttcttctcaggcagaaaataaaagctaaggcagagttgtaaactgcctgcagtagtattaaacacataccccaacaaacacacagagactctcagaaaaagctaagagacttattagttcaaggaatttaataaactctctccactcattagctgtccactaagttgactgagcagagacttcagtagctgcatacaaagaatacagattttgcagaattatcccagaaacataattaaacaaacagcaacgacaaaaataaataaatatgcagtaaaaacaagaaacccaggtaggggaaagaatctgagtttctagaatagacacattattttaaatgtccagttttcagcaaaacgtataagacacacaaagaaacaggaaagtatggctcatgcgcaggaaaaaaacaacgaatagaaattattcctgaggaggcccagatgttaaacttattagacaaagactttacatcaggaattataaatatattcaaagaacttaaaaatcagtaacatagcggtcctctaaaattaaaggataaattaagacaaaactgagaaaagtcatctctagcagacctatcctacaagaaatactacagacaactctcaagactaagctgaaaggaaactagacagtaacttaaatccacacaaagaaataataagcaccagtaaaaatgtaactgcatagtaaatataaaaaacagtataaacgtggtttttctttgtagcccttttcctccactagattaaaatttaactgcaggctgggagtgatagctcatgcctgtaatccctcagcactttgggaggctaagatgggtggatcacttgaggccaggagttcgagaccagcctggccaacatggcaaaaccccattactactaaaaatataaacaattagccgggtgtggtggcgggtgcctgtaatcctagctacttgggagactgaggcaggagaatcacttgaacctgggagacagaggttgcggtgagctgagatctcaccactgcactccagtctgagcaacagagagagaccctgtctcaaaaagaaaaaagaaaaaaaaattaactgcatacagcaataattgtaaagctgtattgatgatggcacacaatgtagaaagatgtcattcgtatagcaataatggcacaaaaatatgggagaaaacagagccacataagagcaaagttttacacagtattaaaattaagttgctattaatcaaaattagattgtgaaaaattaagataattgtaatccccaagggaatttttaaaaaagaactcaaaaacatataacaaaaaagggaattaaaatgatgcactagaaaatagaaaaagaaacaacagtatctatcaacagacaaatggataaacaaaatggtgtatcaatacaatagaatattatgtagctataataagtaatgaagtcctgatacatgctacaacatggaagatccttgaaaacatcaggctgaatgtaagaagccagacacaaaaggccatatattattccatttatatggtgtgtgcagaagccattgatagaaaattcatggtggctaaggggaggtagaaagaggaatgcctgctaataggtatgaggtttctttttaaagtgatgaaactattctaaaattgaatggctgtgatggccacacaactccgaatatattaaaaaccaccgaattttatactttagatggatggatttcctttttttgtgaattatatctcaacaaatctattttttaagttatacaataagtaaccaacaaaaataatcacatacatatatgtagattctatcaactacacgtcaatactaaaaatttcattagggccctactgttattcagtgggtcttaatctctataagcctctctggtagtagaataaaatactagaatgggcaaaagggaatgttcttctgtcttaaaagccagggacctttccccctgacagaatatgatccattaaaggacctttgtcattaatttcctgacaactggtttacctgcttcaggccaacaatggatttttcaacaagaaatgtagtctaaggagaaagccatctttcctcatctgcaactgtgacaccatgaccttctgccttcccctccaacactagaataactttcagtctcaaagtccttaaaaaataaataaataaaagtttctcccttcaacattctgcagaacatcacattcactactggcattccccactcctactccaacctcaccctcctggcagcagtgataagttctgccagttagtgttccatgtggaactgctgagactttattaggagaaatgccattaaaaataataagataccaaaggtggaagacacagcccataaaacaagagtatgaggggcaaggtggttggcaggcttcaagacaaaggtagacaaataactttcggagttcagagggaagatacaagccaaaagagtaccaaggtgacattttaaagaactgtccacttccactttgtctgcctggttttatatgaagtgctgtcagcacagccttttcaatcatgttgcctggattgaacataactcactttcatatgtacctttaatttcagatcccaacctttgtcctcctaattcctacaaagtaaactaaacagaccagcaaatgttgacttaacgattacatttttacatagaaggatatagaacttaccactcttttttccctgaaatcaatgcccactgttgtgataaatttggagttaaatttaccatctgtatattggtaaagtacactggtcttccctacaccagagtctcccaaagctaaaaacttgatgaggtaatcataatctccatcagacataatgaagaactcagtagttcacctgtaaaatacacacaaaattttttaattaaaatccattagaaaacattaattatccatttaaaaagtgacaacaatattcagtttaacacctaatgttaacctgtatgtctacgggttgtatgaaaagagagttacatacatattgttcaccatccttgaagacctaataactagctagatgagaagctattgaaatagtaattaacagtgtagttttaatttaacacacaggtaatcccagcactttgggaggccaaggtgggcagatcacctaaggttgggaattcgagaccagcctgaccaacatggagaaaccccatctctactgaaaatacaaaaattagccaggcatggtggtgcatgcctataatcccagctactcaggaggctgaggcaggagaatcacttgaacctgggaggtggaggttgcagtgagccaagattgcgccattgcactccagcctgggcaacaagagcaaaactctgtctcaaaataaaaaaataaataaaaataaaaataaaaataaaaacatacatattatagtaccattaggacaaaaatttcaagtgggaatgataatcaacaagaaggtaacagtcactaagtcttatctgtagaccatatagaacaaaaactaatacaagaaaaacagaggaaagagaatgttataaggaataacagtaatcattagagtgcaagtggttccaatttcccctcctttttcaaagtctcctagtgctaaaatttgcaattgcaaacataaggaaccagtccaaatgctcaccagtcaatgagtagataaagaaattgtggtacaccacaatttttttatctgtatatatatacacacaccacggaatactactcagccacaaaaaggaacgaaataatggcattcacagcaatctggatggaattgaagacaattattctaagtgaagtaagtcaggaatggaaaaccaaacatcatatgttctcactcatatgtaggagtgaagctatgaggaagcaaaggcataagaatgatacaatggactttggggactcgggtggaaagggtgggaggcgggtgagggataaaagactacagattgaatacagtgtacactgcttgggtgatgggtgcaccaaaatctcagaaatcaccactaaagaacttatccatgtaactaaacaccacctgttccccaaaaacctatggaaataaaaaaaaaagaaagaaagaaagtctcctagtgctagaaccttgccttttctctctttttacatggacatctaggcaatttcatttattctattcattttcacatgttattacggttccttcaaagacactgttatttcacaagtaaatttagtccctgcttccttacatattactattaatatgtactacatattaagccagacttctctagagtatcactgctcacttgggaactgagttccagatttgaacagtcactgctcagagaccacagtgccacaaccaagggctcgcttacctatgtttacctgggtactctatcaagaactgctaaaaattcagctcttcagtaccgactaaaacaaaagtccaccttaaagaagaaaaattcatttatatcagcaatacctaaccacggctatttttggttctttgcaatcagcacttttcatgatttgtatttaccttctaaatagattcaaacccaaaatatcagtccaactagaaatgggatctctctccaggggaggtttactttttcattaaaattttattgatacataatatttgtatatttttatggggtacatgtaatattttgttacatgcatagaatgtaatgatcacatgaaggtatttagggtatttatttcctcgagtatttatcatttctatgcattgagaacatttcaagtcctctcttctagctattttaaaatacacaatacatttttgttaactatagtcaccctagtctactgttgaacattagaacttattctttccatctaaccatatgcttgtacacattaaccaacctctctccgtttcccccgccaatgccaataaactctcctgaaaatcataaaaacaactagctatctcattaacactgacgactctacatgactattcaaacatacatatttatccatctatacacatgccagatgtcctacattggatgctactgactcccggcgttatcccctttttacccagcaccatatccagaaacttggctgccatattcagtgcttcctgtaggactatttctatatatccataaaattaataaaaactcagacaagaatatttactggttttcagtgttacctccctcaccccatcctcaacttggggactcaccttatgctgaaaactcctgaatgctgagccccaaaagccactgcagtgtgtttcctcagagtgcttcagtgcagatctgcaacctcacgtttcaggtatggctagcccgtggataagggcagagcctctacaaacattcaaaattctatttgcacactataaagagtgacacttcacagatgatgccttacctgtctttatagcttggatatttgcaagtataggtcaccagtattaatgacatataacagaattcctctccaaaaaacgacaacttggacatcaacattatagcacgtcatatcacagcatcacacctggctctaagttattggaaataagagctaagaattgaaaagcaagtccagataatgttgactcatttgagggcttcccctcaaactgaatggagcagcagataacaataccgatcctgcagtgagaatgatgcaagaagacactgtgactaccttatttcctatttatttttaatttgaaaaaaaagttggtataactatgttttttacatcacttagggtacaggaaaaaatgctgtcaccaatggcatcatattctagaattctctaaactcacttaagtggaattcaaagacttaaatgaaactatctctaatgtgtttcatttccatgggtaatcacacatgtaagtctacaaatgatcttcgtgagttttgttttctattcacaatagcaatactgaccaagtaatcataaagggactgttaacaaaccaaataccataaattgaaggtatagacaccaccatcaatattaatcatagtttgcacttttcagattgtatctttaagacaattatctgctttcttgatctgaaaataaatgttcagaccttccactctctgggttcagttttctaaagggtaaaacagaacccagagaggtagactgatttgcacgatctagaatctagatctcctagctccaagtccaatgcctattctaccccaagcttcatatccattattcatttttgttataaatgcacattgggctttaaagtgaccagtagtatggtatcttacaaggtaacctaataggaaactcaccaagtcaagcagagctgggtttgaatcccaaatctcccagataccaattacttggatgtctttgagccttagatttccaggtttctgttctataaaaaagaatatacactacctcacaccattattctgaggattcaatgagatactgtttatggagtgcccagcacaatggttggcatatactgggtacttaactgttggctcactttattctccccattgtggacgttcagactgggtctgaagatctagaacaaatttcagattgactctggccagcttaaaacatgtctttctagcacaaacgattgctaactggctcaaagtggtcggctgagtcaacaaagatcactttcaaataattctgatcctttttggctggttctaaccatttgcaattcatttaatacagatatgtttacttcaaaagagttctgatcaacttaaaaagaggttcaaatccatataaaatacaccatccattttagcaagttcatagttgttcaaaagaatctggttcatattattttacggtgagttaaaagaggttctcctacaaaactttctgactttggctaaaacctgatatatctaaccaaaattattggagtctcattgtaattagctttaattgcttcagactggttttagctagttccaataggctctgacttggacatgcaggttctgacaggcttctaaaagttttagttggttctgagtatattttactaaatcaaactgtgctgacaaattaaatccactttcaattgagtcacactggttctacctctatcgaactgctggaaactagtttgataactatagttatctgtaaaattgtttttactggtttagaccaatatagactggttcaaaacagtctgaaatgtttcaaattaatttcagatgttcaaacagttcaaaactagaaatgtaaaatgacaatcagaagcaacaaaaacaacagtttggtgtttaaaacttgtgccaaaccaacaaacttaaaattttatttttaaattacctcatttgtagatattctgtatccaaaaatttatctccaccattatatactgtataatcacactcgaacagcatgtatgtgttcgagtacagtaaaggattgggagaaaggagcactggcataggagaagatgacagataacagggaaatatgtgatgagtgacacaggcttcctgggttgagaattcacctcccattttacctgaaagacctggcagcaaaatattcacccatgacccaacaatgaagattctgattggggaaaacctttagcaaatttggaggctgtctagagtttgttcaaaactgatcacgctgaccaggctggtctgggttaaaagagaccagaattccaaagaataagaaaatttcagagaaataaagggagttgggggcaggcaggttttcaaaataacagatctttcaaggtttgggcatggtgttgagggcgacagccttcttatctgagcttgcagtccagttagtgaaagcctggagttagtggaattaccccatctttcagcagaaaatcattctagtctataccagactatactcccacctccatcctgcaagtccatacgtggctttctcatcactacttatcactactaggtgaagacaatttaatgttaagtctcaattgatggtatattttcatataaacaatttttgttctcttatttattattcaagtcctgagtagtattcctagggcctgttttccagaaagaaaatactccactcctcaaatacagaaatctaataacgtaaatgatttttgtgttggcatttcatttcaggaaggagtaaacagtgagaacacacagtaccagaatttgacatttggggcacccaaacaacgttgtatgctcaccatttcctgcttgtactccagcctactgaggtttgggaagccagttcacaagggcttccctctgacactctcttgctgaaaatgggtctgaaacctaggtcagatgcccacatgtcaagcactttacacacattagcacaacaatcctcatcactgccctatacatagcatatacactgtctccctcagaaagatctagagctgttctatcgtaagtgcttcagtgagggcataagtaactgagtcttggccagtctacccacatattagcatgggcacaattccaatctattgttgagagacaggaaaaaaaaatggaggttaaaggcagaaactctacaaccaagccacctgtatttgagtccagtcatgtaactttggaaaatttatttagtctcttttgccttgggctcctcacctgtaaaacaggaagagattctattttatcaattctaacatgctttcttattttaacttctttaaaattggggtgcatcttacatttcagtcttacaatccaagacatcttgcaattgctattattgcaattgcaatagagatacaactgtgtgaaagctttttgttagcatcttctagcaaggtcaagaatgcatcatcaatatattttagactcaatgaagcacaataataaagctatttctgagggctgttgtgaggactgagctagtgtatacacacaaagtttggaacagtgcacaggacatagtaagttctatgtaagtattagctgttattagcagcagcatccagcaatctggcttccaagggtcaatatgcaggcaatgttcttttctttcctagaagtataagaaagtacattgagcccctaaaccaaaaattaatttttaaaaataaggatctgctaagagtatttgaagccaaggttatatatttaaactctgtactgccttgagaaaagtgctgtctacctcaaggaaatatcttctaaaaagtcaagaatgaccttaatttgggatatgcaaaagactttcttattcagctcacttctctctctcctccttatacaaatattttttcaaagtgctctccaccctcactatcatcagattaacaatagaaagcaaggaacacccatttcctcaacatgtactatgtggtgttaattgcctggtgagagaaagtctatcatcttccttatttttaaaataaaacatattttcacctgtaataccagtgactgaggaggctgaggcagaaggatggcttgacgtcaggagttcaagactagcccaggcaactagcaagacctatttatatatatatatatatatatatatgtgtgtatatatatttgtttttttttttataaattaggcaggtgtggtggcattagcctgtagtcctagctacttgggaggctgaggcaggaggattgcttaagcccaggagttcaaggctgcagtaagatatgctcacatcactacattgtagcctgggcaacagattaacatcccatctttaaataaatttatttaataaataaaaataactgcacatgtacccctgaacttaagttgaaggaaaaaacacttaaagatttttaaatgtttttaaaaatactttttaagtgttttttaggaaataagatagaagagagtagatttagttaagaggaaagggaaagatctagttctatttctccctctctctctctctgctacacacacacagacatatcacagcccagattttccatgaagtgtcatattaaagtgaatcatagactccaaccttaggatcccccactattaggcagaatcattctaaaactactctagataggtcagccattttccgaaagccaaattttccctctattactcatatttagtacagagcaaaagaaaggggaggaataatattaactgaacagcaacatgtaataaatatacttgattttattttatctgctcatcatccttaaaaagaacttcatgtctggacaagactcataccatatagagactgatgttttctcagtgtgatggcaaataggcttgagttcaaattctgacttttctactttgtatgatctgatccaagttttttatactaagccttattctttaaactgtaaaatggagataataacagtactaatctcattgggttgttttaaggactaagtgagataacccacagaaagcttttagcacattgtttgccctgtgctaagtgttcaataattgagacttattaaaaatactattattaatagtttcaccacgttcttcattagcaaggcatgtaattttataacctattcttaatgtaaccagtacctgaaccttcagaaaaatcacagaaagaaatttaagttaagtacaatgattttggggcgccctatccatcacaaaatctaccttggcattccaatctaagaatgagttgtatctgggtgatttttggtaatttcagacctaggagtacccatcagttgaatgctctaatttccagaagaggaaactgaaactcagagaaggtaaatgaatagtctgaaataaaccagctagttagacatggggctaatctagatctcatgtctcctaaattctagtcatgtatgcatatttttcttctgtctgtattccttccttcagagtgagaaacctcagttacagctgcttgaattcaagaatcaaaagttttcttcagtgccagcagttatagcagtgataaaatgctttataattaaggcttgtgctctcagagaggttgggttgagggatctgtacttctgtgctcagagtccctctatcaagaagcccttcatcctgatgggctctgccaaggacagaagtcataaattgggagcttgtctgcttcttgctggtcattgcaaatccaagaaaaaaaaataactcttcttaatacttgtaccatatcccataaatcatctttctttcctatggtttcaaaatgaaaagcaagcagagcaatcatgaaatttttcatttacctgtagaattgctcggccccgttttctctcaaataagtattttcctctcgaataagattattttaggccaggtgcagtggctcacacctgtaatcccagcactttgggaggccgaggagggtggatcacctgaagtaaggagttcaagaccagcctggccaacatggtgaaacgctgtctctactaaaaatacaaaaaattggctgggcatggtggcaggcacctgtaatcccagcttcttgggaggctgaggcaagagaataacatcgagatcacaccactgcactacagcctgggcgacacagcgagactctatctcaaaaaaaaaaaaacattattttctctgacatcatgtctctgtaaggacacttctggccctctctctttttccttcattcaataaatattgattgaatacttattatatgctaggtgccagggtacaatggggatccaactcagttatattcaatgtggaaaatctcttactcttgcctaccttagaccttatagttttagccatgtcccagtctaacttctcccaacaactatacctgcctttgggttttcaaataagtccatctttctgaacattttaagcttctctcataaacataacacaatatgacatcaaaattcatatcctaagtcacatgtttgacaaagatgcaaaaggaataaacatggaaaaggaataaaagtgtgaagcttgggcgggcacagtggctcacacctgtaatcccagcactttgggaggctgaggcagatggatcacttgaggtcacgagttcgagaccagcctggctgatatggtgaaaccccatctctgctaaaaatacaaaaatacaaaaatacaaatggctaggcgtggtgatgggtgcctgtaatcccagctactcagcggggttgaggcaggagaatcacttgaacctgggaggtggaggttgcagtgagcagagatagcaccactgcattccggcctgggagacagagggagactccatctcaaaaaaacaaacaaacaaacaaaacaaaacaaaaaaacacataaagctcagtagagaagaaagagacagcctcaacctcctgggctcatgtgatcctccagtctcagcctcccaagcagctgggatcacagcagtgcacaacaccatacaccatgcccagctttttgttgttgttgttgttggggggagatgacgtctccctatgttgcccaggctggtctcaaactcccgagctcaagaggagaaatttttataaagagaaacataaggtatattataaagaattttttatctgaaaatattttgaattttttagaatggttcaatatttgagtgttcctatgtagcttatggacttcacttattgcagtgcaaaattatttttgcagagaaacaggagcagatgaatataactattacttttcaaatagcacagaacatcagcatttatgtgaattataacaccacatgttctttcatataatttaacatccccttgttcagtgattgatttggagaaaatgttcatatacaaatgactggcatagaaatataaaccttatcagtacttttatgtttaacgttaaaaagcagtaggcttttcttgctttttttgttttattttgtttttgttttaataatgccattgtggacccatacccggcattctggaaggaaacacataacagagacaccaaaagcaaggaagagaagtcacatggcatgaggcaggctagaagaggcattttataatgtaccaagatatatgagtagggacacttgtatttaccaaatgagccctggccacaactctcacagaccattacaattcctacaccctgaggtggaacacagctacttccacttcaaaagcaagatgcatactgcccaatagcaggaaccccatttccataagtggagacagcctatgtcttccgtgcagtttactcatctcaacttctggtctagatgtgcgtagatatggttgcgccctccctaatatgtcaagagtggaaaaaatgatgttataaacaaagagctcatcttgtttgtgcaaaatctcaggcggagagaagtggaaatctaacacctttgaaaagtagaaggaaacaggaatatgattctttcttgtttcttattaaaagatgagtttgattttatctaaattcagaatattagataactgcattttatattcacctataacctaagattcataagtgcattcctatcagtacagtattttataataataacataagtccatccttaacagtgatgttgaggcagcagagaagttcatggctagaaactgttgagatcttaagttctatagcatttggcttaatatttataaatgcacttgctacataggaatattccatttccctcaccaactgctagaaaactgctagaccaacttctagcagatggtgatattccactatagcaagttcttcagacaaaaaataaaattatctgtaaatactgttgaattaaatatacatttctgggccgggcatggtggctcatgccagtaactccagcactttgggaggccaaggcaggcagatcacttgaggtcaggagttcaaaaccaacatggcaaaacccttactttactaacaatacaaaacaattagcctgtagtcccagctactcaggagggtgaggcaggagaattacttgaatccggtaggttcacgggcgataatgccactgcactccagcctgggcgacagagtgagacttcgtctaagatatatatatgatatagatatatatataatacatataaatatatatacacatttataaatgcttccaaaacaccaaaacatacatcatttttaacagcatcttccagatgttcataatttttcttaaagagaaagaccaggatgaagaaaaaaataagcagtcatagcccagaaatccatcaactatttctgaaatgttaccatcacctcagtgggtgaccaacataacccagtaggcaaataacacaaacaactgtatgttaggaaacaagaggcgttgaaatgattcctgaaagcagaaaacgttctggaagaccaatgtcaataactcaaatgagatatcggcttttttttttaatttattgaaaccattgacttcatttacccaaaagacattatttgttgcccaaggctcttccaggatcagaatatgaatgtttatagagatttatggaaagtaaattcaccaaaacactgggtcttatagtacttatagtttgtgacaagtaccccttgctccatagatatagggtaatagaaaaaaaaaaagcacacatagaatatatgtcattggtaaaacataggcagtacagtggaaacaggtgtggctgtttgatttgcttagtaatatctcaaataatgtgacggcagtctcagaatggacacagccactcgacactccaaaagtctgctcaacccatagctaaacatgcctcttaccaccaccaagaagcaagcagtctccaagaatttggaatgagtgcaaaatctacaaagtatgctcccactgagtggttgctttttgtgagcacatagaagacagtgaaacacagacttcggagtcaagttctcctaaattcaaataatagtataccacctcctacctgtacaaactgaacagcaaaatgcctgatgaagatcaatgaatcatagctattcttatgattatgacagattaaggcttaaaccaggcttgagcactgatcctggggctttttccagtctaccttcaggatgacactgagacttcataaagctatcaaagaatggagtggaaatatttcctgaaaatgaaaaaggaggaacaacttaagctacctggaaggtagaacatctgcaagtccaactggtaagtacagggaattctggtattaacaagctctgaagaggtaaaatgaaaagctttggttatctcagagtgccaccaaacttgtgggcccaaggctcaaaggcagaaaaaaatagaaatgatagcactgctaccccagccaggactgagagaattacaaatcagatagcactcaaaagaaaaaaaaaaaatcagatagcactcaaaggacttcacattgcaaagagaatttccaagttgcaaaacacagacctaaaaacagtgtcaaggaatctgtcaagactcatcttcctagaacatgaaacatgcatggaaagcttttgaccaacacagactgactctcctattgcatctcaacttcctcaagttttctgtttgctgcaacacaggaaagatgttaatctgttagggaaatgcaccaactcaaaaagcaaaccctttgctttctgaaggagcaatgatacttctttccttccaagaaacatgatgaattagaagcagccagacgtgttaaacatgactgtccaaataataaaaacaattagacaaacatccatgagttggcagtaactggggaagagacgggcgcatttatcattgactttgtacaaaatgagaatatgagtaccatcaatttgacacatagatacttacaaagactactaagaggcaccaggtatggcttcatgcctcccttgtcctgcctacccaacaccctcttcctcactaaccacttttttttttttttttttgagactctcactctgtggcccaggcgtgagtgcagtggcgcaatctctgctcactgcaagctctgcctcaggggttcacgccattctcctgcctcagcctcccaagcagctgggactccaggcgcccatcacctcacccagactacaggcactaatcacatttaagcagatacattctctgcccacaggaatatgttcttcaggtacatggtggcatgctaaagcacacaggacttccatctcttcacagctgattttcatttccatagtcaaacatccaccctaccacaccccatgctgtgttccaacagcctcacttccaaccatcatctgggtgccataacctctctacagtcttcttcctctcctggctttcctgtccctcatctccaggtactattgccaaactccggtttgcatgtgcaaaaagtgacatgaaactaacaatattagtgcttttcttgtaacacactgagttgctatatcaacttcaaggtgttcaaccctcctcaataaattcataatgctgctgtgtcttcaggtactcccacttttccaatcaggaagagtttttcccctgcaaagtatgggaaaagagccattctggaaaaccaagtgtttctaatactatgccagttttggtttcaccataatgttaatgaaaaggtagcattctgatacaaatagatcacgtgtttaaaatattagtatctataaatatgtttattatatgccaacttagttcttttaaaaacattaaactaggctcagaaaaatcaaggcttttcctgatgttttaataccactaaatcaatgatgccaggattcttagcttcttccatttgttgtcaataagctgtagacagccagctatatataggtctttttggtatttgtcaagtctactgtctccattaatatatatttacaacacatgtttaaatgtttccctaaatatcatattctttaactgaaccaaaaaaaaaggaaactcacctaatggacaaggtcaaatcagatatatttcttattgcttctcaaagtctttccttatttcacctattattcagtatgcagagtctcagaactgactgtttgcatttctatcagcagctgtttatagaatggggtgtgacttgcgtttgcttatgcaaaatgactgaggaacaacaatgcacagccatccagccagtttctaactcagcctgtcagattacagttggcttttttgctattattgttgtccatctctaattttattgcattgtgatcactaaatgtggtctgcttaacaacaaatttggtggaatttaagaggaattaagtgtatttatttagaggcagggtctcactctgtcacccaggctggagtgcactggcgcaattatgtctcaccgcagccttgacctccccagcttaagcaatcctctcacctcagcctcctaagtagctgggatcacaggtatgcaccaccaaaaatggataattctttttaattctttttggaagacaaggtgtcactatgttgctgcccaggctggtcctgaactcctgggctcaagtgatcctcctatctcagcctcccaaagtggtgaaattacaggcatgagccaccatgcccgggctgaattaagttttataaatgttccacgattatgtgaaaacaatctgtacaccctgttagttggatgcaaaattacatacattctagtcaagctagttagttgtggtttttgatctgatatatccttatttatctttttgctacttcatctgtttctaagaaaggtgtgttgaaactcctagatcatattcatttttagaaaataagcccaaggtcatgtcttaaagaggatgaatataaagcataataaaagaacaagcattgcagtccttattcagagaagcattaaatttgtgcttttcagtctgttttctatgaaacgctgggattcatgaaaatactttaagagttctgtaaacttattaagatttttttttctatgtttgttttttgtttttttgagacagaatctcactctgtcacccaggccggagtgcagtggcctgatctcgggctcactgaaaccaccacctcccgggtttaagcaattctcatgcctcagcctccctagtggctgcgactaaaggcctgcgcaaccacgcccagctaatttttgtattttttagtagagatggcgtttcactatgttggccaggctggtctcaaactcctgatctcaagtgatctgcctacctcagccttccaaggtgctgggattacagacttgagccactgcgcctggactccttctattatgttttttaaaaactggaataaaaaaaagtatatagtcaaataagttacataccaaatttagagacctccaagttatttacttatgctactttgttaagctatttatggctacctttaacgtatacatgttatttggaattcctataattattagttgagaagactgtactttgcactagacttctctcctttgcttaatcagaatggattaatttgtctattgtgaaattatttaaggaagtacatgtgaactacattcagtaaacggcagtcaaagctcaggcacatgtttcagcagatgtttgctttcatcctgttacaacagtcaattgagcaataaagaatgaacacaacatgttgcatcacaacattttattacagatcactatagagattattctttgggaagtttgttgtctgacttctagaagcatgaaagggctattctgggtttgggctacttctttttcatagcagatgagtgtcttcacagtcagttcctgcataggaaacctacataatgtcattgcaacaaacctttcattgcctcagaaaactgctctggcccagctggttgcaaactttctttagcaataaaactgtttcttcaaataaaatcttacatggcaccccaacatataaaacagatggcagcagagtgatattctaatgaaaggagtgaaggtcaagacaccaacgcccatagacccaacaaggacataagaagaatctcactgtacacatttagaaaatcattgcagaaaggtctacctacaatgcagctctgaatcgtctcatttgcctttggctttgtccctaaacacttcctctctgcctaaccacttcagttgacagctcatttgtaagatctgccacactcttttattcagcgtctcctaaagatgccacctctcagatatcaccttaacacacttcttatctgggagggatttgaaatgctttgggtgtccctggtgagaactgcaagaggagctatttaaagcttaagagaatgaaagaagaccataggaagagtcttgagaacaaccatcattgcgtcattcctggggaaagggtcctggaaatgagtcctggaaaaatcgaggccaaactgcccaaaaggcaaccaaagaagcagcatcgaccatgggataggaaactggtgtccttaaaggggcaagagagaaaactgcagggaggatgtctgtaaccagctacattggtgatcctttcttgtatctaaatggacactttgaggccatcagaaaatatgaccagattagtcctgatgggctcaaaaatctatatatggatgaaccctcaaaagtcaagatgtggtttgaagaacacaatgaaatgttggtatagcaactttaagataactgagaatatattattttgtgctgtatcagaagccactttatactaaattatagcacagaagggaataaagaggtacaaaaattttttaaaatactgatcaaagtaaaagttcagattttctctactaacttcattttctttctatgaattcagaagaaatttctagtattaggctcagctaatgtctgtgtcatgaggagtgttttacatgaaagtacccttgcttgaaaccattacaaagttccagggaaggagaaagcggcatgaggtagaggggacagagaaacccctagcactccctacctggcttcatgtcaaggcagcacaaaatcaactccaacccacagggattaagtacaaagggagttttcagacaggtgttcaaagtcataccaaggtcaaacaccaagagactaaggagcaggtcaacaaaggggaagagtagtttatggatctgggagtcttggaggtcagcattccaagaattcaagaggacatctgggcagacaacacagttcattagagcccacagcaacagtagctagaaaagaccgggggagggtggtgagggatataaaaactacatattgggtacaatgtacactattcaggtgatgggtgcactaaaatctcggaatttaccactatattattcatccaagtggctggatacagtggctcacacttgtaatcccagcactttggcaggccaaggcaggtggatcacttgaggccaggagttcaacagcctggccaacatggggaaaccccatctctactaaaaaatacaaaaattagctaggcgtggggacacgtgcctgtaatcctagctactctgaaggctgaggcacgagaatggcttgaacctgggaggcggaagctgcagtgagccaagatcgcactactgtactccagcctgggcgacagagtgagattccatctcaaaaaaacgtacagaataaaataataattcatccatgcagccaaaaaccccaaaagctattgattgatagacagacagacagacagatagatacagatatacgtatctatctatctatatacaaaaaaaaagacccatagtagttgttgctttatcaaaagccagagaaatgttctaaccttctaagttacagcaatttattcaatcaacttgctttcctctactctgccaaccagtttgaaaggctccctggccgggcgcggtggctcacacctgtaatcccagcactttgggaggccaaggcgggtggatcacgaggtcaagagatcgagaccagctggccaacatggtgaaaccccagccctactaaaattacaaaaattagttgggcatggtggcatgtgcctgtaatcccagctactcaggaggctgaggcagtagaatcacttgaacccaggaggcggaggttgcagtgagccaagatcgtgccactgcactccagcctgggtgacagagcaagactctgtctctgaaaaaaaaaaaaagaaagaaaggctccctaatggccaggcgtggtggctcatgcctataatcccagcactttggaaagccaaggctgacagatcacctgaggtcaggtattcgagaccagcctggccaacatggtgaaacccatctctactaaaaatacaaaaattagccgggcacggtggcgggtgcctataattccagctaccccagaggctaaggcaggagaatcgcttgaaccagggaggcagaggttgcagtgagccaagatcgtgccaccgcactccagcctgggtgacagagcgagactccgtctcaaaggaaaaaaaaaaagaaaggctccctaagtattccaactaggttccttcactaagtttcgttttcctacctaggcagatggaaagccaagcatccaggttagaacttagtcccccaaggccataccttgtctctgtcctcagctaagcccaggataaggccatctatggaaacaaagctcctattttcttaacatgcctctgagaaagatatttgaagcctagaggttaagaacataagggctaaaataagcaggcaagagggtgactcagaaagaacaagagccttgtttaaaaaaaaaaaagagtcggggaataaacctcaatacagatttactaacacagaaataaagactttgtgttagcaaagagactatgaatcagcaagagaacaacgcaagaggataaaggaaattgtagacaagagcagcataaaccatgaagatgtaagtatccacgtgtttataacatggataattgataagtaataagtaagtcttcagaaactatgtttgagtgttcaggggaaatcacaaaaacaagtaacagtacacttaattttttaaatgaggttgaaatgagattctgcatgagagataactgtaaagtagtaaaaaaggtttcagaagtcacacatgaaaatcaatctcataattctacaatcacattttagtatgtccacattttaaagtataaagttagactttatataccaacaaatttggctgcaaggtttgtaagttgagttttgacctcgagaaataccttcctattttttaaagaaagaaatattataatgacattccttttaagttattactttcctatacatacttgcttatcacataaaaaatataattgctatatagccatcaagcattaaaaataaaccaacacatctaacaataggcctcaatggtactaatctattttcctagatatatcactttaaaaccacatatgaatgtctaagaaataaaagttttttatttttcttttagaatctacagcatacaacatgataaaattattttgtataaaaattataatttttaattaatttgaaataatttccattaatttctgatgcttgtaagcattttagatatacattcctttagctcttataatatacttataaactgtgaaaaattctgagacaggaaggaacagatattaaaattctattacttctaatctaaaagccctccatcttatgttctctgtaggagacagaaactcacaaaagaaaatgtttggcttctactattaagaaattggacatttttcacatatattacagtggaaggggttttacatttctttcaggcacaaaatatttatgaactcgggagcagcccaaacataaagataaaatgcagcatgactttccaaaccaaaatctgcggcttatgtctatggatttttgtgacccttttgggaaaaggcagagttggaaacacaatttagttgtccaagtattagaacttttaaagcatctctttgatttatgaagaaaatgcacaaaaatacgttaaaggaggcagtaccagaaaatccagcaagttgctcatcactacacacctctatgcacagatgacatgagcaattatttgtctttccttcacttctgactgccagggctcagggctgaggtcctattgactgcacatagtataagaaagggaagagaaagttgtttcaacggcaacatcctcacctacttatgtctcttttctcctggttccagtaattaacagaatgatcacaaactgaaaccaaactgcaactctatcccttccactctcaccctggaagcctgttctcataaatccatcctcctcggggtattcctttaatcaatgtttattaatatgaatgaatgctttggctaacttgtacaggtcatctgccacttttaagtactccattcccacctcatgggtgtgtttcatctctttggtacagttgcatatttcctgaagagtctcattttgtgtattgcttctccactacccctcaccactggacagacaactggccagctgtcactcaaatgctaattgtgtctatcatctgctttctctaatagccttttccttccgctggttccctccattccctgccaattttatttagaagtgactcaaaaagtgtttggggactccactgatagctgtgcttttttgataattaaaccatatttacatccaattcaacagtatttggtaagcaattactacctttccagtacggtgctagcaactacgaatggcatgaaagaaacacaggatccaactgctcccttcaagaagttggtaattagggtgaggtggaatgatgtactcatttacgaaaaaggacggataagacaatattatcagggagaaaaacgtctggtacaccatgtgcaccagccagcacaagaaatcaaaagtgaaaggggcttcaagtcaaaagacctgaactctgctacttccttcctagctatgtgtcctgtggtgagccagacagcttccccacactgtttcctcaatatgggaatatttatctagcaagattattggaaggattaaagggtacattatgtgaaatgcattttataaactgtaaactactgggtacatgtaagatcgttgttttacaagtcaagtagaggctgggaggtcagaaaaggggagcaatctgtcgggcatggaggctcatacctgtaatcccacctattcaagagactgaggtaggaggatcacttgagcccaagagatcaaaaccaacctgggcaacataatgagatgctgttgtacaaaaatttttttaattagcaaggtgaggtggcctgtgccagtagtcccggctactcagaaggctgaggtgggaggatcacttgagcccaagagttcaaggctgcagtgagccatgactatgtcaccacactccagcctgggtgacagagtgagaccctgtctcaaaaaaagaaagaaagagggagcaatctgaccgtgactcaaagcaagagccaggacctgagctgagcaccttcttcaaagccaggcaagatttagctagatagtgaagaataggatacacagcatgtttcatgcaagggcatgttttgacttcaatttaacaagtattgaggaggcttgctaatcatttcaaaggatacaaatgtgcctcagatataatcctctaagtacaaaactggctgtaaactcaaaggaatgcttatgaggtaatgtgacaaattgaggagagcaggacgactaatccattggtatatggggttcctctgccaccatctgtttagacccaggataggtcaccatccctctgcaggccttgttttatcaaatatgaaataagaggtttgaccacaatggtctctttccaacacagacattctatgctgtatgattccaggttcaaagttcaaagcttagtcatgagaaatttaagtggggtcatggtgacagttgtcccttctatcacctctcactccttgaagatgagagcctagatgagggcagccgcatgggaatgggaagaaggggatccaagatacactaattttaaaataatagaacagagttccacatcaggtggaaaaggacacagcaaagagaacaccaaagaataaagcctagggggccaggaggccaaaataatgttgccaacagaagcaggacatttgaagtggggaagggaaagagttggaatgggcataaggtgtttgtgggtggtatcagatttttggaagggaaggatgatgagattggatcggggcaggttcagcatgagagatcatcaaagccacatgaccaagaaatgcttgaaaatcatccccagtccctgtggcccacatttacctctgcccttgagacagaggcagagtagccaacagtgaaagctccaaaaagagggccatgactgtacaagccacagaagagggaacatgctgttagttcaggatgaacaagaccaaggataacagcagggtgctctcagccaaactcaattacacaggacatgatgggcagtccctgctgctctgattaaactcagtttccagatactatctccctgttgtaaagttctttatctggcagtgagtaaaaaggaaatgtcagggaagacagctagatgtcctgcacagcattcactcctcttaggagcctgcaataggcacctcctcagattccaaacttaggccttgcccatcatcatccaccacccatctgaatgtatctcaatgaaaacacacactggctgggcatggtggctcacgcctgtaatcccagcactttggcaggccaaagctggcggatcacctgaggtcaagagatcgagaccagcctggccaacgtggtaaaaccctgtctctactaaaaatacaaaaattagccaggcgtgcaggtgggcacctataatcccggctactcaggaggctaaggcatgagaattgcttgaacctgggaggcaaaggttacagtgagctgagatcatgccactgcactccaggctgaggcacgagaattgcttgaacctgggaggcgcaggttgcagtgagctgagatcgcaccactgcactccagcctgggcgatacagcgagactcagtctcaaaaaaaaaaaaaaaaaaaaggaaacacacagtgaggaggagttgtagtatcactttcctccagctccttctctgcacctctcactctccttgaaaccactgacactaagaaataagaggttagaacccttctcttattacccttatctaattacttaatgtctctgtgttttcctagaagaagaattcactacctataccaggtctatcctgtttttggtctcacttaacactgctatatgtatgtgcctgtctcctaatgcacaccagcaagagtttctctagaaaattgctttccaaccttgttcatgatatttgtatgacctaccagggcatatgctcttgatcaaaggcaataggttttagggccccagaaaggccaggccctgtccagccaccctgagggacaaagggttcaacatctcaacacatctgaaccaattcagtgcacaccagggggagtcacctcctctagggtaggcgtcaaagcgtgaaattcctgggctatacctatgcacacatgttcagtaatacaagataatgtcaaattgctgtccaatatagttgttttacactcccaacttcatatcttcaccaacatttggtgcttgttgtcagacttctcaaaatggtaacacattgtgatctaaattcacatttctctgagtgctaatgagtgtgagcatcttttattagtttcttggccatctagtttcctcttattaaaatgcacatttgtatctttctcctatttttctattgggttctttttctttaagacagagtctcgctccgttgcccaggctggtgtgcaatggcacaatctcatctcactgcaacctctgcctcctgcattcaagtgattctcatccctcagcctcccaagtagctggggctacaagcacgcaccaccatacctggctaatttttgtagagatggggttttcccatgttagccaggctggtctcgaactcctagcggcaagtgatccgcccaccttggccgtccaaagtgctgagattatagacataagccaccatgcccagccaggttctttttctatggatgtgcagttcttcatatattctggatactatttataagttatgtatgttgcaaatatattcttactgtttttggtttgtcttttcacttttttagtggctcttaatcttaaaatagtcaaatttattcttttttatagttatttattttatatcatatcaagaaagtctcttttttttttaatggagacacggtctcactccagtgcaatggcacaatcatagctcactacagcctcaacttctcaggctcaagtgatcctcccacctcagcctcccaataactgggactacaagcatgagtcgccacgcccagctaattttcttttcttttttgtagagatggggtctcactatgttgcccaagctagtcttgaactcctagtctcaagtgatcctcccacctcagcctcccaaagtgctaggattacaggtgtgagccaccatgcccagccaagaaattcttatctaaagcaataaagatattcttttatattatgtttataaagatactgcctttttatttaagtctttaatacactgagaattcaaggtatatgtagggatccaatttcattatttttcccttaagtatatacaatcgtcatagcaccatttattgcataaaattatcttttgcccagtgatatgcaataaatgaatggatctgtttcagggctttacatttggtttcgctggtcattttgaccatccctgggccagtgccacaatgccttaatcactatgaccctaaaatataacttcatacctgttacgactggtacccaccttaccaaggacatgaacccttcacatttccatctgagttcctcaaaaaccatatggggattcttattggaattgcattgcattgcattgggatcacataaatctatagatcaaattaagaagattgacatgttcatgatgtttaatttacctacctaagtacatgcatatttctccatctatttacgtatttttagtgcctttaaaaatattctcaaatctcacaaaagaagatatacaaatggcaaatatgcatatgagaagatgctcaatatcatatgttattagagaattgcaaattaaaacaagaatgagatatcactatacacctatcagaatgaccaaaatccaaaacactgacaacatcaaatgctggtgaggatgtggaaacccagaactctccttcattgctggtaggaatgcaaaatggtacaagccctttgttatagacagtttggcagttgtttacaaagctaaacttactcttaccgtacaatccaatcacattctttggtatttacccaaatgaagggagaactcatgtccacacaaaaacctgcacactgatatttattatagcagctttattcataattgccagaactcagaagcaacaagatgttcgtcagtagatgaatggataaataaactgtggtacattcagacaatggaaaattattcagcactaaaaagaaatgagctatcaagccatgaaaaaacatggaagaaccttaaatgcatattactaactgaaagaagccaatctgtatgattccaactatgtggcattctaggaaaggctaaactgtggagatagtacaaagatcagtggttattaggggttggagtgggggaagtgaaagagatgaataggcagagaacagacgatttttagggcagtgaaactattttgtgtgacactataacatagatagatgtcattatacatttgtatacatacccatagaatgtacaacaccaagagtgaactccaatctaaactatggactttggatgataatgtgtcaatagaggttcatcatgtgtaacaaacgtaccactctggtatgggatgttgatagtgggggaggctatgcatgttggggggtttgggagggaagggaatatatggaaactgtactttctactcagtattactgtgaacctaaaactgctctaaaaactaaaactcggccaggcatggtggctcatggtggcctgtaatcccagcactttgggaggccgaggcgggtggatcacgaggtcaggagttcaaaaccagcctggccaagatggtgaaacccccatctctactaaaatataaaaattagccaggcgcggtggcaggcacctgtaatcccagctactcaggaggctgaggtgggagaattgctggaacccgggcagcagaggtttcagtgagccatgatcgtgccactgcactccagcctgggtgacagagttagactctgtctcaaaaaaaaataaaaataataaataaataaactctaagaaaagaatatttttggctgggtactgtggcttacacctgtaatcccagcactttgggaagccaaggcagccagattatgagatcaggagttcaagaccagcctggccaacacggtgaaaccccatctctcctaaaaataccaaaaaaaaaaaaaaaagttagctaggcttgggggcgtgtgcccgtagtcccagctacttgggaggctaaggtagaagaatagcttgaacccaggaggcggaggttgcagtgagccgagatcactcactgcatctcaaaaaaaaaaaaaaaaaaaaaaaaaagcatctttttgaaaagttttcgggccaggcacagtggctcatgcctgtaatcccagcactttggaaggccgaggtgggtggatcatgaggtcaggagttcaaaaccagcctggccaacatggtgcaatcccatctctactaaagatacaaaattagctgggcatggtggcatgcacctgtaatcccagctactcgggaggctgaggcagaagaattgcttgaactcaggagacagaggttgcagtgagccaaaatggcacaattgcactctggcctgggtgacagggcgagactccatcccaaaaaaaaaaaaaaaagttttcaataaactcttttcatgaagatattgtacatctttcaacttattgatactttgtttttgtcactactgtgataacttttaaacatgtatcttctatttcttacatagccatactaattccagcaatctgttaaacatattaggtaaaaataaattacttcttcctttctaatcttaccttttagtctaattataaaaagtcggccaggcgcggtggctcatgcatgtaatcctagcaatttgggaggccaaggtgggcgaatcacaatgtcaggagatccagaccatcctggctaacacagtgaaacctcgtctctactcaaaatacaaaaaaattagccgggcgtggtggtaggcacctgtagtctcaggtactcgggaggctgaggcaggagaatggcgtgaacccgggaggcagagcttgcagtgagccgagatcacgccactgcactccagcctgggcaacagagtgagactctgactcaaagaaaaaaaaaaaataggtaagaacaaaacaaaacaaaaaaacagtgaatagacatggtgatacaggtagtcttatctcttttttttctttttttttgtttttttttgagacaagatctcactctgttgtccaggctggagtgcaatggcacaatcacagctcactgcagcctcggcctcccaggctcaggtgactgtcccgccccagcctcccttgtccaggctggtctggaactcctgggctcaagccacccacctgcctcagccttctaaagtgctgggattataggtgtgagccaccacgcccagcccagtctcgtcatgtcttgattctaacatttcactgttaagaatgacatttgctgtagatttttggtacatatttttatcaggtcaaggaagttcatctatcctagtttgctaagtacgagtattatgaatgggtgtcaactttatcacattttgtttcagcatgtatcaaggagactgctacttttttcccttaatctgttaatttaccagcttttatatttattccgcctttgatatttttctttcctttcttctagcttcttctctcactttcctggtttctgctcttttctcatactttctacctagaatttctctttcaaagtaattctgtttcttccttttgcattcgccagggggtaggggagagcaaagggaggtagttctcagggtaattaataaatatttgaatggctaaaaagtgaaatacctaataggtgccaggtccttgaggtgaccttacccaaaaccagtcttcaaatgtgccatattacatttatataagtcgctcccgtcttgggcttaaaaaaaaaagttacttgagatgcagtcactagaggaagaattatagtagaatgctttaaacagaaatggtgtttcaccctctagagaaacatcgaaaatgcattagctatcatccgaattttcttttgaacacagtactatatttaattttaactactagcacttgggttcccccatttaatacctagaaagtagggcactagattataaaaatgccaagtatctgaagagagacaaggaataacgtttatgcattctgtaattcaacactgtatgttaaagaggccagcccatgtctcttcttaattttaaaattaaagaagccgaacccaaatttctgaattctagctaataatttaggacccacttaaaaaaactttgccaagtttttccattagtctgtttaattgtcctaaagtctgtatttcatttaactccatgaaatgcatatatttgaggaacgatgttagagtaaccatgatctagaaatgaaaagggcacttacacaaaagaaacaaatcagcaaacaactctgtaacagaattctggagtctttagtcttacaaaaaaccacattaaacatcgtaagagaatacaacatttagtccacacctgactccaaagagtctctcaactatagccagggttattttttctgtttgtttgtttgtttttgttttttgagacaagagtctcactctgtcacccaggctggagttggagtgcagtggtccgatcttggctcattgcaacctctgcctctggattcaggtgattctcatgcctcagcctcccaagtagttgggagtacaggcatgcaccaccacatccggttaatttttctatttttagtatagacagggtttcgccatgttgcccaggctggtctcaaactcttgaccttaggtgatcagccggcctcggcctcccaaagtactgggattactttgggtgtgagccactgtgcccagccaaaatctttattttgtgatttctacaaacctttaatcacgtttagattttaaacatttttccaacctctataagctagaatagatggggatctgttttttaacagaaattttaagctgttttagagaaaaataaacttggctcaaatgacaaatgtgaaattatcaaaattacgaagcataggaggatgtgggaaagggttgtagtgttcacaacacataggaaagtatttcccaaaaaatatatattaaatgtacttcaaatataacagaagttaaatgcagaatagcatacatatacctctccaaaatctgttaataattttaaatgaggtttgataagtaaattggcctccaccaatgatccaaagatatactagtaaagcttgatgccactgaggagggagagagcctggtttaaatgactgaaattcattcagtcatttaagcagtagctcatgagcacatcaattaaacatctaacaaacaagaattgtggatgtgccactatgttaagcaccaagaatgtggctctagaagagcaacagtctaataggtaagctgtttgtggaaatgcccaaggaaaatgcatggaaacaagaactatagggcccggcatggtggctcatgcctgtaatcctagcactttgggaggccgaggtgggcggatcacctggggttgagagttcaagaccagcctgaccaacatggtgaaaccccatctctactaaaaatacaaaattagccgggcgtggcggcgcatgcctgtaatcccagctacttgggaggctgaggcaggagaaacatttgaacccaggaggcggaggttgcagccagccgagatcgcacattgcactccagcctgggcgacaagagtaaaactctgtctcaaagaaaaaaagaagaagaagaagaactgtaacagaagtatgcacaagccgttggggagatgggagggctggggagatagcacaagagggagaagaaggagcccacaatgtctaaggagggaatcagaaaaacttcacacaggggcatctgagctaaggactaaagtcagaatgtgagtgtacaggcacacataaggacaagtgacagatgtgaatggacaaaaattacacagtgcactagataatgtggggaacgactttacctcacatgtcagccaaataagcattatcctttcaagataacagaaactataagcaaataattcttgatgccaatccaaaacatgtaactgagttttgatggaatttggtaaggaatgcctgatgctcaaaattaaaaaaaaaaaaaagaccaggtttcgaaccgtcaggagggaacacatcttgggctgactgatgcgggcaggtaagggtttgagggtttgcgcttgcaaaggtgtaagaggctaaggttacttaggatgcattaaaggacttcagcagtggatgtggctgaagggatgcatggaggtaggggagaatgtatccagaacagaggctgaaaacatgggaaagtgtttgagacctgggtctaaaaggactgtgacatggcactaaaaagtttgtgtgttatcctctgggcaacagaaggccaccacgggctctttatgcaggagaggaccatgagatgtgtgccttagaaagatctctatggcagccacatggagactggaaatacacagagcatcagaaggctctaatgttaccgactgaatgtttgtgtctccccaaaatttgtatgttgaaatctaatccccaatgtgatggtataaggaggcaggtctttgggaagtaattaggttttgaggatagatccttcatgaaggggattagtgcccctataagaagaggccagagagctacctttctgccttgtgagaatacagtgaaaagtcaagtgtctgcaacctggaagagagctctcaccaaaatctgagcatgctgataccctgatctcagactttcagcctctagaacaatgaggaataaatttccgttgtttgcaagctatccagtctatggtactttgttataacagtttgaactggttaagacatatggagagagattttgagggtttgaattgtgttggtgacagtagggatgaagaagaagtgattaatttgagatatatttaggaggtagaaatcaatataacttcttaacagactagtatagaaattaaagataaccaaaacttttagtttggtaaataaatggtataacattaactgaaaaaggaaaagatggtttgagaagatgataattattataactaacactaagcactattctaaatcctttaaagcactaactcatttagtcttcacaacaaccgtataaggtccctaaatctacagatgaaaaataccaatgcacagaaaggttaataaagttgcccaaggtcacacagccagaaatggcagaaccaagatgtgatctcagacacactctcaactaccacattacactgtacggtacacaaccagttaaacatctctcatgtctgagggacatcaagggagttgtgtttaatttgcatttggaaaacagacctagggctcacaagaagaatatggctatgaattttagtgtcatcaacataatagtatttccttaggccatgggaaaaatgagatggacatttagagtgaagagagaacaaaaatgtaaggagcagcaagacagatacaagaaggacactaggaaggagatttttcaagcagtgattgtccacaggctggctcagttgccacaccacagaggtacaaacttgaagtggtctgggccttctccgtgtgaaaatggcaaatccattcactgtttgctggatgaatggacttatcattgagctatttgctggatttaccatctagctaaaagatagctaaaagattccagcttagactatgtcatcaagaaaggaggcctgatagggtatgaaacggggaaaacaagaaaaacaaacaaaaatggatgctctcagctcttgaaaggatgatttatacccgtgtttgagcaaagcagattctgccttcagagaagcagcagcaaagatagctcatttctcaagcagcaccccatctcatccatcacccacttcccctacctgccccccagcctacaccacaggacctctgctctgccaagagggcagggccccagccacgctgcagcaacaccagaagcgcaaaagaaaatgtgctgttgcatagacagcgcaaataaataatggttcttgtgataatcagcttttgcttttaatgggcttcacatgactcatcagctatcacgtatgctatagcctgagctctggctctaaatcaaacaagttcaaagggagaagaaaggaataatagcaaaagatgagcagatatctcaagaagccttaatcctactgaggaaaaacagaaatggaggcaggaagaagacagtttcccctatgagcactcaggtaccgagggtccagagagggcggaagctgaaacagccgcagagagaggcagcctagttgccgtgacgccatcctgccagccagcaagatttcaccagaccgttccctttctgccacagttcctgtcttgtgggcagcagaagcaccaagaaagaagaaaaatggttgtttgtattcttatggctgcagggtcatacctctgtgacttaactatttcaacaagtgacaaggagaaagtggtaagagacagagagagcagccaagatgggggtaaactcctttggaatgtattaaatccaacttcattctatggataaaatgccctcatgaataaacactcatccccaaaacatcttttttttttttttggtatttataatccaagaaccttgacagagaatgtcagctttttatcaaggctctttcccacaatgacttctgataatgggggttggggttcattcccaggtgaaaagcatgagtttgtggcaaagaaaacagtattgtttggtcaccacactggaatggaagccaggatattctgaaggatgccttggcactaatacaaattagcaaatgactttagcacttctgagcctcaatttcttcatctgtaaaatgagaagaatggactgggtgaatatgaagtccttccactctcttaatctatgcttatgggtgctcagagcacgggaacccttccaggtgtctcttgtggttaggctgtccatgtgtcaggaccctgattgtgctcccagggacacacaagtgtgagagtggctacaactcaatggaagcaataagtaaacacgtacacactcacaaagctagatccctatatttgattaaaccatgggttagtagacaggaaccatgtcttatgcatcttcacacactcaaaatccagcccagtccaggcactgggcttaacaaatgtttactgcatgcattttgaggcaaatctttaaaatgtcatattaagaagcttttcagacatgtcggttatggattgaattgtgtccccctaaaattcacatgttgaagccctaactcccagtacctcagaatacaatgttttttggagctaggacctttatagagggaatcaagttaaaaagaggtcattagggtgggtcctaatccaccctcatggtctcttcacaagaaaggaactgggatcacagacatgaacacagggaggatggcatgaagagacatagggagaagacagccatccacagctaagcagaaaggcctggaacggattctccctcacagtcctcaaaagggaccaaccccgctgacatcttgatcttagactttcaggctccagaactgtgaggcaataaatttctgtttttgaaatcacacagttttaaagccacccagtttatggtactttgttatggcagctctagtaaactaatacaatatccagaagtagaattatataatgaaatctcccatcacactcaccactcagatctttcactccggcatacttcatttcgtatttctaaaatatatggacatttccttacataacaatacccttatcaaacctaacagaattaacactaatttaaaagcagatttaattcccagaagaaataaaccttatactaaaacacacacttacattcctccattaaaactattaacacttttaggccgggcacggtggctcatgcctgtaatcccagcactttgggaggcccaggtgggaagatcacttgaggtcaggagttagaaagcaggctggccaacatggtgaaaccccatctctactaaaaatacaaaaattagccaggcatggtagcgtggggtcccagctactcaggatgctgaggcaggagaatcacttgatcctgggaggcagaggttgcagtgacccgagattgtaccactgcactcaagcctgggcgacagagcaagactctgtctcaaatttaaaaaacaaaacaaaacaaaacaaaagctattaatactatcaaaaacaaaacaccaataagcttgaatttttgtcaaacaaccctcagaggataagcaagactctcagaataattcaatttcctaatcagctctcatattcaacaatttcctgaaagtaaaaacctatgtttctttattcaagtacagaaaagaaaggaagaatgcggtcagtattcatacccactccgtggtcactgaaaatgcacttttcaaactaatcccaagaaatttagtagacatcattaagtctttagtttaaaaacagtacgtgcaatggtattgtatgttatattgcacataatttaagcgcatgaaaattgacatgacagagctcaaaaccactaccaaaaaaaaaaaagataaatacaaaaccatacctttacagggtagagaaccgcttgttatgattttctaaaacgttagagactggagttaccaatgcttcaacaattgacaacttccaatcacatgtcctcttcaggaaggttactttttgtctaatgttaagacaaagagaaatgttaaagtcagaatggcctacttaaaaagtttttcaaaagagtctttggaaaagcagttcgctccatcaactttcaaaacaggcatcgctgtaaaaacccacaatccagctaattagtctcagctgtttgtcatatggcactgcagaccagtcaagtgatttttgcccctttcaagcttaccaagttccagttcgactggccactcagagggcggctttattaacctcttctggtgttagaagactctgcacttcagctctttcttccgcccacctaccccgtgaatcaaaacagtagaacatttgttttcttgagaaagtgccttgtattctcaaggcccttaaaggttatattcatattgttgcttacaaatacaatgcctgatccaaacaaacaatatgggggatcaaatggaagtggcaggagggatggggctagattacttaccagaccttgcagctggcctccaatttcataagtaaaactgcctacaagggagtccacccagatatcttgctggcatctcaaatccagcatgtcccgtactcacctcctttgcttttctccacaaccttgcttcaaacccacttctcttcctgtgtcttgaatcacacaatcccaacacagccagaaatctgatggctctcattaactcctccctctctgcccctcccacttccaattggccaccaagtcctaaggatattcatcttcttgctcctactccaagtttttattatttcttagatggctataataaaccacttatttggttttctggtccccacgtattcttgactctgatccatcctccacaccacacccaaagtgatctttccaaaaggcaaatgagagtccatcactctcctgttaatggctccccacaatctccacaataaaatccctgctccttaagcttctgccttcagtatcaccgcctccttcctataagctgctagagtccagccatcagtacgttttataattcgctaagttaagtggttctcaaactgtggttccaagaccagtattatagcatcttctaggaacttattagatttgcacattcttgggcccacccagctgaatcagaaattctgaggatagggcacaggtgtctgtggttcaacaagcactccaggtgattctgatacacactaaagtgtgagagctgctgctgtaaatccaccaagttctgttcactaagagaatcagctccttggctccttgtgccagcaatgctgagctggatacaccttccctgtgcttactgtttctagaaatggtcacccctgtatgctaattattcaatttatttcttggtctttgctgttgctttgtgacaatcttgaagacaggggttgtatcttgttttttgttcattcaccccacaatcacttattgagcacttatgaattattgggtgaaatgtcggacatagaactaatcaatctatcccttgcctctaggagaagctacgctttcattatggcagctcaacgtgtgactgaagactcaatctgtccaatctaaaaaaaccaccaccggcctcaagaactgtgggcaactaagaaaagtctgagcacaaccagtctgacatctcttctcatggtaaatgaaatggaattttcgtttcacacctgacgaaaatctcatgaaaatgcacctctttcttttttatatcacacagcaacctcgagaattttgagaacaatttagtaagaaaatgtatccagatttttaaatcccagattaaaattcattagagttagcttcctttaattacaagttcatattagcacttctcaaccatcaggatatataggaatctcctagggatctttcaaaatgctaattctgattcaatattcctgtagggggagatcgagaccatcctggctaacacggtgaaaccccgtctctactaaaaatacaaaaaaattagccaggtgtggtggcgggcgcctgtagtcccagctacccgggaggctgaggcaggagaatgccgtgaacccgggaggcggagcttgcagtgggccgagatcgcaccaatgcactccagcttgggtgacagagtgagactccgtctcaaaaaaacaaaaacaaacaaaaaaaatcctgtagggggctcaggagtctgtatttctcctagtaagcacccaggtgatgcccaggtaatactaacattcctaactctggaactataatttgaatagcaagtaaaattatgacaataccaattttcatagtctgcttaaagcaacaaaaccttttttggatgcttttgtattgaaagctttctaaaatatctttcagacttcagaataaagatggcatgctcaacatgtacatgtggttctgctgcctcccaaaatctcactaatatagcaataaagaatgttttatttcttttagacataaactcacaaggacaaagatcaggtagtggaagcaacaaaatggtagaagctacagagtagatggactagaggtaactgattagcagacctcggaaagctgactctttatctgccagtagggaaatccaagaaggaactcatcacagaatctccagaaagtctcagggattcagaaccccaaaacttctggaatttgggggacagtaacatagggactcaaaacagacagaatggtggtcatctgcttaaaaagcagctcagcacaccaagagaagaagaaaagaaagaacgaactaccaaatagaaaataatgaacaaaatggcatagtaagtccctatctatcgataattactttaaatgtaaatgtattacattctccaactgaaagacatagaggttgggcacggtggctcaagcctgtaatcctagcactttgggaggccaaggcgggcagatcacttgaggtcagaagttcaaaaccagcctagccaatgtggtgaaactccatctctactaaaaatacaaaaaaattagccaggcatggtggagggcacctgtgatcccagctactagggaggctgaggcatgagaattgcttgaacccgggaggcggaggttgcagtgagccaagatcgcgccactgcactccagcctgggcgacagagcgagactccatctcaaaaaaaaaaaaataaaaataaaaataaaaaataaaagacatagaatgacagaatatatataaaaaataagatacaattatttgctgcctgaaagagagttgctttagatttaagggcagacagactggaagtaaagggatggaaaaaaatatttcatgcaaatggaaaccaaaagaaagcaggggtgactatacttatatcagaatagacttcaagtaaaaaacagtcccaagagactaagaaggtagttatgtggtgacaaggaggtgaattcatcaagcagatataacagttgtaaacatgtaggcacccaacatcaaagcacctaaatatataaagcaaatattaaccaaactgaaaagagaaatagataaccatacaataatagtaagggatttgaataccctgttttcaacaatgaacagatcatccagatagaaaatcaataaggaaatggcagatctgaacaacattatagaacaaatggaattaacaggcacatacagaactttctatccaactagaggagaatatacattcttctcaagcgcacgtggaatattcttccggatagaacatacagtaggccacaaaacaagtctcaacaaatttaagacgatcgaaatcatattaattatcttttctgaccacaccgatatgtaactagaaatcaataacaggaagaaaactgaaaaattcacaaatctgtggaaatttagtaacataatcctgaacagccaatgggccaaataaaatcaaaaggaattttttttaaatcttgagatacatgaaaatagaatacaacacatcaaaattttaggggattcaggagaagcagttttaagagggaagtttacagcgataaatgcctccattaagaaaaaagaaagatctccagtaaacaacctaagtttatactgcaacaaactagaaaaaaggtaacaaactaagcccaaaattagaagaaagaatgaaataataaaaattggagccaaaatgaaatagagaccaaaaaaacagaaaagaaagaaaagatgaataaaactaagactgttttttgaaaaaataaacaaaattgacaaaactggctgggtgcggtggttcatgcctgtaatcccagcactttgggaggccaaggcgtgcgtataacctgaggtcaggagtttgagaccagcctgaccaacatggcaaaaccccgtttctattaaaaacacaaaaattagccaggcgtggtggcaggtgcctgtaatcccagctgcttgggaggctgaagcaggagaatcacttgaacctgggaagcagaagttgcagtgagctgagattgcaccactgcactccagcctgggtgacacagcaagaatccgtccttaaaaaaataaataaattatatatatatatatatatatatatatatatgtatagagagagacagacaaaactttagctagtctaaaaaaaagagtaaaaactcaaataaataaaattataaatgaaataagaggtgttacaactgataccacagaggtacaaagaataataagagatactctaaataatccagtcgggcgcagtggctcacgcctgtaatcccaggactttggaaggccaaagtaggtggatcacttgaggtcacgagttcaagaccagcctggccaacatggtaaaagcccgtctccactaaaaatacaaacattaactggggcatggtggtgcacacctgtaatcccagctacttgggaggatgaggcaggagaatcacttgaacccaggaggcagaggttgcagtgagtcgagattgctccattgcactccagcctgggtgacagagtgagactccatctaacaacaacaaaaaaaaaaagacaaaaaaaagtgggattacatcaaactaaagctgctgcacagcaaaggaaacaacaaaatggaaaggcaactggccgggcatggtggctcacacctataatcccagcagtttgggaacccaaagagggcagatcacttgagggcaggagtttgaaaccagcctgaccaacatggcaaaaccccatctctactaaaaatacaaaaattagctgggcacggtggtgggcacctgtaatcctggctactcgggaggctgaggcacgagaatcacttgagcctggaggcagaggttgcagtgagcagaggttgtgccattgaactccagccaggtgacagaatgacactccacctcaaaaaaaaagaaagaaagaaaaggcaacctatagaagggaaaaaaaggtaaatctgatcaggggttaatatccaaaatatacaagaacctcatactactgaataccaaaaaaacaacccccaaaagaaaaaaaaatttaatgggcgaaagacctgaatagacattttttcaaagaatacattaaaaatggtcaacaagtatatgaaaaagtgctcgacatcactaatcagcagagaaatgcaaatcaaaaccacaatgattttgattacctcacatctgctaggatggctaattaaaaaaaaaaaaaaaaaaaaaacaagagataagtgttggcaaggatgtggagaaaagggaaccttgtacgctgttggtgggaatacaaattggtacagccactatggaaaacattatggagcttctttaaaaaaatgttttcaaaaattttttaaatagaataccataggatttggcaatcctacttctgggtataatacatctgaaagaattgaaatcaggatttctaagtgatatctgtactcccatgttcactgcagcattattcacaatagccaagacttagaaacaacctcaatgtccactgacaatgaatgaatgaagaaaatgtggtctatacatacaatgaaaaagtattcagccttaaaaaagaaataaatcctgccacctgtgacaatacagataggtggaagatattatactaagttaaataagccagacacataaagaaaaatactatgtgatctcccatatatttaatatatagaatctaaaatgtcaaactctccaagcatggtggccactcctgtagccccagctactcaagaggctgaggcgcgacaattgcttgagcctatgacttcaaggctgcagtgagctatgatcacgtcactgcactccagcccgggcagcggagtaagatcttgtttctaaaagaaaaaattttaatttaaaaaaaagtaactcaaactcccagaagcagagagcagaatgatggttgccagggactgggaggagggggaaatgggaaggtcatagttaaagagaacaagtttcagttatgcaaaataaataagttctgaaaagctattatacagtatagtgtctatagctaataatactgtattatatactgaaaatctgctaagaagatagatccagtgttaattgttcttaccacacacacacaaaaatgcaataataataaaacaggcaggataaaaccttgggaggtgatggatacatttatggccttgatggtggcgatggtttcatgggtgaataattatccccaaattcatcaagatgtatacattaaatatgtacagactttttatctgtcaataatacctcccataaagtagtttttttaaaaataaattgttaagtaggggaaggaaagaatgaacaaacaaacgtaggaacaaatgaacaaactcaggtaagaaagaggagatgaaaatggtatacttgtggcaggggtggatggagcaatgagctaaattctctacttctgtaataaagtatcaatagataatgactaaaactgaaaaactgaccacagaaatataaatgtgtcatttagagactagatgtataaactactgcaagacttcagtggttaactctggagagcaggaaatgggctgggggagaggcgtctactggttttttgtaacagcccttgtaaaacaacgtccacgtataactttggtaaatttggcagggcacgatggctcatacttgtaatcccagaactttgggaggcagaggcgggcaggtcacttgaggccaggagttcgagaccagcctgtttgtctccataataaatggctcctgactgctgtatttatttcgtgtcttttgttaatttatatttccttctccctcccctcacctttgctgtcaggcagctatccctcaccacagtaatcagtgtgccttcctgggacaacccctaccccttccgatgcactgtttttaattgacaaggcacctggaaaccaaataaccaagcttattagaactgtgtgtaaaatgaagaaaaatgggcaccaaaaaatgttctgaaagttgctctgtgatgcaggttggcaattttcaatacattaaccatttgtccaactcagaaccgtttggccttactatcaactatgggtcagtaggctgggtgacactcagtgggaccaaccatcccagtttagtggggactgagttatagcactgaaagtcatgcatcccgggaaaccatatcccagcattgggcaagttacttcatcttcttcaacctgtttcatcatctgtaaaatgaaagataatatctgctttgaaagattgttgaggattaaatgagaaaatgtttgtataactcttgacacatatggtagctgtagctattatactcacttgcatattgttattatcaaccctagtatcaggtagaaaaagaaagtattcttagaaacataacctgtaatttgctttatatatagtggacttcaggaagctgcaatgtttgcttttgtgaatttccttcccattttgtaacacacattttgtttcagggactaaaacatattaaagaaatttaatagttcaacatttctgatttctctactggacaaaagcctggcaggtttccactatattttcatagaaatgactcttttacactatgggagccctggggtatttatgtcagtagccgcttctaaacttgtgaacagaaatcagcctgccacctcacaaagaagaggcatcatatctgaaatttgtttttaatttccatttcacttttttccttcataatagcaccagattattcagtcttctaatcattattattttttttttttttttttgagagggagtctcactctgccacccaggctggagtgcagtggcacgatctcagctcactgcaagctccacctcctgggttcacgccattcgcctgcctcagcctcccaagtagctgggactataggcgcccgccaccacgtctggctaattttttgtatttttagtagagacagggtttcaccatgttagccaggatggtctcgatctcctgacctcgtgatctgcccgcctcagcctcccaaagtgctgggattacaggcgtgagccaccgcacctggcccagtcttctaattatttagtgaattcagtacgttgacatggggctgaaaaatctgcatttctaagttctaagttctaagccaagtcattcactaattatgtcaattctatccctgaaaaataagggcttgtatcaccaaacggatgaaataccatttctgaactcaaaagctgaagcaactccctactccacatttattaattacagcctgaaggaaattgctcacatctatgcaccccacagacaaaagggcacagttgctaaaagaacagttccaaactttgggatagataatggaaagaatcacaagttactcaaagccaaaatatggcctaggaaccctctaagaagcagtagagacagcagaaagagccaggcagataagactcttaataaaggcccccatggcctgtcctcccatactcttctatttcttctccacccagtgtccgaggcctgtgaccacaaaacacaggacaacacagaacctcagagaagccttgaggggcaactggtcaaccaattagggcaggtgaaaatggatccaggactggcagcagaatcacctaggatatgtgatgaaaatccaaaattctgggtcccattcaggcctctgaattaggatctctgcaagggaggcctagggaatctgcatttatatcaagcttcccaggggctttctggttatacacaatcaagtttgtaagccactgttctagggagacaacagatggcaaaaatgtacaactacagttaggcaaatagcctgtacatcaagatcatatttaacttctactagcctcagataccaaatctgtaaaatagggataataatactgacctagcaaggtggttgtgagaatcaaatgaaataagtaatagcctcacacacagtgtctcacatacagcaggtgctcaataaaagtccattccctcgcttgtgtatggcattctaatgaagacttacaacaatagtttttgaataaatgtcacctgttttgaataaatatcaccaaggaaagcagatggccaggaaagttaaggcctcaatgttaatgactcatcaactacaaaggccgaggtcagcagccttaaccagcgattgagtcatgaaatgtacttgtagacagtggttctcaagcttcggggtgcatcagagtcacctagatggttttaaaacacagactctaggccccaccagagtttcagattcagtaggtctggagtggggctgaaaatctgcatttctatgttcccaggtggtgctgatgttactggtcctaatctgacactttgcaataaaaaaagaaaaactatgctgtgtatatttcctgtttgacactagactggttagtttcatgtaaatagagaaaaaaactaagaaaccaacaatttccgaggctgtgctgcctctgtccctgagaatcttactatgttgtttgaacaatgcatagagaggacagggagatttgagttctatcttcccactcacttgctgtgtgactctgcatgagacatatgatctcttccagcctgagtttactcaggctgggagtaaaggtgagctagacactggttcccaaaccaggttgtccaccaacaatcactagagcagtatttaaaataaaacatagattcccaagccctagccacaaacctaataaattagaatcaccaaaggagagactgaaaaatgtgttgttgtttcttgtgggtatggtttatatatatatatatatatatatactttaagttctagggtacatgtgcacaatgtgcaggcttgatacataggtatacaggtgccatgttggtttgctgcacccatcaactcataatttacattaggtatttctcctaatgctatccctcccccagtccccaccccctgagaggccccggtgtgtgatgttccccttcctgtatccaagtgatctcattgttcagttcccacctatgagtcagaacatgtggtgtttggttttctgtccttgagatagtttgctgagaatgatggtttccagcttcatccatgtccttgcaaaggacatgaactcatccttttttatggctgcatagtattccatggtgtatatgtgccacattttcttaatccagtctatcattgatggacatttgtgttagttccaagtctttgctattgtgaatagtgctgcaataaacatacgtgtgcatgtgtctctatagtagcatgatttataatcctttgggcatatacccagtaatgggattgctgggtcaaatggtaattctagttctagatccttgaggaatcgccacactgtcttccacaatggttgaatcaatttacactcttttgtgagcatgttttaaacaaaagctccctgtgccattttcatgtatagccagttttgaggaagcattaacatggtaatctttctccagcattaaagctcttgggtctttttgatttccaattcactgggtcctgagtctatacttagccagtataagtagccttctccttttatatttgcttcacctggctattcttccgaaaggaagcatacactgtcctcaaaaaaaggaatctactctgcttagcagttccatttctcatatatcaataaactggcattctggtttcatttaaaaaataaagtccaggataggcacagtggttcatgcctgtaatctcagcactttgggaggccaaggcaggcagatcacttgaggtcaggagttcgagaccagcctggccaacatagtaaaaccccatctctattaaaaatacaaaaattagcccagcatggtgacatgctcctgtggtcctagttacttaggaggctgaagcaggaggatccacttgagcccaggatgttgaggttgcagtgagctgggtgacaaagacaagaaagaagggaagggaaggaagaagagaaaggaagggaaggaagggagaagggaagggggaatggaagggaggaaggaaggtaggaaaggaaaagagaaggaaaaaaaaagaaaccagaggcccttacagaccacaggtacatatttggatcttatacctattacaatgaaagcaactaagggattttaagcagaaggatatgaattgaattcctttaattttttaaaattttgtctcatgctcctcaagagtgtgagttccttttttgggacatcactggctttgtgtgaagaatgggctatggcagggaggggcaagaattggaacagaaaagtagcagtacaggcctttaaccagcagctggcacagagcaggcacttggatatttctgcactgctttaacatagggaaatcataatatacttgtttcacctcctaatgtatttcagaggagttcaaggaagagactctgggtgttagcaaagttccatctagatgtcacttcttttgaacaacacatagaattttggattgtccacagtacaactggttccaatcaagaagtattagaataagaacataaaaagaacacaccaggaaaccatcagaccaggcttctggaaccatccctgccatcaattagctatgtgacctgaggcacagctctggatttctgggaggggagcctgggctacaatttccaaggtccctactagctcttaaattacacaattctgtaagtgtaacaaatgtggtttccttatctgggtggcaaaatgggatgatgactcagggtgaggttttttgttacagattttcaacctcccagagaagctctagtgaagctagaatcagggtgttaataaagaaactgtccagttttattatttcctttccagggtatggtggtcagctggaaatctgggaagtagacattcctggcagctgcgagcttatcgtgcaaagactgagaacccaagtccctgtgtaacccttcaggtacacgatctctggggtcccctgctcatgtggctttcgctcatgtggaagcacacaatagacaggcactgaagaccagcctctcacttcctcctgctggtaggctgttcccaaagggtccactcctctcctatggccaacctggcacctccacgagaaccccatttcgcatgatccctgggggcagtggttctcagtctcaactgcaactgcccatcagaatcccgtgtggagacaataaataaataaataaacaaacaaacagcctgagccctaccccacatttactgacttagaattggggtgagggagaggttagaaagacaacagcggtagttaggcttagttagttttacatgatggacagaacgtgtaacttgggaaactgtaagccaaagaggttgaatgagttgtctaatgcagggtttcttagcgtcggcactgttgacattttaggcaggataatcctttgttgggggctctcctgtgtactgagaatgttttgcagcatccctggcccccacccactaaatgccaggagtaactccccagctgtgacagtcaaaaatgtctccaggcattgctaaatgtcccatgtggggtggggcaggggagaaaatcacccccaactgacatacactggtgtgatatcacatagttaataatcaggaatatggagactaaaaaccgaccgactgattcctgactgtgttgattcttccacattcaagcaggaagtccggaacacaggaatgagccgccacctgaggaaataccacaacccacttcactacacaacccacttcaatacacagcctagggcagacgtgggacctgggacagctgaccttgtccctaatgagaaaagccacattaggtctccagtatttgactgtgaggacaatgacttatcttttcaaggactgttacacctcttcactcattcttggagttgtttccttgaaatgatgcgatttattatgaaaatcactattttcataatgatttcttagcaagaaacaaagaaatcctgaccacaatcataggttatattttaaaattctttagttttgtaaatgaacatttaagtcatgacctatttctgtatgtttcatttctccccttattagggctagtacagcaagaacaaaagtatcatattattgtgtttaactagctgatttagaccttgactttgcttttaacgatacaaatacacagcagattagtatttagccataccctgataggacttgaccagcctcccaggtggtgggatcaggccaaggtagataaactatagcaaataagaatgaacagacttttcagtctcgtggcaaccaattttattattatgctttgacctggcagctggtaagactttatatgaattaaccaatgaaactatgaaaaaacaagattagtggttctgaaatatggtattcaaatagcagttagagaaagcagttcattttcaaggctgctttcttttaaataggtacaaataattacaataaaaaataataaaatcttgtttaaaaagaacagatctctagtgagcaagtcacatacacctgtctatctaccttggtccttgtcatatgtatatcttccatatttattgtaccaaaataaaaaggggtgaggaattttgtgggaataggccactcaaagcaagcaggctttccataagacaacacttagttgttgtggaattatactcagtaagaccaccttaatcaaagcaccttataataaatactccagagggtcaaaagtgttaacaaaaccataaaaaaaaataaaaccacattgaattacaggctttctggcataacagcagggacaagaaccacatggggctttcaacagttatgcggctctcagagaaaagtcaaagtgtctcatgagaatggctttggctgccacatgttggatctggggactgaaggacagtatgataatgaggtgatcttgagtggatggctagagatgtgattaaaggtcaacatgaaaacataagcaacttcttcatgacctcttaagggaagggattatgcagcagaacaactgctggttccagagtcccacttccagctctgccactaactctatgtgactttgacaaagtgacttaacctctctggagtaaattccattaactataaaagactagagtaaaatgaaatgttctctaacttccttctaattctaatactccttgggtttacaaatcttctcttttggatacatgcacaatcaccaaaaatcagccatggctcaatcattctttggacattttcaccatcgatgcatttcctatgcataaacataaactccagctagggctgccagacacaaaacaagacatccagttaaatgtgcattttggataaagaacaattttttagtaaaagtatgtcccaaataatgtataagatataggaaacaattatttagtgtttttctgcaatgcaaatttaacttttttttagtttgctaaatctggcaccccacctccatccccacattagaatcaaaactctcactccacacacgggaggttggctgactaaagcactacatggtaaacttctgtttaagggcaacatatacagacgaaaaacaaacaaccaaaaaaaaaaaaaaaacaggaaaggaggaacaaaactttcagcattcctcgtaagagaggcatctaattttacttgacaataaataaaatatgagtattactagacctcaatcatacaagtacctgcaaaaccagagagtccaaacagagctgaatgctctctactccacacaccttaccctacgaacataagtaaattacaaaccctttatctctgcctccagttcagggctcatgtctgcacctagcttaagggaaaccaaatcataaactcaaacttcctgaccaagaggcagaagaacaaatacagtccaagaaaatctgcaagtggcataaaaagtgaaggctatagaagggaaaaattactctcttcaagaaccaatcttgttttagcgatggcaagacaatttcccttctcaggggcctggccaacatggtgaaaccccgtttctattgaataaataaataagaaatgaatttccattttctcaaatttccaaaaaacttcactcttcttaaattagcacaagaggccaacaccctggagataggcactgaatggccctgcccagtttgcccaggatatagacagagggctccggtctgccactgtgggagggaccaaaatcctcacctttctacttatttgacctttccctttttaaggaagataagactattatttttgggaaagtaggacagaagacgagagacttaggagatgttggtgtatctatagacattgcttctcttagaaaaaaatggatggaatagtgggaaagaaatagcagaacactctacagacataccatcctggatgtgcccgatctcctctgatcttggaagccaagcagggttgggcctggttagtacttggatgggagaaatggcagaatgatccctattgctctgtcttctgttccctttttcattagttcaacacatatctctttgagtgcttaatatatgtcagaaaccattctatgtgctatggacatcacagtgaacaaggcagattactggccatcctggagcttgtcttctaccagtgaaagacaaatgttgtgtgtgtgtgctggtctgtgtatgacagttctataaatactcgaaagaaaacaaggcaaggtaagggggcagaaaatgatgggataggtgagggatactattctagatggagtggtctaagaaggcctctccagaaaaatgacttttcacctgaatgaaataaataagaaagccatgcagacatctgaggggaagagcattccaggcagaggaaacaagtgcaaaggtcctgaggtatggctggagcagagtcagcaaaggcaagagtgatagcagatgaagccgcactccatgcaagggttgtatagaccatggtgaggactctgtcacttctgagataaaaagccactggagagtttcaagcagagtgacataatagactctggctgctgtgttaagaatagagtgtggagcagtaagggtggaagcagggaagcccttcagaaggcttttgcagtaatccaggtgacagagatgatagaacttggtggaagcagcagaagtggtgagaaatggttatcatcctagatgtattctttttttttttttttttttttttttgagacggactcacactctgtcgcccaggctggagtgcaatggcacgatcttagctcactgcaacctccgcctcctgggttcaagcgattctcctgcctcagcctcctgagtagctgtgattacaggcacccaccaccacgccccgctaatttttgtatttttagtagatacagggcttcaccatgttggccagcctggtcttgaactcctgacctcacgtgatccacctgtctcggcctcccaaagtgctgcgattacaggcgtgagccaccgcacccggcctgctgaggaatttaatgtggggtataagagaaagaatcaagagtgatttcagggtgtttggtgtgagcatctggaagagtgaagttgccattcactaagatggagaagactaggggaaaagcagctttgggagagaaaactcaaaaatctggctcctagagattgttgctcactttaaaacccttacatctattttagaaccaaaacaatagaaattgagaagctgactttaaatttcatgtggaaggccaggcatggtggctcatgcctatgatcacagcactttgggaggctgaggcagacagatcacctgagatcgggagtccgagaccagcctgaccaacatggagaaaccctgtctctactaaaaatataaaattagccaggcatggtggcacatgcccgtaatcccagctactcaggaggatgaggcaggagaatcacttgaaccagggaggcggaggttgcagtgagctgagatcgtgccattgcactccagcctggtaaataagagcaaaactccatctcgaaaaaaaaaaaaaattcatatggaaattcaagggactggatagtcaaaacaatcttgaaaaagaacaaggttggaggactcacatatcctgatttcaaaacactatgtagctacaataatcaaggtagtatgatactagcctgaggacagacatacagatcaatggaatagaactgacagtccagaaataaacctttacattcatggtcaatttatctcaacagaggtgccaaaactattcaaagaggaacagtcttttaaacaaatggtgctgaaagaactggatatccacatgcaaaaagttgaagtcagaccccctgcctcacaccatatttaaaaattaacttaaaatgggtcaaagaatgaaatgtaagagctaaaaactataaaacttttagaagaaaacataagtataaatcttcatgatcttgaatttgacaatgttttcttaactttgacatcaaaagcacaaacaacaaaaggaaaaataggctcggtgcagtggctcaagcctataatcccagcactttgggaggctgacgcaggttgatcacttgaggtcaggagttcaagaccagcctggccaacatagcaaaaccccgcctctactaaaaatacaaaaattagccaagcatggtagcacacacctgtaattccagctactctggagtctgaagcaaaagaatcacttcaacccaggaagcggaggttgctgtgagccaagatcatgccaccgcattcctacctgggcgacagagtgagactctgtctcaaaagaaaaaaaaggaaaaatagattaaatatacttcaacgaaattaaaaatcaaggcacgtcacagaaattaaggaaggaagaaaaaagggagggagggaggaagagagaatggtagaaaggaaggaagaaaaaagtaggaatgaaaacataaaacaacataaaccaacataaaatacagaaaataatgatcctcagtcaagttccttcagcattatattaacctttcttcacttctaaccatctgcagaaactgttttccagattgtattttccctctaaagcaagtttttaaggccgaaaaaaaaaaaagaacaagaacagtgagtggagaatcaacaaatttaattagcaatgattacagaaaacttaaatagcacacacaactctataatccctctacccccaattccaacatctgactgatcaaccaaccataaaatgtgagaatccatccagaaggaaagaacagctgttaagctgtaggggtaaggaccctgtggcagaagaccctgaggccatgtgggcccaggtggccagcaggagcggaaaggctgggaaggctcctcagtccagggctcacaagactcccttcgcttcaggcctgactttgctgaactggtgatctattgggacagagacaggctttggcaatagttaccaaagcctgtcatcatatctgcaccaccaccagtcccgaccggagggcctggctgccaggtagttttcagtctaactgacaggagaagagagagcccctccctcgcagctagtctgcagtccagaccctcaccaaccggagggcaaccaggttaaacagttaaactgaaagcaaaagagggaggaatgaaccggggggcgtgcgggaggtcggggactttcctcctttccctcctggaaagtttcctacccctgatgggcatcctcccacctggatgcaacccggaggcgatctgagaccctggccggacctgggaccgcacctggccagcaccaggcagttgtcatcactggggtctgcgctgagggcctgggagagaagccactcttcaggcgggctcgggcgcctggaggcggggaggaagggcggcgcactcggaccccagccctaggacggccccagggggacgcctcgctcggccctcccggagggaccggacccgccgcgcgcctcccgctcctcaggccccctcacctggctcgccccgccgtcctgtccccgcctggctcgggtcctcgcgcgccgcgtccacccgccgccggccttttttgggtcgttggcgggtattttccgc

SEQ ID NO: 373 - DNA, 71247 bp, Homo sapiens
gagacaataacatagaaattttattacagcatttcatgtttaagccagattccctgccaggatattttctgcttgaattaatgaggcaggatttggtcataccttaatgagtttcacagaaaaagagttcaagcattagcgcaaactgccttctgacattaaaataaaataaagcaaacatgggattttcacaaagttaaaagcctcctgtgatgcacattttggatagtaggagacattgagccccaaaatgtttaacataaagcatggttaattaaatgaaaccactgaaaaatgtgaatacatgaagaagaaagaataaaataattttgatgttaccatttcaactactatttttgatataatcattcttggcaaaatcattcttaaaggtggaaacgagcaggctgatagtacagcaagtaagagaaagtcaatactgatggcctccacttgctgatcctctgagactgcatcttatagttcataaaatctgctgaaggtcacaactgaggtacaacgacttgtgttacttgtactgtagcaatgagggctttcccaggccacaacatctgggatcaaggaacacattttgactaaataaactatacagaagtctgttttaggattttatgcaaatattaacctcattttaaaacatgaggaaaaatattacccacatttagggctaatttagctgtcaggaatagaccatacagttgaaaaaaacacagtctcatttaaaaagtttcagcagagacaaaaaggtactaaagatgatattcatccttcttcatcactgctgctccaggcatcttcaaaggccggatttaattgtgattttgttgtagtctaaaaaaaaaaaagataaagaaaaaggaagattctgttttttctacttcataattttaggctcacaataaagttatgaaatatatcagataaatagcaattacattattttggaagaaaatgtataactgttaatttcagaacaaaaataagaaacaacccatatacaatataagataatgtaacttcatttgaaacagacaacaccagactttatccaaacaccctgtttcctttaatcacttcacaaatacatacatacacacatacatacatatactatgatgctgccattgctcaaggtatttctcaacaactctttggaattacctggagaaagtggcactctgatatccataggctaagactggactccaggtgtacagtctgacctgacagcccaaaatatcaatggtggcaactctttattgtttggatgaaaataacttttataaataaacaaataccaaatatggagaataaggtattcaagctgaataataccatttttagtccaaaaataatgtgggttattaagtagtgatatttatgtacttatttgtaagcagtgatatttaattacttatttttataggttggtagggcagttcagtaaaacatgcaaaatacgtcagaaatggtaacacgtttatagtcagcacataggtttccctcagggatttgtctgaaggataacatgcatctagatgatgtttatttaaaacaacaaggtgattagcaactacagaaattttaatcatctgtggtatttcaaatcagttcattttggggaaaacttctgaatagctacttctgatactcatgcaaataactaaaagggctttaagatggtctcattgttaaagtaattgggtattatgagccaggtttgcttctttttgtgcaacttttacaactactacaattttattcagattccaattccaatgctgtattagcatcaagactactcttaaattattttagatttattgccttttataacttagagaaattttttttttccttttgagacagaatctcacactgtcgcccgggctggagtgcagtggcgcgatctccgctcactgcaagctccgcctcccgggttcacgccattgtcctgcctcagcctcccaagaagctgggactacagacgcctgccaccacgcctggataattttttatattttaatttatttattttttcttttttttattatactgtaagttttagggtacatgtgcacaacgtgcaggtttgtcacatatgtatacatgtgccatgttggtgtgctgcacccatttaacattaggtatatctcctaatgctatccctcccccctacccccaccccacaacaggtcccggtgtgtgatgttccccttcctgtgtcgaagtgttcttactgttcaattcccacctatgagtgagaacttggcggtgtttgggtttttgtccttgcaatagtttgttgagaatgatggtttccagcttcatccatgtccctgcagaggacatgaactcatcattttttatggctgcatagtattccatggtatatatgtgccacattttcttaatccagtctatcactgatggacatttgggttggttccaagtctttcctgttgtgaatagtgccgcaataaacatacgtgtgcatgtgtctttatagcagcatgttttataatcctttgggtatatacccagtaatgggatggctgggtcaaatggtatttctagttctagatacctggggaattcctacatggacttccacaatggttgaactagttgacagtcccaccaacagtgtaaaactgttcctatttctccacatcctctccagcacctgttgttccctgactttttaatgatcaccattctaactggtgtgagatggtatctcattgtggttttgatttgcatttctctgatggccagtgatgatgagcattttttcatgtgtcttttggctgcataaatgtcttcttttgagaagtgtttgttcatatccttcgtccactttttgatggggttgtttgtttttttcttgtaaatttgtttgagtccattgtaggttctggatattagccctttgttagatgagtagattgcaaaaattttctcccattctgtaggttgcttgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctggggtttttatggttttaggtctaacatttaagtcttaatccatcttgaattgatttttgtataaggtgtaaggaagggatccagtttcagctttctaagtatggctagccagttatcccagcaccatttactaaatagggaatcctttctccatttcttgtttttgtcaagtttgtcaaagatcagatggttgtagatatgcagcattacttctgagggctctgctctgttccattggtctatatctctgttttggtaccagtaccgtgctgttttggttactgtagccttgtagtatagtttgaagtcaggtagtgtgatgcctccagctttgttcttttggcttaggattgacttggcaatgcgggctcttttttggttccacatgaactttagttttttccaattctgtgaagaaagtcattggtagcttgatggggatggcattgaatctataaattaccttgggcagcatggccattttcacaatattgattcttcctacccatgagcatggaatgttcttccatttgtttgtatcctcttttatttccttgagcagtggtttgtagatctccttgaagaggtccttcacatcccttgtaagttggattcctaggtattttaatctctttgaagcaattgtgaatggaagttcactcgtgatttggctgtttgtctgttattggtgtataagaatgcttgtgatttttgcacattgattttgtatcctgagactttgctgaagttgcttatcagcttaaggagattttgggctgagacaatggggttttctagatatacagtcatgtcatctgcaaacagggacaatttgacttcctcttttcctaactgaataccctttatttccttttcctgcctgattgccctggacagaacttccaacactatgttgaataggagtggtgagagagggcatccctgtcttgtgcctgttttcaaagggaatgcttccagtttttgcccattcagtatgatattggctgtgggtttgtcatagatagctcttgttattttgagatacgtcccatcaatacctaatttattgagagtttttagcatgaaggttgttgaattttgtcaaacgccttttctgcatctattgagataatcatttggtttttgtcattggttctgtttatatgctcgattacgtttattgatttgtgtatgttgaactagccttgcatcccagggatgaagcccacttgttcatggtggataagctttttgatgtgctgctggattcagtttgccagtattttattaaggatttttgcattgatgctcatcagagatattggtgtaaaattctctttttttgttgtgtctctgccaggctttggtatcaggatgatgctgacctcatcaaatgagttagggaggattccctctttttctattgattggaatagtttcagaaggaatggtaccagctcctccttgtacctctggtagaattcggctgtcaatccatctggtcctggactttttttggttggtaagctatcaatgattgcctcaatttcagagcctgttattggtctattcagagattcaacttcttcctcgtttagtcttgggagggtgtatgtgtccaggaatttatccatttcttctagattttctagtttatttgcatagaggtgtttatagtattctgatggtagtttgtatttctgtgggattggtggtgatatcccctttatcattttttttgcgtctatttgattctgctctcttttcttctttattactcttgctagtggtctatcaattttgttgatcttttacaaaaaccagctcctggattcactgattttttgaagggttttttgtgtctctatttccttcagttctgctctgaccttagttatttcttaccttctgctagcttttgaatgtgtttgctcttgcttctctagttcttttaattgtgatgttagggtgtccattttagatctttcctgctttctcttgtgggcatttagtgctataaattgccctctacacactgctttgaatgtgtctcagagattctggtatgttgtgtctttggtctcgttggtttcaaagaacatctttatttctgccttcatttcgttatgtacccagtagtcattcaggaggaggttgttcagtttccatgtagttgagcggttttgagtgagtttcttaatcctgagttctagtttgattgcactggggtctgaaagaccgtttgctataatttctgttcttttacatttgctgaggagagctttacttccaactatgtggtcaattttggaataggtgtggtgtggtgctgaaaagaatgtatactctgttgatttggggtggagagttctgtagatgtctattaggtctgcttggtgcagagctgagttcaattcctggatatccttgttaactttctgtcttgttgatctgtctaatgttgacagtggggtgttaaagtctcccattattattgtgtgggagtctaagtctctttttaggtctctaaggacttgttttatgaatctgggtgctcctgtattgggtgcatatatatttaggatagttagctcttcttgttgaattgatccctttaccattatgtaatggccttgtctcttttgatctttgttggtttaaagtctgttttatcagagactaggattacaacctctgcctttttttgttttccatttgcttggtagatcttcctccatccctttattttcagcctatgtgtgtctctccacgtgagatgggtttcctgaatacagcacactgatgggtcttgactctttatccaatttgccagtctgtgtcttttaattggagcagttagcccatttacatttaaggttaatattgttatgtgtgaatttgatcctgtcatgatgacattagctggttattttgctcgttagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtgaaggattttatttctccttcacttacgaagcttagtttggctggatatgaaattctgggttgaaaattcttctctttaagaatgttgaatattggcccccactctcttctggcttgtagagtttctgccaagagatctgctgttagtctgatggggttccgtttgtgggtaacccgacctttctctctggctgcccttaacattttttccttcatttcagctttagtgaatctgacaattatgtgtcttggagttgctcttctcgaggagtatctttgtggcattctctgtttttctgaatttgaatgttggcctgacttgctagattggggaagttctcctggataatatcctgcagagtgttttccaacttggttccattctccccgtcactttcaggtacaccaatcagatgtagatttggtcttttcacatagtcccatatttcttggaggctttgttcatttctttttattcttttttctctaaacttctcttctcacttcatttcattcatttgatcttccatcactgataccctttcttccagttgatcaaatcagctactgaggcttgaacattcatcacgtagttctcgtgccatggttttcagctccatcaggtcgttaaaggacttgtctgcattggttattctagttagccatttgtctaattttttttcaaggtttttaacttctttgccatgggttcaaacttcctcctttagcccggagtagtttgatcgtctgaagcccttttttctcaactcgtcaatgtcattctccatccagtttgttctgttgctggtgaggagctgcgttcctttggaggaggagaggtgctctgacttttagagtttccagtttttctgctctgttttttccccatctttgtggttttatctacctttggtctttgatgatggtgacgtacagatggggttttggtgtggatgtcctttctgcttgttagttttccttctaacagtcaggaccctcagcaacaggtctgttgaagtttgctggaggtcccctccagaccgtttgcctggctatcagctcagagactgcagaacagtggatattggtgaatagcaaatgttgctagctgatcgttcctctgggagttttgtctcagaggtgcacctggctctgtgaggtgtcagtctgcccctactggggggtgcctcacagttaggctactcggcatcagggacccacttgaggaggcagtctgtctgttctcagatctccagctgcgtgctgggagaaccactattctcttcaaagctgtcagacagggacatttaagtctgcagaggtttctgctgccttttgtttggctatgccgtgcccccagaggtgaagtctacagaggccggcaggcctccttgagctgtggtgggctccacccagtttgatcttcccagccgctttgtttacctactcaagcctcagcaatggcgggcgcccctcccccagcctggctgccgccttgcagtttgatctcagactgctgtgctagcaatgggcgaggctctgtgggcgtcggaccctccgagccaggcgcaggatataatctcctggtgtgctgtttgctaagaccattggaaaagtgcagtattagggtgggagtgacccgattttccaggtgccgtctgtcacccctttctgtgactaagaaagggaattccctgaccccttgtgcttcccaggtgaggcgatgcctcaccctgctttggctcatgctcagtgcgctgcacccactgtcctgcacccactgtccgacactccccagtgagatgaacctggtacctcagttggaaatgcataaatcacctgtcttctgcattgctcacgctgggagctgcagactggagctgttcctattcggccatcttggctccacctagttttttgtatttttagtagagacggggtttcaccgtgttagccaggatgatctcgatctcctgatctcgtgatctgcctacctcagcctcccagagtgctgggattacaggcgtgagccactgcgcccggcttagaaacattttttaatggtaacccctactgcatgtctgagaatgttcattttccttttgatgaatatgataactttgaatcttagaattcaatcaatgaaaacagtagaaaaagttacgtgttcctagtacattttccaagtatcagctagaagagctggaaaacaatatattaatttaggcattctttattgttaaacagattacattattaaacttaatgtcagctatactccaaatgtccagaagcgaaactattattattattatttgagatggagtcttgctctgtcacccaggctggagtgcagtggcatgatcttggctctctgcaacctctgccccccaggttcaagtgagtcttctgcctcagcttcctaagtagctgtgactacaggcgcatgccaccggcgaatttttgtatttttagtagagatggggtttcaccatattggctaggctggtcttgaactccagatcttgtgatctgccagccttggcctcccaaagtgctgggattacaggcgtgagccaccactcctgggcacgaaactattattaaacctcaggtaactactcactgatttctagccacggtacacttatttgcaacagttgtatactgaagtctgttcattttgtctttcatccaaatgtttactgaatttcctgtctttttgggttgtcaatttgactattaaattaggttatttagtgagagtttattaaaagacatcttgtcattgggggttagctgactcctcttccctactctgtctctagaagcctttaacttgcctttgataactaccaaaaatagccctgggaaaacacacacacacacacacacacacacacacacacatgtctgtaggtggataagccacatgagggccatgcttcctaatcctactatggaagcccagtgtgtaacctattaaaaattttaatttcagttgaaaactcaacagaaaagcaaaattatacttcatcataaattatttttgtatggtaagcaaagaaacaaaaataaatgaaaatcataatcagttgcatacaaattatttcacttttcagtgaaataatgatatatgaatgcattacagtattttagaaatacattttattgccaaaacaatcacaaataaatattatactggtagtatgataaagcagcagtaaaaatgttgtagatggatgtggtacacattaccatttgagacccactgatcaagtgtcactactattatttcagttttctctgcaacatctcctcctagtggacatgcagtctgtgcttgaacatattcatctatatctcaccaggttgtcaattctactgacagatagtgtcaatgttatagaaataatgaagcatgagtttagaggggacctagttatgagtttagagaaggaatagaaccaaacttaacatctacaaggatatttcttgataactttcaaatttctgactggtaattagtggcaactctcaggttgtcagcaagtgattatacattgacacaagtgatatgtaaaacagttatgtattgtgtgaatgtcaaaacaaagtaagattcttagtgagaggtcaggtttaaactggaataaacctgccctatagatctcaggcaggaaaaagtaattaggagttatagataggcttgtcttgaccagaccagcttttagaaaggagggtcaaaaggaagccagattcctcaaaatataataaaacagtctgccaactaaataaaaggatttatagttaaagaccataaatcctgtccctatcatccagtgttcttcctttctttagatagaattaaattcatcttctactttggatatcaggagaaacacccctaagggattacatcttgattgatggggaggtaactctcatctgaagaatgcatttgaaaggaaacctaagaataactttgattagacaattctgatatttggaaatattataagcttgtcccagatcataagtagaataaatggcagaactgggattcaaacccagtttcctgaagctaaagactaagtatgtgggctgagggtggtggctcaagcctgtaatcccaggactttgggaggccgaggcgggtggatcatgaggtcaggagatcgagaccatcctgtgaattgtgaaaccccatctctactaaaaatacaaaaaattagctgggcgtggtggtgggcgcctgtagtcccagctactcgggaggctgaggcaggagaatggcgtgaacccaggaggcggagcttgcagtgaaccgagattgtgccactgcactccagcctgggtgacagagccagactccttctcaaaaaaaaaaaaaaaaaaagactatgtgtatgtatatgtgtgtatgtgttttttttttttttgttttctagtgtggtatactgcctccttgggaaataaatatcaaataaatatacttattttgtagttgggataaaagcacttttaaacatggcttaaattataaacatacatgtaaggaataggatcttctggacagactattctactgggatctgcatcatgatcacattcatgttctgcctatattcacaggaatgcttcaaactaaaattttatggaaattactttagcacataccattttatattaatatgagaatgactgctatcttaaaatatatgaacatgacattttaaaaggtaaggttttatagctctaaaacaaatacaaaactcaacttgatatttgtatatctctatgtgattttctaacttgttttgcttaatttctcatatacaaaagtttgtttacacgaagagttcaaactatcactataacgacataacaaggaaataaaccatcagtcacatattatctttttttttttcctttgagtcaagatctcactctgtcacccaggctggagtatagtggtgcaattgtggctcactgtagccttgaactcttgggctcagtgatcctcccacctcaccctcttaagtagctggaactataagtgtaaagccaccaaacctggctaattttgtctattttttgtagagatggggtctttctatgttgcgtaggctggtcttgaactcctggactcaagagattctcccacctcagcctctcaaagtgctgggattacagatgtgagccaccacacctggccacatattatctttaagaattaaacaatttagtattcttctaacatccttttctatacataagtcactatagatttacttttcatttatttttactgttttcatttggtaaataaaatgttatatttcctaacatggcttacagtgttaacttgggtttaatgtatacagcaattcccaaagagcaggacacaataattacataaagaaatgtaaaataaatggctaaacctaattatttgaccatattaagctttatacagaagaatattctgacaccaaaagcagctgtatgctaaagttaatcaagccacaataaaccaaattagacgtgataaaatctggaagtatgcatatggcattgggtagctacttaaagatttatcaaaaggtatttttttctctttatttggattaaggacaaaagaaaataattcacaggtttacacagcagtaaaccttagcagttgaaaatttaggtatgaaatatatattgtcaatagctgtgagatgctatcaaccacctctatacaaattatattttcatgtggtttttgacatagtccttttttcataaaggaactaaacacagtatatgaaaaatgttttttgaatgtcaaacgtgctctatcaataacttttcctccacctccatttaagatgcttttactatgacttggttaagattaccttaaggtgtttccaactacattatttatatttccaacttaaagaactatatgtatatatatatgtatatatatacaaacattgtttttagacattgcttttagactttttatattgtagaaattaagataaatgaggatgattattaggagaataaaccttggtgggagagaaaccacctttaaacagcctctatcttcctactgcttgatgtgaaagttaaaaaaaaatacagaggctattactttaggtcagggacaatggtcttgttcatctttgtttacctactgtgtttttaaggtctttatttacactgtcatgcttatactgatttatgttctacgaaaggcactgtcagactgctggtaggagtgtaaactggtaaaatttgacgtgagaacaaagtcttaaaaatgtcggctaggggtagtggctcatgcgtgtaatcccagcactttgggaggccaaggcaggtggatcacttgaggtcaggagttgaagaccagcctgacaaacatggtgagaccacgtctctactaaaaatacaaaaattagccaggcgtggtggcgggtacctgtaatcccaactacttgggaggctgaggcaggataattgcttgaacccaggaggcaaaagttgcagtgagccaagatcacgccactgcactccagcctgggcgacagattgagactccatctcaaaaaaataaaaataaaaataaaaataaaaataaaaataaaaatagaaaaagaaaagaaaagaaaaaaagtgatatataataatttaagagataattccacttttaggaatctatctaaagacatagtcagaaatattaacaatttttgaacagatatttaccttgatgtttacaataatcaacagaaatgcctccaagtaggtaaatatttgaattgcttttatcaatgacagaatatcattagaaatgtttacacatagttattaatgacatgaaaaaaggcttattgtacaatgttaatgagaaaagtgagataccaagttgaatgtccaaccatgatatgaactatgttaaaaaacatatgcataggaaaaaacagttatgaaacaaatcaaaatgttaatattgattaatttgacttgaggaattttatgttcttcttttgatatttttctgaattttccaaatgtattaaaatagtcaaattatttttacggaaattaccaagaaatgcttttttgttgttgttgttctgagatggggtctcactacattgcccaggctggtcttgatttctgggctcaagtgatcatcttgcctcagtctcccaggtacctgggactataggtgcatgccactggcaagaaatgctttaaaagtctctctcacataaagtaacaaaacattatttcttaagctttagaagtcactgtaccatttgtgaaaataatatttacctcatcatcatcaggaactggttcatataaggatggaacccaagccagaatgttgcagtctctgctaccactataaagttcctataacatagaaggcaaagatgatactgtggatcaagagctgatatcaaactgaaatgaattatatcatttttgaaataattaggtcataataattagattaatgctatttctactccctaaagaaactaggccaatgctgtttttcctttgtttctttgttagtaaagctttgttttgtatttaaaaatagtattaggatttgtcagagcttactaatggtgtgaaaattttacaaacacaccccaaatcctagcagttttatcaattatagtatccatatatttctaatgtcagagaaagaaaaaaatagtttgtctttctgtgtccaaataactgagcttcaataaagacttcagtgaagaaaccatatgagcgtctactaaaataggccaagttctcaaaaagttttatttaacttacagctgcctaactggctgcaattcaacagaagagcttgaagatgtatatcccatgcctgttgagaagtttacttcataaggggaagcttggggtgatgcacagcctatgtcaatgtctacagatatgctgtttgcttatggctgaacaatgctcatgcccctccccaacaaaaccgaagaaatatgttatattggcttttttcctctgctgtttaatacaatttatttttattattgtacatctcaaaaacaatgtgaggcatggtataattgtgttttttatctaagtaaggatgtgggaaaagggaaaataagattatatagtaatttatagaaaatgtagatttaaataattattagatatacattatcaaatttcctaaataaaacaaaattttgttgactgtattacaaaatctagactataaagttacactaactgtggctgatgcaaagatatatatgttcagtgcccttgagtaattttactcccctgagaaggccaggtaatgcgcaagataacttggtcagataagcttatagagcaattcacaataagtactaacacacccagtgaagacataaaggaaattctgtagatgttcaagaaagagatattgaaagcagcaacatttaaattagaatgactaacaaagaacacttagatagaatgatttacattaagccttgaagtatctgtgatagatggaggagttcatttgggcaattagattttcttaaaaaataatctcaaaatgtaagttacaagtgcagtccaaaagacttcttttcccccttgaatcatatgagagtaagttgccaacattaggccttactactcttgaataattcagtgtatttttcctgtgaacaagggtacttccccttatagttacaaagtaaccaacaaaatcatattattaccaccatctaaagaccacattcatgtttcattatttgttccaatactgtcctttatagcaaaagggaccagttaaaaatcacatgctgcacttagtcgtcaagtctctttagttttcaagctggaacagttcttcagtctctttggcttttctgactttgataattttggatatacagcagttactttgtagactgcccttcacatttggcttgtcttatgtttcctcatgattaaatttgagtgatacaatttggtcaggaatatcacagaagtgatgtcccataactgggatgctaacttagattattcgatgaaggtgatatgtgccaggctccttcagggtaaaattaatctttttagtttgtacttcatattttgtagggtgatatgttgagattatataaatatctcattcctcatcaaattttcaatttattaatttacttacttatcccagcctagattcatgaatttatattctgttgcccatgttggagtgcagtggtgtgaacacggctcactcaatctcctggactcaagcaattctcttgcttcagcctcctgcacagctgggactacaggcatataccaccacacctggctgattttttgattttttgtaaatacagggcctcattctgtcacctaggctggcctggaactcctgggctcaagtgatgctttcggcctcctaaagtgctgggattacaggcatgagccactgtgcgcagccattgtcacgattttaatccattctaggcacacctattagagaagctccaatttggtagaaagaaataatttgtggttagagtacctgggatgaaatttcggctgtgtctctaagtaactttgcaaagaaaggagggacaatgttttaagaatttctttgaatacaaacacatgctttatcagtaactacttgcaggttaggggcaagtcacgtcacctctctggtgctttcgttttcttctctcagaacactaaaaatgtttaacaaatgggatataccttcttattgactaataaaaagagatactggctatagggttggagtagggtcttgtaggtccccttttagttgctgcgttaaggtgacgtctaagaggtcccagggaaggggctgaggctggaggtcgcttgggggcttggtgcagcagctgtttaccagccagtaggatatataaatatttatatattttaataatgaatactgccataatggtatgtactggctgaaaaatcaggtctatatatcttacagcacagtgtcaggcacaaattaggcaatcagtattaatgaatgaatgaataggagattcaaagtgatagtctccttgagctctaataatctgtaatgttcattctatcagtatttaacttacgtgagtttcattttccttacctacaaaacagggaaaataccaactatcttgcaatgttatactcatttaaagaagtgcatgaggtaatttgtgcaaatgttctctgaaaaaatgaaaaaccatctgctccattggtgatatgaaaagatctggatgtaaaacaaacaaacaaaagccagagtatttaagaaattatataggttgtattaacttcaaaacctccctttactagccattggtagaaaataaggaagaatagatcatccacacatacataaaccaacatatacaaattatattttatgattaaatgcctatattttatttcttacccaaaagattgtttcaagaaattattttaattcaccacagattttcagttgttaaataaatgaaggtcatatgcaaaagaaacagaatttataccaatcaagttgcacagtattatattgattcattcatacattgtatgctgtctaacaatctaggctgtgctattctctattaaataaatcctactacaaatgtggattaaaagcataactcctcagaataaaatcataatttattcttttacatataactggtctggcaagctagctagctgaacattttaaattcctgtatcactcttacctggaaatttgactgaaatacacagcagtcaacagttttataatgtcccttaagcatagttatctgttctcctgagtaaactgtataaacagcaatggtgctaccatatggtacaaaaacaaattctgaactgcagccacaggagacagtgaatttcaatccttttttactgttattacaaacttttccatagttcacctgtaggattaaaataataaggttactcatctctgaaatctgaatttaaaacacaacaaagcctaggagaaatacttaaaatattatgctataaaaagggctcttttaaatttaaggaaaatattcaacgttgacagaacaagggccaatgacatgaatgtacatttaacaaaagaggaaatacaaatagtaaaaaaccacaggggtaaatgtttacttttcaatcttaatagaagtaaaatacagacttcaaccttgaagaatcattttagaccatttagcaaaaaattaaaaaaacgtaagacattagtgatacaagtgaggtaaacatgttggtggcagtgtaatttggctattctttctaaaagggcaaatggtttattaatgcaaccattcttttcaaaagaataatattttttggggggtgtatattatatactcccaaaaaacattattttcaaaagactaccccaccaagaattttttttggggctaataccccccaaaaaccattcctttcaaaagaatggtattttttggggagggggtaatgatattttttgggggggcatattcttttttttttttcctgctgatacttcttttatttctgttgtaaaacagagtaggggttaaataaagggtattgggtttgtcagctccagcctcttgggactctttttcctggagagagtggagagaacagtgggaggcaaagacacatagttggggaagggttcttttaatatgcagatgcttcagggagaaccaaactatttcactggtaatctcccgtcccactggaactggtgcttggatcggaagggaagtgagatcagtcaattagttaccaacactgccatcagcattgccagagaggtggagggcagacatcatggaatcagacagctccctggggattttatctgcacatttctgtaaattcttactcttcagggaggatgctagagcctggccctgttgtagggggtccatctccatgatcctctgcagtactgggcagcagtccactgggcacacatccaccttactgtttttttttagggtggtggtctacattgagtttagcccaccccatctgatgacgattcggattggtgcaataaccagtgagatctccaatcttatatacagtagctttatcttcaatggcatctgctatttccatcatcggagaatggagcaacttgatctccattttgagtgggtctgtgtcacccaatagctcatcagattctccagtggccaagcattccatggtgtcttcattgacttgctcggtatcctcgatgtcaaagaacttggtcatttccttaattctcagcactgagatgggcaggcagagtgtgagtgggtggtggtggtctatagaagctgatcttcccgctcacccagtcagctaggacagttttggctgcctgctcctgactgtgtaagtctctcttcttccccaaatggtgggccactgctgtcagaaagtgctcagtagtctggtacccagagagaaggtaatagttggaaatctcctccaggttgcagcactgcaagatggtctccactggggtcatggggtctgccagtctctagatgtggatgcagttatgcaggatggtgcccacctctgagctgggccctggaacaatggctggagcatccagcagccggatgaacttgtccaggtagacctcctgcatgaatttcgtgaccccaggaatggctcccacactgcatgcatggctgtgcttcaggcttttaatcaggctgcttttcccaatattgggaaggcctacaatgtccatatggatgtgggtgcgcatttcaccaaggcagcaatagttccccagaaccctcatgaggttttcagctccaaagctgacctgatgctgggtcctggccttgaaagccacagttggcaactcattccgaaggtaatccagccacttcacaacctccttggggtccaggtcaatctttttcaagaccaggaccagcttcttgttgccttctgcccataggatagcctcccccatttggaagcagcagcagcagcctaatgggtctctggcatccaggacttccagaatcacatcagagtattctaccacctcacggactccttgtaataagccttcatagtggcctcgtcatccagctgaggaaacatatttaattcctgcaaaacttcttccttacactgaaactcctcctggcgtcttaggatatcctcacagtagctcttgatagacctgcgtttttgtctttcttgctcctgggcagcttgctgcttctccctcatctcctcaaccctcttctttatttcagcctctcgattggcatgatcattggagtgaacaaactgaggagcagagggcactttggaggttgctttcttcccattttgttttgcaggcttcttacagcccttggaaactttacctggcttttcatttttgtttctaagtttcatcatcatgatcagcttgaaagcagataggttcgaatccgcttgctctcttcctatacttccggcggggatctgagaagagagagtaacagacgctcttgtgctgctaggctccggacttctggcttccggatgccagcctggcggcgcccgactccgcccactgggcagtctccacgagggggcggggcttctcccttccctttatagttaaacattttttcatacacataatataaaatttaccatcataaccatttttaatggtactcaatggcattaagtgcattcatgttgttgtgcaactctcatcactatccatctctagaactcttcatcttgcaaaattttacccattaaacagcaaagatattcttaccccttgacctggtaattgctcctgggaatttatcttttttttttttttttttgagacagagtcttgctctgtcgcccaggctggagtgcagtggcgcgatctaggctcactgcaagctccgcctcccgggttcacgccattctcctgcctcagcctcccgagtagctgggactacaggcgaccgccaccacgcccggctaattttttgtatttttagtagacacggggtttcactgtgtgagccacgatggtctcgatctcctgacctcgtgatctgcctgccttgatctcccaaagtgctgggattacaggcgtgagccactgcgcccggctgggaatttatcttaaggaaataattaaatagcaaaagctatatgcccagaggaattctatccagtattatttagaatggggtaataactgagaataggtatatattcctaataatgttacattaactttatgatttatataaatcataattatgaaaattatgcagaaaacagggataaaggctaagtgtaaaaaagcacagaccataaatagtgtgtacactgtagttttacctttatataaataattatgtatttgggacaaaaattaaaattctttgcttgtactccaaaggtgtagtgtgcaggctcagcagtgtgagcatcacctgaagcagtcagacatgcagacttccaggccccaccccaatcctaccgaaaataatcttcattttaacaagatccctaggtaatccctaggtaaacactaatgcaaatttgagaagctttgggctaaataagttgatgggtttacttcctgataataattttgataagcttggggtgagtgtaaaaccagtaactaatcatttgggaatcatgatcatgcatatcaacaaaatccactgtcgtcagggctaatattgaagtttaaatagtgatttgtcggctgggcgtggtctcactcccgtaatcccagcagtttgggaggccgaggcaggcggatcacaagatcaggagttcaacaccagcctggccaagatggtgaaatcccatctctgcaaaaaacacaaaaatattagccaggcctggtggcgggtacctgtaatcccagctactcaggaggctgagagagagaattgcttgaacctgggaggtggaggctgcagtgagccaagatggcgccactgccctccagcctgggcaacaaagcgagactctacctcaaaaaaaaaaaaaaaaaaaagggattcacttttttttctataggttagataagtgtgtgtgtatgtgtatgtatatatatacataaataaaaacactgaggtcaaaatggatacatgctaataatctatggatactatacttggcttactttccctttaggctaacttgtgccagaaatgggtacatgcatttagctacctcatggcagtagcagtatagtgggttaaatattaaactcattttggtggacttgggttttaaacactcatcttttttttgccccttatgaataatgatttaaccacttcgtttcattcttcttatctgttaaacggaaataacatcatttacttatagagttatgtatcgtgaaaaagcaaatgaaataatccatatgaaagcacctggaacacaaaggtattcagtaagttcctagattaattcctatacatgtttaaaaatataacattccctcatttgtgtcttctgatcctacatgtgcaacaatttgcacaatgatatgggggtggggtgacgaagaaaaaatacaaaacagttttcaactagtatttcactgttccccctggaaaaattataaactgctagactgtgatggccttattcacatttgtttctcaggacacctagttataaaacttatggtctttccagtataccacattccttcccaaatatgaactggaaagtgttgaatgaggtatgaatattgaaccagggcattaacttttgtcttgtccttagggtttcttcctccaatccatcctacaacttaatgtcatattaatatttcttttcttttcttttcttttttgagacggagttttcgctcttattgcccaggctgcagtgcaatggcatgctctcggctcaccgcaacctctgcctcccaggttcaagtgattctcctgcctcagcccccaaatagctggaattacaggcatgcgccaccatgcccggctaattttgtacttttagtagagatggggtttctccatgttggtcaggctggtctcgaactcatattaatatttcttttttgtttgagacggagttttgctcttgttgcccaggctggagtgcaatggcgcgatctcggctcaccgcaacctccacctcccgggttcaagcgattctcctgtgtcagcctcccgagtagctgggactacaggtgcccaccactggctaattttttgtatttttagtagagacggggtttcatcgtgttagccaggatggtcttgatctcctgacctcgtgatccacccacctccgcctcccaaagtgctgggattacaggtgtgagcgaccgtgcctggcctgtcaactttaaaataaaaaaaagaagttactaaacggcaggactggttctatctgatagccctttaaaaatctgaagacagtgtgtttccccttaaagtaatcttttctggtatcaaccgtaagtattctatgtaggtcagtttctgggataccttagttacctatgcatgaattacttttactttgatcaagtccactgtaaaatgtattatccattttcaatacattattttagatacggacttaatagaaaaaaatccaaagggcatgagactcaccttcaagaaggaaagaaaaatggaatagaaccacatgaacaatttatatatacattcagtaccatttatatttatcacattaaactttgacacacatgcccagctactcttccagagtgatcctgtcacttctccactcacaagcctttagtggctttccatctcacccagagaaaagcctgaccccttacaaaggcttgcagggcccatatgatctggcaccctagttccttctgttcctcatctgttattcccttcatattccaacgcaagaacctcttagctcttccttgcgtatcccaaggaagttctcgcctcagggtctttgtaccttttttctttccctgactagaatgatatcccccagcaaacaactgatgagccacttccccatttccttcaggccaaatgtcaccttagtgaagcctaccctgacttccctatgtgaaacagcaactccaacgtcccagtatttcctgtgatcctttctttgctttgcttttcttcatagtccttacctaatctaatatataatttatccatctgtccatctattaattgattgatgcctttcatactcttgctgaaatgtaagctccatgaggataggacttttccatgttttgccaactgctgtctaatactgcctggcaaattaaatgctaattattattagcacagtatctgacatacaagctctcaataaatattagctattattattatcaccaaattataagcttttagtagtttgttctgaaaattattaaaccataggcatatctgataagactataacctacataaaaacaagtactagaaattaatagccacataagaatatagcaccttcgaaatatatttattgcagtagtattaaataaagtactacatattctggtactataaaattcactgtaaattttgtttataagtcatatatagtacaggttaagtatccccatccaaaatgatttggactagaagtattttggattttagaatatttgctttactgcctgaacatccctaatctgaatattcaaaatctgaaatgttccaatgagcacttcctttgtgtgtcatgctagcactcaaaaagtttcagattttggaacatttcagatttcagattttcagattagggatactcaacctatataaaatttgattacttagcttcatatctttaatttatatcagtagtcctcagtcttttatttttctctactacgctttgcactcccattgagaacagtggctcagtagaacagtgattctctgctaagtagggagaatgtggtaggtagtgggtaagggtgggttgtcctgagttgagaattactagtccacatagtagaaacacatttttaaaaacagctgtgattaaaagggaataaatgagttaaatatataaaaaaatcaagtgtatgtcacagatccatttcttaatttatacccaaatatatacttaaaaatctcttacaagtgtgttttctccattggaactattccagagcctcattcgattatctgtaccaacagtgaggaggtgaagtccatcacttgtaaaacataagccattaactttcccattatgagcagtgtttgctgcaatgaaaaacatagttcagtttatctgttcttgtattcaggacatatttaatgtttgatgatataattaaacatattaaaggacaactacttgagttacttaaaaaatgtaagtagattatacttaaccaacccttcagattatttgaataggataagctatataaatcagaaccataaaaatagaggaaaacaaaaaaaaaagggaaaaaatttctgcctaacatacttttcttttccagcaaggaaattgtgccatgaaattcaattaaatgtgtagcttaacactaaaatttaaaattaaatgcctttcatctctcatatatttttattgctaacctaaaaatcattctatggactattaaaatcaataattctagtgttttccattgaaaaaaaaaacagggaaaggatgactgttgtagtctcaaaatttatatcacttacaaaattaacaagtttgagaaagcataattctaaaatagcctaattaatttaaaaacatataaaacatgttttatatagtttacatgtttcataaggttttttaaaaaactatataaattctaatatatgaaatatattagaatgaactatataaaacctatgattgttttatatagtttttaaactttgtgattgttttatatagttttatgtagaaactacataaaactatagttgttaagaaattacataaaacaattataggttttatatagttcattctaatatatttctggtccagaattaattctctatcaaaatttctacacaggaattaaattctactgtaaaaatgcagtttaggtactttgtcacatggattgcagctgactcacatttaacacaattttatgttgatacaatggccacaaaatgttactatttctgtaatttattgtgactttttaaatggcattgaatatgtatagttggcctcaatggagcaaaaacaaaacaagtaaagcaagttaattcacaaaaatttctacttttgaaaatttgggggcaaatgaaactgccatttttatttgtatcttaaagaaagagaatcataatttagtttatgtaaattaagaaagtgatatacgatgaatgccttttgaaaaatcataaagtttgcaatttgtcaatatgcgtttattatgtggcttcaattaaaaattttcaatgtaaaaaaatactatcattgtcatatttattaatgcgttcttccttacctgattcaacagcttgtgactttttcccattatgttgatcaagagtaatcaaacatcctgatgctcttctcacatcccataattttactctactgtcagcactgagaagaaataaatgttacattgacatatgtagctaggacaatgactgtacccctcacccacctttctaattttatggcacacagaggtctcgttatataggtacatatgtattcatacattagggttgttgaacttttgccttttcagcaaatattcaatagtcaacagtagctcaaataagtgagtaaatagcaaaaaaaaaaagtaacctttcttttccagataacaagaacaaaattttgctgctttttatattgttttaaattacatgagcatcttttctcccaaggaccagaaaggcttgtagcttgttccaagtaagttccttaccataccttttctactgcttgttatccaaatgctgtcaagacaagcaattaactaatttcactttgctcaagaatccatttggtatgatttggtgtttttttcctttttatataaaaaacggtaagtgtaaggtgaataatgaggacaatgcatttccatttggtttcctatactcaaatcaatctttgccagatatatgagaactatatttaatgtctcctagaaattagacacttactttcattttctttcaagtaagcaaaaagaagaaaggcaaatctatgatcagacatctatttcagcttctagattatttctaaagaaaaatgcctggcaatccgacgtgctcctaatcagttcaactgatgctatcatgtcctcacaaggacctcaacaatattgtaacccagggggcttatcaatgccattttaataagagagagcattacatttttataagcctattttttatttaatttttttaaaaaaatatacacacaaggtttactggtttctataacctcgattcttttcacagatgaccatcaaacctagccaactggaatagttagcaaaaaactagcattacccattcttaagttggttttctttctttccaggtgaaggaaatgaaatcagtatgaggatttaagtctcttctgaaacagattagatttgaacatatccaacttttaacactgattactaggtccattgtggtactgattcaaattcctggagtattcttataattgaaagcttcttagctctcctcttatctgatgaaaaccaagttaagcatgaaaaatgtaaaatccacccaagcataaccagcacctagctcctaaccttcatacctcttcagctagccttcttatggctacattctagaccttgctgcacttcagaaatcataaatttcaacatcacattctgccagttattaacagaagcttctttggggcctgaactgtgacagggagacagggctggcaacttaaaaaaaaatccagacacagatctttataaaattaatatgaatagctttcgtaataattcttcttctacttaaagttttatgaaaatatataaaaatatttgattactacttcctatcccttcagtttttaaattttcttagtctaactctcatacttctacttcattagatccttgatccctcctacaagcctttttgtgatttttttccttttacccatgacttctacaattttcaggcacctaggtactttcctgtagacaccgaaaattgttaagtctctttcatttaatgttttaatttctgtggcttagtacagctgtgctctacatattcaacagggagcaagtgcccagtaatcctatgggcccttaatcagctccctcactctttcaatctattattccagatccatactatctttcctcaaaattgcatcctcattcctatattttcaagagatgacatcaagttctactccactaaaaaccaagagaagccgttaagtctgagtttcttgagcttctctgccaaagctacaaagttaactgtattcatgtccaccttttcctctttccatttagtctcacagtgctcttcatgtgccaaactaggtgtaccctccaccctcatctggatccttgatactacccacttctgtgtattcaaggacctaatgcaccaattattccctccatttcttatcttcacctgtttctctctactggtactctttccccagcagataaatatgcaatactctttttctccagcaaaaaataaacctccccacatcttttgatcctctcagagttaagtgatcctgctttcttttcctatattacacctaccagagatgtacctctattaaagcatttttctggatgccctgtaatcactgatttttgactatatgcctcattagatcattagattgttggtttttcaaagccttggttacctctgtgtccctagcacaatgcttggcacgtgggaggaagtcattaaatattagaaaattgaatcaatgaatgtgtggatatgttacatcaaattcaaaataactccaggttaaagataatgaataaaaatgctctatttaaaaattagcactgtgttatacatttgtgtgtaagaatgacacaacacagttcctctgtgttctaaggtgaaacaccttgaaggtggataggattagaattagaatacaaaggaagatttcttttggtgacatgaattaaaatttctaagtcaatacttcattttaaaggagtgaattaataattaaatatgctaaaatatatacattacataaatgtagacttttcaaaatgcttattattaattactaacttcaaaagcaaataagttaaattttaccttgctgttgccaagatatagtcataacgtggagaccaggaaactgctaatatttcttgtctgtgacctgcaaatacaactatatgaaaagtcttgcaagatatctgaaaaatcagaagataaagtgccaataattttgcctgattctgaagaaagtgaggccaaatattcaatgtgaatagatatgaccatttttcagatttataataatcgatgtttcaatgctaatgtgaagtttacaggggtatttcaaacatatggtattttattgtaaaagaactggttttgctttggaaaaaacagagttaagtaagtctttctttttaaatacagttgttagcttatgtcagtaaatccatataactcaagctcaattactgtaataaaacatataagataaacattttaaaggataaaaatgttttccaatttctcataaagttataagagaaacctactttaactcatgcttgtagaaaagcatttatataaaatgtttttttctagaaagcacaggtgataagttcaaagggtgatttcaatattttaattcacttttagctaactgaactattcacatcagacatttccacctgcccagcttatattaataaaaattcataataatgtcaaaaaatgctatctatctcatcaacttttcttaacatatttgttatgtgtttctttgagatcagtcaaaatatataaattatattctatcttttcattgtttagaattagacaatctaatactgataaaagtagcaagaataatttaaatacacctttaccaaagaattacttcaatatatttttctaaaatatttttactgagaaaaaatgtacctaaatattaagaacaatgtttactcattagccagaatattaaataatacatatgagacaagtacactgatgtgagttgcattagtctttttaatgtagaaataacacaaggttttgagttagaactatttttcatattgtttgagcttccccaatgatcattgttcatataaatgtgttttcaatggttcagttttataagaataatgcacagaaggatctttatttccctgctgagtctcaacaaccagcacaaagtacattagtcatgtcacttacaaagaatacactgttagtaacgtttctttttattgaatcgtttactcaaagtagttgccgtttgaaataaaataaaaataccctgtagaatgtgagaacaggatccagacttcaagtcacaaagttgtactttgggtcctctagtaccaactgtaaaaacagaaccggtttaagataattttatcataagtcatcatcaaaaggaaacaagacattatcattagtaatcatgacattttcactgtatccatgcagaaatatgaagatatatgccaaaattacattgtcatttttaatgtttacatttagaaaagttattttaactacagttatattttagtagtaagagacctctattattacatttattttttattctgaaataattatagatttgcaagcagttgcaaagctagtataaagagaaccgtgtacccttcactaagtttccccaacgattatgtgtgaggtaactaaaacacagtatcaaacccaggaaatttgtattggtaaatgtgtatgtatgtatgtacagttctattccattttatcacatcaaatcattgtattttaatagcttagtttttccaagttaatgatatacttccaatcactagtaacagattcacagaaactggacacagactgaaaggacctcaagacaacttagttcctagctcttcttcacagataaaagaggtagagactcacatggtgccaaagaaataatgaatcacagggcccagatacctgataccagaaaatcattttttcttccttatatatgaagatgtttgttgcaggtgcttttatataaattgatgcttaatttgaatcacaatcttagagaaagaaagaatttccttgttttattgtgtcaaattgggaaagttgccaaattttattcatgtaaaatctctgaaactttggtggtttaaaaggaactctttagacagaaatacgctcttattctctgaatcctggccacagcatagtgcttgccttgcaaaatatctgttgaatataaatagtacaatatctgttgaatatatatagtgtgtgtgtgtgtatatatatatatatatatatatatatatatatatatatatatatatataaaattgtgatattcctctgggttaaaatgtctacatcaaaactaactacatataaaaagggagaaagttttcagtatgtcaaaagacaaaagaatacacttacaaacctgctaccaaacagtgcttggtggagactggagacatatgatgactataaactgtttcctcaaaattaaatacatctgcagtctggtaatcaaaagacatttaaaaagtataaggtttaagtataaaaacaaagcaataaattttctatttactttttcctaaatttttagctatttttaaattgactgttagcaattcaacttaaacataggaatgtaataccccaaaaaaccttgataatttgaaatcctgtcatttacaacattcttttcccttctatgaaaaaaaatatgttttcccaataaatcccagaaattaagaaaatataagcctgtggctcaccatattcctctccacccaccctggtggggagggggctcagcatctacatggatgatgtagccagcactgcctctcagttccgtataacctgagctaccacacccaggacgctgtcactacctagaattgccccttctttgaaatcatacatttcagttatctatgaccacaatcttctaccattttcagcttttccccctccaaatactctcaagaaatctgaataaactctggaacccctaacagttcctttcatctacttctcttcctctccagcttggatttcaaggtccaataccaataccaaggtcaactgccaatatctgcaattcctttgctaacatccttccacttgtcaagacttcaccctgggtgaccccaaatgtctgccttctctgtacttatatccaaattgatctacaccaggtgttggcaaactttctttaaaagtcagatggtaaatattttaggctttcaggaccaactactcatctctgtcactgcagtgttaaagcagtcatagacaacaaatgaacatattgtaactgctcaccaggttcttcctgcctgctgcacaaacaaaatcaattcacaaaaaccatggcattgtagtaaagagtttaactgatgcaaggctggccaggccaagtgcgagatgggatttattaatattactctaatcaacctccttgaagtcttgtaggtttggggtttttcaaaggtagtttgggggaaggggtgggagtggttagatgatgaatagatgcttgctattgattggttgggggtgcaatcataagggtgtggggaatggtcctcttgtgcactaagccacttctgggtggggccacaggggcagttggcaggtccaggtggagcccctggtgtcagacatgaaaaaatcctgaaaagatatctcaaaaggccaatctcaggttctacagttgtgatgttatatgcaggagtaattggggaagttatatatcttgtgcctccggaataatggctggcaatcatttatgtctctttatttatttatttatgagaccaggttatgagactggctaatttttgtatttttggtagagatggggttttgccatgttgcccaggctggtctcgaactcctgagctcaagcaatccaccctccttggcttcccaaagtgttgggattacaggtgtgagccactgctgggcctatgttttagcagaattcaggcttgtctcctcctcctagtctggtggtctctcattagctttacaaaggtggttgagttttggagaagggctattatcatttaaactataaatggctgggggcagtggctcacccctgtaatcccagtactttgggaggccgaggcaggcggatcacttgaggtcaggagtttgagacaagcctggccaacatggtgaaactccgtctctacttaaaatataaaaattagctgggcgtggtggcaggcgcctgtaatcccagctatatgagaggctgaggcaggagaatcgcttgaacccgggaggcagaggttgcagtgagctaagatcacgccactacactacagcctgggcaacggagcaaaactctgtctcaaaaataaataaataaataaataaataaataaacaaatacatacataaaataaaaaaaatagagtattaactaaatgtcttccaaagttagcttggccaaagcccagcaataattaaggcagcttgaaggctaaaggcaagagggggtggtggctagatcagatctcccctactgccacagttttctcactgatataagttttgcaaaggcagtttcaatatttgtgtccaaaacctactttatttacaaaaaaaggccatgagccagacttgcccatgagcccagacttagccaatcccttgctctcctcaggtaaaaaatcttataattagggcagtgtgacatcaccataaaagattattcatttcctctggatttcagtaatgactgccagtcccactatatttcacttgtattcttctctgcagtattcctcagctatttcaaatcttctccacaaatataccaactcagtcacaacaggtaatttgatcttttatttcaaggagaaaataggaggcagtcaatcagaatttccttaatgtcttaccaacaaacctacaaacacatttgcttccacttatcctttttccttcttcactcctgttatcatagaaacatgattctttttttttttttttttgagatggagtcgctctgttgcccaggctggtgtgcagtggcacgatcttggctcactgcaacctccgcctcccgggttcaagcgattctcctgtgtcagcctcccgagtagctgggactacaggtgcccgccaccatgcccggctaatttttgtatttttagtagagatgaggtttcaccatattggccaggctggtcttgagattcctccccatttttaatgtcaatccccctacttgtgttcagattcccttcagcactgtcagaaatctcaccctatagattatcttctgggtatctataacctctgtccccactggctcattcccaacagcactacaagtgaaagtctttttcatcttaacaccgcttccctaagacaaaaaaaacaaagagcattttcgccctacattctccctaatctttcctcctcttcaaatccaaactttggctatctctaattccttatctcccacgtatttctcaactaattgcaatcttatttttatcgcactactgtaaatcacactattcttccaatattaccaatatgttcctcatctgatttaatctgtcagtagcattcaacacaattgattactcccatcctctttaaagcaatcttttacaggcttccattgtatcatatattcctgattttcctctttctctccttggctacatcttttcatcacctttagcagactttgctttcatttttctgtcctatttatctttgtcttcatggtcttgttctatgtactcctttcaaatgccacttgtatgttatgggttaagtatcccttatccaaagtaactgggaccagaaatgtttcagagttcagatttttttttttttggtttggaaggtttgcattatacttacaaggttgagcattacaaatctagaactcaaaaaatttcaaattttgaacttctggattagggacactcagtacatagtgaggcacaaatctgtatattcagtgtagacctcactcctgaattctgggtatgtatagatcgattcctggattatcttcatttggatttcctgtaaatccctcaaactcaacaaatcgaaaattgaactcatcattccaacccttccccatcttactaaataacaaaataacaatataatccacccaattgtcaagccagagaacctgggggtcattcatataaatacatatatatatatatatatattttttttttaaataatggctttgtcaagatacaattcacattatcatacaccttggaacccatacgaagtgtcactagtgatgctgcaagtggtaccaagaagcagagaaaagtcatgacattataaaaaaaggctgaattgcttgacatgtaccatagactgaagtgtgcagctgtggttgcccaccatttcaagataaatgagtccagcataagaaccattatgaaaaaagaaaatttgtgatgctgtcactgcagctacgccagcaggtgtgaaaaccttgtatgttttgtgaaatacctttgacctcttattgaaaatccatcttttatgtgggtgcaggattgttaacagaaaggcgtatctatatgtagactctaatatgacttttaaaaagcaaagtcagtatagtcattatatgacaatgtgaagccaaaggaaggtgaaggatctaaagctggagaattgaatgccagataaagatggtttgataatttttggaaagttttggctttaaaaaagtcaagataataggatgagaagcttctgcccaccaaaaggcagcagatgagtttccagataccattaagaaaatcatcgaggacaaaggatatctgcctgaacaagttttaaatgcagacaaaaatgccctattctgaaaaaaaaaaaaaaaaaaaaaaaaaaaaaaaaaaagccacaaaggactcttatgacatggacccttcaatgatatgggctctgaaactaaagcaaatagtggaagaaggttcagtactgtaatagaaacatttttagagaaatacagcagaacacacaaaaattacgatgtatttccatagttataccaagtgtggctgcctctccttccaaatcttacaccttttgctaccctagagacagcaaggtcaactcctcctcctcctgctccttctcctcagcctactcaatgtgaagatgatgaggataaagacctttatgatgatccacttccactgacttagtagtaaatatatttctcttcctcatgattttcttaataacattttcttttctctagcttactttattgtaacaacgcagtatataggccgggcatggtggctcacgcctgtaatcccaacactttgagaggccgaggtgggtggatcaacggaggtcaggagttccagaccagcctggccaacatggcgaaaccctgtctctactaaaaatacaaaaattagccaggcatggtgacacacgcctgtagtcccagatactcgggaggctgaggcaggagaatcacttgaactcaggacggggaggttgcagtgagctgagattgcgccactggccactgcactccagcatgggtgacagagcgagactccgtctagaaaaaaaaaaaaataataataataaaagaatacagtatgtattacatataacatacaaagttgtgttaattgactgtttatgtaatccagaaggctaccaattaacactaggctattagtagttaagcttttggggtaatcaaaaattatacatagattttcaactgtgatgggggtcagcttccctaacctccacactattcaagggttacctgtattatcataaatcaaattaatgtcatcaacgggtacatttcttgattatccagttccactgtatggtgtttttcttttttacttaccaatatcacattgccttcactagtataactttatagcaagtcttgatatctgatagtgaagtcttccaacttcactcttttgtttcaagagtgccctgctgttttgcatttccatatgaacattagaattagctagtcaattttcaaaaaaagaaatcttctaagagtctgatagaaaatgcattgattctatagatcagtttgggtagaactgatatttttatcacactgaaccttttaattcttgaacatggaataccccacatttatttaggtcttaatttctctcaataatgttctaaagttctctgtgtattcggaatagtcttgtatatttttcattaaatatattactaggtatatgatgatttttgatgctatggtaaacaatgttggttttgaaatttcattttataatcgcttgtgtttggaattcagaaatataatttaccttgtatccagcaaatttgctaaatttacttatattaattctaataatttggctatagattcttttgaattttctacgttcataatcatgtcttctgtgaatgacagtttaaatgcttcctgtccagttcctatcccttttatttcctttgctttattgcactgactaggacattcagtacaatgttgaacagaggaaataatgaggataatgcaaagggaaagctttcaacattttaccaccaaataaaatggttgctttagttttttaaaaaaatagatactttgtatcaaattaaggaatttctcttctattcctagtatgcagagaattttatttttatttttatatattttttaattatacttttaagttctagggtacatgtgacaacgtgcaggtttgttacataggtatatatgtgccatgttggtttgctgcacccattaactcatcatttacattaggtatttctcctaatgctatccctccccctacttctccacattctccccctatttctccacatactctccagcatctgttgtgtcctgactttttaataatcgccatcctaactggtgtgagatggtatcacactgtggttttgatttgcatttctctgatgacgagtgatgacgagattttttcatgtgtctgttggctgcataaatgtcttctttgagaagtgtctcttcatatgctttgcctactttttgatgggtttttttttttcttgtaaatttgtttaagttctttgtagactctggatattagccctttgtcagatgggtagattgcaaaaattttctcccattctgtaggttgcatgttcacttaatggtagtttcttttgctgtgcagaagctctttagtttaattagatcccacttgtcaattttgacttttgttgccattgcttttggtgttttagacatgaagtccttgcccatacctatgtcctgaatggtactgcctaggttttcttctggggtttttatggttttaggtctaacatttaagtctttaatccatcttgaattaatttttgtataaggtgttaaggaagggatccagtttcagctttctacatatggctagccagttttcccagcaccatttattaaatagggaatcctttccccatttcttgtttttgtcaggtttgtcaaagattggatggttgtagatgtgtggtgttatttctgaggcctctgttctgttccataggtctatatctctgttttggtaccagtaccatgctgttttgtttactgtagcctggtagtacagtttgaagtcaggtagcgtgatgcctccagctttgttcttttggcttaggattgtcttggtaatgcgggctcttttttggtttcatatgaactttaaagtagttttttccaattctgtgaagaaagtcattggtagcttaatggggatggtattcaatctataaattaccttgggcagtatggccattttcacgatattgattcttcctatccataagcatggaatgttcttccatttgtttgtgtcctcttttatttcattgagcagtggtttgtagatctccttgaagaggtccttcacatcccttgtaagttggacttctaggtatttcattctctttgtagcaattgagaatgtagtttactcatgatttgggtctctgtttgtctgttattggtatataggaatgcttgtgatttttgcatgttgattttgtatcctgagactttgctgaagttgcttatcagcttaaagagattttgggctcagacgatggggttttctagatatagaatcatgtcatctgcaaacagggagaacttgacttcctcttttcctaattgaataccctttatctctttctcttgcctgattgccctggccagaacttccaacgctatgttaaataggagtggtgagagagggcatccctgtcttgtgccagttttcaaagggaatgcttccagtttttgcccattcagtatgatattggctgtgggtttgtcataaatagcccttattattttgagatacattctatcaatacctagtttattgagagtttttggcatgaagggctgttgcattttgtcaaaggccttttctgcatctattgagataatcatgcggtttttgtcattggttctgtttatgtgatggattacgtgtattgatttgcctatattgaaccagccttgcatcccagggatgaagcccacttgatcatggtggataagctttttgatgtgctgttggattcagtctgccagtattttattgaggattttcggatcgatgttcatttgggatattggtgtaaatttctctttttttgttgtgtctctgccaggctttgttatcaggatgatgctggcctcataaaatgagttagggaggattccttctttttctattgattggaatagtttcagaaagaatggtaccagctcctctttgtacctctggtagaattcggttgtgaatccgtctggtcctggactttttttggttggtaggctattaattattgcctctatttcagaacctgttattggtctattcagagattcaacttcttcctggtttagtcttgggagggtgtgtgtgtcgaggaatttatccatttcttctagattttctagctgatttgcatagaggtgtttattgtattctctgatggtagtttgtatttctgtgggattggtggtgatattccctttatcattttttattgcgtctatttgattctcctctcttttcttcttcattagtcttgctagcagtctatcagttttgtggaccttttcaaaaaacctgctcctggattcattgattttttgaagggtttttggtgactctacttccttcagttctactctgatcttagttatttcttggcttctgctaacttttgaatttgtttgctcttgcttctctagttcttttaattgggatgttagggtgtcgattttagatctttcctgctttctcttctgggcatttagtgctataaatttccctctatatactgctttaaatgtgtcccagagattctggtacattgtgtcattgttctcattggtttcaaagaacatctttatttctgccttcatttcgttatgtacccagtagttattcaggagcaggttgttcagttcccacgcagttgtgtggttttgagttagtttcttaatcctgagttctaatttgatttcactgtggtctgagagagtttgttgtgatttgtgttcttttacatttgctgaggagtgctttacttccaactatgtggtcaattctggaataagtgcaatgtggtgctgggaagaatgtatattctgttgatttggggtggagagttctgtagatgtctattaggtctgcttagttcagagctgacttcaagtcctggatatccttgttaaccttcagtctcattgatctgtctaatgttgagagtggggtgttaaagtctcccattattattgtgtgggagtctaagtctccttgtaggtctgtatggacttgcttatgaatctgggtgctcctctattgggtgcatatatatttaggataggtagctcttcttgttgtgatccctttaccattatgtaatggccttctttgtctcttttgatctttgttggtttaaagtctgttttatcagagaccaggattgcaacccctgctttttttttgctttccatttgcttggtagatcttcctccatacttttattttgagcctatgtgtgtcagtatgcagagaatttttaaaaatgaggatgggcacagtggctcatgcttgtaatcccaacactttcagaggccaaggtgggaggatcatttgaggccagattttgacaccagcctgggcaagacagagagacactgcctctacaaaaagttaaaaaattagccggagatggtggtgcacacctgtagccttcactactttggagcctgagctgagaatcccttgagcccggagtttgaggttatagtgagttataattgcgccactgcactctagcttggggaacagggcaagactcttgtctcttaaaaaaaaaaaaaaaaaaaaggatattgacttttatttcaaaatgttcgtatctattgagatgactaatatgtagttttcccccttcattctattaacatgatgaattacattagttgatttatagatgttaaaacaaccttttttgtccactcatgatatattattctttttgtatgttgctagattctacatattaatagttgatttaggatttttgttatttatatttgtaagagacactggcttgtaattttccatataatgtccttgtaaattttgaaatcatggatatgctggccccataaaaaaagtttacaaaagttcctttttttcctcttgaagcatttgtataagattggtattatctcttttttaagtgtttagaataacttactcgtaaaggcacctaggcctggagatgtcagtcttcttctattgtctgtttttactcctaagctcatttgttggtaagcttggaagtttctgttttgagtgctagaaattatatagaaaaaattgggagagattctgcgttatgttatcctcctctagagaagatccaatctctcttttgcaggtaggagagggaagatcatatcaattcaaacataaagcttgtctgctattgtagagttctgtaataattttctactgatgcagtaaggaaagtacttactgtacttagtaagtaccacatacttagtaatttataacacaaatttattatctgtaataaatctgttctacaagttaaaattctcacataggtctcaatggattataatcaaggtgttgacaggctgcattcctttttggaggctctaggagagaatactttctccatcttccagagaccacccacatttcttggcttgtgatccccttaatccatcttcaaagctagcaattttacatttctctggccattctcccagtcaaatttaccccgtctccttctgcctcccacttccattttttaagattcttatgattacattgggcccactaggataattcagtattatctccctgtcttgaggtcaggtgattggcaaccttaattccccttcgtatgttctagagattagtacatagacatctgggagcgggacatgatgctgcctaccacaggctccatctacctcctatttgtacccattattagagtattcccctctaggtgccctaagagcctgggtgttttcctaggcccccttctacttagcaagtactgcactgcaattcttctctccagtaccatgtgactggggaaaattgctgttcttcaaatgtcttctgcttcatttcttaagtctatggtctcgcatagcttggtcagcaaatatctcaaagaaaaaaccagtgcaagatgttaggctgatttctctgcatctctcttctttctgtgatcttgaccctttaatttctggctgtcttggcagcccacattccaatttctgtctctctagctttatgaaattgactaaagtcccactcatttatctgcctcttagaagctatccaatgcctgtcttctcagtctcttgccttactttaatgacaaatgtccaaagagaaaaagagtgtgtggaaagttgaatgcatttctgtaagtgttcccctctctaggatctgattctcaattcctagatttcttggcagctttataaaaccctcaactagatgcctgtttatgctttatctagcttttctcaatggaggtgctggtttggctacaagatattccattatagtcagaagtgaaaggtcatgacattcatttaattgttaaaatatactctcattttcaatgacatgtattttaaataaatatactttattataaaaataaatctgaaataataggactattctaatgtagcaaggtcaaaaaaacacatctatttagtttgaattattagaagtatattaaatttacatttatatacacaacactgttttgttttgctcactagaatcataatatacttcatgattttattactttttagtatgtggccagttacatacattgttagtcatccctaaagcatttactcagcagttactgtacatagcactgaatttagtaatgtataagacatagtactttctttggggaagtaacaatctagaacaacaaataagacaaacaagtatgaaaatgatattataaagtagtatgagaatgtattgaaataggaatacagaaaatagtgctataaagtaaaataatggttaatatttactccagaagctgaaatcactaaactgcatgatagaactaaaagggaccttagacaccatctagtctgacactttaattttatagctgaagagacctttgctaacaaattaaatgacttatctaaagcaacaaatctcataagtggcagaatggaactagaactctggcatctacagtcttggctcaatgtaattgtaaaaaaagatgtgaccttaggagaagggaagagttgcaagggaaagggacttgaggtagggaatacaacagattcaaaacacgatcagtttagttgcagcaaagcatttgtgttgaaaactggtagaacataggattgaaggaacaagggttgatgtcatggagaacttggaatgccaggctgagtttagacaatgggaatccctagagggtttgggtagtgacatgatgaaactgctttataataagattaattctggggtagaacttagtgtagaaaatgtagaaggtaaggcagtgattttagtagtccagatgtgcagtaaaggcaaggtaaatagaaaagagaggtatgagagagtttgaagaaaggattgctaagattttatgactaaatttaatgagatgtgatcatgttcagttgggaccatgttaagtttgaagggatgacactacatttaagtatagaggtactgtagaaaagtagagacatatcagagtagagctcagagaaaagattagcactcggaatgtaaatttgaccaaatgtcatacaaactattatccattgcttgtctttactaagctacagtattaacagctttctccttcaagtttttagatcaatcaaagataaatccaattttctactttagattactagatcatagtatttttcacaaagggataataatattagctaacagtttttgagcatttactatatgctatgtactgtactaggtactttacatattttggctcatttaatcctcacaaccatactataatcattattcccatttacagatgagaaagacacacagaggtttggacatttgcccaatgtcatacagctgtcagcagcacagccaggatatgaactcaagtagtctagctcttcttaaccactgtactgctttcacatctaacatatatgacatctcagcaaataatcatactaaaatggtttaggattaaattctcctttatcctacaaagcaatctgcaaatgttttaatgtacttacttgtaatgtatttgtatcccatactttcagagttttatcaaatgagcttgatgtgaacatgccagtgtcatgaggataccactgtacagtctccacactgtatctgtgaacatcaggatgatctctacaaaacagcaatcaaaatttacattaactgacttatgtgagtttcaaaactggtactatattaagaacaagtagtagtctcaggtaggatgatatgaatggccaaaccgagatcacatgcctgtgtccaagctgtgtagaaggcgagaaagaatgtccaggcatctctagattcaggctcccactgtgtgatgtagagacatacctcctactaagggtcacaatgtgaaagattctctgtttttgtactatatacagcctggaggcatcagccaactacactggtcttctttcatcttgaaagagtgatttggtcttactggaagagacagctgttttggttttggatttgcttttccaaagtctcattctattagcactactattcttagaattattgaatgcctcacacacctccatggtattctatacaatattgcttcttatcaaggaacttattctatgaccaaagaatgcaactggtgtaggcccatgagattcacatcttatgtaacccaccatccataaaaacataacatgttgaagactctatgacgtcagctacaatacaccaccttgtgagggtggtatgctgtcctgaaggatgcagtatatgctctgaaccagtgaccaacatagtgtgttacctaactggatcttgattcaaacaaactggcttttaagagagatttatgagacgaagagggaaatttgaacacagactggatatttaatatagataatttttgtgtatttaagatagtggtactgtagttatgctcataaagtctttatcttttagagatataaataattatgaataaacgataggttgttcgagatttgcttcaacataattatgagggtggatgggtgggaggtagagatgaaacaagattggttatgatggttggtgaagctgggtgattgatacacaggtcattatacaactctccaatcttgtatatgtttgaaatttcccatagaaaacaaaagttaacagaagacttctgcaaccctatgcagatacaaccgtgatgcttttggattccttaagatgaaggtttgggaccttaaaacatttgtggtgctatctgaaggaatgagaacacaaagaaggaaagtcttaagtgccagctctggcattaaaacagctgcaaaaatacaagaactatagtgcctactcatatttcctttttttctctgtaaatattcatatattttaactaattttctctttcctctcttacctttattatttttataggttaactatatcattgagtccacaaattgtataatactgatataggataaattaaactagtggaaaaatgaacatgaccttgaaatggagccaggtgtggtaactaaatcaacttaggatcatcaccctttggggaagaggatgatcacctttttggctgtatagtgaagatttgcattaggttaggctggaacatttttttaaaaaacagtaattatgggaagaaaggtgtatacgcatgctggacagccaaatgggtggattgtagggaacatgtgcctttttttcttggctgatgagcattcaaactcctatttagaggaaatgccctttgttttactgaaaataagagctctacctcttcttacagaaagcaagggactctagacattctcttttcctaggagagttagccattattcaaagctgaggagttgagagtctgcgttggtgacatatagcaaaacccaaactaatgttcctgtggtgtgaccctgactgtgttctctatcctgacttcttttgttttctgctcattttctaagtctgattctcccatcttcctgacagttatgtgagatactaaatattcttccaataaatttcgcttaagataagcagattgatttccttttgctcctaagaatattgacttctacagagatttttccagtgatactacttttaaatgaaacaaatttttaatgtagtgataacaaataaaagctcacttatattttaagtttaaattttaaaataggatattttattatgttactatatatgttctgttattttcatttatatttaataagaattttggtagaggaaaggaatctttttagtgctcaaggacaaacacattaagtatactaatagtaagcatcagaaaatagtctaagtcacattaacttaataatagtctttattgaaattatttttaaattggattgtaaatccttcagatgtataaaatgttattataactcattttgtaaagatgcatactatatgtccattttcaaattcaaagtcacacttttaaatatagaatctgaatccaagaataaaatcacagtaaaacaagactgacacattacgcatttacttatgtcacaaaccaaaacaaagcaaatcacagttcctcacggaatattatgtagcacgtagaataggtgaaaatactattttgctatgtaacaaaataaatttaatgttaaaatgttagctaggataaaaataagataaaaatgaatttaattaattaacatgactttttttgttattgagggtgggaagagagtatatatggcctaagtctctaagttctagagtatttgaggcgatatcttgttttgtactaagtattcctgtaagtacattgcttttcacttatgcagtggtttcggttttcaacacgcttttaaaaagatagtatttcatttaattctcatagaaacgtataagaaccacagggcatgtatactgatttctaaaataaaataatgtgaagctgagattaactgattttcccaaatttgtatttctaatgcgaaacaccagagccaacaaacaatagcaaatctcctccgaaatattccatagcatatattctaatgctttgggaagagctgtaatagatagttgatgttaatgtttacaaagttttccctcttgaaagcattttctcagtgcccattctccctgttaattcaaaggtctgctcattatcagattgaatgtaggtgaagagaaaggattaaatgaccacaatggaaaaattacaatgtcacaaaacattttattagagacttaaaaaaaattatcacaagattggtaagccagtagagaacagtcagagaagacaagtattacagatgtatgtttttaagttagacatctttgagtaagtagagagacaagacaggggtgagtgggtatatgtgtatgtgtgtgtttggtgagggaataccaatatgtttagtatatctaaacctttttcttccattagtatcaggtgaaaatctaatttgtgtttataattagctgaaggactataaatgaatcttacactaagtggtactaaaaactctaattagttactgagatgtgctatgtaggtaaagaaaaagaaggacataatcacaagttttttaaaaataaaatactaatgaaaattgatactgaagttgctttggggaagacacatgttaaaaaactatacctgaatgtcagttactattttcaagaaagtgtcaaggaacagccatgcaaatgtgttatgtgaaccattcgcttgacccattcacttgactgcaattttcatgttttgcattcgatgcaaaaaatactcaactatttacaaattcataaatttttacattttaaatacatacctgccaatggaacacactgctttacatgtgtaataagattgtctgctggagttctcaaggtcataaagtacaatcacaccatctgaaccacctgataacatgctgataataaaaaagttcacattaatttatcattttatttattatttagtccatttatttatgattgcaaatttctaaaaactgatttgcaaacactcaaatgtattaaggatacattaatttataataagttaatcctcaataacacagacttcataaactaaaatttcttaatatttaatacaagaatgaatataaaaaaattcattctgtgatcatttcaagtttacttccataacttcaaaaagaaagggtgacagaaacaagacggcaaaagagatttcttaagaaagtaaaatattacaaagttattttaaatgtcctaattatgactatgctaaataaaaaaggaattagacaaaccaactattactgacacttgctatttggctctgggcaagttataccacctgtctaagactcaacatttgtaaaggagggggacatttttacctgaatcacagtgttgataataaaagtgcaaaattctttttatagtacctggcaaaaaataggggctcaataaatgttagattccttccttctcttatgaatgcattcactcaattcattcaactttaagttcctacaatgttagacactctgctaaaacaactgtcaacaaggcaggcatggttcctgtcttcgcagagtttacaatccaatagggaaaacaagtagtatgcataatcacacaaattattagttatgattgggatcactgtgacaataacttatttttattctagtttggaaattcaggagcagtttccctgattgcaatatttaagctggtatgtgaaggatgattcaaagttagccagaaaggtgtgaaagtaacaatccaagcccattctaggaaccaaaagaagggatttgttgctggagcagtgtggaagggaaagagtggtgagagatgagaggcaggagccaaaccactgaagccttacttttgggagtaaaagagggtgctaaaaaattagcagtatctttttttggaaacaattattgactcactctcaagctggtctattatattggtagaacctacaaaattattctattcaaaaactttgcaaaaatatttctaaaaagtaaaagtaacaagcatatatactaaagctatatacattgattgaacttaataatttgtaaaatcattcttggtacttcatatactttaatcagtttcttaaccatatttgtctctaatactgttactgtgtttttttaaatgggatttttcaatatgatcttattagtttttttggcataaaattgtctaaaaatcatctttaaatctggagttgttgacacctttaactgacttccctaaaagccataatgtttaatttaggaaataacaatagttgatgaggtatatgataagttcagagaaaattctgcaaaatggaggatattcttgaaatgtgcaaatatttcaggttattttcactgtttttaccttaattcaaagtacctttctttagtatacttatttttttacaagacaaaattctccttgaacaaattctttatgtctcttttggaagttacaccaaatttaaatattataaaatcttagacattgtgaatgttattccattacaaaatatacatttatcccaattacaaatatacatttatcccaatcaaaaataggggaaccatcaaaaattcttcacagagatccaaacaatgcaatctctctacatcatcactctttccttttcacctcaaagtaactcattatcatgatttttatcgtagtcactgtctttctcttctgtatagttcatagttcatcaccttagagtgtacacatgaatattagctttgctttttaaaaaaattttaatgtcttttaactttaagctataggtctcctctacctttcttcctccctcctgtacttttcccctctcttgtaatttatttgttgcaaaaaccagatcatttgtcctgtaatttccagcctggactttggtgactgcattcatgtgctataatttaaaataatttctatttcccattgctctttgttgtgatgtgatattagcagacaaaccaatatctagatccatcaatttatacatttatataaagtgttgctatctgctaatattattgctcaccgtcaatccttaagttgctgtctctcttgtcattctggttgaatgatttcattctctggttgattcctaaggaatggctaatgagaacaacagtctctgaattcttgtgttgttgacaatttatccgtcctttttgtatctgaaatcagtttggctggatataaaatccttgactcacattttatttccttgagcatcttggataagaagcttcatttcttctgccagaaagcccaaagtcaaagtctagtgacaatataaatccccccctcttatataaagttccagatcttatttatcctagaaaagctttcttgaattattgttttaatatttattctgctcttttgccttggtttcttttttgggaacttctatcatatgttatgctggatcttctttgcctatgttctatatatacacctcttgaattattttcctctgttcatttctttttggcttttaaaattttcctcctttctagtttctatttctaaggcattacctcttccatttatttgtgttctttaagttttagtcagtcttcatttctgaaatatttttatttctaattttctgagtttgagcatctcatttctgaggttttctaataacttaacattattctctcatttattatatgtttataaaacaacttttacctagttttgaaatattaggttagagttctcatctgttttatagatacttctttccggtgtgacttcactatctgtagcagctttagtccacttcttattctctttgtttttataatgattttgtaggaactttgaccttaatcctattcctttgctcatttttatgtaaaattaattttcttaaccttttagaatggaggcttgacttacaataatgtttaaattttatatattaaaacatcctcttcttcccttaaaaattttttttggggggtaagatttcaaaatatggaagcttactttcagagatttcctgtttctgttcacctttccaattttatcggggacatctttttcctttgtttctattgtctctgtactgctcaatttggattctatttccagcagttttcctcagtatatagttctgtactgggggcgcactttgactggttagctctttggaaagatattagagtccagactgctatagctccttctggtcttaccatgggccactcaaacatatctacaattagagtatgccatcttctcccagtttgagctgctgtagtcaaatttgcttgctaagttttcaaccaacctgttggttactttggacttatccaggtatatcagatgccttatcgctttttactgcctcctctagcaaaaatgctggtagtgcacagatcttttagttgtcagtggtttgttcccacttattcacagtttggggtttgtagggatacttcatgacctagtttggttgtaagtgttaatctggtttttcctatttgccatttttagtctctttatgtgttttaatggagaactagaggaacattaaaaactgcattgacattgtcatctttctttctttttttctgagaagaagtctcgctctgtagcccagactggagtacagtggcatgatctcggctcactgcaacctctgcctcccaggttcaagtgattctcctgcctcagcctccagagtagctgggattacgggcacgcgccactgcacctggctaattttttctatttttagtagagacggggtttcaccacgttggccaggctggtcttgaactcctgacctcaggtaatccgcccgcctcggcctcccaaagtgctaggattacaggtgtgagccactgcacccggcctgtcatctttcaagaatggcacccaaactacagtttttggcactacattcactgagtattttgattgaaagattttcatctgattttgaacaaaatacaattaaatgtagaggcagtgctatttaactctccaagataaggagcttgtaccagaaacaaacacacgtctttcttcactgagaatgtcttgttacaaacatgtcttagctcctttaaatggtgtgtgtaatgatgtagtagatttatgttttagcacaagatccttatcttgtgacccagtcacaaatagttcatgaactagtagcatgtattgatttatagacttgtttttaagataaattcaataccaatttataaaacaatagggttaatttaaaagtagttatttgaaggctcaaaaatccaattgatgggcagtaaagaaagactgctaataatgccctacttagttattttaaaaaatattccacattagctttattacattttgtagttcagttactctaattgtgtacatagagaaatatttgtaaattttaacaactacaacttttatttagattgataaaatgtttggacacagttgtgagttacatgtatactacaaccaattcccaaaacacttttgcttcgtaattaatcttcatgaaacgttgcttttcttgccatacagatgtattatcaatataaaacaaaattatgttaaaagttgaaattttaatcttaattgatatggtatttacaataatgtcagatgttttgactctgttaaaatggcttccaaaagcttttctctgattccattaactttctatttgaagtatctgatggcactgacattaactatgagatactttttgctgatagagtatgaagagatatggtttcatgtttttatatagacaagaaaacttagtattaaagatgaatgaaattaacttagaagaatttaaaaggtataaaagaaaattcaagcttcacagagtgatacgcaaatgcaccctctgcagttgcacctgttaaactgtaattttcagatactttttgtaaaataacaccttactttgaaaatctctgccagatttgtgtattctgtctggtttccaatctgattttcagtgacacctttacagctctcatggtggatggtaaatattaacaggtgttttgaacaagttatatacacatcgatttttttagttttccacagaatgtacgctttccttttaatatctcttgttgctatcaaaaggggttaatgcaaaatacaagtcttagcaaacaatgaaatagttgtagacttttaccgtgcaataaagcggaaaatcactgtagcaagagtcttcagacttttctctatgtgctgtattaaaagatgcctcatctgcatttctcaaatatatttcatgcacatataatctgtaacttcccatatttctcaccaactctgccaactggtagtctactggcttctcatacatcacaggccacacaactgattactacaccaagtggctggctggagtaacagtattgattactttcctgaccagcatccaaacccaaaagtcagctatctcctgctgctcatgtctgcatgtttcataagtgagtgcccccccagctgtccttgaatagaaggtgttacactgagcctggaaaaggtcaggaaaaagaaaagaattattactcatcttttagatttaaccacatgctaaagtaagatgtttctcatatactagtagatgagaccatggtggaagctggaagtaaaaagtggaagtttatcaaatctgttctgacttgacttaatgtattaataataatatttcagtataaaataaaaattctgggggaaatgctaaacataccataacaccaaaaactgtttcctttagttaatgctatatgtggcctaattataggccacatgaaacataccataacacaaactgcttcctttagttaatgctatatgtggcctaattgtaggccacatgaaaggttttgtacggtcttttaagagtaatgcagtgttatgacgaattgtaagtaggagaatatgttcagaattgagtttttcaaagcattttggctgctgtgtagagactgggctgaaaggagtaaaagtatatgtaatactgcttttgattaatagtggcagcagtggtggcaactgtttatgacgtgccaggtcttacgttaatcatgttgtgcatattatctcaatcttcaaaacaagcttgttaggtaggtactattgttcccattgtatagctaaggcaactgataattcgaaaggttaggtaagggtaaagccaggaagaactcaaatataattcttatttgtttctaatctaattcttcaaaagagtctttcactttttatatttattttaccattagacttttttgagagtagcaactatgttttaaaatagcacctaaagacacattctagcacctaaaagccctctgcatccaaaagaagttcaatgtttgttaatttaacaataagtaaatatttatattaaagtagcttggaaatgtttatttgacaacatttggtaggttcgatgttttgtatttacttgaaattaataatgccagattcaaaaatgctacaatttaggattttcattaattttaatgaaacttctacatcattaatttgaaaaagcaggttttactgcatttcacttagaaagaaaaatgattatacaagtataataaacttactatctcccttcaacaggttcaatgtcaagggtgttaattccaccgccgtggattctttcaacatctctgtctttatttaattccagtcccaaaactcttaaaaataaaagggggagaaagaaattaacaagtaatttaacatttaaaaatttcttatttaaccaagattacttatggtacaaaaatcacaagaaatgtctaaatcttctaccacacatcctaacgtatttatagatttttagacatcttgtataaatgtttaaaatatcagcagtagtaacaattacatgcaaacttttaaaggtatttaaagacggaaatttgtacgaaaaaagttaaattctgataaatgtagctgaggacatctaatggacaaaagcataaattacaggattaaaaaaattccttgaaatgtttcttaaagacggacagaaataaaaaatgagtatgggctgggtgcagtggctcatgcctgtaatcctagcgctttgggaggctgaggtgagaagactccctgagaccaggagttggaaagcaccccaggcaacatagcgagaccccatctctacaaaaaataaaataaaaataagctgggcatggtggtgggctcctatgcaggagactgaggcaggaggattgcttgagcccaggagttcaaggatgcagtgagccataatcacttcattgcactccagcctgggtgacagagtgagatcctgtcttaaaagaaaagagactatgttcaacttaacatttatgtgtatttaaataaagccacttaaatatcaatacaaataattaacaagtactctcacaaactaagacaaatgacatttctgatattttataactgtaaaccatcattatcctggtgagcatattattaagattaaatgagtttgtatataaaaggtgctaattacaatgcctagtacattgtaagtatctagcgaatattaactatttgaatctctcttaatctgttggctgttattagcatctacactaatttaaccagaattatttctaaattcattattgattaaaataatgctagtttaaatatcaaattataaatttttggcctataaaattatcagttttttaaaaagataacaatgcacaatgctggaaaggcataaactgatactttcattcattgacattagtacaagtaattataagcattttggaaatcattttagcagtataaagtatctgatttgaagatatacatggccctttgtcttctagacattacatatagtacaacaatgacaagcaggccaggcgcagtggctcatgcctgtaatcctagcactctgggaggctgaggtgggcggatcacctaaggtgaggagttcgagaccagcctggccaacatggctaaaccctgtctctactaaaaatacaaaaattaggctaggtgcggcggctcatgcctgttattccaggactttgggaggccgaggatcacaaggttacaagattgagaccattctggccaacatggtgaaaccccgtctctactaaaaatacaaaaattagctgggcgtggtggcctgtgcctgtaatcccagctacttgggaggctgaggtaggagaatcacttcaacctgggaggcggaggttgcagtaagccgagatcacaccactgcactccagcctgggtgataagagcaagactccgtctaaaaacaaaaacaaaaacaaactaaaaaatgagccaggcctagtggcgtatgcctgtaatcccagaggctgaggcaggagaatcgcttgaacccaggaggcagaggttgcagtgagccgagatcgcgccactgcactccagcctgggtgacatttattgcaatacatctatatacattgcaatttagccttaggtttaaatatccagacaaacagtaatgagttatctgactttgatcaataacaataacagctaatataaaaagccaggccgggcatggtggctcatgcctgtaatcccagcactttgggaggccaaggaggccggatcacttgaggtcagcgattcaagatcagcctggccaacatggtgaaaccccgtctctactaaaaatacaaaaaaattagccaggtgtggtggggcatgcctataatcccagctactcaggaggctgaggtgagaaaattgcttgaactcaggggacggaggttgcagtgagctgagatcatgccactgcactctatactccaacctgggtgacaaagcaagcaagactccgtctcaaaaaaaaaaaaagcctactactcattgtaataggtagtaataagaagtgtaataagtggtagtcccaggagtggtgattattattaaatgcatctcctgattataagattaatagaagagtaatttgcccaaggtcacacagctaatatttggctgagccgcatttgaactttaacattaaatttttttttaaatttacttttagagacagggtcttcctctgtcacccaggctggagtgcaatggcaaaatcatagttcactatagcctcaaactcctgggcttaagggatcctcttgcctcagcctcccaaatagctaggactacaattgcatgttaccacacctggctaagttttggtatttttttgcagagatgaagtattgctatgttgcccaggctggtttggaactcctggcctcaagcaatcctctcaccttcacctcccaaagtactgggattacaggtgtgagccaccacattcagccctgaactttgacattctttccccagaccactatgctgttctgtcatttctgaacttcaatatttcatcaaaactttttttttcatatttttccattgaaattgccatttttctgaaaatatttttccatatgatcatttttcaaattacaacagaatatatgctctttgtaacaagtaaaaacagtatcattcaaacatgtataaaggtaatcatcttttccttcagctccctcttcctaacagtaagaagcatggctcccagtaagaagcatggctcccattactaccaatatatttatcaatcccctgtatgtaaccaatctcccatctccactaccatcccctcccccaacagcttgggctctgatttctgtctcctctaaaatccttatcacctaaatttgtatgtccccacaattaaactacttcctcaacctgctcaggctctgaaattccactctaggaaacctaatcccatactaagtgagaaagcttacctctgcccaacataatgacttcaggactgaattgtctgtgaactagaaggagagtttaagatgaagggaaaagggcaataatactataaagggaaagagaggtggggagtggcaggagacaaggtgtacaaaacataggttaacatagcaggcctgagacggctacccttaaaaagttctgcttgcaagattggctcttggttacagtctgggatttcaggagggtgcccaccatgactggataagaatggctcactgtgcctaaactatttgagaaaataatgtgctttatgatgaatacctgctctacttttgggagtctggaattttggtacatgctagatagagggtgcctttatgaacggtacccagtaaaaaccttcaacattgagtctctaatgagcttccctgatagacatttcacatatgttgtcacaatttgttgctaaaggaatagagtgtgtcctgtgtgactccactaggaaaggattcttggaagcctgtgcctggtttcctccacactttgcccatgcacctattccctttgctgagtttatcttgtatcttttcactgtaataaatcacagtcatgagtaattgagtcataattaaatgctgagttctcagcccttctagaaaatcataaaacctggggatggtcttgaggacttcccccaacacaatggcataggagtagagggaaaagagaagggaaaatgggcaaggagagaggaaagagtagacacataaaggagggagggtaaaaagggaaagagaagagggaaggcagaagagcctggggtagaagggtaaggacaaaaagcaagccctggtgtcttttaaaatcacctttccaatctcttttttatataaaagcattgcttactggttattaatagctagcattcacttggcttagttcgtttccatgccaaactgattgttaaatattttatcagtctcttgcttcttctatggcacatgcttgcccaaatttcctatttaatttcagtttttaccttttatttttgttttaatgttttaaatggcttttataggatgtatattatatgtatgtatatctatgtatgcattttttccttttttttcttttttttttttttttttttgagacggagtctcactctgtcacccaggctggagtgctgtggtgcaatctcggctcactgcaacctccaactcccaggttcaagtgattctcctgcctcagccacctgagtagctgggattataggcatctgccaccacacctggctaatttttgtatttttagtagagatggggtttcaccatgttggccaggctggtctcaaactcctgactgcaggtgattcacctccttggcctcccaaagtgctgggattacaggtgtgagccaccatgcccagcccctgtattttctatctactatatattacttagtttttgttttacttttttgaatttttagaattttttatttatcaataggttttggggggaacaggtggtgtttggttacataagttcttcagtggtgatttctgagattttggggtacccatcacccaagcagtacatactgtacccaatgtgcagtcttttaaccttcaccccacttccaccctttcccccgagtccccaaagtccactgtatcattcttatgcctttgtgtcctccatagctcagctcccacttatgagtgagaacatacaatatttggttttccattcctgagtttcttcacttacaatatggtctccaattccacccaggtcactgtaaaagccatgatttcattcctttttatggctgagtagtattccatgatacacacacacacacacacaaccacattttctttatccacttgttgattgatatgcatttgggctggttctatatttttgcacttgcgaattgtgctgttataaacatgcatgtgtgagtatcttttttgtataatgacttctcttctactaggtggatacccgggagtgggaatgctggatcaaatggtagtactacttttagttctttaaggaatctccacactgttttccatagtggtggtactagttgacattcccactggcagtggaaaagtgttcccttttcaccatatccatgccaacatctactatattttgattttttgattatggtcattcttgcaggactaaggtaatatcacattgtggttttgatttgcacatctctaatcactagtgatgttgagcattttgtcatatttgttggccatttgtatatcttcttttgagaactgtctatccatgtcagcccactttttgttgggattgtttatctttttcttgatttgagttccttgaatattctggatattagtcctctgttggatgtataggttgtgaagattttcttccactctgtgggttgtctgtttactctgctgattatttcttttgctgtgcagtttaattaagacctatctatttatctttgtttttgtcgtgtttgcttttcggttcttggtcatgaagtctttgcctaggccaatgtctagaagggttttatcaatgttatcttctagaatttttatggcttcaggtcttagatttaagtctctgatccatcttgagttgatttttgtagaaggtgagagatgaagatccattttcattttcctccatgtggcttgccaattgtcccaggactatttgttgaatagggtgtcctttccccactttaggtttttgtttgctttgctgaagatcagctagctgtaagtatttggctctacttgtgggttctccactctgttccgttggtctatatgcctatttttattaccactagcatgctgttttggtgactatggccttatagtatagtttgaagaagggtaaggtgatgcctccagatttgttctttttgcttagtcttgttttggctatgcaggctcttttttcctagttctgtgaagaatgatggtggtatttgatggaagttgcattgaatttgtagattgtttttggcagtatggttattttcgcaatattgattctacccatccaaatgtagaatttagctgtgtttccatttgtttgtgtcatccatgatttctttcagcagtgttttgtcttgtagaggtcttttacctccctggctaggtatattcctaagtattttatttttcttttttgaagctattataaaaggggttgagtttttgatttgatcctcagcttggtcactgttggtgtatagcagagctactgacttgtgtatgttaattttgtatcctgaaacttcgctgaattcatttaccagttctaggagctttttggatgagtctttagggttttctaggtatacaatcatgttatcagtaaacagcaacagttttacttcctctttactgatttgggtgtccttgatttctttctcttgtctgattgctctggctgggacttccagcactatgttgaatagaagtggtgaaagtgggcatccttgtcttgtttcagttctcagggggaatgcttcccaacttttcccctttcagtataatgttggctgtgggtttgctatagatggcttttattaccttaaggtatgtcacttctatgctgattttgctgagggttttaatcataatgggatgctggattttgtcagatgctttttctgcatctattgagataatcatctgatttttgtttttaattctgtttgtgtggtgtatcacctttatggacttgcatatgttaaaccatccctgcattcctggtatgaaacccacttgatcatggtggattatattttttatatgctgctggatttggttagcaagtattttgttgggggtttttgcatctatgttcatcagggatgttggtctgcggttgtctttgttctttcctggttttggtattagcatgatattggcttcacaggaggatttagggaggaatccctctttatcttttggaacagtgtcaataggattgatacaaattcttctttgaatgtctgatataattcagctgtgagtctgtacctaaactttttttggtaacttttttattaccatttcaatctcattgcttgttgctggtctgtccagggtttctattttttcctggtttaatctaggagggttgcgtatttccaggaatttattcatctcctctaagttttctagtttatgtgcataaagatgttgatagtagccttgaatgatcttttgtatttctgtagtaagggttgtaatatctcccattttgtttctaattgaatttaccagatcttctctcttcttttgttggttaatctagctaatggtctatcaattttatttatcttttgaaagaaccagctttttgttgcatttatcttttgtgttttgttgttgttgtcctttcaatttcatttatttctgctctgatcttggttattttttttcttctgttgggtttgggtttggtttgctgtttctccagttccttgaggtatgcccttagattgtctgtctgtgctgtttcagacttcctgaggtatgcatttaatgatatgaactttcatcttagcaccacttttgctgtatcccagaggttttgacaggttgtgtcactattatcattcagttcaaagaattttttaatttccatcttgatgtcaggtattctatgtcaattttttgtatttatgtgaatccttttcccctaaggtgtgtgatcctttgggggtgttaaacaaccttgttttatcatattaccagaattgtttttctgattacttctcatttgggtagactatgtcagagggaagatctgggactcaagggctgctctgcagattcttttgtcccacgaggtgctcccttgatttggtgctctcctccttcccctaaggttggggcttcctgagagccaaactgcagtgattgttatttctcttttggatctagccaaccagcagagctactggggtctggttggtacagggcagtttctgcaaagagtcctgtgatgtgatctgtcttcaggtctctcagccgtggataccagcaccggcaaccgtagaggcagcaggggagtgaagtggcctctatgagggcccttggttgtatttttgttaaatgtactggttttgtgttggttggcctccagccaggaggtggcactttcaagagggcatcagctgcagtagtatagaaaggatacatgcttgccctagggttaggtggtgggcaggccgatagagctcccaggagattatgtcttttgtcttcagctaccagggcaggtagagaaaaaccatcaggtgggagcagggttaggcatgtctgagctcagatctccttgggtgaggcttgccgctgctgctgtggtagatgggggcatggttcccaggccaatggagttatgttcccagggggattatggctgcctctgctgtgtcacacaggtcaccaaggaagttggggaaggccggcagccaaaggcttcacccagctcccatgcaacctacagcctaaagggctggtttcactcccactgcgcccctacaacagctctgagtttatttccagcagggctgaggacttgccccaggctttaagccacccagctgagaaagccagccaactcacagttccttggctgtcccacagtgcctgcagcggcaatccacttccttcaaagggtctgtggatcctctccgctttcctggagcgttcctgtggtagttcttatagcaaaagttcacgatatgcatctccatacactgctctgtccatctgagtgggagctgccaagttagtcctgcctcctatacaccatttcctctcattctcctctgttttagtgtcttaagatggctacatattctttttgttcaatgagttaatatgtatgcgtgtgtgtgtgtgtgtatacatacatacatacatacatacatatatatatatatatatatatatatatatatatatattttattttttttttttttaggttacgaagtttcattgaatataagtttctctgggtcccctaagttgtagaagtggttattctccttttccttgatttccaacttgtaacttcaattttcatttcatctttgattctggagttttctgaaatgtaattatgaatttccaaaacatgaggtggtggtgatgttaccatgaattatttccagtttctataccttatgatcaaagaatgtggcctgtaagatagctacctttttgaattttttttttttttttttttttgagacggagtctcgctctgtcgccaggctggagtgcagtgacactatgtcggctcactgcaacctctgtctccagagttcaagcgattctcctgcctcagccccccgagtagctgggattacaggcgtgtgccaccacacccggctaatttttgtatttttagtagagacggggtttcaccatgttggccacgctggtctcgaactcctgacctcaggtgatccacctgtctcggcctcccaaagtgctgggattacaggcgtgagccacagcgcccggctgaatttgttaaagtttgcttagtggccaagaacaattttggtaaatgtaccactgacttacaaaaagtatgtacgttctccacttaagggatgtaaagtcatgtatctactaaatctagtttgttgtttcttcatttcctccatatatatgtagctttatataatgtccttctttaaaatgtttggtgcttttaaccttaaatcttaccttacctaatattcgtagtgatgtccacattttgtttacagttgtctgatctctctttatcctttaactttttaactattcaagaattttgtaaagtattttaaaatattttaacttaatgtatttatgagaaacagcttttagctttatttgttttaaaaattaatctgataatatatgcttcttaatggaagaaatcagcctgttcacctttgttatgacatctgatatacttggtattattccttctttacttaatgtcatggtttcttcttttacctttacttttgctagtttaatgaagttgctattcatttccatcttgtcaattgagaagtgtctaaaaaaaatttcgcagccatattatatatttccagcttgtttattattatatatttacatttaatcatacacatactgcaaggttcataggtttcctctcctcttcatctttaatgttccttcggatttcattcaaatacatttggtttttgattaacgttctttcctaatttttttcctgaagggaaattgggtaaaatatttctatggaccttagcacaaagatatttcttctgatagactggtttgtttggattccccggttgcaatacttcttttttttaatttttagataacttttagttgctttttgagacagagtctcgctctgtcacccaggctggagggtggcacagtctcagttcactgcaacctccaccaagagatcctcgtgcctcagccacgtgagtagctgggattacaggcacctgccaccgcacccggagcacgcccggctgatttttggatttttagtagagatggggttttgccatgttgcccaggctggtctcgaacacctgagctcaagtgatccacctgccttggcctcccaaagtgctgggattacaggctgcaatacttctttcttgttagtaggtatcattccagtgttttctagtctctagaactactgatgagatgttttacctttatgaatggtaaattctttaccattagaagcttttaataatattttcttcattgctagataaatttactaggtatacatacttttatgtcttttttatcaatcttgtctggacttcagtgagccctttgagtctatgaatccagatcttttgcaattctttttctttattactatttgttttgttctccctctggaactattattgtctgctagatcttttgaatctaccctcctaatctcttatcattttcattactggtcttttaattcttgttttatgagttgtgatatttaatttgataatttcattcattattcaatacttcagttctgggtaatactactataaaaactaaacaaaatgcagagacagctacttgaggactctgaaaagtaaacagccacagacaatcccatgacagaaatggctatggctacgcatagtggcctgcagaagccagaactctgaggaagggaaattgttttctctgttcatcagagtcccgatcccaagagggtagggacaatccctgttgtttattgcctctcttctcacttctgagcccagacttgggcctaaacttggaagcgtatggcagaacagggtaactgaaccctaaagtttctggctagatggccaaaacagggagtcccagagaactgggaagcatccaggagatcacagagaagaaggagctcaggaaagtgatcccataaagttgtttataaactccagaactcatccctgagtgaggcatgcatagatctaaccctgagtcgtatacaaaggattttgaaaattgagctaatcactcaggtcacagtctgaccattgaatggcatacacctggggaagatctgaagagactttgaaaactgagctaacattaaaactacagtccataagtaggtaggttcttgtagcctgaacctaatcttgctaattaaatgttaaaacaaaaatatcaacattcttcataggatcaaaacaagacccagagtattcaaaatgtccaggatgcaaatccaaaatttccctgcatataaagaaccgtgaaaatttcaacttgcatgggaaaagacaaacaaaacaagccaaagctgagatgacacaagtgttgagattatctgataaagacttcaaggcaaccattgtaaaatgcttgaacttgagcaacactggcatggtggcccgagcctgtaatcccagtgactcttgtgaagctgaggcagggggactgcttcagcctaggagttcaggaccagcctgggcaaaacagtgaggcctcatctctaaaaataaaaaaaaagcttgagtaagccattgtgcacacacttgaaacagatgttaaaacagaaagtctcagcaaagaaatagaagacataaataaaagccaaatggaaattttagttttcaatataaaattattttaacttaatgtattcactaacagattggagatggcagaggaaaaaatctgtgaacttgaagatagatccattaaaattatacaatctaacaatatagaggaaaaaagatcgaagggaaaaagaacaaagccttagggatcagaggaacaattataaaaggactaacatttttgtcattggaggtctagaaggagaagagaaagagtgtagtgttgaaaaaacattggaaaaaatggctggaaagttcccaagtttatggaaagatataagtctacaagttcaagaagcagaatgaaccctaactaggataaatccaaagagatctgcaaccagacacatcataattaaactgctgaaaactaaagacgaagtcttcaaagcaaccagagaaaaatgataaattacctataggaaaacaatgatttgaatggctgcagattccttttcagaaaccattagacctactctaaaaaaattgataaactatattcttcagagacaagaaaaagatataagaaggaaatttgaggcatcaggaataaagagacagcaacagaaataactatctggttaaatataatggctacttttttccttaaaatatgattgatggttggaaaaaattataatgtctgatagagtatataatgtatgtaaatataaaatataagacaacaatatatatatggtgcaggggaaagggtgataaggtttctatatgccaaatgaagcagtaaaacaatgaaatgatccgaagtagacaacgaaaagtaagtattttataattcctagagcagccactaaagaattatacaaaaagatatagtcaaaaccatagtatataaaatagaatactaaataatgttcaaacagtcaaatgaaagcaggaaaggggaaacataaatatggagcagctagcactctcacctattagtggtgggactggaaaatgcttttggaaaactgtcagtttcttaaaaagtaaaggatttatctagtagctccactgttatgcattaacttcagagaaataaaagcatatgttcatacaatgactcatacatgaattttcagagcagctgtaaatgtattagtcctgaactggaaacaactcagatgtccatcgacaagtgactagataaactgtggtatatctgcacagtgggatactccacagcaaaaaaaaggaattgatacatgcaataacatggagaaatttcaaaataatgtaattatgctgagtgaaagaagccagacaaaaaagattccatttatataaaatactagatatgcaaactaatctatagtgacctaaagcagattagtagtttctagagaaggaagagggtaaagcagagaaagaagggagacagggattataaatgaccgtcaaaaattttttagggttatggatgttctcttgattatggtaatggtttcaaaagtaaatatatgtcaaaattcatcaaattgtatattctcatttaatgtgcagggtattgcatgtcaattatacctcaataaagttgtaaaatgtttttttagagggtgtaaactgtgaacactgcatatcagtgttcatccttttgctcttacatgatgacaaggaagaacagtagacatctcctatgaataaaatggaactatataattgtttaagcaaaaacatcacttaatgatggaaatatttttaaaaaaattttaggctgtgtggtagctcgcacatataatcccggcactttaggaggcaaaggcaggaggatcacttcagcccaggagttcaagaccagaatgggaaacatagggagaccccatctctacgaaaaatttaaaaattagctaggtgtgtgggcacatgtctgtggtcccagctacttaggaggatgagatgggaggatcatttgagcctggaaagtcgaggctgcagtgagctgtaactgcaccactgcattccagcctgggtgacagagcaagaccctgcctcaaaaaaaaaatatttttttaatttttaaatactttatttgtcttaaacgtataagcaatcctcacttggcacagtctgatatgaatttcagttaccacagtttattaaccgtgagaaatagcataaaagtttgctactagcttttcagttcacaaatcattacataaataacatatgaatcaaaattgaccaatttgcaattttacttctttcaaagtctatgggtgattggtcactgtgcatctgttattcagttcacacacaggctgcaaagcatggaggtttgttattaatatttctgtgcccttgagataaacccacatggaattttacagattaaaagaggaaattggccaaaagaatgaaagtgcactaaagaagagtgataatactagaagtgaaacttgcattaaacataaatggagcaaatgaaaaaaaagctgcctgtgggaacatgctgattgtggcaacaatgacactgccgccatttgagacattctagatatgcagactgaggaaatcagtgaaggtgaacttatagacataaatgaggaaaagtgattgtgatgaaaggctgatgatgtgtcagaggaagtgacactggcaaaaaaaacacattaaaggaactctcagagatatttcacaacattgaaaacgtaatggataaaatgttggaaactaatatttaaatttctccagaacgcagaactcataagcaactgtgttctccaagtaaatatcttcacaggttcctcaattaatgtgggcaaaattaaaagtacaacttgcttcttccctttggaaaaccctctctcagagtatattaccaacattcaacttcttatacaaggcatagatctgggaatcattattcattcttctctttttgtcattcacgtatccactcaatttccatggcctgttgattctatttctcagacgttgttcaaatctctccactatctttattctacttggcaactctgtggcccaggcttccaacaactctctcccggacaagtgtaatcacaacagttacctaacttggctcccactcttgttctcagttgcaacccattctccaagcagaaaacaaaatgcaatagctgttaccttattctcatcttcacacctctactcaagtacacaaggctcttcctcatctagtttctgtctacttcatctcttgtcaatggtccctaccccaattctccgctctagtcattctgaactttgttcaattcctggcctgtgtcctctgcctttaataggctgcctggcacactgtaggaattcactaaatatgcagactgaatgaatgaacgagtccgtggagggcagttattctttggagtaacttaagagagaaggaatacagtacaacgaagtattcttatttaggtttatagtgtcttcacctgagcccgcgggggaaccccccccccacccccggggaaccccccccacccccgccgccccccgcctgcaagttgttaccagtaaataaaagggatcctattttagcaagccacacagcattagagggcaaataatagtttggtggcaggagagcgatgagacgggaaagtgtggggcaaagcttacagtcattggtccagattctaactggcctgttagccaaaaagtaaggttttctttacctccgtgttgactctgctctccgaaggcgaagagggtcctccaaacccgtttggcgtgcggacaaaaaccccagcatatcgtgtcctcacaccggctggagcactggacgtcgccatgacagagctcaggggcgggactggaacagc

SEQ ID NO: 374 - DNA, 207909 bp, Homo sapiens
gttactagaagggctccaggatggaggccgacctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaagggaagtgaaggagcacgtgggcacggaccaattcgggaacaaatactactacatcccgcagtacaagaactggagaggtgaggtggcggcgtgggcagcgattgcgtggtcagtgattgcgaggtcagtaaaggagggaaaagtgagagcccctagtcaactaacgcatcatgcgacacttagggtgtcaccggagagaatttcccgagttcgttctcccctgtcgaccccttcactctggcatcggagccctacccggcccggctctgggcgccttggcccggcctcgtgcgtccgcggtccctactacccagcgccttcccccggcgtgccccgggctgcttgcgctgttaaggcgcaccaccactttcctcccagccacgcctgtagaggagcctcagttttagccctggactggcgacggaggcagggaaaagtccacggaaatctttcaccaaaggggctagaagggccaggggaggggtttttcgtacgctgttccccgccttgtgacccagagctgagtggtgtaattgaagaggagtatcttcagcgcctcggctgtcttctttcttggtgtttacccttttcggtggcaccctggctccggcgctggccccatgcgccttccttactaccaagacttgtcagaagtaggtccatatccccacaaggctcgctgattcctttctcgggagttgacattccaagaccccgttgagctcaatttaagaaacgtggcaataatcatggtgttactgtgtaggattcgtgccaagtagttgagcgggttgtttggggagtaaggaggcgttgctgtccattgaaatcacactgtgtagccgccgtcgtaacctcttctgtgttgttccatcgccgcatgcagaaaatgtcaggttttgggcgaagaggcgtgggttagaatctcagctttgacacctgatagctcgggaatcacggaaaaagtacttgtcctctccaagtctcaacatcctcacttgaaagttagagataatataagatcagcaatgttgagaagcactaagacctttccaagattatgtgccattcatttcccacacatataaaatgtattctgtgatttatcactcaattaatttatttttgcctggcctttttctgtaacttattttaatatttagacttgtttccctaatgagctcctctgtcaggcagggaatatgtctcacaaaaaaagaaaaaagcctgcaaagaacatagcatggtgttaagtatttcttgacaggttgcaagcagagagatgtttcttttccataagttgtcagtaaaattaaaaatatgcaaactgtcagactgagtttttttaaattgaaatataatttacatacagtaacattcaccctttatggtgtacagttttattgtttttgacaaatgagtagagtaacctcactggattcaagtaatagaataattccatcaccatcagaatttcctccaactccttagtagttcattcccacaccctttggcaactactgatgtgttttatgggcctatagttttgtcttttctagaatatcatataaatggaattatacaggatttagacttttgagtctggcttgcttcacatagcataatgtagctgagattcatccatgtgtcagtagttgttcctttttattgctcagtagtattccattgtatgggtttgccagtttatctgttcacaagctgaaggacattaggatgtttccagtttctgtgattgtgacaaaagctctacaaacattcccatacaggatttgtgtgaacgtaagttttcatatctcttgggtaaatatctagtagtgggattactaagttgtgtgatcaatgtgtgtttaactttatgagaaactaccaaactgtttttcaaagtggctgtaccattttgtattcctgccagcaatgcattaaaattctagttgtttccacaccctcaccagcacttagtattatctgatttttgggtgtgtttttatttttattttagccattttgataggtatatagtggtatctcattgtgattttaagtttcattttcctaatgcctgaggatgttgacagtcttttcatgtgcttatttactatctacagatcttcggtgaagtattgttcaaaccttttgcccattaaaaaatccatttatggctgggtccggtggctcatgcctgtaatcccaccactttgggaggccgaggtgggtggatcacctgagatcaggagttccagaccagcctggccaacatggtgaaaccccatctctactaaaaatacaaaaattagctgggcatggtggcacgcgcctgtaatcccagctagtcgggaggctaaggcaggaaaatcacttgaacctgggaggcggatgttgcagtgagccgagatcacaccactgcactccagcctgggtgacagagtgagactccacctcaaaaaaaaaaaaaaaaaacaagcccaaaaaacaacaaacaaatatatttataccagtttttgtatcattcatttatatagagatacaataccattaaagtttcaaattaacagtcatgtctattctacaataacatgaatattttatttttacatattctcactaatttgtatattttcttacataattgtaattgcattttgagagttttattgaagtataattgacaaaaaaaattgcccatgcttaaaatgtataatttggtaagttttgacatatgtatatatctgtgaaaccatcaacacagtcaagaaaattaacatattcaatatccacaacaatttgttgtgctcctttctagtcttgccttatgcttctgcttccatggataggcactcatctgatttctgacactatacattagtttgtattttttataatttttatttagttatttttatttgtttattttgagatggagtctcgccctgtcgcccaggctggagtgcagtggcgctatctcggcttactgcaacctctgcctcccaggttcaagtgattctcctgcgtcagcctcccaagtaactgagatgtgtgccaccctgcccagttaactttttgtatctttagtagagacggggtttcaccatgttggttaggctggtcttgaactcctggctttgtgatctgcctgcctcggcctcccaaagtgctgggattacagatgtgagacagtgcgcctggctagaattttatttaagtggaagcatacagcacatattctgcttttttttttttttgttttttaggttcttcactcagcataattattttgagattcatccatgtttttgtgtttatcagtagtttatttctttttaatgctgagtaatattccattgtatgtatataccataatttgtttatccattcacctgttcatagatatttgggttgtttctagttaggggttattacaaataaattatgaacattcatgtgtaagtctttgtatggacttatgtttttatttctcttgatgtaatatttagaaatggaatggctgagtcaacttgttaggtgtatgtttaacttcttaagaaactgcctaagtggtggtaccgttttaccttcccaccaggagtgtatgagatttccagttgtcctatatccttatcaacacttggtatggtcagtctttttaattttagctcttctagtaggtgtgttgtggtatctcattttttttctttagttttctgtttgctattagttggtttttttagattctatttttaaaatacagtaaaattaacttttaaaattggtgtatagttctataaatttgaacacatgtgattcatgtaaccaacaccaaaatcaggatacagaacagttccgtcaccctgaataactccctcatgctacctttttgtagttacaatctctcctcatccctaacctcagcaaccactgatttgttctctgccattatacttttttccatttgagactgtcccacatgtatacttataccatatgtaaccttttgaacctggcttcttctattcagcataatgcctttgagattcattacgtatatcagtagtttgctcctttttactgctgattagtattccatgttaatggatgtaccagtttgttcatttactcattaaagggcatttgagtttagttacttgcagtttttggtgattatgaatacagctgcaagaaacattcacatatgggtttcgtgtgaacataagttttcattttccatgagtacatacctaagagtgtgagtgcttggccatagcagctccagcttactctgtaaaacggaaataacagtacctacttagcctcacaaagtatttttgctactcaagagagacaaattggataacgtagcatttaagagaatgggatttaatgtcgaaatcagtttgacttaattcacagagaccttttacttggtcatttttaaaaatttatcactgatttgtagttttcagcatagagatcatgatatgttttgttaaatttattataaagtatattatattgtattgttattataaatgatgctttaaaaaacgtaatttctaattctttgttactattatattgaagtacaatagatttttccatgttgagcatgtatcttgcaacctgttttactcacctactagttcttgaatgaagccttttgcagatcctttggacattctctgtaggtaattatatcaactgtggatagagacagttttgtttttatcctttctaacttatttgcattctatttccttctcttgcctggctgcactagatgagcctccagtataatgttgaataagagtggtgagcataggtatctttttcttgttccatatcttagaagaaaaacatttaatctttcattttttttttccccaaaggtggaatttcgctctcgttgcccaggctggagtgcaatagcgtgatcttggctcattgcaacctccacctcctggtttcaagcgatttttctgcctcagcctcctgagtatctgggattacaggcatgtgccactatgcctggctaattttttatttttaggagagatggggttcgccatgttggacaggctggtctcgaactcctgacctcagatgatctgcccaccttggcctcctaaagtgctgggattacaggcatgagccaccacgcctggccactactctttcattgttaagtgtggtgttagctataattttttagataccttttattaaattaacaaagttccctgtctgtacctcgtttgctgagcgctttctcttatgaatcgatgttgaattttgtcaattttgtcacatgcttgcttgctgggttttttttttttttttggttctgttggaatgatcatgtggtgaatttatactgattgacttttaaaaattaatagactttattttttagagcaattttaggtttacagaaaaattgaatggaaactactcagatattcctgctcccccaatgcagtttctcccattgttaatatcttgcattaatgtgtcctcacttcctcccttcctgctaccaaacccctagcaaccactgatctttttactgtctctgtagttttgccttttccagaatgtcatgtagttgctgtcatatagtatgtgatcttttcagactggcttctttcacttagtaatatgcacttaagtttcctccatgtttttttgtggcataatagctcctttctttttatttatttatttatttttgagacagagtctcactctgtcgcccaggctggagtgcagtagtgcgatattggctcggtgcaacctctgcctctcaggttcaagtgattctcctgcctcagcctctcgagtagctgggattacaggtgcccaccaccatgcccagctaatttttgtaattttagtaagagacagggtttcgccatattggccaggatggttttgaactccttacctcagatgatctgcctgcctcagcgtcccaaagtgctgggattacaggagtaaaccagatgcctggccatctactttctttttattgctaaataatattctgttgtatggttagaaccactgtttattcgtttgcatattgaaggacatcttggttgcttccaagttttggcgattatgaataaagctgctataaatattcctgtgcagttttttgagtggacataagcttttaactcatttggcattgattgattgttgaatgtcttgaatattgcatttgtcaggtaaactccacttggtcatgatgcattatcctttttatatattattggattgatgtgctttcattttattgaagaattttgttttctgttcttcaggatcttaatttcttccttttaatgtgttttctaggtttgtttttaggttaatgctggccttataaagtgagttaaattttgtttccttcttttgaattttctggaagcgtttgtgaagaatttgtattacttatttcttacatgttggatataaattgcctgtgaagccatctggtcctggagttttccttgttggaaggctggaattaaaaattcaaagataataaatttttaacctacaaatttaatatctttggcaggtataagactactcaggctatctattttgtcttaggtgagttttggtagtttttatcttttgagtagtttgccctttttatctagtatgttgaatttacagtcataaagttgtaatacctcttcattatctttttaatgtttgtacaatttgtagtgatatcctctctttcctgaattgataatttgtggctattgttttcttggcctatctgatgagtggtttgttaattttattgatcattttagagaattagctttgagtttcactgatttttctctgtaagttttttccattggtttcagaacttatcgctttctcttatatcgtcatcgttttcttctgctttcaattggttttatatgttcttctagtttcttaaggtggccactgagatcataatttgatctgtttattttttaatatacatttttaatgttaaaatttcttgtaggcactgttttggccacatttcacaaatttttatcttaaaattttcatgtaacgaatatattttcttatttattttttcctatatgacctatgtatttatttagaagtatgttctttacaaatatttggagattttctagatggagattttcattgacttctagtttaattctattatattcagagaacatattttatatgatttcagttattttaaatgtattgtaaattgttttatggcctagagtatggtgcaatttggtaaatcttctgtttgtgcttgagaaaaatgtattatctattttgctatttggggttgaatgttctgtaaatgtcagttagcccaagctggttgatagagttgttcaagctttgtatattcacactgattttttttgtacttattctatcaattattgaaaaaagtatgttacagtctctgaatacaagtttacatttgtcttttactctttccagttctatcagtttttgcttcatgtattttcaatacctattgttaggtccttacacatttataattgaaagataataatacaaattacccaaaataaaacacagagagaaaaaagaccagaaaaaaaagagcaattagcaagctgtgggatacccccaagtggcctaatatatgtaattggataccatgaggggtaaaggtcattttgcaggtcaaaaatatttgaagaaataatggccaaaaatattccaaatttgatgaaaactataaacccacagaccccaaatcatcaacaaattccaaaaacaaaaagtgtagaaaaccacaccaaggcatattattatcaaattgctcaaagccattgataaagagaaaatctttatagagctagagaaaaagatacattacttacagaggaagaaagacgaaaatgagttcagggttttttttaaaacaaacaatataagctggaagacagtggaacaatatctttaaagtaccaaaagagaaagtctgccaacctataattttgtacacaacaaaaataccttgttaaaacaaaggcaaatgaaggttttttcagacatactgtacctgaaagaattcattacacagagaccataattccctttcctcttccctctactggatatcttattccctggattctgggcctttcaccacagttttgtagcatatatgcttcagtagcctcctgagaagaggttcaaggcggataaagtttttgagtctttgaatgtctgaaaagatttttattctgtcctcatttggttgatgtatttgttgggtgtagtttctactgcagtcatagtgagtaaatgtctagagaaaagcaagcagtaaattctatacgagcttaaaaggagtagcctatgaattgaggaagagtatatgcataatgtaggctttggtaaatgtttttaatgtaacctaatgctatggtttactgtatttatgaatatatattttaaaatgcatgattacattgaataacagtgttttggctttaatagtaaagctttttttcaaatttagtcggtataaaattatttgagatagtcacacatactttgtatgtgccctattgacaacaaccaaaggaatttctcctttccatgcaaatgaggaacacatagacacagatgtaaatgttctaaatcattatttctagtgatataagttaggattgttttactggaagattgtggtgctttttgagtgttggctgtgtattttagacaaagtagctggtaactaggactagttccagctttacaggtcaccatgatacccatatccatgtctctggtcccaagtcattagctgtaagatagccaaagacctatgatgtggctaggtgtgagaattctgccccatataggcattctgtataggttggtaacagaccaaacatggtcaaatttttttctgttgaaatttgaactcatagatatatagagagaggaaaatatgagaataattagggatcagtagatgtccatttctaagaagttagggtggcaagcatgttgaaaggttcctattagagcacaataggtattgttgtgtcctaaatcacattccagttgtctctattttgcaaatgttgagtttttcgtctttcttcctgtatctttacagtattccctggttacctgagataacttgagcgtaactgttctttgaaatctgagactagctaacatatatactatgtactagattttagaaaattttaggtatctgaaaatacaactttttcctttcatgtgttaattttgtctcttagaaattcttcctgttaaatatcaaggaactcatgacctcaagtgatctgcccgcctcagcctcccaaagtgctaggattacaggcatgagccaccgtgctctgctgtccttttttttttttttaaatagtagccatcctaacaagtataaggtgatagcttattgtggttttaacttgatttccttgttggctagtgatattgagaaccttttcatatacttgttggctattttgtatgttttctttggagaaatgcctgttagttcctttgcccattttaaaatcaatttatttggttttttgctattaagtcatagaagtcactgatacattttggtttttaatcatttatgagatatggtttgcaaatatttgtcctattccataggttgcctttgtatcctttgctttgcagaagtattttggtttgacgtaatcagacttatctatttttgcttttgttgttttgtgcttttggtgtcatatccaagaaatcattgccaaagccaatgtcaagaagctttttccctgttttcttctaagagttttgtagtttaaggacttacattgaaatctttaattcatattgagttgatttttatatacagtgtgagataagcgtccaatttcattcctctgcatgtggatatctagttttcccaataccatttatttgaagagattatcttttcttcactgtgtgttcttggcataattgtcaaaactcacttgtcctcatgtgtgggtttattactaggttctgtcttctgttccaatagtttatatgtctggttttatactggtaccatactgttttgattactgtagcttttaaacgtattttgaaatcagacagtgtgatgcgtccagatttgttcttcctgcttaaaattgttttggctactcagtgtcttcttgtaattccatatgaattttaggattgttgtttctatttctggaaaaaaaaagtcattggagttttgttagagattgtgttgaatctgtagattgctttgggtagtatgagcactttaacaatattaattcttccagtccatgaacatatcagatgtcattgcatttattcctgtctgcttgaaagcatttctttcatccatgttttatagttttcagtgaataagtctttcacttccttagtttgttgctaaatattttactttattgatgttattgtaagtaggttgttttcttaatttccttttcagataatttgttgatagtacctagacatgcaatagatttttgtatgttgactttgtttttttttttttgagatagagtctcgctctgtcactcaggctggagggcactggcgcgatctcagctcactgcaacctctgcccctggggcctaagtgatcctcctaagtactgggactacagatatgtgccaccatgcccagctaatttttgtattttttgtagagatgagatttcaccatgttgcccaggctggttttaaactcctgggctcaagtgatccacctgcctcggcctcccaaagtgttgggattataggcatgagccaccatgcctggcctctatgttgactttgtatcctgcaactttgctgaattcattcattagtctgaacagctttttttgtgtgtggaatctttggggatttctatatgtaaggtcatcatctgtggcttcttccgctctaatttggatgccatttatttgtttttcttgcctagttgctcttgctagaacttctgtttttgaataggagtggtgagagtaggcatccttgtctcattcctaaccttagaggaaaagctgtctgtttttcactcttgaatataatattaactgtggatttgtcatatatggccttcattatgttgaggtgcatcccttctatacctgacactaagaatttttatcttaaaaaggactgaattttgttaaatgcgtttcctgcatctattgagatggtcatacagtttttgtccttcattttgttgatttggtatatcacattgatttgtatatgttatctcaattttttgaagtgttacttatacgtttataaaagttgtgagccaagaaaaatttgtgctgaggtttttatgaaaacatttactgccaaactatattttctatactttctgtatttctgtgtgagtatatttagacacacgtatatttggattatcagtgtgccaaacattatttataatatcatctcctgaattttatattttattttttttagttaaaaagaaaatactgccttttgaatatgaagttctcaaacacttttgagaaaccagatcaaaagaggtattaaccaaactttgagaaaccggatcaaaagaggtattaaccaattttaaagttgataatttaaaattgaggtttgctaatcagaaatagaattttgcttataactgaagggtgttttataccttttgtgcttcctttttaagaatattagttggattttaccttttgttctaacttgagaatcactgttttatttatttttaattattgaattaaaatatagtagagagaatgagaaagcaaacctccacatacctgaagcttactttttacagttatacttgtggttaaatataattttcttcctaacccccagttatctttcctattttattttgaagcaggtaacaaacatcttgtcaatttacctataaacatttcagtatgtatcttttaaacacaagcactcctgtttttaaatgtaacaataacaccatcatcatatatagaaataaatcccttaatatcatcagatatccagccattcacattttcttggttatcgtataatgttataatgttcttgtttattggctgatctgtttactttttttttttttaacagtttatgtctctatagattctccctttatctttttaaaagctgttcttctgattcctgattaccctccttagatgtcttttgcagcatagccctcaatttacttgaaattagctgtctgcacccagacagaccccagtgaatattacaggccagtagctcctcattgtgctctggtagaattactttggtagaactgtattcaatacagagttccttcactttcagcccctgctagtgggaatctgaagactgtcagtatcaggtgaaagttgtagttgcctgtgagaaatagggaaggggctcattgggacactgaccatgtgttattgtttgggtttgttcttttggtgttttctttttgctgttttttgaaaaacctgtattttgtgtataacctgtattagtgataaccaggactccctgtagtagcactagtggcatttttgaattttttggacttgactgttaacatttgccacttgctcttagccttgctcctccaattttggggttttctcagaacctatttttggaaaactatattgattctttctaagcaagtctgttcacttgtgctaattcacaggccagtcagcactgctaagtttgcttttcatctcatcctgtgtcatttgttaattttctcatgtgacagatagttattgactactgctctaagcaaaacatctgttttatgtatttcagaacttttggccttagtgtctgaccttttaatggtacctttgttttctagcatagctgtatctcctctcatatattctttaataaattcaattgggttttgggagataaaggaagtaaacatgaatcataggctattttaatctgaagttttcatatttaatttgtaacaaattgaaaacacatttttttcattcattttgttctcagctacttataatcttccaatctttttagtgatacttaaagtaatgataactattatttattaggtgctaactctgattacttaacatttttataacaaccatgtaaccagggattattatcctcattttaaatatgaagtgattgttatgtttctgaatacttaaatgtactttatatgcatgtgcctggatataaagtagatgctgaaaaagcagctattcagtgaattcagatgtttacggacccagaggcataaagacaaaaacaaaacaaaatataagaaaaccacagaaaatggtttttctgttaactagttttacaaaatcttgagacagatgcttaagatatacttttctttttattatggtaaattggccaaattattcttcagggactaaaatattctcattagaaataggagtatcttttcataatgtcacgacgcctctagtgtggttcaggtttggatttggtttagtcagtgtcctaaatatagtttcattgccagcctcaaacttgttaagatacccagtcataaggatgaatatatcaaaacctatgttatccactattatatgtaattgtaatcctgcattgttttaaattatctcacctcatcatatttgtatttaggatttaaaatatactaaaaattataatgaattagtatgcagttaagtagttattaaggatcaaaacaaatgaaatggtcagaattataagtcaagtctcttgtttttagtagctattggaagatcatgatatatagctcttttcaatgtgatattttctctttaacatttgggaaattatgaagacatttcagatttttccagtagatggcagaattgttttaaacattttagattcactgttaaattttttttgaattgatttgaaggagtaatcatttctctaaaataactggatgtattttttcttccaaataagccctgcactactgttttataaactaacttttaagataaagatttttaaatgataatatggatcattcctaatcagtaatgcacaatgatagaagtggcaattatattttgaagaatggataaaaaaattttaaatcaaacatttagttttttcaatagtaagtaacattctttctttagttatcagagatccagaggtcacatgatgtaatcatcaccatgggcatcatcagattgatagaatatcctaaaatattttgattttagctaaaacatgccttcggtttagtgatatctataaaaagttgaacttactttaaaatactttgttgactataaaatagtaatttaaaagtttttatacaggttgtctcagagttgtttgaaggttggatttttaattttctgatcttcattttgaaatttcatgtcttatgttttcttctgagactatttcaaatacttactgaattcccttagttcgtgtgtatatgtgttcatgtacttaaatatttaattgtattttgttgaggggaaacaaaaacccttctcccttacttatacaaatagtaccacatctgtgtcacactttcaaacagaaaaacaggaggatgaaatgtgttcacagtcgtacctgtcagttctttatgctttatgcttatgaagttaaggaaccttaatcttgaattctagttttccctgccatagaaatatgaaacattttaacagaaatggaactaataatggatgagtgactaagctgggttatgtttctaagtgaggttgaaaatatttcatgtaagagaaaaagagttatttgtctccttttgttttgagggttttgtaattgctttatattaagaatagtagtgtcaataataacaataatgagaattagtatttcttaaatactgtgtataggcactatgcctagcatttgttgtgactcgctgtatttgttgaagaatataataaatgagggaaaataatatgtctagtgttgatttgtcaatatcacgtagctatgaaactcaatttgcattctttttgtgtaaaacccagtttctctgcatcagtgtaaatcacatgaaactattacttttcatactccctcacttttcaaagtactactcagttcagcagttcctttctgctgctgtttgaagactttgtaagtgtgacttactctgcaagagttgtaaaagtgagttgacaaggttgcttttgagatttttcaattgaattgggtttggtagagatagtatcttcagaactatatgtcagacttcactgtttgattgtttgaataaatttccattcttataaaatgaattggaaatgtacctgattttttttaaaattaggtttgttatttttacacttaaaaggctgtttttttgcttttatctttatttccgtttaggtgactggtgcctccatcttgtggtccaactcacaaattgcatcctttgctagagattgtgtttacactttttttcccctcagctgaataaatgacagaaaattattttctgttttatttattaaaaatataactccgattaagcatacattaccttcaaagaggacagaaagtgctcaaaagggaccacctaaagcaacctgttcaaggatgaagtcttgtaaaataaattattattgttgatggtagtggtgatggatgatggtggtggtagtggtggtggtggtggtgaatgagagagaggatgaagttcgatttgctctttatgttgaaaaatgaaacttaaagtcttcagcaaaatttactgtataacttggtcaggcatggtggttcacgcctgtaatcctagcactttgggaggccaaggcgggtgcatcacctgaggtcaggagttcaagatcagccaggccaacatggtgaaaccctatctctattaaaaatacaaaaattaggccgggcacggtggctcacgcctgtaatcccagcactttgggaggccaaggcgggtgggtcacgaggtcaggagatcgagaccatcctggctaacacagtgaaaccctgtctctactaaaaatacaaaaaattagccgggcatggtggcgggtgcctgtagtcccagctactccggaggctgaggcaggagaatggcgtgaacacgggaggcggaacttgcagtgagccgagattgtgccactgcactccagcctgggcgacagagcaagactctgtctcaaaaaaaaaaaaaaaaaaaaaattagccagacatggtggcaaatgcctgtaattccagctactcaggaggctgagacaggagaatcgcttgaacccaggaggcagaggttgcagtgagccgagattgtgccaccacactctagcctgggcaacagaaggagactctgtctcaaaaaaaaaaaaaaaaaaatttactatgtaattgcaaccttagctaattattagaattaagaatgaatcagtatctgtggtcctacttaggaagctttggtagcaggatcgcttgagctcaggagtttgaggttacagttaactatgattgcatcactgcactccagcctgagtgacacagcaagactctttctctaaaaaaaaaaaaatcttaaaaaagaatgaattaagtactattttttcctccagctttattgaagttcaatttataaatacaaattgtatatatttatattgttgagtatgcttgaacaccataaatatatgtatacattgatatatacttcgtgattaccacaatcaagcttaggcaacatatctttcacctcacatagttatcttggttttttttttttgtagtgaacaagtactgatttttttaacataggttttctgacaaaactatgatagcacaatatgacattcttcttttcacatttgtctccatggaattaacaaaagtgactttttttgcaaaagttgaaagcatcatcaagttttctaaagatttttattactcagtgattaatactgtattcactgtcctttaaacacctttcatgttccaattcttattggtctaactaccttggccacgttttcaattagaaagtaataattttctcatgaagctatattattttcatagacttcatgaaactttatctttttgagatttgcaattttactttgcattcaccttgtgctacattcataaacattagaaaattgcgtggtggctcacgcctgtaatcccaacactttgggaggccgaggtgggcagatcacgaggtcaggagatcgagaccatcctggctaacacggtgaaaccccatctctactaaaaaatacaaaaaattagccaggcctggtggcacgcgcctgtagtcccagctactttggagtctgaggcaggagaattgcttgaacccgggaggcggaggttgcagtgagccaagatcacaccgctgcactccagccaagtgacagagtgagactgcatcttaaaaaaaaaaaaatggagagactgacttataaacaaagagattgtcatttatttatttatttatttatttttgagacagagtcctgctctatagcccaggctggagtgcagtggcgcgatctcggctcactgcaacctgcgccttccaggttcaagtcattctcctgcctcagcttcccgagtagttggaactacaggcacgtgccaccatgcctggctaatttttgtatttttagtagaggcagggtttcaccatgttggtgaagctgggctcaaactcctgacctcgtgatccacctgccctggcctcccaaagtgctgagattacaggtgtgagccactgcacccagccaagattgccttttaaagatgaggtagagattctaatattgagtagatatctaaatgtcccctgatataagttacatagtgaagatttttatttaccttgaaactattgttttcctacacgtactaggaacttcagttactctgttaatgagtacacagtcagtgaggaattcttggatgtaaataagtctgcaacttgccttcccctcactggcaagatttttgaaaagggagtcaacctactgacttcatctctcatctagaattcatctttccataagtgttgtacattgtactgcatttcccatttggattataggcgattgcttgtatagctaggtccctgactctgtgttcttctggacattttctagattgtagcaggtattcagcaaaacttgttcatccatctgactgatatttattgtataccttgtaggccaggcacagttctaggcatttgagatactatattaataagcagaatactgaaaaatccgtggctttactgagcttacattgaagctgaaggaatcagatggttttaaaaactgtcatagttgttacagtgtggtaagtgtcaagagaaaagaaaaactaggttagagttgagatcagaagtgttggctgtagagagtgggttgaaatcttaaatgtgatggttagggtagattcattgagaaggtgatatttgaacaaagacttgaagggagtgaggaagttagctaagtgaatatctggagtaagagcacaccaatcagagggaatagcagtatacattttgctttcactgtgaataaaatggagaattattccagggtttttagcaaaggagttacataatctaatttatgattttaaaaggattgctgaatttttttttaattgagaatagactgtagcaggcagagattgaagcagggagatcatttaagaggcttttttgatgttgtttttgttttaactcttcaacaattttagacttacagaaaagttgcaagaataatacaaagaattctcacatactttccccaaatcaaccaaatgttactgttataccacatttggttcatctttccaatttttaagatttattttttaaattaacaaataagatgtatatatttatgatgtatagcataatgttttgatatatgtatatattgtggaatggctaactcaagctaattaacatatgtattacctcataatttttttttgtggtgagaacacttaaaatctctcttagcacttacaaagtgtacaacactttttttttttttttggagaccgagtctcactctgttgccccggctggaatacagtggtgctatcttggctcaccgcaacctctgcgtcccaggttcaagcgattctcctgcttcagcctcctaagtacctgggattgcaggcgtgcaccaccatgcctggctaacttttatattctttggtagagacagggtttcaccatgttggtcaggctggtcttgaactcctgacctcaagtgatctgcctgccttggcctaccaaagcgctgggattacaggtgtgaactaccgcgcccggccacataacgttgattaccattaccatgttgtacaatggaactcttgaacttactccgtcctgtcaaagaatgttcatatcctttgaccaacatttccccaatacctaccacccaccagactctggtaactcctcctgttcctgcccttttttgacccaggtgccttaccattttcagatgaccttcatcaactaaatcctttgtcacgtattttctgtccgttcctcatgttatggttgttgctatgtctgagaatagtttaatgcagtactaggaagaggttcccaaacctggccaattgtcagaatttccccaaacacactaacataattagaatctccccaggtttttccgatttttcaactaggtctaggaaccactaacatgacagatacagaagacagaaaaattgtactgacctgagcccatacctaaagtaaatgatttcaaatctgacttgacatagctgagaacataattttcctccgactttattaaggtataattgacaaaaattgtatatatttacagtgtacaatgtgatgttttcatatatgtatacattgtgaaatgattaaatcaagctgatgaacatatctacacctcacaggcttatttttttgtggtgagaacacttaagatctaccttagcaattttcaagtatataatacattactattaaatatagtcaccatgctgtacaatagatctctttaacttattcatcctgtttaagtcaaactttgtactctttgaccagcgtctccccatttccccaccccagcccctggcaaccaccattctaccctttgtttctatgagttcagctttataaagattccacatataagtgaaatcatgtggtatatttgtctttttgtgcctgtcttatttcacttagcgtagtatcttccaggttcattcatgttgtcataaatggcagatttccctctttttaaatgtttaatagagttccattgtgtatatataccacattttccttatctgttcatctgtcaatagacacttaagttaattccctatcttgattattctaaataatattacagtgaacatgggagtgcagatatctctttggcatactgatttcatttcctgtggatatatacccagtagtgggattgctagatcatatggtagttctatttttagttttttgagaaatctccatactgtttttccataatggctatactaatttacattcccaccaagagtgtgcaaggttttccttttctctacattgtcgacaacacttgttaccttttgtctttttgatactagccattcgaataggtgcgaaggtatgtcttgttgtggttttaatttgcgttttcctgatgatgattgatgttgaatattttcttcacatgcctgatggccatttatatgtcttcttttgagaaatgtcttcttagatcttttgcccaattatgaatcagttattagttttttttcctgttgaattgtttaagttccttgtatattttggatattaaccctttatcaggtgtacagtttgcagatactttctttcattccaaaggttgtgtctttactctgttgattattttgttgtgcagaagctttttaattagaggtaatcccacttgtttatttttgcttttcttgcctgtgtgtttggtgtcatatccaagaaattattgccaaggccaaaaagcattcccctctgttttcttctagttttacagtacaagtcctgtgttttaagtctttaatctatttcaagttgatttttgaatatagtgtgagatgagggtctaatttcattcttttgcatgtggatatccagttttccaaacattatttattgaagagactttcctcttcccatctgtgttcttggcatctttgtaaaaaatctattgatggtaaatgcatggctttatttctggacatcctattctgtcccagtggtctttgcgctaataccatgttgtttagctactttagccttatagtagattttgaaatcaagtagtgtggtgcctcagccttgttccttctgctcaagattgctttggctatttagagtctttggtggcttcactgaaattttaggattgtttttcactatttctgtaaaaagtgttattggaattttgatagggattgcagtgaatctgtagattgcatagggtagtatgaatatttagccaatattaattcttccaatgcatgaaacagagtatgtttccattcagttgtgtacactgcagtttcttttgtcagtgttttataatcttcagtgtatggatttttcacctccttggcgaaatttattcctaaatattgtattaatattattttgtagctatagtaaatggaattgatttttttattcttttattggatagtttatcagtgtatagaaacactgattttttgtgtcttgatttttgtaccctgcaacttcactaaatgtattagtaacagttttttagtggcatttttagaattttttaagaatataacatcttgttgtctgttaacagatacagtgtaacatcttcctttctgattcagatgtcttttatttatttttcttgcttaattgctcttgctagtatttctggtactatgttgaatacaagtggtgagaggtgagcatccttgtcttgattcggatcttagaggaagagctttcaactttttactgttgagtatgttaactatatgtttatcatatatggcctttattgcattgagatatattccttttatacctaatttgttggaagttttttttttatcatgaaagagtgttgaattttgttgaattccttttctacatctattgagatgatcatatggtttttgtccttcattctgttattatagtttatcacatttattggtgtacattggcaaaccattcttgctttccagggataaatctcacttgatcatggtgaatgatctttttaatgtacccttgaattaggtttgccaatattttgttgagagattttatatctatgcttatcaggaatattggcatataattttcttttcttgtaatgtccctttctggccttggtatctagtaatgctggcattatgaaatgagcttggatgtttcccttctcttcagttgttttggaagagtttgagaaggattggtattaggtcttctttaaatgtttggtagaattcagcagtaaagccatcaggttatgggcttttctttaatgagagactttattactgatccagtctccttacttgttactggtctgttcagattttatatttcttcatgattaagttctgttaattgtatgtttctagaaatttatatatttattctaggttatacaatttgttgggaaataagtgttcatagtagtcttttatgatcctttgtgtttctttctgtagtatccgttgttgcttcccctttcatttctgatattatttgtatattctctcttttttcttagtctatctaaaggtttgaccatttttaaaaaatcttttagaaaaccaatttcttagtttcactgatcatatctattgggtttctagtctccatttcctttttatctgctctgatattttttatttcttttcttctattaactttgagctaagtttagtttgttcttttctacttcctgaggcatagtgttagattgtatatttgagatttttttaatgtaagtgttcattgccttaaattttcgtcatagaactacttttgttacacgctataagttttggtatgttatgtttccatttttgttttttgaaaaatttttttatttaaaaatatttttagtttttaatttttgtgggtacatagtaaatgtatatatgtataggttacatgagatattttgatatagctgtgcaataaataataatcaaatcaggggtattcatcacctcaagcattcatctgtactgtgaacaattcaattacactcttctagttattttaaaatgtaaaattaatttatttttgacaattgtcaccctgttgtgctatcaaataccaagtcttattcattctttctattttttttgtaccacttaaccatctccacttccccaccacccctctactaccctccctagcctctggtaaccatccttttctgctctctatcttcatgaattcagttgttttaatttttagcttccacaaataagtgagaacatgtgaaatttgtctttctgtgctgggcttattccactttgcataatgacctctgggcccattcatattgttgcaaatgacaggattgcattcttttttgtggctgaatggtactccactgtgtatgtgtaccacattttctttattcatttgtctgttaacggacatttaggttgcttccaaatcttcattattgtgaatagtactacagtaaacatgggagtggagatatctctttgatatactgttttcctgtcttttgggtatgtacctggtaggggattgccagatggtatgttagctcaatttttagctttctgaggaaactccaaactgttatccacagtgattgtactaatttacatttctaccaagagtatacaagggttcttttttctccacatcgttgccaacatttgttactgcctgccttttgtatataagccattttaaccagagtgagatgatatctcattatagttttgatttgcatttctctgatgatgaacgatgttgtgcaccttttcatatacctgtttgcaatttgtatgtcttcttttgaaaatgtgtattcagatgttttgcccatttttatattggattatcaggtttttttttaccatagagttgaaaacaatatagagctccttctatattctggttattaatcccttgtcagatgggtagtgtgcaaatatttttcacccattctgtggattgtctcttcattttgttgattgttttctttgctgtggagaagctttttaacttaatgtgatcccatttatccatttttgctttggttgcctgcacctgtagggtattactcaagaaatctttccaagaccaatgtcctggaaagtttccctactgttttctttcagtagtttcatagcttgaggttgtagatttaagtctttagtccattttgatttgatttttgtatatattgagagataggggtctaatttcatttttctgcatatggatatccagtttttccagcaccatttattgaagagaatgtcatttccccactgtgtgttcttggcacttttgttgaaaatgagttcactgtaggtgtatggatttatttatgggttctctattctgttccactgacctatgtatctgttgttatgccagtaccatgccattttggttattatatctctgtagtataatttgaaatcaagtaacatgattcctccagttttgttcatcttgcttagaatagctttggctattcagggtattttatggttctatatacattttaggattgtttttctgatttctgtgaagaatgtcattggtattttgatagggattgcattaaatctgtagattgctttggatagtatggacagtttaacagaattgattcttcccatctatgaacatggaatatcattctatttttttgcatgtgtgtcctcttcaatttgtttcatcagtgttttatagttttcattgtagacatctttcacttttttggttaaggtaatttttaggtattttagttgtacttattaatgggatttcttgatttctcttgaagattgtttgctactgatttttgtatgttgattctgtatctcacaacttaatttatttatcaatttcaatagttttttagtggagtatttaggttattccaaatataagatcatatcctctgcaaacaagaataatttgacgtcttccttttcaatttggatgccctttctttctcttgcctgattgctttagctaggacttccagtacgtgttaaataacagtggtgacagtgggcatccttgttgtattccagatcttagaggaaaggcttttagtttttctccattctctccattattgagatgtaaagttcaatatgtaggctgttaaactcttcatcattgattatgttatttggttgtttatatccttatatatatatttttgtctacataatttgtctcatattaaggaggattattttaaagttttctttttttactgtatttttatctgtgttctaccaatatcatttgtgtttgcttcattgagtggtggttctgttatttattgaatagttatttataatttgtctttattgtgaactgtggctgaaaattttgggtcatgcttaatgctctctaattctattttaatatttgaatcacaacctctatttcttttttcgttttttttttaaattgtactttaagttctagggtacatgtgcacaatgtgcaggtttgttacatatgtatacatgtgccatgttggtgtgctgcacccattaacttgtcatttacattagatatatcttttttctttctttcttttttttttttcttttttgagacagagtctggctctttcgcccaggctggagtgcagtggctgatctcagctcactgcaagctccgcctcccgggttcacgccattctcctgcctcagcctctcgagtagctgggactgcaggcacccgccaccgtgcccggctaatttttttgtatttttagtagaaacagggtttcaccgtgttagccaggatggtctcgatctcctgacctcgtgatccgcccgcctcggcctcccaaagtgctgggattacaggcgtgagccaccgcgcccggcatatcccctaatgctatccctcccccctcccccaaccccatgacaggccccggtgtgtggtgttccccaccctgtgtccaagtgttctcattgttcagttcccacctatgagtgagaacatgcggtgtttggttttctgtccttgtgttagtttgctgacaatgatggtttccagcttcatccatgtccctacaaaggacatgaactcatccttttttatggctgcatagtattccatggtgtgtatgtgccacattttcttaatccagtctatcattgatggacatttggcacaacctctatttcttaatatttggctgatacaactttgcccattctttttgcccccctccctttttttttttttttttttctgagacggagtcgtgctctgtcacccaggctggagtgcagtggtgtgatctaagctcactgcaactgccacctcccgagttcaagcaattctcctgcctcagcctcctgagtagctaggattacaggcatacgccaccgagcctggctaatttttgtatttttagtagagatggggtttcaccatgttggtcaggctggtttcaaactcctgacctcgtgatctgcctgcctcggcctcccaaagtgctgagattacaggcatgagccactgtgcctggcccatttttttttttttttaattcttagcatttgatatggtttggctctgtgtccccactcaaatctcacctttagttgtaatctctaaatccccacttgtcaagggcgggatcaagtggagatagttgaatcacgggggtggtttccccaatcctgctcttgtggtgatgagtgagttctcatgagatctgacagttttgtaagggacttccccctcttcactcaccactcattctctctcttgccaccctgtgaagaggtgccttctgccatgattatatcttttctgaggcctcccaggtatgcggaactgtgagtcaattcaacctcttttctttataaattacccagtcttgggtattccttcatagcagtgtgagaacagactaatacagcatttttaaatcacttgttttaggtgtgtttcttgtgtacaggttatattagagtcttgatttgtcagccaagtttttaatctctttttttaaagtagaaaaactaagcacattctcatttactgatatgtgtattctgttttttttttttttggttttcttttttttttttgctatgttttaaaatttctcatggtatataggaaggtttgtagttttgtatttacctctgtatttctaccttttttaatgcccgtatttcttggtttcttattctattactatctcatttgttagtttctaatgatatcctttaattctcacccattttttttaccataaccaaagagcttataccccttttctttctccttttaactttgtctcctaatgtttagttgcatttttgacttcttttaaaatatatttaatacatagtatataacatataattaggttgtcttgcactctgatccttgcctttgttttagacttagatctctaattaaaggtattgaatgctcaccattagtctttttgctaaagttgccccagttaacacttggttggatgcagcttactttttggtagattcctcaagaagtgttcctgagtatagagttccctgagttcattcatgtctgtagtcttgaatcttcatgcttggatgtaacatccttgtctcatactttttttcttgagttttttgtttgcttgcttgtttgtttgtttaggaagcttactgttgccttgctttctatgttgttgttgagacatttgccaacataattttttccttttcacaaagggaaaaaaatataacacaaagatgttatattcaatcacaaagattcaaggctacaaacatgcgtgaactgagggaaattctatactcagaagcacttcttgatgaatctaccagaaagtgagctttgcgaaccaagggatgcctggggaaactttagcaaaaggagtaacgtaagttatgcagtagttttgtttggaggccttgagtatttttgtttttggagtcttataattttagtagaatatgtcttggagttgatctttctaggtgttaaatcacatgcattcttaagttctttattaagtcctctggtttttcaagatcctttttaatactttttacaaaaggatgaactttttcttcccggaggttattttattgagacaaggtctcactctgtcaccctagttggagtagagtggcatgatcctggctcactgcaacctttgcctcccaggctcagtgattctcccacctcagcctcctgagtagctgtgactacaggcacatgccattttgcctgtctaatttttgatattttgggtagagacagggtgtgatggttaatattgagtgttgacttgattgaaggatgcaaggtattgttcttcagtatgtctgtgaggacataagccaaaggagattaacatttgagtcagtggactgggagggacagacccactctcagtccaggtgggcaccatctaatcagctgccagtgctgctagattaaagcaggcagaagaaagtggaatgagcagacttgctgagtcttccaggcttcatctttctcctatgccggacgcttcctgccctcaaacattagactccaagttcttaagcttttggattcttggacttacaccagtggtttgccaggggcttttgggcctttgccacagactgaaggctacactgtcagtttttctgcttttaaagttttgggactcgactggcttccttgctcctcagcttacagttggcttattgtgggactttaccctgtgattgtgtgagtcagtactctttaacaaactttcttttatatatacctccatcctattagttctgttcctctagaggaccctgacaaattcacagggtttcaccattttggccaggctgctctcaaactcctgagctcaggtaatccaccctcctcgcatcccaaagtgctgggattacaggcatgagccactgccctctgccctgatggtaattttagatcaatcttaagcctgctgctagctccttctctcttctgggaattttctcagtttttcttggaatgtccttgtttttcatgaatgattgtgacaagagccagtaggatagcttactgagatttgtgtttgtttgtttgtttatttgtttatttatttatttattttgagacagggtctcactgtgttgcccaggctagagtgcagtggtgtgatcttggctcattgcaacttcctcctcccgggttcaagcatttctcctgcctcagcctcccaagtaactgagattacaggtgcacaccaccacatccagcttattttttagtagagacgaggtttcaccatgttggccaggctggtcttgaactcttgacctcaagtgatctatctgccttggcctcccaaagtgctgggattataggtgtaagtcaccatgcccagcctttttttctatttgcagataatttgaagtttattttccaattatgttgagggcatgagttttatttgttctttttggttttgtgtatgtatgtataatttatttttttaaggatattgtgttacgacactccaatttatttggccgtcattacctaggcttgctgttattttgaagtctcaagtgagcgaaagaaaggatttaagaatgattctaaggatttttacctaagtaattggaaggatagaattgtatcagctgaaatggggaaggctgcaggagcaactagatataaaggtaagatcagatattcagtctcgggttgtgtttaagatttctgtttgatatctaaacagagagattcagaaggtcagttggataaatgagcctggaatttaggagagacatctgatttggaaggaaaatttgtgagttattaacaatagatggtatttaaaagcatggaactagatgagatctcctacagtcagtatagacaacagaaccagaccaaacacagaacactggtgtcttctgcattaattggtttgggatatgagaaggaatcagcaaggggtgactgatcagctgctgatttcttggtcaatcagtagctgactccttggtcaaaaaagaatgagccataaagtagaaggaaaactatgaaagtcaggtgccctggaagccaaataattttttttttaacaagaagggagggagaatgttactgatgctactgatagttcaagtacgatatgccgttagaattaagaattggatttagcaacatgtaggtcattgataacattgacaggagcagtttgtggaattaaattataatcagcgttgcaatacttttaaattagtcttgtcaatttggtgcccttggcatatgagcaggatgaagatgatccaagtagcttggcctctggccttcacttgttttaaaagaactgctaatctttgttctaattttgtatactgggtttccatgtaatattttctttgggattggtagttataagggtctactataaagtaaataaatacactaacagtttcaaaaataataaagaactttttaaagaacacattactagatgtaaatttttaaaaaaatttaatgggaattttttgttttaatacgtctctaattctagtatcaaatgaagtagactttgattagaatgtatgtgcttttttttttttcttagcttctcttaatgcgtaagcttaaagcttttttaggctttatgtatgccctcagactcattcatttctttaaatttctcagactcttctaagctaatattcacatattatagtctttctgtcctccgcacttatgttgatccttaacatatagctgatattttgtcagtgttttttaaattgaaggaaatggaccccaagggggtagactttggcttactttgtctcatttcttttcttgcagtgcttctgctggcctgtctcttaagcagtagaataataaaaagtagtttctttgaggatataaaagcccttgagatagtttcactttaagcttaaaagattttcttgtcattttacctctaaaatttgattttcatgtttctttttagtatgtattttctgaaccctcctcttgtgcattttaaatgaacctatatttggtaactgttcccagcaatgcctttttctttttcataaggaacctgatacgttattctatgcctatgtggtatttagggaggcagatggtataatagaaggagaaatgagcagtacatcaaaaccagggccagcttctgccacttgcattcatctttttagtaaataattattgaatatctatcttctgtgtgctaggtatttactagaagtttgtgcttgtgttttaattaatagactttattttcttagaaatgccattttcacaaattactttctcttagatactaagatctagtctgtaataaagtattaagtactaaatgagcaatattaaaaattaatataatattaaaatataggtgttataaaaattgaaaacactggtggagtgtggtggctcacagctataatcccaacactttgggaagccgagccaagaggattacttgaggccaggagattgagaccagtctggaaaacagagtgagaccccatctctacaaaaaatacaaaacattagctgggcagagtggcatacatctgcagtcctggctactctggaggctggggtgttgggattgtttgagcccaggagttcgagattacaatgagctatgattgtgccattgcagtccagcctgggttatggagctgtctccaaaaaaaaagaaaaaattgaaacaaacgacttttccttggttgttggagattggtatatattgtcatggaagatcaaaagtaaaattatgagcagagaggaggcagagcaaaatggctgaatagaagccaccaggccaggtgtggtggctcacaccagtaatcagcactttggaaggccgaggtgagcagatcacctgaggccaggagttaaaagatcagactggtcaatatggtgaaaccccgtttctactaaaaatacaaaaattagccaggcatggtggcacacgcctgtaatcccagctactggggagtcagaggcaggagaatcgcttgaacctgggaggtggaggttgcagtgagccaagatcgtgacactgcactccagtctgggctacagaacaagactctgtctcaaaaaaaaaaaaaaaagaaaagaagccaccagcagtcatccagtcacctccttctgggaacaccagattgaacaactatgcacatgaaaaagcacctttatgagaaccagaagcagagatgagtgatcatagtacctagttttaaaatcataataaggaaagaggtactgaagagagtaggaaagactcgtcccccattccctggtagcagctgtgggccactgagatcatatctgtgtgcttggggaagggagagtgccgggattatcagacattgcgttagaactcagtgccctgtcacagtggaatgcaacacagggtggaactcagctggtgcccattgagggagcattaagaccagccctagtcagaagtgaatcgtctatctcagcagtgggaacctgagttgtggcaagccttgatactgcgggttaaagtcctctggggtccttgataaacttgacagacagttgtattagtctgttctcacactgctataaagaaatacctgagactgggtaatttatggagaaaagaggtttaactggctcacggttctgcaggctgtacaggaagcatagtggcttctacttctggggaggcctcaggaaacttacaaccatggcggaaggcaaatgggaaacagaaacatcttacatgtccagagcaggagcaagcagttgggggaggtgccatacacttgtaaacaagcaaatctcatgagaactcactattgcgatgatagcaccaagggggatggcgttaaaccatgagaaactgcttccattatgtaaccaccttccaccaggtcccatctccaacattggggattacaattcaacatcatatttgagtgaggacacagacccaaatcatatcagcagtctaggacacaaggactacaattcctggcctagttttggtgctgtactatgctgggctcggagatggtggacttgcggtgcctatgacctagtgagacaccagctgggatgcccaagtgagtgcctgtgtcacccctcctttaaccctagggagtgcagctcgcaattctaagaaaacctctttctccctgcttgaagaaaggagaagggagcgtaaacacgactttgttcttccaacttggataccaactcagccacagtagatagaggaccaggcagagttctgagacctccatttcaggttttagctcctggatgacatttctagacacatcctaggccagaaggaaatccagttttgaagggaaatacctggtccctgcaggatttattacttgctgacaaaagtgccttgggccctgaataatcagcagtagtagctaagcagtactcactgctggcttcagataagattcagagctattctggcttcaggtgtgacccagcacattccagctgtggtggctacgggtaatgactttttctacttgaaaggagagaggagactaaggggattttgttttgcagcttgtgtaacagctcagccacagcagggtagagcactaagtgggctcatggggcccccacttttaggccctggctcctgggtggcatttctggatctgccctgggccagagggaagcccagcatcctaaaaggagagagactcaggactggcagtattcagcataagctggccgaaaagcccttgggccttgagtgaacaatggtggtagccagaccatactcccttcagggttcgggcagtggtggccatagggtgagacttctctacttgaggaaaagggagagaagactgggaagaactttgtcttgtggctcaggtgccggctcagccacagtggaatagagcagcaggtagattcctaaggtccctaattcccaaccctggctcctgaatggcatctctggacctgcccaaggccaggagcaacttgctcccctgaagcaaacaggacataagcctggctggatttgtcacctgctgattgtagagcccttggacttgagagaacatagatggggtagccaggcattggtcactgtagtccttagtgagacctcgtgtgtgctggctttcaatctaatccaaagcaatacaactagtggtgaccacagggatgcttgttttacctctcccccagctccaggcagctctgcacacagagactctgttaagggaagaggacgaaaatgtctgccagggaatccagggaattctgcatattacccaagaccaccaacgtgtacctcaataagccagcaagcactacagcattactgggcttggggtacttcctaatgcagatattaccgcaatgaccaaagaccaaagatcataacaccctttgaatacttggaaagccttcccaagaatgatgagtacaaacaagtctagactgtgaagactacaataaatgcttaattcttcaatgcccaggcagcagcgaatatccataagcatgaaaaccatccaggaatacatgatctcaccaaacaaactaaataaagcaccagtgaccagtactggagaggcagagatatgtaacctttcagagaattcaaaataactgtattgagaaaacccaaagacatgatgtaatcctattcctattccagagaaggaattcagtattctatgagataattttaacaaagaaatacaaataattaaaaagatcaagcagggcaggtgcagtagctcatgcctataatcccagcactttgggaggctaagacaggtggattgcttgaggtcagaagttcgagaccatcctgggcaacatggtaaaaccctgtctctactaaaaatacaaaaaattagctgggtgcagtggcacatgcccatagtcccagctactcagaaggctgaggtgggtggatcacttgagtctgggagacagatgttgcagtgagctgagattgcaccactgcactcaaaatattttttgaaaagcagaaattctggagttgacaaatgcagttgacacactgaacaatgcatcagagtctattaacagcaaaaatgatcaagcagaagaattagtgagcttgaagatgggctatttaaaaatatacggtcaaaggagacaaaagaaatgagaataaagaagaatgaagtatgtttacaagatctagaatgtagcctcataagggcaaatctgagactctgaactcaaaaaggagataaagagagagatggggtagaaagtttattcaaagaggtaatagagaacttcccaaagcttagagaaagttatcagtatttaagtacaataaggttatacaacaactaagcaggtttaacccaaataagactacctgaagacatttaataatcaaactcccaaaggtcaaggataaagaaaggatcctaaaagcagcaagagaaaagaaacaaataacatacaatggagctcaatacatctggcagccaacttttcagtaaaaaccttacaggtcaggagacagtggcatgacatatttaacatgctgaaagaaaaaatacatatattagaatagtatatctggcaaaaatgtccttcaaacataaaggagaaatactttcccaggcaaaatacctgagggacttcattgatctcagacctgttgtatgaaaaatgctaaagggagtttttaagtgtgaaagaaaaggacattaatgaacaataagaaatcatctgaagatacagaacttactggtaataatatgtacacaggaaaacaaagaatactgtcacactgaagttatggtgtgtaaactacttatatcttaagtagaaagacaaaaagatgaactgatcaagaataataactaaaacaattttttaagacatagtacaataagatataaatagaaacaacacaaagttaaaaagtggggagacagtgtaaagtttttattagcagagctatattaaccaaaacagcatcatagtggcataaaaatagacacacagaccaatgaacacaatagagaatccagaagtaaatctgtacatccacagtgaactcattttcagcagagatgccaagaacatacagtgaggaaaagacagtctctttaataaatggtgctgggaaaactggatatccatatgtagaaaaatgaaactggacccgtctctcaccatatacaaaaatgaaataaaaatagactgaagacttaaatataagaattcagactgtaagtactaaaggacatctttggagaaacacttcagtactttgaactgggcaaaaatttccccacaagcacaaacagccaaagcaaaaatggacaaataggattacatcatgttgaaaagcttgtgtgtgacaacaaaagaaggcacacaaacagcaaagaagtaaatgaaaaggtactcacgatcactgattatattagtctgttctcatgctgctgataaagacatacctgagacagggcaattttcaaaagaaagaggtttaatggacttaacagttccacatggctgcagaggcctcacaatcatggtggaaggcaaggaggagcaagtcatatcttacatggatggcagcaggcaaaaaagagagagcttgtgcagggaaactcccgtttttattttttaattttttaaattttttgttatactttaagttttagggtacatgtacacaacgtacaggtttgttacatatgtatatatgtgccatgttggtgtgctgcacccattaactcatcatttaacattaggtatatctcctaatgctatccctcccccctccccccaccccacatcaggccctggtgtgtgatgttccccttcctgtgtccatgtgttctcattgttcagttcccacctatgagtgggaacatgcggtgtttggtcttttgtccttgcgatagtttactgagaatgatggtttccagcttcgtccatgtccctacaaaggacatgaactcatcaatttttatggctgcatagtattccatggtgtatatgtgccacattttcttaatccagtctatcattgttggacatttgggttggtcccaagtctttgctattgtgaatagtgccgcaataaacatacgtgtgcatgtgtctttagagaagcatgattcgtaaacctttgggtatatacccagtaatgggatggctgggtcaaatggtatttctagttctagattcctgaggaatcgccacactgacttccacaatggttgaactagtttacggtcccaccaacagtgtaaaagtgttcctatttctccacatcctctccaacacctgttgtttcctgattttttaatgattgccattctaactggtgtgagatggtatctcattgtggttttgatttgcatttctctgatggccagtgatgatgagcattttttcatgtgtcttttggctgcataaatgtcttctcttgagaagtgtctgttcatatcctttgcccacttgttgatggggttgtttgtttttttcttgtaaatttgtttgagttcattgtagattgtggatattagccctttgtcagatgagtgggttgcaaaaattttctcccattcagtaggttgcctgttgactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctggggtttttatggttttaggtctaacatttaagtctttaatccatcttgaattaatttttgtataaggtgtaaggaagggatccagtttcagctttctacgtatggctagccagttttcccagcaccatttattaaatagggaatcctttccccatttcttgtttttgtcaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggcaatgtggctcttttttggttccatatgaactttaaagtagttttttccaattctgtaaagaaagtcattggtagcttgatggggatggcattgaatctataaattaccttgggcagtatggccattttcacgatactgattcttcctacccatgagcatggaatgttcttccatttgtttgtatcctcttttatttcattgagcagtggtttgtagttctccttgaagaggtccttcacgtccctttgtaagttggattcctaggtattttattctcttttaagcaattgtgaatgggagttcattcatgatttggctgtttgtctgttattggtgtataagaatgcctgtgatttttgcccattgattttgtatcctgagactttgctgaagttgcctatcagcttaaggagattttgagctgagacgatggggttttctagatatacaatcatgtcatctgcaaacagggacaatttgacttcctcttttcctaattgaatgccctttatttccttctcctgcctgattgccctggccagaacttccaacactatgttgaataggagtggtgagagagggcatccctgtcttgtgccagttttcaaagggaatgtttccagtttttgtccattcagtatgatattggctgtgggtgtgtcatagatagctcttattattttgagatacgtcccatcaatacctaatttattgagagtttttagcatgaaggttgttgaatgttgtcaaaggccttttctgcatctattgagataatgtggtttttgttgttggttctgtttatatgctggattacgtgtattgttttttgtatgttgaaccagccttgcatcccagggatgaagcccacttgatcatggtggataagctttttgatgtgctgctggattcggtttgccagtattttattgaggttttttgcatcgatgttcatcagggatgttggtgtaaaattctctttttttgttgtgtctctgccaggctttgttatcaggatgatgctggcctcatcaaatgagttagggaggattccctcattttctattgattggaatagtttcagaggaaatggtaccagctcctccttgtacctctggtagaattcggctgtgaattcgtctggtcctggactgtttttggttggtaagctgttaattattgcctcaatttcagagcctgttattggtctattcagagattcagcttcttcatcgtttagtcttggaaggatgtatgtgtcaaggaatttatccatttcttgtagattttctagtttattttcgtagaggtgtttatagtattctatgatggtagtttgtatttctgtgggattggtggtgatatcccctttatcattttttgttgtgtctgttttattcttctttgttttcttctttgttagtcttgctagtggtctatcaattttgttgatcttttcagaaaaccaactcctggattcattgattttttgaaggcttttttgtgtctctatctccttcagttctgctctgatcttagttatttcttaccttctgctagcttttgaatgtgtttgctcttgcttctctagttcttttaattgtgatgttagggtgtcaattttagatctttcttgctttctcttgtgggcatctagtgctataaatttccgtctacacactgctttaaatgtgtcctggagattctggtatgttgtgtctttgttctctttggtttgaaagaacatttttatttctgccttcatttcgttatgtacccagtagtcattcaggagcaggttgttcagtttccatgtagttgagtggttttgaatgagtttcttaatcctggaaactcccatttttaaaaccatcagatctcaggagactcattcactatcatgagatcggctcaggaaggacccgcccctataattcaatcacctccccactgggttcctcccaccacatgtgggaattgtggtagttacaattcaagatgagatttgggtggggacacagccaaacagtatcactgattatgagaaacattaaaatcagaactacaaggagatatctcattccagctaaatggcttgtgtccaaaagacaggcaacaacacactggtgaggatgtgaagaaaagggaccccatgtaccatgctgatgggattgtaaagtagtataatcactatggaggatggtttggaggttcttcaaaaaactaaaaatagggctaccatgtgctccagcaatattactgctatgtgtatacccaaaaggaaggaaatcagtatatcaaagagatgtctacactcttgtgttcattgtagcactattcacaatagctaagatttggaagcaagctaagtgtccatcaagagatgactggataaaatgtggtacattgtacaataaaaatggaatttaatttggagaaaatcagtcaaaactatacagttatatggcaattaaacatgctcctgaatgacttcttagtaaataatgaaattaaggcagaaaacaagaagttatttgaaactaatgagaacaaagatacaacatactagaatctctggggcacagatatggcagcattaagagggaaatttctggcactatacactcacatcaaaaattagaaagttctcaacctaatgtcacaactagaaaaactagacaggtaagggcaaaccaacctcaaagctagcagaagacaaaaaaaataaccaaagtcagagctgaactgaaggagattgaaacatgaaaaactggccaggcatggtggctcatgcctataatcccagcgctttgggaggctgaggtgggcagatcacagggtcaggagtttaagaccagcctggccaacatagtgaaaccccatctgtactaaaaaaatacaaaaaataagccaggcgtggtggcgggtgcctgcaatcccagctattcaggaggctgaggcaggagaatcgcctgattccaggaggtggaggttgcagtgagctgagattatgccattgcactctagcccgggcaataatagtgtgagactcttttgtctcaaaaaaaaaaaaaaaaaagaaacatggaaaaccatacaaggaccaatgaatccaggagatagtttttttgaaagaattaataatatagactgttaagtacacaaagaagaaaagagagaagatccaaataaacaaaattagaattgagaaagagaatgttaccgctgaccccacagaaatacagataaccatcagagactactatgagtacctctatatatacaaactagaaactccagaagaaatggctaaattcctggacacatacattctcccaagactgagccaggaagaaattgaatccctgaacagaccgataatgagctctaaaactgaatcagtaataaatagcctaccaatcccccataaaagcccaggatgagaaagattcttggctgaattccaccagatgtataaagaagagctggtaccattcctactgaagatattccaaaaaattgagaagggatttcttcccaactcattctatgaaaccagtgttattctgataccaaaattggcagagatacaacaacaacaatagcaataagagttcaggccaatatctttcatgaacataaatgcaaaaatcctcagcaaaatactagcaaatccaatccagcagcatatcaaaatggtaatccaccatgatcaagtaggctctatccctgggatgcaaagttggctcaaaatacacaaatcaataaatgtgattcattacataatagaactaaagacaaaaaccatgtgattatctcaatagatgcagaaaaagcttttgataaaaattgaacatcctttcatgttaaaaactcaataaattaggcattgaaggaatgcaaataataagagccaactatgacaaaccctcagccaacatcatactgaatgggcaaagctggaagcattcttcttgaaaactggcaaaagaccagaatgccctctcctaccactcctattaaacataatactggaagttccagccagggcaatcaggcaagaaaaagaaataaaaggcacccaaataggcaaagaggaagtcagactatccgtttgcagaaaacatggttctatatttagaaaaccccatactcctggccaaaaagcagcttaagcaacttgagctgataaacaactttagcaaagtttcaggatacaaaatcaatgtacaaaaattagtagcatttctttacaccaacatgcaagtgaagagccgtatcaggaatgcaatcccattcacaattgccagaaaaagaataaaatacctaggagtacagctaactagggaggtaaaagatctctacaatgagaattacaaacactgctcaaagaaattagagatgatacaaagaaatgagaaaacatttcgtgttcactgataggaagaacccaatattttttaaaatggccatactcctcaacacaatttgcgattcagtgtgattctaatcaaactaccaatagcattattcacagaactagaaaaaaacttttaaaattcatatggaaccaaaaaagagctcaagttgccaaagcaatcctaagcttaaagaacaaacctggaggcataatgttacccgacttcaaactacacccacagggctgtagtaaccaaaacagtatggtactggtacaaaaacaggcacataaaccaatggaacagaatagagagcccagaaataatgccacacacctacaaccatctgatctttgacacagctggcaaaaacaagcaatggggaaaggactccctattctacaaatgatgctgggataactggctaggtatatgtggaagactgaaactggacccctttcttacatcatatataaaagccaactcaagaatataacgctgtaaatgcaaaatctaaaactataataccctggaagatgacctaggcaataccattctggacataggaactggcaaatattttatgacaaagacaccaaaagcaatttcaaccaaagcaaaaattgagaaatgggatctaattaaactaaagagcttctgcacagcaagagaaactatcaacagagtaaacagacaatctacaaaatatgagaaaatatttgcaaactgtgcttctgacaaaggtctactatccagaatctgtaaggaaaattaaaattaaacaaattttataagcaaaacccaaacacatgaacagatgtttttcaaaagaagacatacatgcagccaacaagcatatgaaaaaatgctgtacgtcagtaataattagagaaatgcaaatcagaaccacagcgtgatatcttatattagtcagaatggctattattttaaaaatcaaaaaattacagatgctggaggggttatagagaagagggaacacctatacactgctggtaggagtgtaaattagttcacccattgtggaaatcagtgtggcaattcctcaaagaacttagaactacttttaaacccagccatcacattattgggtatatacaccaaggaatataaatcgttctaccataaaacatatgcacatgtatgttcattgcagcactattcacaatagcaaagacatggagtcaagcacccatgaatggcagactgggtaaagaaaatggagtgtatatacaccatgaaatattatgcagtcataaaaaacaagatcatgtccttttcagcaacatggatggaactgaagaccattattcttagcaaactagcacaggaacagaaaaccaaatactgcatgtgttctctcttatgagtgggagctaagtaacaacgcacgtggacacaacaaagggaacaacagacactgggacaaacttgaggtcagagggtgggaggaggaacaggatcagaaaaaatacctatcgggtactatgcttaatatctgggtgacaaaataatctgtacaccaaacccccatgagctgagtttacctgtattccaaacgtgtatatgcattcctgaacctaaagtgaaagttaaaagagaaatttttttaaaaaagaaaatgtggtacatatataaaatggagtactattaagccataaaaaagaatgagatcctgtcatttgcaacaacgtagatggaactagaggacatttattaagtgaaataagccaggcacagaaagacaaacttcatatattctcacttatttgtgggagctaaaaattaaacaattgaactcatgaagatagagagtagagtgatggttaccagaggttaggaagggttccggggaggagtggagttgttaatggttgcaaaaatatacagaatgactaggacctagtatttgatagcaaaatagcatgactacagtcaactataatttattgtacttttcacaataactaaaagagtataactggattgtttataacacaaaggataaatggtcaggtgatggatatcctatttattgtgatgtgattgttacatattatatgcctgtatcaaaatatgtaccccataaatatatacacttactatgtacccctaaaattaaaaattaaaaagtgaaattatgagcaattcataaggtattaaatgtagaagtagaatatataaatgttatgtacatttttaaattattttatgtatttattaaaatagcatttagctatgttgcccaggctggtcttgaattacttggctcaagtaatcctcctgcctttatctttaatgttttcacatgagaggattgactttgtacttgtagttttctatatagcaaatttttacaaaaagtctaagcataatttgtattaaaaagtatttctaatttaaatatgttttaactccaattttatttcagaaatcacgtaaccaccttgaagatgaaagataaatcattatcattaaaatttttaattttgtgtatttctaggtgtgtgtgtgtaactttaagacgctattatttcctcccagatatggattgtcaatgcagagccttttggatctgtccttttcttcatttatggatgaggcagctgagatttggagagtttgtgactagcccaaagctcctacgaactcaggctgtattttcctggtatagttgaacaaaaaattttcaaagtgatttttttactatgctactttttattagtgcataccacaaaatagaccaattaacacttttgaactaattgaaaattttcttaatgccattaatatgtgttgcagtctgatgcatttataaagtttcacctgtttttcttttatttatttattttaaattaaaaaaatgtttttaaaaatgtttgtgggtacatagtaggtgtatatatttatggggtacatgagattatgtatacaggcatgcaatgtgaaataagcacatcatggagaatggggtatccattttcttatacatttatactttgagtcacaatcaatcaattacattctttaagttatttaaaaattattattgactatagttgccctgttgtcctgtcaatagtaggtcttatttattctttttaactcttttttgtacctattaactatccctacttaccctactacccttcccagcctctggtaactatccttctactgtctagctccatgagttcaattgttttgattttgagatcccacaaataagtgagaatatgtgatatttgtttttctgtgtctggcttatttcacttaacatagcaatctccagttccattcatgttgttgcaaatgacagtatcacctttttttatggctgaatgtatccattgtgtatatgtaccacctttttttattcattcatctgttaatgtacatttaggtgacttccaaatcttggctattgtaaataatgctgcaataaacatggcagatatctgttcgatacactggtttcatttctttggggtatgtacctaggggagggattgccaggtcgtatggtggctcaatttttagtttttttgaggaatctccagactgttctccatagtggttctgctaattcacattcccaccaacagtatacaagggttcattcttctccacatccttgccagcgtttgttattgcctgtcttggatataagccattttaactggggtgacatgatgtcttattgtagttttgatttagatttctttaatgatcagtgatgttgagcactctttcatatgcctatttaccatttgtatgtcttcttttgagaaatgtctattcaaatctttgcccattttttgatctaattattggattttcccctgtagagctgtttgagctcttcatatatactctggttattaatcccttgtcagatgggtagttggcaaatattttctcttactctgtgggttgtctcttctctttgttgagtgtatcctttgctgtgcagaagcattttgacacttgacgtgatcccatttgtccatttttgctttggatgtctgtgcttgtggggtattactcaagaaatctttgcccagtccaatgtcctggagagtttccctactgttttcttttagtataatagtttcatagcttgaggtttagatgtaagtttttttaatccattttgatttgatttttatatatggtgagacattattatttttgattaattcatcatttagtctttctacttatttaattcatttatcgttttgtctttctacaccacagttacagtgttataatattctgtgtttttctgtggacttactatatccagtgagttttgtaccttctggtgattatttattgctcattaatgtcctttttgatagaagtattccctttagcatttcttgtaggaagctctggtattgatgaaacccctcagctttttttttgtctgggaaattatttcttcttcatgtttgaaggatcttttcactagatatgctattcaagtttaaaaattttttcctttagtgctttaaatatatcaggccactctctcctgtcctgtaaggttttcactgaaaagttggctgccagacatcttcttgcaggatccttaaggtgtcacttttctggccagaaacctctttggcctgtggcacctttgcctgagtttttcttgggactgttggtctcgttccacacactggacctgcaggccgtgcttggctcaggctactggtctggatcccatgcctgccaagggtgaaccagacatggagcggcaagaggtatgtgagctagtgagtgtgaggtgcagccactgcacacagtcaggcacaccagctgctgcagcagggcgggcagctccaggtgcagcatgggcactggctctttgtgaggctgcagctagaccacactgcaggcagcttccatagctgtcactggggaacgtggtgtcgcctagcagcttagatactccaggaacctcaggccccaaagagggagtcacagccctggcttggggcactcccaagtctgggctccctgaagagttgcagctcttctgttcacccacaatgtggtgagcatggggtttgtttcagccctgtttgtgttacagctgtttcagtcctgccatttggcaggtcccaagttctcctgagtccaggaagaatgaggtatgtggacaagtggagggtgagcaaggtgaagaggagcatcactgagtgacagaaaagctcagatgagaccctggagtgggtagctcctctctgcaacctggtcatcatgttaagtgtttagccctcagcagataggaggccctggagtgggtagttcctctctgcgggtggtcatcccaacatctgcagctgtcaacagagaggaggccctggaatggatagctcctctctgcagctgatcaccccgatgtctgtagctctcagcagagaggagttcctggagtgggtagttcctctttgcagcttgttgtcctggtgtctgctcagctctggctgagcccagggcttttatgggcctcagaggggaggaagtgcctaccaatttgtccatgagcaggtcctgaaaaggcaccataaattccctctctggtctgcaagactggcagcctggcctcctgcctttaggccctgcctgacctgaaggtggggcctcagtggggacctgctcccttctgcccaggctattcatgccaaggggcgcctgcaggccagtgctgagctgccctcagtcccccacggcttccctcccatgctcattggtgcccaaaatccagagggggctgaggtggcgggggctggcatgtcagcactgccctgatcatggcacacacccagctaggctatgacagtgcctggactcagtcccaaacttgcttcaagataggagcaggcactaggagcgggagcagacacttctgagcctgttggggcaggaggagccttctcagtctcccgagagtgcacagatgcccggctctgtaactgtggcttgggtggctgtagctgcacctggcagggtgtggctcctgcctgctccaggagtgggaggcccgggtccacagccacaactctgtcacttgggcagctgcagctgcacctggggaactcccgctccaccaacgtggaaagagcagggctcccactttttcccagcttctgcagggtctgtggagtgtgtagccctggccgtgcttccctgctgtggactgggtgatggcagcaaccactccagatggccgctgctaccattaatattggagctccattgttgtttattttcttttgctgcttttaggatcctttctttatccctgacctttgcaagttttattattaaatgtcttgaagtagtcttctttgggttaaatcagcttggtgttctataaccttcttgtacttggatactgatacctttctctaggtttgagtagttctctgttgttatccctttgaataaactttccacttttatctctttctgcctcctcattaaggccagtaactcttaaatttgcccttttcaggctattttctagatcctgtaggcatacttcattgttttttattttttttcttttgtctcctctgattgtgtattttcaagtagcctgacttcaagctcactgattctttcttctgcttgatcagttctgctgtcaagggactctgctgcattcttcagtatgcccattgcatttttcatctccagaatttttattctttttaattatttcactctctttgtgaactatatctgatagaatttcttctctgagttatcttgcatttctttgagtttcctcaatacagcaattttgaattcttcgtctgaaaggtcacgtgtctctgtttctcccaaatagttacctagtgcctcatttagttcatttagtgagatcatgttttcctggatggtgttgatgcaaatagatgttcttcagtgtctgggcattgaaaggttaggtattatagtcatcactgtttagacttactttagctgtcctttttgggaaggctttctagatatttgaaaggacttggtgttgtgttctaagctgtatctgctttaaggggcaccccaagttcagtaacgctgtggttcttgcagactcatagaggtactgccttgatggtcttggacatgatctgggagaattctctagattaccaggcagagactcttgtactcttctctttctcccaaacatacagaacctctctgtctctctgttctaagccatctaaagccaggggtgaagtgcaacaagcatccctatggccatgaacactatgactacactatgtcagacctgaagccaacacagcacttgatcttgcccaaggcctgctgtaaccactccctggctacactactgcctatatgtactcaaggccctggggctcttcaatcagcaggtgaaagccagccaaggctgtgtccttcccttcagagtggcaaggtccagaagtaccgtctgggagtcagggaatagagtgaaaaaccttagaagtctccctggggttcttttgtattgtggctgagctggcactcaaaccacaagattcagtccttcccaatgtccctccccatttcaaaggccaccgccaccccaggccacaaggaagtactacaagactacccctgatgtttcttttaggcccaaggtctcttaagtctgcttttgttaaatgctgcctggcctaggactcacccttcaggacagtgggctcccctctggtccagggtaggtctaaaaatgccatccaagagccaagtcatagaactggggactctaagaacctgcttggtgctgtaccccactgtggctgtgctggtatctgaaaccagcaagtctccaaggctgacccaaggtcctcgatgtagtacctgggtgtttctgctggttactcagggctcaagtgctcttcaattagcagattatgaatgctgccaggatgtgtcattgtcttcaaggcagggggtttccttctggaccagggtgtatctagaaatgtcatctgggagctaggccctgaaacaggtgcctgacaactctgaccattgcgcagtcttgccttgggtgaactgataccttagatgtaagacagagtcctcccgactcttccctctcctctccttaaacagaaggaaggggtctattttggagcagggagctgtgtagcatggggttaggagagaggtgatgccaacactcccttggcagccccacagtggactgtgcccttccagtccactgtcgctgagcctagttcaacaccaggattcatccaagagttgcaatccttatggcctagactgccttcaagcttacttggagacaagagtgctacaggccttggtggtgaggtttgcaagtacttaagttcaaactgctgggattagtgattcccctctggctagggctgattttgatgttccctctgtaggcgggcttagctcaatttggtctggctttctggttctaacagaaaagcactgagttctgtgccttacaattgctgaggtcagggaggggtggcactggcaattcaggactgattttttgtctcttcagtgcctctttccgggatatgaagttcaaaccaagtactatgaaagctcacctgatttttggttctcatgaaggtatccttttcatgtgtgtagaaggttgttaaattgctgttcttgttggggggacaattggtggagctttctatttctccatcatgctctaccctctgtctcacctgtttttcttctaaaaacaatcttctatttatcagaataatatcaagctctatagctagttcaccaaactgaaaacagatggtttttataatagaggcattgatgcatattaacagcagtagcccaaatagtgtgttataaatgtggcttatgtttatcaacataaaggtttggtgatttcattatagtttctagtcagtcccttttgtaactcattaaaaaggtctgtctgaccccattgtggagtattcttacaactgtatatgacttcactaagatgttttcattagtaaaataactgagacattggaaatattgtaaaaataataagttagctagaagaaaggaaaatgagtcaaagccaatgtgagaatttagtcacccatataagggattgtttagatcaaacaggtatgataaagatgctgctaacgatggaatttaaaaactttattgagctctctttgtataacatacctttgattcataaactggaaggttagtcttgacaacattttgatatgacattagattttaactagaaaataaaagaattgagcataattattcataactaataaaattatatttttcctttttcaaattagtttaaggactgccattttacacccataaacaaataaaagttttcaggatctgcttttccgttcttcacttcactgtgcttggattccctccattgtgcttggattccctccctcttatattctttctttatatgcttatgagagaacaaaaattctaagtgtgtaaaatagctgactgtaaatgaggtattaccatcttggggaaaggcttatcatcctagattttggttcattggccaccttccaggcttcctactaaattattggcagcaaagcactaatgtgcctcccagccaacaagtgataccaacctatgtcttttcttttaggggtagaaaatagtcaaaattttaaactctagaattctcaaactataaatctgggtcaggtttgtagccagcaaaatgaaatttgtaggtactgtttaaattgtctaaaagctaacatgttcaggaacattttgggcaatgtaaacttaaatgaatgaataaataaaccaacaaatttagatctttaattttagtaaggctaattgttattggtaacatttgatagtgtcctttgagaaactgatactgaagaaacaaaaaaaatttaatgattactttcttctttctagaatgtattattatagatgattttaaatgatatttggtttttgaaaattatgaaataaggtatgtgaaacctccaaataaattgttgtagcaacaagaaattaatgctattttggaactatagtagcttgataaccttttataatgtattttaaaaaaattaatatgtggagtaggcttataaaattgtattttttcccaacatgatgaaaacctatttttatcccattaataggcatgaatgttggaatcagagacttatttaacagaagtctttggctattaatgaataaactataaaatgtgatggggttcgagtcatgtgctctcttcagagtgaaaaatgctatgacttaaccctaatctctgtgatcatcctgtttttcctgtaaaaattccattttttttttctccttccaacagtattccacaaagtaggtgaaacctttctctggcttccttctcaatgtatgacctaactgcataaaaatttttatcaattgttcataacttttaaatttattttttggctagctaacttgttgttaaggtgagatttttttccatataggagacccattatattcagagatttattttttttaatttttgagaatttgaggacactgtaccaacttacacttttagtatgctatgaagtatgaagctacttcctatggtagagaaaatggaattggaggctttcagggtaaatgttttcaatgtagtagattgtgtatatttcaaatcctagaagaccaatgaaagttgagtgaaaataatgacacattaccccagatgcataaggagcataaaagttctcaaatacgttttccacagagcagtcttcccactagatattgattgtttgattgttcctcaagttaaacattgaattaccatgggaactagcaattccactcctaggtatatacaaaaattcaaacagatacttaaatgcctgtacacaaatgttcgtagcttcactatttacaatagccaaaaggcaaaaaacaacccaatcatctatcaatggatgaatgagtaaacaaaatatggtatatacatacaatggaacattgttcagccataaaaaggatgaagtactaatttatacttgctgccacatggatgaacctgtgaacatgttatcctaagtaaagaagccagacacaaaaggggacgtattgtatgattccatttatatgaaatatccagatcaagtaaattcactgatagagaagcaaattgccagggttaggggagggaagaaaacagtgtggctgcttaatagttataggtttttctgttggggtggtgagaatgttttggaactagatagagggattagttctgaacatgctaaatgccactgaattgtacacttcaaaatggtaaattttatgttatgtggattttccctcaagtttttaagaaagaataactagttacactagtttgtaggatgaatgctgtcaatatcagtgtctttacatacagtatatttttgaaaatgtttgctatggagtcagagtaccttattccagaattagagaaagttctccaaaaattagatctcttactattttgctttgttgcatgatttggtttttgttgtttgtgtttgtttttcactgtttgcaaatcagaaaaactaacaatgtttagaattccagattgagagaaattttttttggtctggaatttgcataatgacttttgatggacaaaataaaaaagttttagaagaccatatgataaaagaaaaaattaaacttgttatcattgattgctgaggagtttaataaaatcttcatagtgtttaaggatcagtggttgacagactatggaatttgtcagtattaaaaatgtactaatcatctgcccaacaaaaaagatgaacaagggaattaaaagagctttagtatttggtgctcttttttgatagaaaatgagtagatttagtgttcatttgccacatatggtttcattaatagcaattcagcttttctctgtcccatttcaggctttacacttagagaggtaaaaccagcccccatcagatttaccatgagatttctgtgtgtactgtttgttcagaggttacctttcaacactttctaagctgtattatctgtgttaagaaatgctttatttagaattaatttatttcatgtttatggtaagtaaatgacatgttaatattatgtttgttaagaaagtatactatatccaaataaggctgttaattatctatctctaacaacaatgaaattaacttagagtcagacttaacctgaagtgaaaacacactgcattcttcaggttaacccttttggctctctttcggttctcatttaagaagacctggaactcctacctgccttttgccctgtagatgaggaattttcacctggctcctttgtctatcagccacttttgttagtcttatgaccagtgactgctggagatagagcacctggtatatgtagcatgttttctgaaatattttgctttaggttatcaattaatgaaatctccactcatgttagtataagactaattacagaataacattgagagatactaatagagaatgggtatatgcctagaaaccatagaacagcttaagtttaaataagagagagcattggaatgaggcagatacacaaaatatgatttctgctccacttctttctcttattcatctgtgaatcattaccatattataccatggcctttttctagcagcactctctttgggagtccagccaccatatgatactattcctgaaggttctattcttattctctttctttggcagaaacaccccagggagggagccaacttgagttcccctttcccaattaccttctaactatttcccctatcccacatccacagcaattcccctcaaggcttttctctgactaataagtccagatgggcccaacctccttatacttttacttttaggttatatttgtcttctatatctttaatgagctcttcactatttcacatttgcctgtgtttaaaaatgattgggagaacgcaatgaataatttccctgtacaacttttatttctgaagggaaaaccattgtgaagattgtgcaccaatgtatatagactcatagttcatcacgcttatgtgctgtctgctctccatcagtatttttcttagggttgccctgaaagtattttccccacctatgctattctaatagtcgagacatacagagtttgtctttaagatactgaatccttattaaatgtagtttgattagaaatcatgtctcggaaaatattttatgactttagatatttagtaaaatcttattaccttgtgatggataacttaataaataaaaagtcagaatttttattattaaactataaaatatttttatattgaagacatttgttctcttgctcctttctcttttaggtactaacctcagggtttggcatctcaggcatcatccacatcccgtgatcaaaccttcttatatggtcaccttatataacacagcaatgctgctggcccaatgccaacaaatactacaccttaaaaatgaaacaaaatgataaatccttcttatttgacgtgccctctaaaactagtatcgtcatatttccttagcagctggactaaggatttaatgagttgagaaagagaggaaagggttggtaggaaaactgagtggcagtgtagggtggtgcaagctgcctacatggatcagctccatcaataagcaagagatgacgatgagagcagtgcaaaaggaccaaccaggacagcattgtcagaaagtataggtggaacttcagagaatcaaaaggagctcaactcaactctttccttagttcacaactcataggattgcttattaactttaaatcatcaaacaggtctcctttcagttacctattctgtgagtcctctctaatactagcttaagataagaattgtagttttactttaatgtatcacttacttctctgtcagatcaagcaaggagggtattcagccttaactcctttaggatcttaagtagtcatattttttcttattcattctgatttaagattatgaaaatcctgaaaacgtgattttatatttcagaatagactacatgtaattcaatctgtaagttcaaggacattggaatcaatataatttatggttctttcttctcctcaacatgaataacttcaaattcagtgaagtgttcagcttttcttacccaaatggtatacttatccgattcacttcaatagttgcctattttccctttcagaaatgtctgttctctcaccaggagactaaaacattgtgcagatgtacagttggatacaatgatgccaatataatatatgcactgttcaataatttattttgtatctggagtgatgcatctgtttccttcttgtgggagggggtttgagcttcatttcaatgtcattttaggtactggtccaattcttccatccagttaaccaaaaatgaaaatttccatctgttcaattggcattcggaggaatgttttatctctgaagcacattatgacaactaaaattgacagcataatctgtctgacttttttctcttttattccctcttcagattctcttgagatttaacaagagaggattcttttttacagctcctaagattataggacttactctttcttctgtctagtaactgtagaccaatagaacatgaatggctgtccactattcactgctttattatatatttttttctgtccatttgtgactctacaggaaatatacttgttagcatgctattaacagaacaatgcaaacatagcattctctttccataaatgtctgccagtactatttggcattctgttgaatgcacagattctctgcaatcaacgtttggaaggtacagttacaggctgatttttattgatcgttccgtactttagaaaactggctaagaaggcctttggaatatactgcttctgaagttttttaactcttataattctaagaatattgtctcaagttttgttgctgaaatggcaaaaatgtttcttttttattactatcaatattccaatttaaaatttaaataaggagaactctttttatttatgagccaggtaaaatttttctggtacgctgaataaaacaaggtactatccatcaaataaagggttatatccttggggcatcatgattaggataagataactaatttttatggcagtcccctatgtgaaatgtaaatagcaatacaccagaacttcagatatgttgaatcccagaaaaatatcctggatggctgggtttctttgaaaaaaaatctatactttttttttttttttttttttaagagacaggatcttgctctgtcacccaggctggagtgcagtggcatgatcgtagctcactgcaacctcaaactcctggtctcaagtgattcttccttctcccatttcagcctcctgagtagttaggactacaggcatgtgccaccatgcctggctattttttatttatttattttttattaggagattgaggtcttactctgttgcccaggttggtcctgaagctctgtcctcaagtgatccttccaccttggcctcccaaagtgctgagattacaagcacgagctactgtgcccagccctaaaatctgtacttttagtaaacatctccgatgcctgtatcctttcttttttttcttgaaaacattgcatgatagtttacactgtaataacgaccactgcttacttgcctatcctgtaaaatatttgtgcctttatagtcctttgaagtttattaggctatttgcatctatgttatttatttatcctatgtggctgtgttcactaagttttctgtcttatttgtttttattttttctcttttcccgtgctattggcttacagatatcccttctatgttcatatatctcatgtactttcttatagcaaacatgatttcctgtgaattaaatcaatgagttagtaccatattccaattatattatgctacccaatgtaaaggataacacttaaaaaactgaaattgatttttttaataatacaagagtctgatataatggataaccaactgtaaactactattgaggagtatttcaaaagctttaattgtgaaatctactggagtatcatataagggaataaaagagcattcttgagattgttaaacattagaactgaaggattttagatgtttcagacattttttagctggaataacatgaaaatatgtatatttgtatattttatgggaggctgagtaaatttaagtctactattttaggtctttgggatctcactgagaaattctccagactagcatggtaactggcacttttacaggtaaataaacattgtgactctaccagtcatagagagagacatggaaggagctgtttcagatccaagacacatacaaaagaagttaaaacttttctgagataaagtgaattactcatagcattgacccaaaatagtccatttaagcccctagaactcttaatccagcaactggaatactaaatcctatatggctataaaatgtactttcacttcaacagggcttgtaaatttattcttttttatttatttatttatttttcttattattatagtttaagttctagggtacgtgtgcacaatatgcaggtttgttacatgtgtatacatgtgccatgttggtttgctgcacccattaacttgtcatttacattaggtaattctcctaatgctatccctccctgctcccctcaccccatgacagaccccggtgtgcgatgttccccaccctgtgtccaagtgttcttattgttcagttcccacctatgagtaagaaaatgcagtgattggttttctgtccttgtgatagttggcttagaatgatggtttctagcttcatccatgtccctacaaaggacatgaaatcatccttttttatggctgcatagtgttccatggtgtatatgtgccacattttcttaatccagtctatcattgttggacatttgggttggttccaagtctttgctattgtgaatggtgccgcagtaaacatacgtgtgcatgtgtctttatagcagcatgatttacagtcctttgggtttatgcccagtaatgggatggctgggtcaaatggtatttctagttctagatccgtgaggaattgccacactgtcttccacaatggttgaactagttcacagtcccaccaacagtgtaaaagcgttcctatttctccacatcctctgcagcacctgttgtttcctgattttttaatgatcaccattctaactggtgtgagatggtatctcattgaggttttgatttgcatttgtctgatggccctcaatgatgatgagcattttttcatgtgtctgttggctgcataaatgtcttcttttgagaagtgtctgttcatatcgtttgcccacttgttgatggggttgtttgattttttcttgtaaatttgtttaagttctttgtagattctggatattagtgctttgtgagatgggtagattgtaaaaattttctcccattctgtaggttgcctgttcactctgatggtagtttcttttgctgtgcagaagctctttagtttaactagatcccatttgtcaattttggcttttgttgccattgcttttggtgtttcagacatgaagtccttgcccatacctatgtcctgaatggtattgcctaggttttcttgtagggtttttatggttttaggtctaacatttaagtctttaatccatcttgaattaatttttgtataaggtgtaaggaaggaatccagtttcagctttctacatatggctagccagttttcccagcaccatttattaaatagggaatcctttccccatttcttgtttttatcaggtttgtcaaagatcagatggttgtagatgtgtggtattatttccgagggctctattctgttccattggtctatatgtctgttttggtaccagtaccattctgttttggttactgtagccttgtagtatagtttgaagtcaggtagcgtgatgcctccagctttgttcttttggcttaggattgacttggcaatgcgatctcttttttggttccatatgaactttaaagtagttttttccaattctgtaaagaaagtcattggtagcttgatggggatggcattgaatctataaattaccttgggcagtgtggccattttcacgatattgattcttcctacccatgagcatggaatgttcttccatttgtttgtatcctcttttatttcattgagcactgatttgtagttctccttgaagaggtccttcacatcccttgtaagttggattcctagctattttattctttttaagcaattgtgaattagaaaactgtgtttaaaacatagcgtattgttaccagggatgtgtctagagaatgtattgcagtacaggtattaccatctagttagttaatattgtaatgaaaacttgagcttttatttacttaaaattaatgatcattttggtcaaggcgtttgaataaccagagcttccaaaaatactagtggcactaagtctctggttttggaacaatatagtagaaagaagctgtcaatatttatctcttaaagaacggattttttttcttgtaaatttgtttgagttcattgtagattccggatattagccctttatcagatgggtaggttgcaaaaattttctcccattttgtagattgcctgttcattctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccatctcttgtttttgtcaggtttctcaaagatcagatagttgtagatatgtggcgttatttctcagggctctgtgaaaacaaacaaccccattaaaaagtgggcaaaggatatgaacagacacttctcaaaagaagacctttatgcagccaaaaaacatatgaaaaaatgatcgccatcactggctatcagagaaatgcaaatcaaaaccacaacgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggcaattcctcaaggatctagaactagaaataccatttgacccagtcatcccattactgggtatatacccaaaggactataagtcatgctgctataaagacacatgcacacgtatgtttattgcggcactattcacaatagcaaagagttggaacgaagccaaaggtccaacaatgatagactggattaagaaaatgtggcacatatacaccatggaatactatgcagccataaaaaatgatgatttcatgtcctttgtagggacatgcatgaaattggaaatcatcattctcagtaaactatcgcaagaacaaaaaaccaaacaccgcatcttctcactcacaggtgggaattgaacaatgagaacacatggacagaggaaggggaacatcacactctggggactgttgtggggtggggggaggggggagggatagctttaggagatatacctaatgctaattgacgagttaatgggtgcagcgcaccagcatggcacatgtatacatatgtaactaacctgcacattgtgcacatgtaccctaaaacttaaagtataataaaaaaaaagaatggattttcacatctctcaaaccttgataattgatgttactacaaagaatagtctttgtaagaaagattaacaagcaagtgtatacagatagcaaaggcatttattcacattcttagttaataacatccaaaatttgtatggagctttacagcctttagaatagttcatccacaccttatttctctcaatgttcaaaacaatctcaaggtcttaggaaaattgcttaaatgcactgagcttcaatttcattccctataaaatgcggatgatttcacctatcttgatgcattgtgagtagtaaatgagtatgtaaagggcttggtgtatcagtattattattaccacctttatctttactttcatcaaccatttgtggcacatattggctggttaatttagttaataagtgacagaacccgaatgtaaacatagatccttctcattccaaatcttatgtttgtttctttctattatctcttccatagaggcagatcattttaagctctgtagaagaaatattgactagggccttgaaggatgaggtttgcttttgtagcatccaaggctttttatgaactaaccgccttccttgtctgtcttatcagtttttcttcttttattatttattttcccaagtgtgtcttctatttgaggttcttaattcctgccgtttttgtctttgtacattatcatttctagggggcatgtaaatcttttactgtggtcttttctactaatccgtatctattattgttatcttcatagtttacagtgatttcctacatttttttaaaaaattgaaaatcgaaagacaacattctgatattttctacattttgtaaaaactctttaacagcgttttcagatcacagaatattttaggtgttataagttaaatgtattctgaagccaaataagttgagggaacaatttgttgaacagagttaaataggttatctaacaaaatgcagaacctattggagcatttaatttgctattgtgcactggaattctccaagagggaaagtagaggtataggggtatagtaggcaggatatggtatgtaacatctcctaatctcaccaaggaatcaaccccctccctcaagagcatctcaagagattaattcattggactgcccagatttatagcaatgatacttagaatactcttgacctgtgacatcagaattaaactaaatcaattaaatttaaagttactttttaaatttcaagattccttggacctaccagtcctactaaaacagaatctttgagaagtgaaataaaatgtcttgtagtttttctttttctatctctttagtaattgggctaattagagctctgttctcagctaattactagtcgtactgtacttcttcaagtcatggaattcactctcatggctccagtgctgattgccctaaagcaaatcagatccattctccctatgttctgattccagacacttaaagacaacagcttacaatcagatatttaatggggcctcagaatcatcagcatgttaaaactgaaactaattattcccttcctctaaaaaaacaaagcaaagcaaaacaaaaaactccacatctcctctagtatttcttgtcttaataaatgatgccacttccagctagatgtccaagtcagaaacctgagagtcagacttaactctttctgacttactcccaatgttccttcaattgtctgtcaattagactttgtaacaggctcttgaatccttccacttctctctatcctcagtacctctaccctggtctagtcatctgtcactttctcctgaactataactacctcttgattttctacctccaaccttgttctcctgtaatccaggcttcacactctggtcttggtgagatttctgagtttcaaatctgattatatgactgtagctttaattcagtgactttgtaccatccttaggatcaagtctaagctgctgaatttaggaggcattattacaaggtgtctggtctctgcctttctgacaagtattatctcactctactcttccctttgctctctatccttcagcccgctacagcttcttcaattcgttttctgtgtatcataggtctttacacatgttttgcttgcctctagctaccttctcctccttctctcctttctgcattcaactcttccatttagctaacctctcatcctttatctctcatttaaatacatcttccctggggaggccttccctattttctagactgggttagaatcctgtgctatatgttctcatagttcttttttgtacttgtcttaccactctctgttattacatattttagtggttgcttttcactgtgggcttgctgtggcttatgcagctatttgccttgcattatatattcatcccttcttctttcagtaataagaactctaatttttagctggacatattgccatatagcaaatcactacattcgctcttttctgttacagctaggttggctttagtattaaattttgggcaataagatatatgttgagtatgacttctgtaacgtatcactaaagggaaagggcattttcttcttttccccttcccttttctcctgctggctagaatgtgaatgtgctggctggccttttggctggccttttagtagccatcctgggtcatgagatggcgctgtaaggacagcagagtagccagatagaaggagcctgaatcccttatgattatggatctgtcaccatttgagccctggagtcttgtcctccatatctgctttatgtgagagaaaaataaatatctctcttaagttagtgttacatagttacttccttatgtatttttacttgctgatatagctgttcttcatatgaggtttttcctgtgttttcgtaattctgtgccttatgagtatttttgttaggaggcagagctctccccgctgcctccccagaggaagaactgtgtactcatgcctccagcttcccttgtagccaggccatggacatatgatctagactcaaccaatgagaagtgtctgccccacttttgagttcatgagttagtgatacaaataaataaatgggagcagcagataattcttcctggcagtggttttagttgggtagaacatttaggggaagagggaaggacgagcactcaagcttaggcatcacctgttgtttagtgccagggagattagtggtgcaaattgtaatatctgttgctgcgtggtggctgccataaggtaggtcttcactgaactagttctgtggcatcattttcagtggtttcctttttcatttcatagcttctgaacctgtttcttcagcctcccaacaattatgtgagccatccaacatctccttttaggtttaaactaagcaaacgtttctattgcatgcagttaaaatcctctactgataacgttatcattggtcttccctggcaggttgtagatgctgtgagggctgtcttactcatcagtatatcctcagtgcctagcatctcgttatacccgaactcaatgcctggcacattaaataggtgtttagtatgttctcttttttaaaaaaaataaattagcagtccatgcctccaatatgaactttcttacctgctctagcatgcttctagctccattaatctactcatactgcttttgataagattactactggtaacctgtttgctgaattcagtgaatatttttcacaactcaattaacgtctttaaagctttgataatgctatttcttccttattctcattttaccattcacactgttttgttttgttttgttttttaggtttctcaaactattccttattatctgtcagctctcacatctttatgttcctccagatttctttcttcagctcacccatccctctggcttcagttgctgtatatgatgatgattttcagaccttatctccacccagacctctctcttgagctttaaatcagtgtatccaactgcctactcagtatttccaccaagatcttctacagaactctcaaattcaacattttttacatgtttaaaattaaatgaattttgttgtttcttcccaacagacaaatattgaagacatagctattacctaaatcatatggcttactctaattttcagccgattcactgaaattaagtaaatatgcatgtgtaaattcacaattaaaatttattctgttattttttccttttccaatctagtactttatgattttttaattagtgtacaattaaaactgcttataatttccaaaattctgcttagtgtcaagactttactattgaatatagacatgttgaataataatatatattagtatttcatgttgagtaaatgtaaattgtagaatacatttggatctatatttctctactttgaaaaatcatttaattaaattttaaacaattttattatttttgtttaatagaatttttagctttttctaactagaatgaatattttagctttcagaaaaatataaaacattttacaaagaaatggggcaaagtaaatgaaaaaatagtcaaacaaagtcacatttatttcttctatagtagtttcacctataatctcatttattcactttgacattttcaattaattgttttgaaaattgtaacaataatttggtttaatcaaatttgtatcttgcttgaactctctaagtagcaattgtgtgaatagcatgacagggcaatttcagttaaaaacttctccaacagtttggttaccttggaataaaaaaaaattatcttcatattggggtactattaagtcacataaacaaataaaaatgattgttagtgttgcaagcattcaaagagagaagttgagaaaattattgaaacttggagagtagcttttttaaaaaaaattaatcagccccagggaacagctgataaataaaaaatatggtagtacaattttgttcatttgaaaccctcaagcttaattaaatttttttttcaacacttaatttatggaagagcaattggagcttttggattttaattttgtttaatgtcttttgttcaaaggtacataaaaagaaatttttccctttataataatttctttcaactctcttaaggtattttaagattttttctgtgttatattgatttaatgctttgtgccttatttggattatattaaagctaatggatttatttctaactagttattcttttttattggacatctgcctgaatgtttgaagattttgaataaagccagttttaaaaaattcactgctctgaattatataacattgaatgtgcttctctagtcatgtattctctgtactgttggttgtgcatcactggagactcagccaagatatcttttggtcctaatgttcctaactttatctcctttttttttttttggtagagttaggaattcctagtttaggtgaaaaagaatgtgtgataataaaataagcattcaacatagtagtttagagaaaacaaagatagaaatttggaaatatactaggaaattcctgagaagtaatttatgtgtaggtcatgtgcaaagcacctttatagacacgctaacttatatacctgaccttggagtaattcctattggagattattgaatttgattgtaggtgtggtaccatgggaaatacatatttaatttttgtctccagtttctggcacacagctcctaaaacccttggaatctctggagtgatgagagtgtttcttgtatgctcatgagatggctggtggcaagtgtcccctagatagtttaagaatggggctggtccccagaaagaccaagacatgattaagatggttgagatttacagccttaccccctcaatctctggagaggggagaggggctggacgttgagctaatcaccaaggccagtgatttaagcaatcatgcctatttaatgagacctccgtgaaaacccctaaatggcagagtttggagagctttcaggttttgacaatagccacaagttggtgaacacatctacatgccaggagggtggcacacctcagctccatggggacagaagttcttgtgcttggaacctttccagatttcaccctatatatacctcttcatctggctgttcatttgtatcctttattgtaagtaggtggtagtgaataaattgtcttcctgagttctgtgagctgtgctaggaaattatcagacttgaggagggagtcctgggaacccctaatttataactggttggtaggaagtacagatggcaacctgggacttgtgacctgtgtctgaagtaccaatagtcttgggacgtaacctatggagtctgcactaactcctaggacttagtgtcataattgaattaaattcaattttaggacacccaggtggtgtctggagagttgaataattggttggtgtgaagaaaacccccacatatttgattccagaagtttaagtaaaaataactcagagtaggccattctaacatttttgttttggcataattgttacccttatttgcagctttttttgaaacactaagactgataaactttctattgtcagttatccatataacagatctttggttttataagttttagaaagttgttaaactcttaactatatatagggagaagagaatatcttttgcatatgtttaatatttattcaacacccatgatataggcattaaataataatgcagaatttttgtttctcctttttcttgtttgttacctcttgagactaaattgaagtcaaagaactatcacaagcaaggctgacttttgggacattggcttcgttttgaagtaggcatgcttaggcatgaactcctattaactctgaaagtaggtcatatctaatggtagagtcttttaaaaatttcagtgactaaaacaatatatacttatctgacacactatttttaattacttaaaaatgttactaaatataacacccaattttttaaattaatttttttaatttttcagacagggtcttgctctgttgcccaggctgaagtgcagtggcatgatcttggctcactgcaacctctgcctcctgggttcaagcaattctcctgcctcagcctcctgagtagctgggactacaggtgcatgccaccacatccagctaatttttgtatttttagtagagatggagtttcactatgttggccaggctggtcttgaactcctgacctcaagtgatcctctcacctcggcctcccaaagtgctgggattacaggcctgagccacctcacctggcccaatttcttatatttctgtatttaatatgaaagtcatgaaaacttaatgattgttgaaatatttctggatgtcctttagtactaagaaatctttccacattagtgcacagaaaattctgcatgtcagaatagcaatcagtactgtaaatttccaagtttctatttaaaaatgattaaaaaatctgaagcaaaaaggttaaaaaccaacaaaaataattacagattatatatagtttccttgccctgtcttatggtggtgattatggattatattttaacaattagatgtgtggctaacagatttgtgttttaaaaaagacttatggctgggtgcggtggctcacgcctgtaatcccagcactttcagaggctgaggcaggcagatcacaaggtcaagagatcgagaccatcctggccaacatggtgaaaccctgtctctacaaaaaatacaaaaattagctgggcgtggtggtgcacgccttcaatcccagctactcaggaggctgaggcaggagaatcgcttgaacccaggaggcagaggttgcagtaagccaagatcacgccattgcattccagcctggcaacagagcaagactctatctaaaaaaaaaatatatatatacagaggtaaaatgatttacctttgggatttaaaagtattatagacacatatatatttggcaccctttttatataaaattcaaaaaggaccaaaggcggcagaggaagggagtggtatgttatataagatgaaaaagcaaaagactgaaattacaaaactatatattgggggacataaggctagtttcaaagaaatcctgttggatgattgctttcattgtatgcgtattgaaattataatgcatttctggtaggtggcagccatgtagcatgaaagctggtaaataactatgtggttggaaaactatgagataactgtcaatagggaatttgaagctttcttcttttttcactaattttgccttctaccacactaatatattgtcttgacagagtatatttcttaaggtggagataaatgcttgagtaattactatgctgtcctccgctattgtggtaggagtctgtgaaacagttctctccccaaagcctgaggatcccagatcaagtgcctctgttttttaatcatctgaatgtcatgtaaagtggtcaaagcttgtagttttaggcatcaacatggcttataaatctcgataataattgagtctcagtttaaaggattggtaggttgttcgtgcctgtgtaaccttgacctctcattgtacccttgatgtatctgggatatccagcacctggtgcctggccacacttggtaagatcaggcctatcccgaagaaagtagtcatccttagtattctcaggggattggttccaggcttcacaaggattccaaaatctgaggatgctcaagtcccttactgtactcgttttctcttcttcatttttaaactcaacatttgcctcaaatcaaaagcatattcctttctctacttttcactcttgcttttttctattcgaatgagatagaggtaggcgtcaaacagcttacaataggtagtaagttctaaaataactgattatgtcctaataagatgattttggaataagacaaattcatactgatgttatgttgacagggtatattagggcaaaataaacacctcagactcagagaattaagcatgggagtcctttctgtattaatctaaatttaaaaatctttgtagaagctttgaactaaaaatgtaaacaaatagattattgattcgggttttctttgggcacacttttttttttaattaattgacttttgctaaattagataactttgtagaatgtttgagacaaaaaaatgaatgtatgattttatgtgaaatttcattatgtaaaatttcagaaagcaaaagtgtgggttttcagtggtgtggtggagccagcttgcaccagcccgttagaactgattggaaattttgtaaactagttgttaaatataaacattagtaaaaattgaagtagctgggcagggtggtatgtgcctatagtctcaactctgtgaaacacacaggcaggagtagaggattgcttgagcgcaggagtttgagtttagcctgggcaacacaggggagaccctgtctctttgtatttatttatttatgtttttttttgcgatggagtctcactctgttgcccaggctggaatacagtggcttgacctcggctcactgcaacctccacctcccaggttcaagagattcttgtgcctcagcctcccgagtaactgggatgacaggcatgcgtcaccacacccagctaatttttttgtatttttagtagagatggggttttgccatgttggccaggctgatcttgaactcctgacctcaagtgattcgcccacctcggcctcccagagtgctgggattacaggcgtgagccactgcatcctcatattaacttatttaattataagtacatacaaaggtagtaaatacttaaaactcagtactttctaattagcttactacattttactgttatctatgctcttgaggttatttatgcctatcatatttatatggtaaaataatatataatggctggctaccgggtgtgtcttcctaacttcacatttagtgacatcatgttagagcctgaacttagccataaaagagtatttatttaaaccacaggaattggcaaatgctacaaatcagggcttaatttattcttttgttgattgtgcttaaggaagtgatagagaaaatgttaatgcatgtcgtgtctatagtcattatattctgaatttcacaaaaattaaggaaacagtcttccaatattcaaataagtttaatccaatcagtatttatgttggaactgtgcccagaagattattaaacatttatcattataccactggtttaagttcatcaaattttattaatgttttaattaacaaattagaatttaacataagtattttaagctatataaatggcaataaaatgtatttttatttattcaataccagtttaccacttagaacatgagatgtatttatgcatttataataaaatgtagtttgtagtgttcttaaatttgtatattctcattcacctctatatggaggttccctaagtgactgataaaagtaatggaaactttaaataaaaacagtgacagcaaaactgaattttatactagagattatgattccataggcttatggatggtttaagagcctgcattttattgcatatcttatatggatgttattagaataccattagcaatatagtgaaaaactttttagttcctaagaaaattgtttccaaataaaatatcaatatgcacacacaaaaaataagtcttaagatttgttttcttgtactgactgtcattttagagttctattaccttatgtgggtaattctcattctctttaaaagcctgtatttcctcatctgtaaaataaagacattatgctagataatctttgaggtagaaatgatgattatcaaaacgttacctttcatttatagggattaatttttagtgctgcttctgaatccactgagtatcttatcccacaagaaaattgaaggattgtaatttttttcacttgtttctttagttgtattatggggataacaatagtacccatcatcatagtgttattttggagattaggcaagtaaacctgttagtgtttagaagaatgtctggcacatagtaagtgctgtataagtattagctgctattctaccttcttcttgttttccctcttctctccttttccctatcttcactcccctccctcattttactcttcccctttccttggagggttgatactaaactacaactctttttcttttgtacaagtagaatattaataaatattcttttaaaaaatgcagtacacttcaataagttcataacaaattaagaaaaattttaaagtttcttagaaagactattttttttccagcaacaaggcaatctaatgtagctaaaaaaccctcctgctataaaataccccgtagtgctggataaaatataaattttgtttttttcaaacatccagcgtgagctttaagacaataaggaaaatacctggtttttaaaaaatgaatgatttttacatatattcttataaatgagatgggccttacctttttcttgtactggcctcttctgatttttggtatcagattatgttcacctcttaaaaagagctgaatcatttccttctttttttctattctctggaacagattgtgtaaaacagaggttagatgttcctaagtgtcctggaaaatttaacagttagatattctggtcttggtgttttttacagaaagatttttgactacaaattcaatgtctttaatagtagcagattctatttagtttctctaattcttctttgatccattttgataatatatgtattttggaaaattatactgtttaagttttcaagtttatttgtataacattatttattgcattctcttatgctttttacatatatttgtaaattcctaacactgccttttaaaacttgaccaattaataagatgtttgtctataattattttcaaagaactagcttttaattacatcgttttttattttgtttcactaagcaataattgtcctcttttatctcatatattctactttctctgtttccttttcccaccaacccccactggtattatttttctgatttcttgaattaaattttagataatcagtttttagtttctttgttttctgttataaacagggctgtatattttactataaataataatttagatgcatctctgaatatttgatacatttatgctaggcttctctgataagttttaattatcttataatttccattctgtcttctttgacccatgaattattttgaactgtgtgggttttgttatgtgtgtgtgtgtgtgtgtgtgtgtgtacacatgcacgcatgtgtgtgtttaagagatgaggtctcgctgtgttgccctggcaggcctccaactccagggcttaagcaatcctcctacttcagcctcctgagtagctgggagtatgatctttatttttttgagacagagtctcaactctgtcgcccaagctggagtgcagcagcacaatctctgctcactgctcactgcaacctctgcctcctggttcagtgattctcctgcctcagcctcctgagtagctgggattacaggtgtgtaccaccacgcccagctaatttttgtatttttagtagagatggggtttcatcatgttggtcaggctggtctcgaactcctgacctcgtgatccgcctgcctcggcctcccagactgctgggattacaggcatgagccactgcgtccagcctttttttttttttttttttgctatttaaagaagtttccaaatatattaggaaacttgatttggtgttacttttattactcgtttctcatttctaactttgtggcatagtattagtttcctattgctgctgtcagaaattactgcaaatttagtggcttaaaacaacacagatttattatcttacagttctagaggtcagatagccaaaattagtctctctgggataaaatcaagttgttggcagggctgtgtttcttcttgaggatctagaggataatctgtttttttcccctgttctagcttctagagcctacctgcattccttggcttgtgatccctttgtccatcttcaaacagatctgtcgctgactctcagacctctgctcttccctcacattttctgtaactctgacccttctatctccttctataaggattcttgtgattacattgagtccacccaggtaattcaggataacttcttcatctcaaggcccttaatttagtcacatatacaaagtcatttttgccatgtaaggtaacagtctcaggttccaggaattagtacatagacatctttaggacgcccttattctgtctattcacattatttatatcattttccttcccccacctttcccactctgttgttttggatgttatacattctgtttcttttccttggtattgatattatttatgtgtttaacagtatttaatattatgcctttttacctttgcataccatgctcatttgtactttccttgcttgtgttgtttagcattttagtttccctttgtttctaaatgccttctgcattaatcaggcttctctagagaaacagaaccaacaagtgagagtgagatttattgtaaggaattgtgattgtagaagcttggtaagtccacaatctgcaagataggctggtgggcaagagacctagggaaaaattgtggttctaaagatattatgttggcaaaattccttcttgttcaggagaggttgtcctgtctttgttctcttatggccttcaattggttggatgaagcctgttcacattatggaggttaatctgctttactcaaagtctactaattaaaatgtcaacctcatctagaaaacaactttacagaaacatctgaataacgtttgtccaggaatctgggtatcatggcccaaacaaattgacaaaaatgttaactattactctttccaagttacttagtttttctgttactgttattatcaatattatgtacttatttaactttctaatgtgtttaccaatatcttttctcgtaacatattcttgcattccattctcctttctatgctcagttttccttctttacacatatatttcccaagaaactgggagaaataaattctcagtttttatttgtctgagaatgtctgttttcctcacagacctgaatgatggtttaatagggtatagaattcttggataacacttatatttccttagctctttgaggatattattctgttgtttcctagcatttgttattgcgtatgagacatctacctttaattatcttttctttgtagataatctgacctgtcctttgctggttgtttttaagatcctttctttgccattagtgtttttgttgttggtggtggtgatgttgtttgtttgttcgttttgagacggagtctcgctctgtggcccaggctggagtgtagtggcgtgatctcagctcactgcaacctctgcctcccaggttcaagcgattctcctgcctcagcctcccaagcagctgggattacaggcgcatgccaccacacccagctaatttttgtatttttagtagagacggagttttgccatgttggccaggctggtcttgaactcctcacctcaggtgatctgcctgcctcagcttccctaagtgctaggattaccggcgtgaaccaccatgcccggcctgcctttagtgtgttacattttcactgtactttatttaggtatgagtttcttttcttttaatttatttattctgatttttgtttttcctagacccgggaagggattcatgtggctcatcagttttggaaaatgtcagccactgtcttttcaaataggtgttccccccttcttctgtcatttccttctagaatgcctagtaaagatacagattgtattctgtcctccatatcagctattctaatctgtcattccttgaggttttctttttcttaagtgatttttttttattgaatttctctttggttcttttaaaaatattttagttcttttttttgcataaccagtgttgtcattgtggcttttctgtctttgaaaaatcattctaaacatttttactggtttagtcattttcagattctatttatagttttagattattttatttgtagtatttgaagggtaatttgcctatttattacatcagctaaagctttctcctcgtgatggtttcttcaatttataattttttattatgagctcatctttactagggactatgtattctatggaagtccagtatagtatgtgagtatctttgtgggactatttacatctacatcttttggtccttaaaaatttcaagggtccagtcagattttatgttacttttaaattttacaccacggaattatgtaaatttaaaaccctcacatatataggatactcttgtagagttttttatgttttagtggtgactgttttccctctctcattgaaggcttcaaattaatgactggcttctttcctcttagagttcatgggccacgtttttctagttaatttttcttgagtagcacacctctttgattctgtgagctttaggtggatgctcagttcttgatcccccacctcacatcagctatgggtatgttttcactcctgcaagtgatttaaaggtgtatgtccaagcacttagcccttaaagcctagagctgagtttgaaaccccggggattgctacagtgtctgtttaagcttatggctctggctttgacttctatttgtttccagcacttgaggaatttttgtttcttatttttagcaaagtattattttgaaagtattttatccagtatttctctgtgtttggagcaggaaggaagcccttacatattggcttggactataccatgttataagaattttctgttttttttaacattgatgtaatttgattgactcttaatttctttctattttaaggatattggttgattctctaatagctttttaaaaattctgttttgggattgttttaacttttcttttccctccagtgcgtttttcaaacattttttgttttgtgtgtatctggtacctaataaatattcagtaaatgttttctaagtgaaaataagtcaaatgtttagtttgtgccaaaggacgttctaggtgattttaataagtttatttgttttaggcctcatatatgttaagttagactgatagaccctaccaagttataaaatgataataataatagtaataataatagcttcaaataattataagacacgtcattttcattctaaccctgcaatatgtagtattattatcactgttttactgttgagataattgagaaatagagaaagtaacttatcccaaatcacatagttagcacatggcagagctctatttaaagtaagtctggctccagaggcttgtattcttaatcattatactgtagcttttatatcctgttgagagatatccttgattattattatacctctgcttaaaatattttcccactgctttctggataatgtttaaataaacattttattatttaaaaaataaatgtttaaataagtatttaatattctagcctaccttattctatcatactacatatcagccttgttctctgtttccaattgctaacagttttccaaaggccctctatttcatgcttccatgtgtttaattgtattctcccctctgcctagaatgtctctccttctgcttctctcctggctaactcctatacgtccttagaaactacagctctttttgaaagcttctataactgcttattgatatagctgtccctctcttcagcgttcccctaaatttgtcctcccataatgtgtcagcttatagcatttattttactatgttttaatatttttttttctttttgcctctcaactaaactgccttctctgaggtaaaggactgtattctgcacatctccataaccccatgacctcataaacataactggcacataggagatgttcaatatatatttattgaatgaatcgataattgtgatttcattacttgttttacagatcatccgtaagatttgtctactgcattgtcttgttgaatttttaaataggactatgaattattttgttagtaatattaataaaagatgtttataaaaacaagttagtatcttggaatacaagttacttaatgaatttcttaagatatcttttttaaacatataacatttttgcttatttagttgtgaaagaatatggtttctataatagtgtgttatttaaaagcagttctatttagctatttagttgaaaatgattctttggtgaaaaattaactctgtaaatatgtattaagaggaatgcctgctctgttttgattctatgttttaatatttttactcttggcaatatttaatgaaaatgtgtctcattaaccttgaagttactagtcattattttgtgactgcttttgatttatttactgtcttgacttcatatatagaaaacactaattttatcaaagcttattgcattgtttaccactaattacaaaataaataagtaagtaaataaagatcacatagaaaaaataagtctcttggggtgaaaatttatttgtaaaacatatattaatggtttttatatgctcattttcttataataatatagaaaatttaattgttcacttgggggcagatgttttatatcatggctttttaaaaaagttaactctttaaatggaatgaaggaataggagaaaattacttgtttgagccttatgggaaatatatctgagatagcactattttgctgcaactgaaattcaaacatgaggaaattgcagaaatttacaattcaatatgtgtttcatcagggagaaatccacagattgttttgacactcagttagaaattcagcatgaagatggacgtctcatgaaatttgcagctgctgattgaatttatatttccataaaggccatcaacagtagcagcctgcaggggaggaggggggagaaatgacaaaaatcgtgaggctagcatttttcctcagcattatagtcacaaattactggtaataagggtttacactgaccaggattaaagaaaaatatagacagccagagggaaggacttctcagtttaattgattttaactaaatatgtccacatttgatatctaaatatgtgtttagtcatttgtagaaaatctaatatgtgtgtaaaaatcagtttatctttactatttaaacagaaagaataagatagctcttgaagttaaaaaaggttgtatagtacaggttttcataagagcctttcaagatagaagatgagtattgtaggaatataatacgagcttgttttctatgtcactgaaataattatttcatgttcttgcaagtaacctacagttgatgtttttgagaataacaattattattttaaaatgtgttttaaaaattttttgaatggatatccaaataatagtgacagagaacaagttaccttttcaaggaaattatttcattttcaagtgtggtgggttttttatttttagcaaaatgtacaaaaagttctttcttttgtttaatgcatatcttgtggagatttcatattatacatgattttaaaatattcatggattgtaggtgaactgaaggacttaggagtgtgttcattgttcctgcagagttctttgtctctgtgggcagtgtgtacttttaaccataacaggatgccctcagatagctttatttgaaaattagaattttcacaactatatgtaaaaatattatccttattaagaaaaattatatttaatttaatattagtttataaaaagtgagaacattacccagaaaacatgtaaattaaattaagtgttggtctttattttttcacatactcaattaagagtttaagaacatagtgtaactgattacagttgttttgttatgtttaattatatttgagaccatctaatttataaactattgtaattggaaaagaagagtatatatttctgctacctgtgcttaaaaggtacacgtggactttttttttttttttgagtttcagaattttctttaggtgttaaataagcataatcaggctagattacaagaatgtgcttattcttctaggagtctataaatgcttgctttgtcaacatcacttcctattgttttactttctgtatgttaataccaaaatctaccagttaaatatattttgactttttatacattggtttacaaaccaaagcaaaactgttttgtgagagaagtaccactgtgtccaacagataaagtttgtaagtatttggaaaaacgattttctcatttgtgctttcctttcacagcattactcaggcatacacattttaggtcattcatgtaatccagacttccctctctttctttcttccctccttgcccaccccacttgagaatttgctattttcaacattccaaaatatattagcttaactatttaatttactacttattaaaagcctcctttttttcttcttatcagttgctgtcaatttcatcacccgatcaaatcaatgtctttatttctcttttagcttgttgtccctgcccatatgtattttttgtttttatgtatgagatataattcattcactcttgaatcaacagatatttattgactgccatctttgtatcagacattattttaggttctggggatatgttaataaacaacacaaagccttctttccaccttcatggagtttgccttttagtaagagacacaagcagtaaacaaatgagtatataatatgatgtcaagtagaaatgtgcaaaacttacagtgccaggtaaaaggctagaatgtgacaaaattagagtgcagcaactacataataacttccagaaggatctctctgaggatgtggcatttgaaaagaaacctgagtgaaataagaaagtgagtaacattatagagttctacatattttcctttttctttatagcatgaacatcccccccaccacaatttgctatgtgcatatttgttttcgacttatccccttctcttatcacattcaatattagaagtctgaaatgatgcttctacagctcccatcacttctccatgctcataaaatttctatattcatatacagatacaaataagattttctggaaggggtattatttgtcttttacaaaaatggtgttatcctatttaccttcttcaacacttgcatttcttagtaaacagtaaataataaacatcacttaggtcggacctaaagtattattgttaataactgcatattttccatagtatggatataccacagtttatttaacctttgattaatgtattgatgaacattttagttgtttgcagtttttttctactaaaaatgatccataaacatcctgtacaaatatccttttcaactcatgcttttaccttttgtaacatgaattcccagaaatggcattgctatggcaaagaatatgtgtaacttttattaataaatattaccagagtactttccaaaaagaccttagcagttcacattctcaccaacaatgtaggtgagtgtctttttccccacagctttattagcactaggtaactttgttttatattttgtgtattatctctgacggtttttaatccatctgtcatctatcttcctgatgctcagtttatgtgtacactaggcttactctttgcagtcttgtggcttactctttgccgtcttatggaactctgtgcccttataaaactgtacagaccacttttcagcaatcttagcatgttgtattttagttacacatttaagtgtatatctttacccactctgacccccaacacctaaataacatgaggcctagcacaaggtagatggtctaggtaaatactcactttcaaaaccaaatgtatctggtggagaatactgataataggataggctatacatgtatgggggcaggtgatatatggaaatgtctccacctttctctcaatttggctgtgaacctaaaactgctcaaaaatatctttaaaaataaaaataaaaggtacaagattttttgattgccatgcgtgttgaattactcgtgcaattgatttctctgtgtgaaagcagatgagcaagagttcactgcattttaaagttgttacctgaaaggtcaaatgtattccttttttgacactatttccatttggggtttaagcaaacatttatattaggttgcacattactgtgttcaggatacagttattatatttatcagattgttgccagctactctgcattttttttcctggctctgaaagcacatgcatattctaggcctgtgctctgaaattttttgaagtactattgttgacatttagagcattctgtgctgcaagtgtcttcaccccagaatgcgacgtgcaccagtgaacagaggtcaggcaaggcgaaaagttgtttgtcatctgccaagctgtttgtaacaaccagataaaagtatattcctattttcagatttaaaatgtaaacatacatctctagtcccaaccagtctctttattttggaatgttaatgtagaaatgtccccttgccggcagctagcccaatcttcttttcacagtcacccgttccagaggttatgtttatagctagaaccagtgtattttggcttttgcctttatttattctttatgagaactgggaactatggtgacccagcaaaagcctgggtgaccatggaagtagtctgtattagcgcctggacaccagagaaaagggaaaatgtgatcctcattcagccctggttgatagagatcatgcctttaaatggtcagtctcaaagacattcagttgtcacaagtgcagatttaccagttggcagttcagattgttactgtacagtgagtgtgagggtctttagaactggttttagtaatgtagcatatatacaggaatcttaggggatgtgtcatactgttttcaatagtcagggatagcatattggttaatcccaggcacttctgacacatatggttctgattgtgtaggcagaatgggcatgacaaggagggaaccttatcagctctttaaactaagtctgggttacattatacagaccatccaattctttgccctcctattcccattttctcattccccagtttattcattcttaccattttaatgaaaatggtaagctctgctgtcaacaacagatctcagctcttggatccttttattggatcttactatttagtatggaccacttttctttttgaggtatcaactctttaatttaggtcttttatatataaaaccattgattttgttttcaggttagttttctgccttagctgttttctttcttagcattttaaaagtgtgaagtcaatctattttattaaaagttcaatacatctaaattcacaagtaagagatgttatgtaatgtctggatagtgtaatgattatttgtttctggtttcctcttctttcttctttcctttctttttaaaaaatacttaaaagcatatatgaagattacttacaattcttcatataactaatgaggtcttctgcagcaaaaggccaaccagtttacataatataatctttttattttagatgagaacgttgctatttcctgaacctacttctgctcaacacctatttctcttttagttaccatcatcctttgccttaggtatcccacctttctattttgttaacttttttctctggtcatatcaccagcatctcttctggttagttcctttggctgcttttttaaacttagttttatatagactccttgagagtattcgttattcttatcaaccacttgaactcagagttattgatatgggcggtaggctctttactcttagcagccatcaaatcactattatgttttctttttttaaattattatactttgagttttgggatacatgtgcagaacgttgcaggtttgttacataggtatacacgtgccatggtggtttgcaactcatcatctacattagacatttcttgtaatgctattcctctcctagtcccccaccccctgacaggccctggtgtgtgatgttcccctatctgtgtccatgtgttctcattgttcacctctcacttatgagtgagaatatgtggtgtttggttttctgtttctgtgttagtttgctgagaatgatggtttccagcttcatccatgtccctgcaaaggacatgaactcatgcttttttatggctgcatagtattccatggtatactgcatagtattccatggtatactgcatagtattccatggtatactgcatagtattccatgatatataaaatggtaccacattttctttatccagtctatcattgatgggcatttgggttggttccaagtctttgctattgtgaatagtgctgcagtaaacatacgtgtgcatgtgtctttatagtagaatgatttataatcctttgagtatatacacagtaatgggattgctgggtcaaatggcatttctagttctagatccttgaggaattgccacactgtcttccacaatggttgaactaatttatactctcaccaacagtgtaaaagcatttctgtttctccacatcctctccagcatctgttgtttcctgactttttaatgattgccattctaactggcatgagatggtatctcattgtggttttgatttgcatttctctaatgaccagtgatgatgaactttttttatatatgtttgttggctgcataaatgtcttcttttgagaagtgtctgttcatatcctttgcccactttttgatgaggtttttgtttttttcttgtaaatttgtttaagttccttgtagattctggttattagacctttgtcagatggatagattggaaaaattttctcccattctgtaggttgcctgttcatgctgatgatagtttcctttgctgtgcagaagctctttagtttaattagatcccatttgtcaattttggcttgtgttgccattgcctttggtgttttagtcataaagtcgttgcccatgcctatgtcttgaatggtattgcctaggttttcttctagggtttttatggttttaggtcttatgcttaagtctaatccatcttgagttaatttctgtacaaggtgtaaggaaggggtccagtttcagttttctgcatatggctagccagttttcccaacaccatttattaaatagggaatcctttccccatttcttgtttttgtcaagtttgtcaaagatcagatggttgtagatgtgtggtattatttctgaggcctctgttctgttccattggtctatatatctgttttggtaccagtaccatgatgttttggttactgtagccttgtaatatagtttgaagtcaggtagtgtgatgcctccagctttgttctttttgcttaggattgtcttggttataagggctcttttttggttccatgtgaactttaaagtagttttttccaattctgtgaagaaagtcaatggtagcttgatggggatagcattgaatctgtataaattttgggacactactgcccattaatgggattactcagtcaaatggtatttctggttctagatccttgaggaattgccacactgtcttccacaatggctgaactaatttacgctcccaccaacagtgtaaaagcattcctctttctccacatcctctccaccatctcttttttctcattattttgggcaggatggccattttcatgatattgagtcttcctatccatgagcatggaatgtttttccatttgtttgtgtcctctcttatttactcgagtagtagtttgtagttctccttgaagagttccttcacatccctagtaagttgtattcctaggtattttattctgtttatagcaattgtgaatgggagttcactcatgatttggctctctgtttgtctattattggtgtataggaatgcttgtgatcaaatcactattatgttttcacatagatgactttaaaaagttgggcttacataggttttatttgaacattaattattacactatgtgaagacagtgatgtgaaattttttatgccatctatgtatggcaatacctaattaagttagtacagtaataacatagatgttaaagacatcatttcaagtaggggctttattacatatcatccctcatggtataaatgtttcgtcttattccacatgaaacctattttgtgatatagatttaatttttattaaagaattgtttacattttcatttaatggaagctgtaattagtaaacctagaactacttaagacactagtttatgataagattgaaaatatgtatacatacaaattcatttatttccatgttttttcagcaaaaattcatgttgttttggctatagtaacgttaaactctccttaggtagaatattttttcttggaaagtgttttggttcaaatatatttttagaagtccgaacagggataaaccgaagctgtactaagatgactacttagaaggagttacaacctcaaacaaaaaaaagttgtagtgagaagttaggcaaacaaaagagatgcttttatagttgactctcttgggaaaaactatacataaataaatacaacctgtttcatttgataaattaatagctgacgttattttcatatcagaaggagaactagacatctgtgacttatggcctaattctgatcatcaaggagaaaattgactggtaaagtagaatcttgagagaaatcagtatgtaatttgtgagtttattacagccaaggaaggcagtgctatagggatttggatgcatattctaatttagacattagaagaggagccttcagaaagttttgcagaaaaaaagtaggtgttgtatttcaagaggaatggaaagatctttttgtaaacaaatatgggcaatatacctgttagcaatcttgatgagcaggagatggaaaaatggctaaagggagtgctttgactaactagtacagttatgtgtcacttaatgatggggataaattctgagaaatgtgttattaggaaattttgtcagattatatttccacaaaccaaatgcacctaggctatagggtatagcctgttgcccctgtacaacgtgatactgtacagaatgctgtaggcacttgtaacacaacggtatttgtgtatctaaacatagaaaaggtacagtaaaaatgcagtattataatcttacaggaccactgtcatagatgtggtccgtcattgaccaaaatgttggtgtgtggttcatgactgtattttaagtatacaaaaatgtctgtaaccatagccataaagaaatgtgatggcagcaagatagggagcttgaatcattacacacacaccatatatttttgatacattatatatgtaataattgccaaaggaatttaaaaacaaaattcaacaaaacagcatgttcaaactatgaaaggaacacaaagccaaggacagttgctcaaattagtaaaatataataccagaaagactaaatctcagaaagagatgagatatgtaaaagtctcaaatgacacaaaatagctgtctgcttttatatgtgaattcatgtatgtgtacatatttgggtttttttaggtaggcaaatatatatgtgtgtgtgtgtgtgtgtgtgtgtgtgtgtaacaaatatgttctcttttgttaacattcctctgtctaaatatgaatattaaatatccacgtggagctaaaacattgggagcataaacatctgaaaagcttaacccactgcttgagaagatagtgtattttttttttttttgagacagagtctcactctgtcgcccaggctggagtgcagtggcgtgatctcagcttactgcaacctctgaaccccgggctcaagcgattctttcacctcagcctcccaagtggctgggattacaggcatgctccaccatgcccagataattttcgtatttttagtagagatggggttcaccatgttggccaggttggtcttgaattcctgacctcaagtgatccgtctgcctcggcctcccaaagtgctgggattacaggcgtgagccactgcacccagccaatagtgtatttttaatggctggcagagaataagacaactctctttctctcttgctctgttttttttttttttttttttttttttttggtaaagggcttttaaaacaatatttaaaaaacaaaaccaagatggtattaaacataaaggaaatatccagcaaaactgaaaatggcccaagcttccggaaacaccattttttataccttgttctttaaaccacagagcagtctcttctctccttctcttccccactacaccaaaaaggacaagacacaaatctgtgccaggggtctcaatttagaggtagcactcctcctaatcatcacttcattttataattattttattcttagacttaccgaatgctaaacaagtaaaaagaatgttttagttttttcccaatttgtcaataataaattattaagatatttattttcatttataatatagtctagagcatatgatgagtctacattctatcttgaaatagcaaaaattttcataagctgtaatagctaaagagaagttaaaaatccgtcatactatttaaaatgttaaattgttatagaggatacttgcatgctgtattagataaataataaataaaccacaaaactcaccggtttaacagaagtgtgtgtttgtttgttttttaatcgagtagatctcatttatcttattgacatcacttggaaaagttttcagcattgacaagagaagaaaagagtcaaaggctcacttgggatgatgttaagggcaggcctggaagaagcatacatcactttcacccttgttccactggccagaccctagccacttgacccccacctaactgcaggggaggctgggaaatgtatacgagcttgtgcatatttggtgagtgctgcttctatcatagactgttaaattagtcagatgaatgtttattgcaaacagtgtgcatgggacttttctaggcacagggctgaatacaaagatgaataagtcatggcttcttcacccaagtggatcataatccagcactcattgtagactatagcttatatttagttttagattctcaaaacaaattcattgcctattcctagtgttatgagactaataactatttttttaaaacagccaagcaatttatatctaccatctgtatcagttaaaatttaggcaagaaacagatggcacattcaaattaggtaatttgaagactgctaaataaagggactatgtaaaggtgtgggctgggcctaggagggaaactacaaggtataggaaaccaccacaaattcaatactggaaggatgacagcaggatgtctttaccatttccagtgctgaaacagtgaggggaagaagtggtttctgggatctagagacagagttgtgaccttgggccagtgggaatagccttctccccatttgaccttgcaagaagagagccaacaaaataaattctctaatgttactgtccttctggtctcctgttggtattgcctattagctggatcccactggaagccagagggcaagggaggctgttgatgtaatttatgtaggttacctttctggggcaggggtcagaagggtggatccttgatctggagaagcaaatagcacaccatcctaaattttttttcatctatttggccagtattattgaggccctgctaattgcaaagctgtaaatagtataagaccatatacaaaagacatgacttttctttcagggatcttgctctcttgtgtgggagaagagaccaccaccaaaaacaaaatttaaagataagtctctggaagatttgtgtttaggcggtgattgagtgccacatggactataagatgaagtgaaagtggtatcattcaaaaaaagaagagattcatatgcacacaaattgttagggaaggctttgtagagaaaacaaaacttaaacttggttataaagggttgacagtttttgtagataggatggcagtcacacatgcatataattggctcaaagtacaatgagtgtagactctagatgaaggtggaaactcatacaaagttaatgagagattttttaaataatttgaggtcatactttagaaggtcataaggagaaatctcagggttcgtgctttttaaaaactgtcctaatgttctgggagaggttacaaggtgccatgtggtaaaagtgttctgcaatgaaataaatgtataaaatgcatactttccaacccttggatgtatgcaatgtgtattcaacatattaaaagctctgaaaaatcttgctataaagaaaccactttttccatttatctatacttggtgaaagaacccatcccctttcccctactcgcttttaaaaatcaaaacatggtgaaaatcatatgaaacttcagtattctataaaacatatctttggaaatggttctataaataatgggaagcctttgaatagttctgaaggatttatgacatgattagaggggtatttttagggtattattctgacaagatggattttagtgcacatgatcatttaagaacaattgttattgcagtaatacaggcacatggtgcaggtctgaagtgaagggtagtagttgagctgcaaaaaatgcagacttctgagggccattaggaaagacatgacagcatgacttggtggttgattgaatatgggtgatgggagggactgaatatgggtgatgagacggggggtgggagggagggaggcgggggaagagagagagagagagagagagagagagggagagagagaaagtcagcaatgttacaaactataactttaaggcctaaatcttccagttctgtgggagtttgttaaactgcaatctataatgtacatagatcatcaaaaataaaatactctaaaagacatttgagaagactaagtgaaagtataaaaaaggcaacataatgcctattctgcaaatgagtgtaaaagaatatatcctgcaaataattgtgcattattaccctggtattaaaattgattgtgattcagagacttagaagagctgtgttctgaccaaacaaggtttatggaccagaccactgggactgtagccagctcaaactgtactcattggtcacacctgtaaatgtagaacttttattaaccccaccccccagaaaaagaattttggcatagtttacagtaagagccaactctatcttgtttatttgaggtattattaggagtgataatctaaaagcattgctaatttttatagtatttttctctcttaccttttaaaccaaaatcatgttagggaccaaatgcttgcttaatgtttgatttgagccacatactaaaagaaactgattggtgttggataaagaggtaaatgctaagtaaatcttttcaaaattatttgttattaagttattattaatcatccaaaaagggtgacaaaaaccaataactccataacatttgaggtcatgtttcttaattgatgctctctttgcagctataacttttttttttcatttcattttatatgcttgctgtcatttgcccatttctcttctttgcatgaatgcttttttgtttatcttgttacatgtgtttttatttatagaagacaaagtacaatgtgatacttcttcattattacttgctaaattccttgtttaaatggtaagtccctattttaatatagttttggggataaatttactgaaaatattcagtgcttatattttcagttttgaatttattcatattgtgacagtaattggtagaaaactgtttctcacagctgacaggccaaaaaaaaaaaaaaaaaagtcttggggacaaagctaccacatgccagagtgctgaggacccatcagatatttaaggaagtggcatttgtactcgcattatttaagttactgttgaaaaaaagagatgggaagagactatatttgtaacaagcatattatagaattcattttctaaaaaatcatgtttctgaagaatagaacatctatcagatgttttataaagcacatgtaactaatagataatagttcttctccaaaagaactggaaaccatgaatgctatcttttttagaatcccaaaatttaaagaaatatttctgcttcctagaaaatagtaattaagcccaaatttccaactgaatctcaatcaatagttgtactattttctaccacagaaatgctattcagtaaatggtataagtgatgatataatgtatacttaacttctgttttgccaattaacttagatcattctcaaactgtgatttaggggacggctggtgtccttaagaatccctcaggtggtgagatagccagtcattagttttaatgattatggctgtatttctctttctggcaaggatgaataattatgcttagtaagaaccatagcatctcattgatttctcatcaaagaaaacaaacattgcccttaattctgatgaggtatgctggacaaacaggaatgggtggaacagtcatccctactttattttatttttaatagtttatgaactaaattttgaggagccattactatagatcaagatactataactctttagaactttgaagatattctgttaaatcatctcagatccattactgaaatgaagactttaaaaccttcttaagaagttgctaagctgttgaacacttgaacttgaagtttacacaacctggcaagtatttttttgttctttttcctcatacatggtcaatatagtgggttgaatagtgtccccccaaaaaatgtatatccatttgaaacctcagaatgttatcttatttggaagtagggtgtttgtctatacagttaagttaagatgggatcagattatggtcgactctaaatctaatgactggtatctttataggaagaggaaaggacacacacacacacacacacacacacacacacacacgcgcgcgcgcgcgcgaaagttgaaagcagagattggagtaatgcagctacaagccaaggaaggccaggagccactagaaaaggcaaagaaagattcttccctagagccttcagaggaccctccctccctatactttcatttcagactttagcctccagaacagagacaatgaatttctgttaagtcacacaatttgtgattctttgttatggcagccctaggaaaccaaaatagtcagtattcctgaacattctcccataaatatatatttttttgcctttttttttgtacaaatttctatcatttactaagctatgaagtacttgagaggagaactgtgtcacactcattctatacctgatttcagaaccccacaagtatttattagcatataactgtgggatagtcttattttttaagattcacaaatatattcttcatgagaacacgttagtttttattaagtatgcatattagagagagactggagtataaataactgtaaggatattttgtatgaaaaaataattgtagataattaccaggtttgggtttctatagttagcaaaagtaggataactgttgttatcatgtttatgtcccattcatatgaaaaataaaatccaaagtgggttttaagtaaatgaaatccctaagggactgtcaacctgaattatccagagaatattcagtttgtcataattttgctccaatattatagagcacagctgaaaataactgcttaactatcaaaattctatccaaagcacagatcatttataaagattaacatttagtaaaatgacttacaaatgtgtttaaagtaacatggtattttatgaagagctaatattcagaagtaacatctaagaggatatatacaaatttaaattttttaaactttaaaggattggattatagcttacatttctgagatatgaaaaattaccatcaagtaatattcttatctcaatgtaaacatattctccatttactagtataatttttatctctctttaaatagaagtagttttataagtatttgaatatttttgatcgaagagttgaaatactaccaatagaggtactaatgactatttgaggtggttgtaggttgttttttcacccgtaccagtttttttcatgaattttaatacacaaagattcccagtgttggttttaaattcttacaggctaagagagacttagtcttagagagattgtaggtaagaaatataattaatattttaactcattactgagaatagaccaatactttcgagtttaaaacttggtagacttaactatgtgactctttcagttactgcaagtaataaattatgaattataagcaacgtttagtttatccaatcaggtgaataagcatcacttgtaatggttaaatctttatgtgtccatgggcagacattcaagttatcttctactaataaggagaaaagagtcattgttcttagttggtaggtgacattttttcccagatatttgttcaccatgtgtcttagaggaaagtgaagattttaagggctacttaaaaattattttctctccgctttccaacgatgctttcacatgccatgaatcaatctaaaaatccccattgcagtcatgggcaaaccagatgtgcttcttgaagtctgacagttttcctgacatatcatgtgagtgaatcatatgggtaacatttttcataataaactccaatttgaaatccaggtatgaccacgtagatttgtcactaatacgctagagtcttttttagactatatttgtacttttggacttagaactattattttaaatacctaaattagcacagtaactttgatagcactgttttagccataggagattatttaaccttattcaaaattcattggtcctttataaacaaataattccatgattataatttaaattttttataaactcacatgatcattattagaggaccagttccataaattatggtacatttacacaatggatacagctgttaaaaaaagatatgttctatgtattaatatgaaaaaatcttcaactatattattgtataaaaaggaaaagtacagaacaatttgtagaataaactatttgtggaaaaacaaaagtgaggaaattctatgtatgtatgtatttgtgtgtaatatatatatagagagatatacatttatattgactttatatgcataaaaataatctgagaaaggataaactaataaagaggggttgccagttgtgtgtgtgcatgggtgggaacttaccagatgggactgcatgagggagtttttttattatatactattttatgctttattcttgaaccatgtgaatatattagtccaaatttagacagatagataatgttctgtttttaaaactatggtagtgaattctgttttatgaaaaatccagtaaacagaaaccaactttaaaaatggttacattcattcagacaatgggatattattcagtactaaaaataaatgagctatcaaaccatacaaaaacatggggaaacctaaatgcatattaccagaggaaagaagccaatctgaaaaggctatgattccacctacatgacacttctggtgaaggcataattgtggagacagtgaaaagatcagtggttggctgggtgcaatggctcatgcctgtaatcccagcgctttgggaggccaaggcaggcggatcacttgaggtgaggagttcaagacaagcctggccaagatggtgaaaccccgtctctactaacaatacaaaaattagccaggcatggtggcgcatgcctctaatcacaggtacccaggaggctgaggcaggagaattgcttgaacttgggaggcaggggttgcagtgagctgagatcacgccattgcactccagccttggggacaagagcaaaactctgtcttgggggaaaaaaacaaaaatgatcagtggttagagggacagagggataaataagcaagccaaaagtatttcgagtgcagtgaaaatactctgtgtaatactataatggtgagtacatgtcattataaatttatctgaacccatagaaagtacatccccaagagtgaaccctaatattaatataaactaagtagtcaccatgatgtatagtctcttgaactttttcctcctaactggagctttgtgcactgtgatcaatatcttcccaaacccctcacccacagtttctggtacccacaatttagctctgtttctatgattttgagctttttacacatcacatgtaagtgagatcttgtgatatttgtctttctgtgcctgcttacttaccataatgtcttcaagtttcatccaagttgttgtaaatgacaggattgccatctttttgaaagctgtatatatgtgtgtgtgtgtgtgtgtgtgtatgtgtgtgtgtgtgtgtgtatctacatctatattacattttctttattcaacatccattgatggacacttaggttctatccatatcttggctattgtgctgcaataaacatgagagtgcagatatctcttcagtacactgatttcatgtcctttggatatataaccagtagtgggacaactggattatttggtagtcttatttttaactttttgaggaaccaccacactattttctgtaaaggctataccaatttacattcccaccaacagtgtgcaagagttcgcttttccccacatccttgccaacacttgttatcttttgtctttttgatactagtcgttctaacaggtgtaaggtgatatctcattgtggttttaatttgcatttccctgattattagtgattttgaatatgtttcatatacctgttggccgtttataagtttccttttaacaaatgactatttaggtcctttgcttattttttaatcaggttatttttttttttactgttgaatgagttccttatatattttggatattaatctcttatgagatgtgtgggttttcaggtattttctcccattctctaggttgtatcttcactctgttttactttgtttgttttactgtgcagaagctttttagttcaatgtaattccacttgtctatttttgcttttatttcctgtgcttttggtatcatatccaagacatcactgccaaagccaataagctttttcttgttgtttgcctctaggatttttaccatttaggtcttacatttaagtctttatttggagttgacttttgtatatggtgtgtattctttttcatgtgtatatccagtttttccaacaccaatttattgaagagactgtcctttccccattgtggatttttggcatctttgtggaaaagcagttgactgtaatatgtggttttattttggggttctgttttctgtttcattgctctttgtgtctgtttttatgccaataccatgctgttttgattactatagctttgtaatagattttcaaatctgatagtgtgatgcctctggcattgttctttttgctcaagattgccttggctatctggggtcttttgtggttccattcaaattttaagattgttttttctatctctgtaaaaattatccttggaattttgaaaagggttgcattgaatctagattgctttggggagtatggacatgttagcaatataataaatctttcaatccgtgaacatgggatatcttcccatttatttgtgtattttaaaatttcttttattaaaattgtattaaatttattaaattttaatttaattaacattttaataaagtaaaataaagttttattaaaatttaataaaataaaataaagttttattaaaatttaataaaataaaataaagttttattaaattttaataaaataaaataaagttttattaaattttaataaaataaaataaagttttattaaattttaataaaataaaataaagttttattaaattttaataaaataaaataaagttttattaaattttaataaaataaaataaaattttattaaattttaataaaataaaataaaattttattaaattttaataaaataaaataaatttttattttaaaatttcattttaaaatttcttttatagtcttcagtgtgcaggttttttgctgccttgattaaatttattcctaagtattttttgtagctattgtaagtggaattgtttccttgactttttttctatttttaattttatttaaaagtttttttactttatttttttagagacggggtctcgctattttgtccaggctggtgttgaaccccaggcctcaagctgtcctcccaccttggcctactaaagtggtgagattacaggcatgaactaccttacttggctgatttcttttttgaatagtttactgttagtgtatttttgtatcccacaactttactgaacttgtttgttctaacagttttttgatggagtctttaggattttttagatataagaccttgtcatctgtagagacaatttaacatcttcctttctgatttggatgccttttatttatttttcttgtctacttgttctttctaggacttccagtattatattgaatagaagtggtgagagtgggtatttttgtcttgctccagatcttagaggaaaagctttcaactcttcaccattgtgatgtaaactgcgggcttgtcatatatggccttattgtgttgaggtacatttcttctatgtctaatttgttgagagtttttatcgtgaaagcatgttgaattgtgtcaaatgctttttctgcatctaccgagatgattatatggtttttagccatcattctgttaatatggagtatcacatttattgatttgtgtataatgaactgttcttgaatgcttgggataaatctcaacttgatcatgtgaatgatccttttaatatgatgctgaatttggtttattagtattttgttgaggaattttgcatttgtgttcatcaggaattggcctgtgttttcttttcttgtagtatccttgtctggtttttagtattagggtaatgctggcctcataaaatgagttcagaagtttttttggaagagtttaagaaggattggtattagttctttaattgtttggtagaattcagcagtaaagccatcaggtcctgagcttttctttgatgggagacttttttattattgatttactctcctgactcattactgatctgttcatattttctactttttccatgatttagtcttggtaggttgtgtctcttatatttaaccatagtcttaatatccattttgctatatattatctatcataaaatctcttctgaagggcttagtgataacacatctgagaaagagggaaagttaagaatttgcatatgtgttttgtgagggaaccagaattaaaattcaagataaccttgggaataagcagttttaaagaccaaagtaaagtaagtatcccttcatttatgcctggcaaagaattcatgcatacttatgctattctttgtggatccaagctgggctacataatgatattctctactgttttgcactgtaattgcactccagataagtgagggactccccatgcttggaaagttaatagtgttgcccaaaatcatatttgttccccacccacctacatttatttctcttttgatctttctaccagcttttctgaaagtttctttgatcctaaaatcactacagctttctaggcagaagaagtatggctgctctacagagcgctagggctaatacgaatttcaagagcatcaggacttactcttgctcacccctccccttcagcagcacaatggctaggtcttaaacatgattttaactttctgtggtcaaaacctgacttatgatgattcttctactttcccatcccgagagtattaatacaaactgatagtacaaagctaatacatataatgcttactaagttccagatactattcttggcactttacatatagtaactaatttcatcctatgatcatattttattatccctactttttatataggataactgaggcacagggaagttaagtaacactaaagaatacaagtttcagagccaggtggtctggctccaatatctgcacctaaccaattgccttgcagagaaaaaaaaaaagtttaagttgatttgtttgtcagcatttgtctgtcagcttagctagtgtcaaagcattcccaggaaatattagccatttctagagacttgagaggcatttgagttaggggctgacctcagcaatttctgaaccagccatggctgttcccactagatgcacattgctcttggatctcagtgttgtaacatccattatcttctttctgatgtttcatgttatttaaactgtgatgagactcttgtctttatctggtaggattataacctgccacagagcccaaaagtgaaaaaaaaagaatcaacccagctatttccagaatcatatttcattccagtaaggtttcctactgagatattaaggtcaggaaaagtaaaaagagtaaactagagtattttggtgatgctgtatgtgcctagagttaaagtggcatttatgcaagggtatatactgtcattacagtgaaaggaaagcctttctagccatttatcaatgattttatagtccttacttcatggcagatggaataaaagaacaaagaaagtttacttccaaagcaatttaataaacatgaagtgaaaaaaatcaagatagacttgtttcttttcgcatttccctctcacaagtgccttattgacaaatgaattcatttctttttcatatcacaaatttaagtgtgtccctgaataacacccagcatctaatactttttttaagttctaatgtgtactggaactgagtttgaaaattcattcccttggctgtttcttccctttacaatttggagagttttgaaattacctttggatggctttcactgaggagatatgtttgcttgtttatctattttaaatcaagaaaaaacagataaatattcatattatttctcgctaactaactcagttggcaaattatttttttatcctggggttagtgcctactcacattaaactttaaaaaggagattgagtttaaaatgaggccactctttaatcaggtaggatgcctggaactatttcaaaggcatatatggtttttgtttttataggaagtgaagaatgagacattagagttatgaaattaagattcttgttgaataagtaaatttgcctaaggttggggataatggaagtgtgtaatgatttgcattgagaggttagtgttgtcagaagctatctcccaggcagctttcttcaagccattacacctgggccaataaccttgtttcccagtctcagcaaagttgatcttaatcctaacatccaaataagaattcttcctgtaacctttgtggtttttttcttcaagacatttgagtgaagaaccaccattcctctctatgacttagatgttactcatcttgttgctagaaggcagtcaggcagtggaaaatatcatctttgagaccatacaaacatcatggttctgacctaagtggattaagatgggtgattggagaggggagtggtggtagaaccacattcacaatggggcgcactttttcaggctgcgtggttatgtctcgttgtttttgacacaaacatgcaaggtaaacatgcatcttcatcatctgttggggccaaggtatattttaaaaatcaatgtataataatgtccaaaattcagtatattatattagagttttgtgttctttttatatatatagaattttagtttggcaattttaaggatcaattatatccttgtggataacagctggtaattatatactatttgagtcaatatattgatgtaaccttttattaaaactgttataaataagtccctagagtatgtagtaattttttattaacccagccttacttggtacaaagagttttctttattaaatatctttttaaatcacaggtaaaagtttttagtccaaataatttaggatctcaaaaaggaccaaaaaagccgtataaggaataagacacggatttttaccctccgaaatttgaagaattatcagaacagggttacaaaatctgtagtttgtgaatttttatttagttgtggtaaaatacacataacataaaatttactatcttaatcatttcttaggctgtagttcagtggtattaaatatattcacattattgttcaaccaatctccagaactctttttatcttgcaaagctaaaactctgtatctgttaaacaacaagtcttcattcttcttctcccccaccattctgctttatgtgtttatgaattgaactactttaagtacctcatgtaagtagaaacatagtatttgtcttttttgtgtctggctcatttcacttagcataatgtcctcaggttcatccatgttatagcatgtgtcagaatttctttccttttttaaggctgaataatatttcattgtatgtgtatgtgtgtatttatatacatatatataaatacacacatacacaatgaaaattatatatacacaaattatgcaatttaaattatacacacacacacacacacacacacacacacagtctgacatgtatagtctgatgagggacacttgggttgtttccatcttttggccctccgaaagttgaagaattatcacaattttggccattgtgaataatgctgcaatgcacatggacatacaaatatcttttcgagactctgctttcaattcttttggttatatacccagaaatggaattgctggataaagtggtaatactattatatatatattttttttgaggaactgccataatgtttgccttactacattattttacattcccaccaacagtgcacaagggttccagtttctttacaacctcgacaacacttgttattttgttattctggggtttttgtagaaaggatagtagccatcttactggttgtgaggtggagtagtgtattttaaattcaactttaacctagagaaaattatgatggaaatgatgatgaaatgtacaatctcatttacagattatggccaaagtctaaatttgaatactgtgctgactgacccttttctactctattgttgcgcaaatgatactcttcaaggaaggattatggcagcctgagaaatcaggaaagcatggcttggaactggccaaaacaaaatccagcaagatctctttgaaggtggtatttaaaaaaaaaatcataaaatttatgcactttgaaccttgtacagaatacagctgtcctcagactagaactactgacttggtgtagtaggtaaggtgaaggatttagcaagttcagttttcctttcattaccaatttatttccttaattttctacatgtaaaagattggaaaagggctgacagacagtagtcagcagtaacactaattgacaataagaaatatcttcattattgcaaggtggaagaatcatttaaaagtcaaaaagtcacagtaggacactattttaacatagtggactatgttgtgtttataattagcatgtgatccaaagagaaagtgagtacacaaaggatgtttagttcactaaggcaggaaaaaaagaactctaaagtatttttaaattcttttcattaaaacaatcagactgagaatatttgcttttcaaaggaattggcttcatttatctaaaaaatgctatcatatggattagctgattttccagtgacgcagaaaagatgacatatggtacagagtagcatatattcaagtgtccaaaaatattctcataatctttcccatgtaaaatccaattgttctcttaattttaattttctagaatgatgcttctaatctccattagcctcctcttttgcccacctaactgctatttgatagatacctctcacagaaagtttcccatttctctttacttcacaattctgggttccttatttttcctgtgtggtatcacagcacacagcattttctttcttgtacttatcgctctctattgcagtcaatctgtgttcctaaccatctgacccctgagaccaccagtgtgtcccagatcagtaatagccaaagagacaaagttgttatcatgctgagaattgtatatagcatacatcttggtatgcctccaggaatgtgaggccattaggttgtcagatatgagtcatagtgggaaaaatattagggtcattgaaccagagtgtgaacaacttgagccttctttctttttctcccacatatagcagtgtttgacctaggcattagtataaacactaaagtgaagagtttggatttttgctgtattaaaaaaaatgcattgtagaattgagttttgtatagggatggtgttagaattgtggtacaataaaactattataagatcattctcttccttcttccagaaaggatgtaagattgaagactcaaagatagaggcataaaattgcagtgaaaggaggaatgtaaagtcagggtggggaaaaagtagaaccagatatgaggcactaatataaactctgattagctatgcattttctaagagtggactcaaatgcaattctgacctttgtagcaaccaactcaaaaaggagaaacctttaagtcagaacctcacaatggctctgaggtcaatcaaacaactacttagagaagtataactattttttcttttccaaaaataaagtagctttattttgctttcattcgaaaaacaatatgttacttattttaaaaaaatcaagcaataaagtacaaaatcttatataattaccccactagagcacttgtggtcatacccctaagcttcttggtagtcagtccagaaaaggaaacagttggtcgcacaactcatactgctcaatttatattccaaacagtatgagagcttgttaattttcctacactcttaataacactgggtctgtgttgttaatctttcctggtcctataagagaaaaattatatttgttattttctctttttttcttttgagacggagtcttgctctgtcgcccaggctggagtgcagtggtgcgttctctgcttactgcaagctccgcctcccgggttctcgccattctcttgcctcagcctcccgagtagctggaactacaggcgcccgccaccatgcccggctaattttttgtatttttagtagagatggggtttcaccgtgttagccaggatggtctcgatctcctgacctcgtgatccgcccgcctcggcctcccaaagtgctgggattataggcgtgaaccactgcgactggcatatttgttattttctattatccttaatactaatgtctgatgtgactttttctatggtttttataagtagacactaatgtaatgaacaagtattcttgataacatactttgattaatttgataagtttttttctggagtattataataacactgaattatgggtaatggtatttcaccaggtttttaattcagtaaaaccagtttttctggggcgaatatgatagtgttcgttattcaacctttttgttgatttggctttattcaggaacatatttgtggtagagaccactagcttcctaccaaaatcactttttccttcttcgtggatacacaaactacctttagcagctccatttgaaattaagtgtgctatgtgactaagttttctctagtgcattgtaaatgaaacagatgtgagtcacttcattggcatgagccataaaaatctccattatgtgttcctgggtgctctttttctttctgactaaatgaaatggcagtgttcagggaagccttagaagtcatgtgttgaaaatgactgagtagccatcagcctggatctttgaatgactgcatggaaagaactgcatggcctacctgaacattcacccagcactgttgcataagaaacaaatacacttctaattatttaaactacgtagttttttagagtctgtttgttactgcagcttagccaatcccaattaatacaatattttagaaaatataactgaacagaaattgagctagattcaaatgatccatgtcatcaggatatgcaccatctccataacatgactctgaattggtttcattcatagatagattttctccacatagtagaatagatggcccagcaatcacaggtcttacatggtctttatagcttatgatcatagaagctgagaaagtatcttttcctggaagcaccagcaaaagttctaggaagactcttcattggcccagcaggggtcatgtacccatccctgaaatagtttctgtggctaaaaggatagaataccatgggtcaaatttggttaacattcctacctctaagtagaagggtgatagtcccacacaaccccatggacaaagtaggatcatatggaatggagtagtttcctaaagaaacaataaagaatagacatcagaatacaatatggttaggtttttaaaattaatatagacatgaaatgagagggacctggatgaaggtcttggtgtggatataaagggaaatattgaaataaaatatattttgttgaaagtttgcattgtcagggagggaaatagtagaaaaaacaactgaactttaaaaaacaattaaaaattttaattttggtaaaaaataaaacatatgaggtggtaggatcacttgaggccaggatcaagaccagtctgggcaacatcacgagaccccatctctacaaaaaatttaaaacttagctgggcacgttggcatgtgcctgtagtcctagctactccagaggctgaggtgggaggatttttagagcccaggagttcaaggctgtagtgagtcatgatcacaccactgtactcattcctgggtgacagagtgagactatgtctctagaaaaaacaaaaataaaataaaaatataacatcttaagcagtttgaagtgtacagttcaatatttttaaatatattcacattgtaaaaacaactgtagtttttgaattaggaaatgagtaaagtaatagtcctatcaaaatatttgagagatttgaaaggaaatgcagttcaggcctgggagaggtgggtgtcataaacactgatcaagcaggccagaccataggtttccaagtcctagggagccaatagaatagtcctgggcaggtgatttgtgagacaggagtagctaacagtgaggaaaatggtctacacctgggcagttgacgtcaccattagaccaaatctcagtagcattcagtaacgatttctagaactgagatacagggcaaaatccaaggaacaaaacccccttgctacttaattggtaccagcaacaaaagtgacttcatattgacagactgacttgggatatcttacatgttcctctgcttcaatgcaaaattcccacaggtaggaacttataggccttactcataaagatcagacaatttcagggactagatgctaagctcagtattacaggaagatacagaactctgtgtagcagaagtataaagacatacaagtagagagcattgctttaaacaaaagtttatgactggagctcattgagtggttagagttatagatgtaatcctgttagtttccatcgctgagataaagttaaaataatgagagctgttctctcatgtgtcattagtataactttaaggggtcactgcaaagtaggaatggaccttattgttatcaacaaatatttgagtgtttcattatatgtagtgtaagatttaaatttcacaagacaaggagatgtatattaactcttaagaagaggaaaatatatatagtattgctttgttttagcattctattcctttatttaccatgtatgccactacagaagactttatacttttatatgttttaataatatggcaagtttcccaacttacaaatcagttgaatcctaaaaattccatgtatgtagcttgttgaaattcaacacattttaaaatagaaattgtgttgtaaattgtagttctgtttccagaataattcacaaattgcttttaattcacaattcatcttcattgcttcatattagcaaacattgattagcagtgaaatcaagtggtaaagtaactctacaggtttttgaaaggagatatgaaagataaaaaaggagttgtatgtgtatatgagaaaaacactttttcaggtgggtgtgagtgagctgaaataaaaaaggcagaataaaaagcccaaattatgcattatctttctaaaggtaagaaagcagatactgatttcagatttttccaatacctttgccagccaataagtggtgctattgtcacagaatagttaggttgttctgcagcacaaagcaaagggggaagatgtggaaagtatatgccaagtggttgtaaaatgggttgtgaaaaggaggcagaaataaaaaagggaggcagcatgaacctgactatatgtggacactgtttttgtagtataggaggtgattatgctagtacattttcttaaatttccatgtaaaaattaaacataattcaagacacacctttccttatccattcaattttctttgagctttagtttcctcaattataaaagtgaagattgttgtgagaattaagaaaataaaaataaagtgtctattaatatcatatacataatgctcaataaatataattctgctcatctaaatgagtcagataacattaataagccaaattaacataatattattgacacgttgctaaattagcctaaattacatgatcttcagaacctggaagcttataagaaagtagcaagaaatagggaaaaaatgttgagctttgtcatttgctactaagaataaagaattgttcaactccaattattttattcttttgtaggtaaatatccaggcatgggctatcagtacatccttgagtagagaggcaggctccatttttatatgcactctgtttttggagacccccatcttaaagtaataccatgtggcatatcttactattagtgactgtagtgtttatctttttgagcatcattgagaaataatgaataagtaggtaaaaattgcaagattaatggtctttttgcagccttcacaagcaaaatggaatcaacttttctttttcatgctcctacagcctgccttttggtgcaatcacagcttattagcatatctttctaacagcgaactaaaatagagaacaaagataaaattcatgtcatccaattttgttagttattagccagggtaaagtttgtcataggaagagtttaaacgaatgactaaaatcatatgatgctatggctgggcacggtggcccacacctgtaatcccagcactttgggatgccaaagcaagaggatcacctgaggttggcagttcaaaaccagcctggccaacatggtgaaaccccgtctctactaaaaatacaaacattagctgggcatggtggcgcgtgcctgtaatccccagctactcaggaggctgaggcatgagaatcgcttgaaccaaggaggccgaggttgcggtgagctgagatcacgccattgcactccagcctgggcaacagaacgacactctgtctccaaaaaaaaaaaaaaaaaaaaaaaaaaaaaaatatatatatatatatatatatatatatatatatttatatggtgctatataaaaacttttgatggaattttctatcctgtctttccttttactgctggtaattggcctcagactacctaaatctttcccttcacagcagcctgcagttctggggagtcaaagtattaaaaatgcctctccagtgaaggcctgcttgcttgatgacaagtgaattggagagttgtttttccctcttgttgttcagacttctttgtcttttcctaagcacttcttattccaacatgagaaaatgacttctcactgaactcatcctttctgaacactggaagcaagccttaaatcaagttctagctttaaatcatagattcacagctgaagtaggctttacatgttcttggaaaacaggattgtagggaaaatgctacattgtcttacaaccagttactcagtagtttgtgaaagattgcttgactaactaaatgaagaatagtatagggaaagaagtaaatgtatggtggtctttctgcccattggcaagatcttgattttgtttagtaaatgaatatatgtattcacagatggactggggaatctcagaagtacagtacttggtctgaatcaatgattttcacaggactctttagaatcctaggagtgtgaggaggtaactacatgtaaggggaggggagaaaaggtgggtggtactctgaacccctcccttaaccagagaggctctgcttgaatagttttgtaaattgaacctctaaagaggatatttttaaagacaatagtttgaaaattattggcatccgagacttttaccaactaaacccaatttttgagcttgggaatctggttcacaaatactagtgtagttcctgttaacttgataactatcacatttcattagatgattatgtgatctccttctatatcagaatgtttctatttattagtgatcagtggtgcctggtggctaaattaaatagattaatgaagggtattagtaatttcatggattaataaatataattttttaaaattgagaactaatgtaccacaaaatgcaatctgtttatttttattaaattattcatatttaaaactgccacatattctgtgaattagtaacagtagataacagtacggtctttgactcttttatggtctgtgattaatgaccaagtatttgatttctatgaaaccatttgggtctagaagtcaatcacataatcagctgtatctgctacatttcgaatctgaaaataagtttgggcttggcccaagcttttcacatactataattttataattctctaaattctagtaatatttgccatcatttttaattatttccttccatctctctttttacctatatattgaaagccctagtgttcaaattagattttcaaagtgaaaattaaatacttgattatattattttataccacactatgaatatttactaattttgaaagaaaatactctttttatatatatttttatatcaagggtgtaccagattggaatttgtttgcttgagtcactataaaataagatttccaatcacattcataaatgtcctcttattgtaaaatagttttgttaaaacttgaaattcttgtataatgtcttaaagcctatttaatttagctaaaaaaattttcatccccgccttttttccttcctttttgtgtgtgtttaagacatcttaactcatgttataatttagatatattcatagcagaatcacctaatattcatttttctgacattttgttaaatgttcacattttcaattatgaatatacttcatacattgtagacaatttagctttacaaaaaagtatagaatgtattaagtgagtgaagtactttcaaaagttgatttctacacatcaatcaaaacctgaaatgactacttctttcagctcttcatagtgaacacattattacatggactaaatagtcatgcattcatcatttatattttttgtttgaatggttaccttcttttggagagtagatcaggtgtaattgtaactgctttttcagcagatcaaaaattcctttcagtttggaaaataaatggtttttcaacataatattcaagtgttatttctttgttttttaaaaacagtttttgatgtgtgatttccacagtaatggaagggaagtaaatgaagtaaaggcatttctaagacttacatgtttgatttgggaatataatcagaagacctgcttaacttttaattataaatcttcttagattaatgcaatagactattcagtgtatatttgttggttgaattacagatgtttttagaactttgaagttttgtttgaatataatgctctcatggaacctttaaaaattaacggtcaataagagtttattgtccttgtgcaaagcacaaacacaaatttacaataggttaatcttttttcttaaattgtgatattcttatgtattttcagattgaaattttatttgtggctttaaaaaaaattcattaatgaagtccagtttaaacgtaatattggtgtgctataaacttgccacaggacattttcactaatataggaaataggttacttggaattgttctgctgtctttctgggtgtagtttaagaccttttatcttttcagatctgaaaagctaaatcatattatataaagcatttcagaataaccaagcattttgatataatattggattttctgtgatagaacaagttgagattccttataggacacttgtaaatatgaggaagctaataagattttaggtaattcattgaactagtaggcagtcttaaaaattctgaaagcttatctgtaagacttctataattgctttaaaaatattatctgtggagatagtcttacatgttcacataagtatatgtaggacatgtcagattatagaatcatcacattttcaagctggagtgcctcctttaattactgtgaggaataatagcttatgatagtcatgcataagatgttagtttttaattgggtatctgtaataatactatatgcaagctttataaatgctaattttaaaatcttaaacagaaagagcttatgcttggagtcatagaaatgcttaggttcaaatgctagctatactactttaatcagctgtgaacatttggataagttaactaccctatacctttttttttctcatctgtagaagattgttttaaagataaaagataaaacatgaaaggaacctaaacattgcttggtgaacagcaagctcttaataaacagatgctgcaactgagtaactttagtcaaattacacttcaagtcatgtgtaaaaatggctttcagtataagaattcctattttagtgctcttaatttgtgttcattttatttgtaatggttcagaataacaaagtttgaaagcccacaaacctaatatatgtagcgtggtgcttggctttcagtagttctcactttcatacattgtgcattgatacttctaaacctccttttgtatgcagaattcagtctcttatacatcaccaccagtcaacaaactgatttagaattatcacctgattgtactgcttgctgccactgctataaaaggagagacatcagtcagactataaggatcttattctggttgtcctacctatttgatcaccattcctccaacccaggagctcgtgtcaggtttgcttatatacaagggaacaactatctcagaagtatgtcacctcactcagcccagcctctctttcaaccccaaagtcacctccaaattccacttatctctcctcatgctaccccatcaatgtaaaatattgggctagaagtagacaactggttgaaaactatcaccaagaattatatatgcttgtgggttacagctctatagccctctacctttgatttggtactagtggaagaaaatccctcctccacggtcttagatattttatgagcgctgaaactctgaaatgtaaagattaaaggctgcccaaatatctctcctggcctgtgtgaatggattaggaaaggaatagtggctcaggaaaggagagatgcctgagtctgctgtttcattcttaggaaccattggtgtctcctgccacaggtaccttcaagagtcatactcacctacagggtcactgaaaccctaggaaggcagtatttgtaagtagtaatattagaaatcttatttctaaccatcctttaaataatatcttgcgcagctttcaaatgtgtgagaacactatatgcagaagaaagggaaactttctaaataaaaacaatccctttccattaataatttttatcagaactagtcatgatagttagaaaatgatgcttttccaactctggtacttgttccacatttactattcatcatcatggtaagcaagagcccttttatcgctccaatttttatttattcatctatttatctatattgtttagtgctgtggctttattaattcctgggtttttctcagtgttatatatagtgctcagacattttggtttcagaattcctttagactcttcataattattgagagaactttgtttatggaatatgtattgatattttttataataaaactaaagggtcagaaccatagctatatctcagccccttgggcccaggatgatagagtgtgcctcagagcaatagaccatggcttagtgagagaattgcattcacttgtacctttgagagtgaacctatacatcaggtcccaggtgctatagtggttttgaaagaccttgagctgaggaacccaactctccagacactctgagcatctgtgctctggatcccagtgctgccttggcagcctgtgagccatgtcagatctgacactgagagagatcccctaagctaagactcaccactgtgaggataacaagaatgagaggattcctaaagcctgtgccctaataacctacactgctgcagtcagtaccacaaactcctgaagcctagaccagggaggcacctgaagttatttccaacattggtcactgctgaagatgctgcatggaatcacattactgtggtgacatagaaccagagccaccacattctgcttatctggtggcatccttggtaccatctacatgtgaaagtcttcacctataaaaaccactctgtaaagtttggaagaggtgactgtaccagcagatgtgcagatatatcaacacagatacacaagaaacatggaaaagcaaggaaatatgacaccactacaaaacaaaataattcttcagtagctgaccaaagaaatggaagtttactaattgtctaaaagaaattcaaaataatgaacctgaggaaactcattaagaaagaagacggtgcaaataggcaattcagtgaagacagaaaagagtttatgatctgaatgagaaattcaatatagatagatatcataaaaatgaacaaaacagaaatcttggagctgaagaattcaatcaatgaaattaaagatacaattgtcggcttcaacagcaggctagatcaatcaagcaggagaaaaatatctgtgaatctgaagataggtctgttggaatgactcagaggaaaaaagaatgaaaaagagtgaagactgcctataagacttatgagacaccattaagaaaataaatgtactatgggagaaatgcacttagaggagaagagacagagaaggggacaaaaagcttatttaatgaagtaattgctgaaaatttgtcaagtcttgggagagatatggatatccagatccatgaagctcagagctccccaaatagattgaacccaaagagctcctgtttgaagcacattataatcaaactatcaaaagtcaaaaccagaattgtaaaagaagcaagaaaaaagcatcaagtcacatattaagaaatctccattagactgtcagcagatttctcagcagaaaccttgcaggccaagagagactgagaagatatattcaaagatgtatccaaagaaataaactgacagttaagaatactatacccaacaaagctgttcttcagaaatgaaggagaaacagtctttcacagagaagcaaaagccaagggaattcattactgctagtccttccatacaagacatacttaagggaattcttcaggcagaaacaaaaggatgacaattactatcatgaaaacatgtgaaagtataaaaaccactggtagaagcaaatatccagaatactttagtattgtaaaggtagtgtggaaatcatactaatctctagtataaaggctaaaagtcaaaaccaggttgggcatggtggctcatgcctgtaatctcagtagtttgggaggctaaatgggaggattgcttgagtccaggagtttgggatcagcctggataatatggcaagatcttgtatcttcaaaaaagttaaaaaaaaaaaaaagttagctgggtgttgtggcacacacaagctactctggaggctgaggcaggaggatcatttgagactcaggttgagtctgcagttagccatgttcatgccactgcactccagccaggagtttgggtgatagagcaagaccctgtctcaaaacaaacaaacaagtcaaaaccatcagaaataattaaaactacaataagttgttaaggaatacaaaaagatgtagactgtggtatcaaaaatgtaaattggtggggagggtagaagtccagagtttttgtatgcatcaatgttgagtaattatcagcttaaaatagtagattataaccataaaatatgttatttaagcttcattctgaccacaaaacaaaaaactacagcagatagatgaatgataaagagaaatgaatcaaagctcagctacagaaaattgtgaaatcataaagataggcaaaaagaggaagaaaagaacaaaggaactacaaaacaaccagaaaacaaatagcaaaatgacagtagtaagaacttatttatcagtaataaacttgaatgtaaatggattaaattttccaatcaaaagtgatagaatggttagatggagttaaaaagaaaaacaagatccaactatatgttgcctacaggagacctacaacagctttaaggacacacataagctgaaagtaaaagaatggaagaagatattccatttaatggtaatcaaaagaaagcaagcgtggctgtacttacatatgataaaatagacttcaagtgaaaaactattgcaagaaacaaagaaggtcattagttaatgataaaagggtcaattaatgaagaggacataaccattgtaaatctatatgtacccaacattggagcacctaaatacattaagcaaatattaatggacatgaagggagaaatagatagcaatactataagagtaggagactttagtacccccacattcaaaaatgggcagattaatcagacagagaattaataaggaaatactggacttgaattgcacttttgaccacttggaactaacagacatcttcagaactttgcatccaacaacaacagaatacacattttgctctagcacacatgcatagaacattcttcaggatagaccttgtgttaggccacaaaagaagattgaccatatatctagtattgtttcaaactacagtgatatgaaactataaatcagtagcaggaggaaccttggaaaattaacaaatatgtggaaatttaaaaacatgctcctgaatgaccagtgggtcaaagaataaatcaaaagagaaatttctaaaatgtcttgagacaaatgacagtggaagcacagcataccaaaacatgggatgcagcaaacgcatttctaagagggacattatagcaattaatgcctatgttaaaaagaagaaagatttcaaataaattgtctaacattacacctcaaggaaccagaaaaagaacaaactaaaccccaaaaaagcagaaggaaggaaataataagattcagaacagaaataaatcaaataaggaacaaaaaaaacatagagtcaataaaacaaagagttggttttttgaaaaacaaaatttacaaacccttaaccagtctaagaaaaaaaaattcaaacaaaataaaaaatgaaagtgatgaaattatagcagatgcctcagaaataaaaaggtcatacagtactattatgtacaagtatatgccaacaaattggataacctagaggaaatggatgaattcctagaaaaatacaacctaccaagatttagtcaggaagaaatagaaagcatgaatagaccaatattaataaagacattaaagaagtaatagaaaaccccccaacaaagaaaagccaaacaccagatggctttgtagctgaattctaccacacagtcaaagaagaattaatgccaatacttcttaaactcttctgaaaaatagagcttcagagaatacttctaagcatattttatgaggtcagcattaccttgatacctaagccagacaaagacatcaaaagaactacaggccaatttttctgatgaacattggtgtaaaaatcttcagtaaaatattagcaaaccaaatccaacaacacatcaaaaggtgtatacaccaggaccaagcagggagatttattgctggcatgcaagactggtttaacatacacaaatcaatgtgacacttcacatcaacagaatgaaagataaaaactacatgatcatctgaattagtgcaggaaaagctttcgacaaagtgtgatattctttcttgttaaaaattctcaacagtttagttatagaagggaagtttctcagtgtaataaaggccatttattaaaaacgcacagttaacattataatccatggggaaaaactgaaaacgtttccactgagatctggtgcaaggcaaggacatgcactcctgccacttctgttcagcgtagtactagaagtactagcaagatcaatcagataagaaacagaaataaaaggcatccaaatcagaaaagaagtagaattatctctatctgtagaaaacatgatcctatatataaaaaaaattttaagattttagcaaaaataaaaaacccgttagaactaataaatgaattcagtaaagttacaggatacaaaaattagcatacaaaaaaaatcaagatacaaaaattagcattttaatacacaacctaactgaaaaagacgtaaagaaaccatcccatttatgacagcattaaataacataagatactaaggaataaatttaagcaaggagatgaaaaatctgtacaccaaaaactataaaacattgatgagagaaattaaagaacacacagataaatgcaaggatatcccatgctcatggatcagaagaattactattgttagaatgttcatagtacccaaaccagtgtacatatgtaacacaatctctatcaaaattcccatagcattctatacagatataggaaaacaatcctaaaatttgtatagaaccataaaaggcctcaaagagcccaaacaattctgagaaaggaaaacaaatttggaagcaactttgatttaaaattaataaacacttactttctgatttaaaattttattacagagctatagtaatcaaaacagtacggtactggcataataataggcacatagatcagtggaacagaatagagagcctagaaatcaatctatacatatatggtcaactaatttttgatcaaaaaaaatttgatgaaaaatctgcggatgatcaattcacttatataacatggcataatatttgtatataacctatccacatacttctgtatactttaaattatctctaaattacttataataccaaatatagtctaaatggtatgtaaatagttgttatactgtattttttaaatttgtattttattgttgtgttgttgtttcatcatttttttccccaagtattttcagtggtggttgactgaatctgcagatgcagaacccatggatacagaggactgattgtatacagagaccaggaacaaaacagtggttacctgggacaggaaggggtggttgggagaagtagggagatgtatgtcaaaggatacaaagtagcagatatgtaaggtgaacaaatctagagatctaatgttcatgaggactgttggtaataaaattgtactgtgtgtgggattcatgctaaatgagtagattttagttgctcttgcgacacacaaaaagggataactgtgagatgatgtatattttaattttttttatgactagatgtttcttttttttaattattatgctttaagttttagggtacatgtgcacaacgtgcaggtttgttacatatgtatacatgtgccatgatggtgtgctgcacccattaactcgtcatttagcattaggtatatctcctaatgctatccctcccccctccccctaccccacaacagtccccagtgtgtggtgttccccttcctgtgtccatatgttttcattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccgtggtgtatatgtgccacattttcttaatccagtctatcattgatggatatttgggttggttccaagtctttgctattgtgagtagtgccacaataaacatacgtgtgcatgtgtctttatagcagcattatttgtagtcctttgggtatatacccagtaatgggatggctgggtcaaatggtatttctagttctagatccctgaggaattgccacactgacttccacagtggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatgataagcatgttttcatattttaatttgcttcactctagtaacctttttactgtctattcatatcccacaacatcatgttatatcccttaaatatatacaatgaaatttattttaaatacataaaagtgagatttttaagtgtttattaattcattttaaaatatcactaataaatccattacatgttaacataaagaatgtatggatcactatactttacctctttcttcctcccggatcttgaagttctgccttaatttgtaaaacttcctttgtatagcatatctgatacatatctttaattggcatacattttcatttttagtattttttaacttgctttactgcctatgcttaacaaggcaatcttttttacttttatcttcacattttaaacacaattgaacaaaagaaatgttattaacacacttttacaagaaatttctttttcctcagaatgtcagagtaagttcagaaactgaatattgattttcctttttaagttatgcaacaatgacatgaaaacctttatattttccatgtggtaggaaaaaggatataggtacaattttaatctcataaatacatgcgcacatgtatatgtgtttgtgtatttataatctattagttacaatagtctgaaagggaacaataacatgttaatatgatattttgagtcacgcgcttacaggtcatttttatttttttctactttttggtattttccagattttcttcagtgaagttttaatgaatctattattaggattaagttaattgatttaagatgtgtcttccacattctgaaacaccttaatgaaaggcagtggtttttcttttttggaaagaaatagtgatttttactcttttacttttagcttagcccttgtattttaccaaccgaaatgtcagtttgtagatgtaacatttgtagtcatctgaaagtctggcaacatatcttagtggttaagtgtctaggatctggagtcaaaagacccatgttcaaatcctgatatctgtttgctagcaagtaaatgtcttaagttctcttaagcctcaatctctttataaatgaaatgtacaaattgtttatttaaatgaagtaataatagtacctcatagcattgtatagcttaaatgaaattactcatgcagagctaaaacttagttcaatatctggcacatggtaaacatgccataaatgttagtgctttttttttttttttttcctgactctggaaatctaggacctctcccttcttccttcaaacctaacaaaacattgttgtgaactacaggattttttgaaatcaagggtaaatgtaatccaagcaagactttgatattcaacacccattacctgtccataggagtttcctgctggttgtattggtttctatgccctgtaacaccatatgtgtggctgggcctgtctctacaacccagtgtggtctgcagtgtggtttcccaactgtggtctataagatgactttagatgacacaaagacaaccctttaaattttttaaatctatttttatgggtgagcaaaaaacacaactagcacattaagtcagtgattacatgaatattttttagagtaaggtaaaaatgagtattgaggaaaaatgcaaatcactgtaaagaaaaatattaggttatagtactctaaagtatggcaaaaattgcaaagatggtacttgaatggctgaagtttaggtttctgctctagaggctccttcccatatctgtgtccagggtgctcatacactgtcccagaagctcagtagtacatgtgaaacctgtcttttacctaaacccttgtcatctacgatatgccttgggatctcaccttttattatgttttcttccttcctttctttctttttttaaaattaaatgggctccatatatttctaaacaaagaaataggaaatctaccatcctcctaaggcaattagctcaacagcagctagctttttctttttttaaagtttggaaaaatatactgttatatctacagtctttaaatacatagattattgaccattactaccttcctgaattcaaaccctgtgtttcaattaaatataatattgtttagtattaaataaaacaactgtgtactgttttatttaataatactcattgagtccaccaatgtcaattatttttgttgtattaggacttattgaacctacacatatattggattaaatgtttttgtcaccaagttaatttttaaatgtaaattagaacctaaaattttgatgcttgagcaggtacttaaatttgctgtattcactacgatggaaatttttttgctgtgataaatagagttgtctttacaaatattgcatgaaagcatattagtataagtaagtgtacagtttgtgcataattccttactcagtgggaggcataaattccattcccaattcataaaaattgaacaagtagtatttattccaaaaaaagggagtagttttacagtgatttattgaggagataaacatatctgattacaaagaatttatttaataagctaatagctttattttatattactaaagatgtatacttttttaaaaaatctttatttcaactatttctaaataaaggtttattcagtgattgtcctgaaattaaactagctcattaattactcttcctgtctttgcatacacacacacacacacacacacacacacacacgcactcacatacacacaaataggcataacttttgattttttaaatccttgggagaccttacatgaagttgatcgacctaagagtaggaatagaaagttattttttttgttgcagatatgcctgtagtatatatgcatttagtagtgctactgagaacgatagacctgtctatcctctccccatgtgctaaactttatggatgtacatttaaaaacttatagaccatacatgtactttgaggatcccatgtatttgcatttttattttagacaatagttttcctttctataactattactccaaaaaacattcttacattttggtaattagataaggactacatgaagacatcggtatttgactaacacattttgaaaattgtcacataagcttactttaatatatgctaaattataaatactaaatttatagtaacttgttatgatgtatttatatatgtgaatgtaaatagcattttagtaaacatacatgtacatatattgaacctctactgtgagagaaatgcagttgtcattgttatatgctccttgtaccctaatccttgttcctaccacttttagtatcagtcccttgtcctactgtaaatttattgggtaagataagcaaaaggtaactcctctttgtagaacttggggaacctctgcgttaggattaaatcagcctgattaaatgacttcataatgaaatgcagaacttcctgaccacatacttaagatttattagccattaatgggttgtctatgaactcccagcctttcacttaatattactaagatggaagaaataaaaccagccattcagctttcttaggctttccttttatgtcgtcctttctcctgcacagtcactcccaggagtttcctgtccacacttaaatgaatttacagctaatagaatatcaggtagtgtaggagagagatttgcaggcatcaaggttaatttctttaattatgtaagtcagtatatttagcatagtgtaagattggcttaggagtggtaagagaaaggagtattttgtaaggtccaaatttctctccctgactggtctgatcactgttaagccatgctgctccctttatcattcctcactaatgacttctctgtctcagctcacattccctggagtaggcaggcacacttgttaaatagtaggaagtagaaagcctacctggtttccccaggctcaaaggttcagtgagaaagaaacatgttttgaagcaaccattttgataaagctgctttgaaagatataatgaagactttctgaaaacagaagaaaataacaattagttttatgccttctgtataaacttaaaatatgcactaatcaacttttattgagaaatataagcattaggcattctcattccattcttgacttctcaccaacttttactttactgttctctctgtttcatgtttctgcattgctactattccactccagatattaatctctcatctgaagaaccatagactttgaaattatgataaaagatcaaagggagacaaaacagcagcagctggtctctcaatgtggctctaacagtaacatacgaacttagtagcttgtaagtggtcaccatcagtctaccatagccataaccaaaccaatgaccagttttgttaaattctcttaagaggaagtgattcagatgggccacagaattcaacccatggcttggctcccttgggtttgccagtgtattagggagagggtggctgcagggtcttgtggtccattacatacttagtaacagcaatgaatatcgattttcttgggtgattgcagcagccattgcttcctctaagatatatacatgtaagtcagaagaagttgaacttgctgttgattattaaaatattttttattggccattagtgctctataggattaattggttgctctttttctgtacattaaatctagatttatttatttatctatttatttatttattttttgagatggagtctcactctgtagcccaagctggagtgcagtggctcgatctcggttcactgcagcctctgcctcccgggctcaagtgattctcgtgctttagcctcctgagtagagtagctgggactacaggtgtgtgccaccatgcctggctaattttttgtattttagtagagatggggtttcaccatgttgcccaggttgatcttgaactcctgagctcaggcgatccacccacctcggcctcccaaagtgctgggattacaggcgtgagccactgcggctggcctacctttaatttttgtaggctgtggtaaataattataaatttttacagtagtttagaatttgccttttgtaatatacctaattcaaaatggaaatctattctcgttttcctgttaatttaattcttttactatataaggggttatgcaatattcaaagattaattgtagaactactgtatcataggttcatttaaaaatgtattaatgacttttgtcttataggacaaactattcgagagaaaagaattgtagaagcagcaaataaaaaagaagtagactatgaagcaggggatattccaacagaatgggaaggtaagtttctgcttttagtagaatctcatgggaggtaagttatataacagtatacaaattcaataagagcatatatagttatatactgtttctctttgcaaaaaagttttagtgtctgaatgtttgaaactttgtttttttaacattgcatttctttgaaagttgtgaaggtgctgaattttagtaagcagatgcatgtatagcaaaaagaactattaagcattatcagagctgagactaaggtgaggcaagccaaaatcctaagatgcaaaatttaagcaggcactcactttcatgtagtgacccagcacttgcacaatcctaggatttgaatcctgtttctggcactcattacacacatgaacttgcaaagtaacttaaacttttagttttttcttttataaattatgcataatacttgctgtagataccatttggagtattttttcaactcacaataactctatgataactgactgcctgttaagacaaggatggatgctcgatccctttcctaagactttgaagttaaaataaaagatcaaagggagacaaacagcagcagttggtctctcagtgtggctctaacagtaacatatgaacttagtagcttgtaagtggtcaccttcagtctaccatcaaagttttattgcataaaaagctaattgattttagaaaagctaatattgcagaaaaagctgatttactgagaagaaaacggaaactagttcacaatgagaagtacatagagagaatatttcctagttttccaacagctttctggttcccagttcagtttctctctgaatgaagttcatctgcaagactgagttcaaaatggcacctcataaccatgttatgtatttctgttttttgcttaccagttcctagcatagtgcctggcacattgtaaggcacctagtaggtagttaatcaatatgtattgaatacctgaggccgggagtggtgactcacgcctgtaatcccagcacttcgggaggtcgaagtgggcggatcatctgaggccaggagttcaagaccagcctggctaacatggtgaaaccccgtttctactgaaaatataaaaaattaggccaggtgtggtggctcatgcctgtaatcccagcactttgggaggccaaggcgggtggatcatgaggtcaagagattaagatcatcctggccaacatggtgaaaccccgtctctactaaaaatacaaaaattagctgggcatggtggcacgtgcctgtagtcccagctactcgggaggctgaggcaggagaatcacttgaacccggggggcagaggttgcagtgagccaagatcacgccactgcactccagcctggtgacagagtgagactccatctcagaaaataacaaaaaattcaaaaaattagccagtcgtggtggcacaggcctgtaatcccagctactcgggaggctgaggcaggagaatcgcttgaacccgggaggcagaggttgcagtgagctgagattgcgccattgcactctggcttgggcaacaagagcgaaactccgtctcaaaaaagaaaagaaaagaaaagaaatacctgaaactgggtaatttataaaggaaaaaggtttaattgactcacagctccgcatagctggggaggcctcaggaaatttacaatcatggcagaaggcgaaggggaggcaagcaccttctttgcgtggcagcgggagagagaataatgaaggaggaacttccaaatacttataaagccatcagatctcatgagaactcactcacttcacaagaacagcatggggaaaccgcccccatgatctagtcacctccctccttcgacacaaggggattacaattagaaatgagatttgagtagggacacagaaccaaaccatatcacccatttaatagatggagcacctaaggcctaaaaaggttagttaatttacctgggttatatagcttcatacgtgggtaaacagtagactcattgcttcttggttggcatagcatgataccttacatgtggtagctataggcattatgttacttttatgccagcatgtgaatgtaaacatcatttcagtaaaaatatttttccatttctgcttactactagaactatgaggaaaaaaaaaaccataaaaataagtagataccaaaggttttttgaagaaatacagaatataaattggcaacttctaggaggggtaattgagctttcttattttagcagactctccagtgttataaactacatttacaattcttggataatgcgtgcaccttcttagaatgagtttgtttttatcattttttccaataatagtatagaattaagatgtttatagaaatgttataaataaatgagtacgtaatgactcatttttcagcctttgagactttcagagagtttgaatgaagttctaatctttttatggctgtcctgatctagtaatttggcataactctcccatgggacatatgtttaaaacaaatgtatcaatcaaacactaaacaaaaattatttttatggtggtacacatcaattaaatgtgaaaaataactcagcaccatgaaaaagtaaattaagtattttcaggttcagatgaatattgtatttgtcaattttactgggacctgcaagttgcatattctcccacaatgtagattaaacaatgtgccctttttcttcgtttatttagtaggtatctattaaggacctctacattcatagagcttattttctagggtgggagaaagacaatacaccagataaataactagactatattgtatgttaatggccacagaaaataaagcagggaaagggcatagggagtgttggggaaggttttgcagtttttttgtttgttttttaagatggagtctcgctctttgcccaggctggagtgcagtggcgcgatcttggctcactgcaggctccacctcccaagttcacgccattctcccgcctcagcctcctgagtagctgggactacaggtgcccgccaccacgcccggctaattttgtttttgtatttttagtagagagagggtttcaccatgttagctaggatggtcgccatctcctgacctcgtgatctgcccgcctctgcctcccaaagtgctgggattacaggcgtgagccaccgcgcccggccgttttgcagttttaaatagtgttcagaaaaggctttactgaaatgacttctgaataaaaacagaaggagctagtcatgcagctaaccagctgaagagcattactggagagcaagtacaaaagccctgaggcaggaacatgctcagatgtttgaaaaacagcaaggaagtcagtgtgattgggatagaatgagagagaaattaatagataaggttagagagttaataggattgtgaatctggggggccttgtaggccattttaaagactctggcttttactgtgagactggaagccattgtagggttttgaaaagagtagtcatatgttctgaggtatatttaacaggatcactatggctgctgcattgcaaatagacttaggggaacataggcaaaatatggagacaggaagctcttgtaataatttaggcaagagattaattgtgacttgggccagagtaacagtgggagtggaaagaagaagttgcattccggatctgtggtaaaagtaggaccaacaggatttgatgacatattggatgtggagcatgagaggaaagcagacagtaattactcttaagctgttttggcctcacctggaaaaaggagttgctgttaactgacatgtgcagttaaaggagtgcagtgaaaggagcaagttaggggtggaaaaatgaaatcaattttggacatgctaagtttgagatgcctattagacatccaagtagagatgttaaattgtgtatgagccaagaacttagtggacatatctgtactggagataaaatttgggagttgtcagcaaataaatggtgtataaagcaatgagactgaagagatcacacacagaatgagtgtaaatacaaaatgagaaattcaaacactgacccttaggctgctccaaagtttagttagagacaatggagaccaaaaaggagctgccagaaacataggagaaaaaaaaagtgtcatgtactagaagccaaatatcaaggaggaagaagtaatcaaaatgtcaaatgaggtctgaaaattaactctgctttaaatacaggaactattttgtctgacaaaaatagttctgtagagtggtaggagcaaatgcatgatagaaaaagaagtatagcaagagagaatttggagagtctgagaatagacagtgtttatgaggagtttatctgtaaagaaaaggagaatgatgaagcagtacttggagaggaaaatggagtcaagaaatattttcttttgttttaaagacagaagagaattttgtaatagtgatgggaaagatccagtcagaaagaagaattgcaggaaagaggaagtccttgagaagacaagatgaggcaggacctagtaaacagggggaagagttgacctttgaacaaaagcttggaaaattcatcaatagtgatagcagaaaaagagtctgtgggcatatatgcaggtagatgggtagatgtggtaatgagaaattgtgtaaattctcttctaattcttactaatgaagaagagtgatttaagtaagttcctaagtatcaatagcaactagaacccagatttgaacccaaattatctgcttccaattttttactcaatattatactgcctacatcatttataacttggctaactcctatttattactcaagttttggagtagacattacttccctttgtaagctttttctgacctggcccgtcacccccagtgataggtgagatgttccttttttttgtttttatctcactttggacctcctccaatcatgacatttaacacactatagggggttccttgtttacttatctgcatcctccgccctaaactggaagattttttagaataggatccttaccttattcatttttgtattctcagggcctagctcaatagttaagtaaatataagctcagtcaacatttgttgaatgaatgcatttcaaactgaaagtatgttatgtaagtatgtttaaggaaaaggcattttggggagtctgctggcttgctgaaaatagtctgttttaagaagaaagacatggaacagtagaccagaccaatttttttcaaacatatagaagatttgatcaggtgcactggctcacacctgtaatcccagcactttgggagactgaggcaagcaggtcacttgagtccaggagttctagaccagcctgtacaacatgtgaaacgccatctctaccaaaaatacaaaaaattagccaagtgtgatggcacacactggtattcccagctattcagggggctgaggtggaaggattgcttaagcctgagaggcagaggttgcagtgagctgagatcgcgccactgcactccagtctgggtgacagagtgagaccccgtctcacaagaaaaaaaaaaataggagattcttggacaagattcagctgtgggagatagtatagtactaactactgggcaatgttataaagtttcagtgaaccttgtaagtttaattcatggcattatttgtagttcttatgtagaggctctcatatttgtctctctataattcagattgttgtatttatctttcatttttgttatttttcttgtttttggtaagtttaagcttgtttcgtgttaacagtaataaacattttttatgagaaccctaaaatacatacaaagcagaatatagttggaggaggcagaaaggccctgatccagttaagctttacttatcacatatactcattaaaatagaagattaatgcctcagaagagaaataaaaattactttttaggtatattagaccatacctgtctatcattaacactgttaataattaatatctcagtataaaatgtcatacccacttttattgcttttaagttaataattgttcataattattcaacatgtctttctcaggccacaggaactccttataaagaattttcaaagtaagcttcataaaataatagaccaggatgttgctatccctgttctagaatcaagacttatgttatatccatgttctgcaatggtcatttactaccttggtcattttggcaaagggatttacctcctatttttcatctataaaattaaaacgctgagttcataaccctttaagcctcctatctatctctaatgctctatgattcatgacccaagaagtatctcgaataaactcacattgcgacgcagaatctctggacttccagaacaatttggttgaacctccagtacacttgaatagaaaagattagagagaatattcttgcattgtttctgaccttagcattcaatctttcaccattaaatatgttgtttgtaggtttttctcatagatgcctttatcaagttgcagaacttctttccttgatggggccctctgccaatcctctagggtttgttctctatgtagctgtcacccaactggtactctgaactgtgaacttgcgtgaccttggtctccctagactcccagctccatcttcttaacttatatagtctgctggattttgacaggattccctccctggggcacaaccgaaactcaaagtagtaaactggggcgatcgtgaggtcagccttcgtttatttaacgttctctgagaccactgtgtttcattattcaatgtccattgttttgaagattgttgttttatgtaatttgtccttgttgctccatcttgactagaagcaaaaggcagcttttttttttaacataccttaatacatttgagatttgtttgtgtacttgcatgaatcagtaagtttattcctttttattgctgactagaattctgtcatattgatatatctttttgcattaactagttgaaagacatttgagtcctttctactttatagcaattatgagtaaagttgctatattaattcatatacacattcacgtacaaatctgtgaacagaaattttctttcaaataagtccttgggcaggattggtaggttttattttaagtatagatttgattttataaaaaactgccaagatatttttcaatgtggctgtaccattttgtatttaagtgtaagtttgattttataaaaaactgccaagatattttgcaatgtggctttaccattttgtattcccattagtagtgtatgagagttcaagttgttcatcatcttctccagccattgctgttgtcagtttcattacatttgagccattctaattggtgtgttttgatatctcattgtggttttaatttttatgtctctaatgactaatgacctagatcatcttttcatgaacttatttgccatctgtatatcttctttggtgtacttttatatctttttgcccagaatttttttaattaaaaaaattagttttgagaatttcctatgtatcatagatataagtcctttatcagatatgtgattagcaaatatttttcacagtctatggcttgtcttttcattggcttgtcttttcattctcttgacagtgcctttcaaagagcatacattcttaattataatgaattccagtttatcatttttttcttttatatatcatggtttcaatgttgtatgaaagaaatctttgcctaacctgaggtcaagaatattttgtcctgtgatttcttctagaagtttggggttctacagttttgggttttacattaaagtctatgatacatttttatctgtttcatgttttttatggcaatctaattttccagcaccgtttttttaaatgaccactattttttccattgaattgccttagcacctttgtcagacatcaattgactatggatgtgtctatttctgcattttctattccatccatggagttatttatctttttgctagtgctgattgtcttgattactgaggctttgtaacaagtcttgaaataaatcattttgagtctgccaacttctttcccaaaatttttgtcttggttagtcagggcccatataatgtttttacactttaaatatgtgcagtttattgtacatcagttatacctcaataaagctgtaaaagaataacatagtcatcttggaaaaataagttactgaatgaggatagtaataatgatacaagcaagggatacaacaaaaaagtgtcagaactgactcttttcccagtctcaggatttgacttaatctagaagactatttgaaatgtggatttgccccaatctctttaactgaagaacgtcaccttgggcatagattagtcttgagatactaagttatataatatgaagttatcccaagtaacagagcatgtaaagatcaaatgcccagacaaacctctatagtttttccagagatatttaaagttggtgtcatattcaatccaggactttccaaagtttctttaaatttaatgataaatgttttgaaatcttttttgaggtttcttaatagcgaaagcaaaaacttacataccattgggaatcatttatttgttcttcctgttgtgataaaaatgtctgtagtaaaaactttaacagaaataaaaagcaatctggcaaggaactaaaatatatttcttcatcagcatacattattggaaagccagcagaaagcatggctgaaggaacatgtatttggacaaagtatgcagggcactgcactgccaaatggatgttacaaatgtttttagcatgtcttctcttataacagaaagaccatacttcttaatttttgttagtccccaaagcaaagataaactagagaagatatagcctcagcagtaaatgacccacttaataaaaacaacgattcacaggagaaaaaaaatgtgcatgagtgtaagattgatggagctgctgctttaggctacaaggacctgtaatgaagttcctgagattgtgcaaataaaattcatcattcttggggatgaaatagaagccaagagtgtacatatatactttattttttagagatggggatcttgctctgtggctcaggctggtctcaaactcctggcctcaagcaatcctcctgcctcagcctcttaagaagttgggactacagacacacatcaccatgcctataagtacactttacttttttctttctttcttttttaaattttagattcaggggttccatgtgcatgtttcttacatggatatattgcatgattctgaggtttggacttcaactgaacctgtcacccaaatagtgaacatggtaccctccctagtttctgttgttcccatttttatgttgatgtatactcagtatttagctcccacttattagggagaacatgcagtatttggttttctgtttctgcattaattcacttcagattatggcctcctgatgcatccatgttgctgcaaaggacataacttcatcctttcttatggctgcatactattccatggtgtatatgtaccacattttctttatccagtctacaattgatgggtatctaagttgattccacttttttgctattgtgaatagtgctgcaataaccgtgcgaatgcatgtgtctttatggtagaatgatttatttttctttggatatatactcagtaatgggattgctgggtcaagtgatagttctatttttattagtagttctttgagaatcgccaaactgctttccacttaggctgaactaatttatagtcccaccaacagtgtataagtgttcccatttctttgcaacttcaccaacatctcttattttttgacttttaataatagccattctgactggtgtaagatggtatctcattgtggttttgatttgcatttctcagatgattagtcatattgagtattttttcatgtttgttggccatgtgtatatcttttgagaagtgtttgttcatgccctttccccacttttaatgttgttttttttttctttttgatttattaaagtttcttacagattctggatattatactttgatgtcttacatttaagtctttaaaccatcttgagttcatttttgtatacggcgaaaggtaggggtcaacttgcatttgtctatatatggctagccagttatcccagcaccatttattgaatagagttttcattccccattgtttatttttgttgcttactgcaaactctgcctcctgggttcaagcaattctcctgcctcagcctcatgagtagctggattacaagcacacaccatcatgtctggctaattttctatttttagtggagatgggatttcaccatgttggccatcctgaccatgctggccatcctttcaccatgttgagatcctgacctcaagtgatctgcccacctcggcctcccaaaagtgctgggattacaggtgtgagccacccctccggcctgtagttttcaactatagatcttgcacatgttttattaaactaatacctaagtgtttcttgatttttttggtgctattgctagttgttttctattttaatttcaaattattcattggtaatacatagaaatacaattgattttgtatatcaactgtgtacttttaagtgatattgttaaactcacttatcaattgtatcatctttactgtaaacttcttgtggttgtctgcataaacaatcttttccttctgtttcttctattctcatgcgtaagcctttgttttttcttgccttactgcactggcaaggaacctccacaataatgatgagtagaactggtaaaagtgaacaactttgccttgttcttgatcttagcaggaaagcattcagtttttcactgttaggtatgatattagctgtaaggttttttagatgcctgctgtcagattaaaaagctgtcttctattcctcggttgctgggcatttttatcatgaatgctgttggattttgtcaaatgtattttcttcatttattgagattatttttatgattattttttttcattctgttaatatgatttattacattgattgattttatttttaaattatcctcccttttcattgtggtaaagtatacataacataaaaatttccattttagccatttttaagtatacagttcagtggctgtaggtacattcactgtttgcaactatcagcagcattcatcgccagaacttttttcatcttcccaaactgaaacttcatgcccattgaaaaacaactctccatttcctcctttctcccagtctttggcaaccaccattctactttttgtccctatgaatctgactactctaagtacgtcatagaaattgaatcatacagtatttgacctttttatgtctggctgatttatttccctcagcataatgtcttcatggttcatccatgttacaggatatatcagaatttcattccttttttgggctgaataatattccattgtatatagataccacatgttgtttatccattcatcgaatgatggacactggagttgcttcccccttttgattattgtgaatagtgctgctatgaatataggtatacaaatatctgtagatttaaacctatgtaaataggtacagtaaatttaagtggtctagaaatgccacacaaaaagcagaagttgtcagaatgatatatatagaagatagctacatcagacaacatgacccaattgacataggacactccactgagcaattgtaaaatgcacatttttttccatatgctcatggaacattcaccaggatgggccacatattctttccagaaatgtgggagataggaatacttctctactcattttattaggccctgtttaacctgatatcaacctgacagaaacaataaagagatactacaaaccagtatcctacataaacatagatgtagaaatcactaacaaaatattagcaacctgaatccagcaatatataaaaagggcagtataccatgaccatgtggagtttatcccagtaatacagattggtttaacatttgaaaatccatttatattcagcataataacaaaaaggagaaaaatcatgagttaattccagttggtacagaaaagaattgacaaaattcaatatacatttatgattaaaaactctccacaaacttaaaatagaaaagaagcgcctcaacctgataaagggcattaaggggggaaaaaaacctacagttaacctcacattcaatggtgaaaggcagaacactttccccctaagattgggaacaagacaaggatatcttctttgactatttacatttcacatcatcttggaaattcttgtcaatgcaataaagcaataaaaataaatgaaatgaatacagataagaaacagatgacatgattacatgtagacagtctacaaaaagtacgtaaaaattaagtgaattttgtaacttttcaagatacaggggaatataaaatcaattatatgtctacataataataccaaacaatttctaagtaaaaatttaaattatattacttcaaatactattaaaaacttgaagatttagggataaatttacaaaaatatatccaagacctttacattgaaaaacataaaatatcagccgggtgaggtggctcatggctataatcctagtactttgggaggctaaagtgggaggatcacttgaggccaggacttgcagtccaacctgggcaacatagtgacaccttgtctctacaaaaagtaagcactttagccaggtgtggtggtgtgcacctgtagtctttccagcctactcaagagcctgagatgggagaatcacttgagcccagaagtttgaggttatagtgagctgcaatcattccacagctctccagcctgcgtgacacagcaagatcctatctcttaaaaaaaaagaaaggaagaaaagaaaaatatgaaatattgctgagaaaaattaaagaagacttaaatagagagatgtacaattttcatagatcagaagagttaatatttaaaagacagtatttcccttcaaattgatctgtaaattcattgccctccaatcaaaatactaacagcctttttggaattgatatgctgattttaaattttgtattaaaatacagagaacctagaatactcaaaacttttttggagaaagaacaagattggagaatttaacttaatataaatctacatttatcaaggtggtttggtactgatgtaaggataattatacaattaatggaaccaacctgaatatccaggaattttctcacacttatatggtcaattgatttttcaatagcaaggaaaattcttttcaatagcttgtgttgaataactgaatttccatatggaaaaaatataaaccttgaacattaccttatataatcctccaagaaatttaacttgggatttatcacagacctaaatataaagctaaaactaataaacttttagaagaaaaagatgaacaaaaatctttcaattatgagtagtcaaaaactattaaataggaccctaaaacacaaacttaaaaaaaatgataaattggacttcaccaaaattttacagattcttatttttaacagatttattagagcaaaggaaaatacaagccatagacagggagaaaaatttgccatacatgtctaacatcgaacttatattcagaatatgtaaagaactctcatacctcagtgagagaaacattaattttaaaatggacaaaaggtataaacagacactttaccaaagaggatttatggtgtggactaaatgtggttcccccacactcttctaccccattcatgtgttgaagccctaactctaaatatggtggtatttagaaatatgggacctttgagaggtaattagagttagatgaggtcatgagggtgaggccttaatgataatattagtgcccgtaggagaagaggcaccagagagctgtactctctccctgagcatgcacaaaaaaagaagtcatatgggtacacattgagaagatggctgcctacaagccatgagaagaagccccagaaagaagctgattatactggcatcttgatctcagacttccagcctccagaactgtgagaaaataactttctgttgtttaagccactcagtctgtggtggtttgttatggcagccgaagcagactaagacaatacataaaatcagtagtcatcaagggatactaattaaaacaacagtgaagtaccactacatacaactagactgactaatattttagaaattgataataccaacaaaactgacaatacattcatgaagatgtaaagtacctgaaactttcatatatttctgactagagtgtaaaatgttacaactactttggaaaacagtttattagttctttatcagtttaaacatacacacttatcctacaacctggacattttatggctaagtattcacccagagacataaagacataagtccaaacaaattcttgtaccggaattttcccagcagctttattcataatagccaaaaactgaaaaccactaaaatgtccaacaagtgagaggataaacaaattgtcatacttccatgcaaaggaatactacacatcaataaaaaataatgaactgctgatatgctcattatgtttgtttttattgctgtatgtcaacattaccacaataataatagcttaaaataagacacatttattatcttacagtttctgtgcatcaggagcccaagcacagcctagctaggttctttagttaagggtttcactaagctgtaatcaacccaaggctgggttctcatctagagacttgattaggaaaagctctaccatcccacttgtgtggttgttggcagcattcagttcattgctgttgtaagactgagagcttcactttttcactggttgttggccaaagaccacactgagtcctagaggtcactggcaatttcttgccaatggtgtttcccaatatggccacattttccttacagccagccagggggaaaaatactccagccaagatgagcaccataatcttatataacgtaatcacatgagcacatatatcccatcacctttgccgtgttcttataattagaattcatgggtcctaccctcattcaaggagaagagataatacaaatgtatgagtaccaggaggtggtggttgtgtaggctaccttaagagtatcactcattgcctggggactatgggtaggataaggtgggtgtttccatgtaaacagactggggaacttttataggtgatggaaatgttctgtctgttgattgtggtgctaattacaggattgtaaatatttttgttagaagttgtggaattgcacacttgaaatggctcacagtattttgtaaattatacctcaataaagttaagagaaaagacagtaatagccatgagcaccacaaaatttgtaacttaaagatgccaacttaataatatccctaagatatccttaaaagtcaataattggaaaatgatttgtttcataatatatcctttgaaggattttcacagtaaaaactgtggatctcttatttttatagtcctttatgaagtgtcagcactcagaactagcaaagatcatttttttaaagatgaggctttattacagtctcttctgtaagtgaagtaagcacatatttctaatgcaatatcttttggatgcagactattgataacctttccgtaattttggttctgaatggttacctactggatctggtgatagagtatttcatttactttagcctctattgacaacgcttctaaaggtgtacttgccatttttagcacctgtggagatttgaagagtgtatgcttcatgaagtattttcttgcttgattcttctagtctctttaagtgattaaagggtgctttaatttgcatactcacctttaatcttattatagtggcttatattctaataggaatattaaagttcagtgaaaatctcatacatgctgatgagaatgcaaatgaatattgacgaaagaatgctaggatcataaggtgtaaactgtccagttatcttgctaaattcatttcaaacaatgtttacattataatgaggactgatacagatttcaccacataaatatcactagcagtggcaaaattatataatttataattggataatggttcagtttcagactgttttgaagttaacaaaaacaacaaagtaatgtcttgatattaatgcaaacttcagctggtcatttgttgtatgtagtagttgggaaattgggtatgattttacaaataagtggtcacgttgagcatttccggctgtagcctttacaggatgcataacaaatagtagtggcatcactcatcatcccaacaggacatttcaagtatctggttattgtacaattataaatatacaagcttatttcagtagttatgtttatgtatctgtgtaaaaccaagattcattaaatggtcattgaaaatgaagctaaaagaagtcccctgacagtaaatagactaggcaatatttattataatacattcagtatttaagttctattacattcttatattaatggatgaattttataaacttatgcaaaaccagtaagctttagaaaacatataacagagtttctccaacctctttaactactttggaatttttttaatgatttgtattcaattgaagtattttttttttcagccttacaagagaactgaaaatgctgttttatagactcatcagtagggcagattgttatttagagttgtttttctcatggtgacgataagtgtgcattatgccattatactttttcagcatggtcttatgcccactggtgtgtcttcatagactctagaatacatggtaatcattagttaaaagtataataatcaataatgatttttattttaaataatatgaaagtgtttttgcatcaaaatatgtatttttcgctaaagggattatacttaattgtagccctggcacaggagttggcaaactttttctttaaaggtccggatggtaaatattttaggttttttatgggccacttagtcagttacaattactcaactctaatgttgtagcacagaagcagccacaaataatatgtaaacaaatgtttgtctgtgttccaatcaaccttatttctagacactgaaattttgaattctctatgattttcatgtcatgaaatactgttcgtcttttgatgtttttgcaaccattaaaaaaatgtaaaaagtggtaggctaaacttggcttgcaggctatactttgctgacacctgtcctagaagttgatttttctaaagctagaattaacttctactctacattaaaactgaagatatattgctgaaaccttttatagatatatagttcatgttgagttattttaaaaggaagctgttttctagaaaaaaaatcataattatacataagtaactttatttttaaaaaaacttttattttaagttcaggggtacatatgcaggtttgttacataagtaaatgtgtgtctggagattttgatgtgcagattatttaatcacccaagtattcagcctagtaccccattagttatttttcctgatcctctccctcctcccatcctccaccctccaataggcttcagtgtgtgttgttcctctctaggtgtccatgtgttctcataatttagctcccacttataagtgagaacatgcattatttggttttctgttcctgtgttagtttgctaaggataatggcttctggctccatccatgtccctacaaaggcatgatcttgttcttttttatggctgcatgtattccatggtgtatatttaccacattttctttatccagtgtatcgctgatgaacattcaggttgattccatgtctttgctattgtgaatagtgctgcaataaacatacacatgcatgtgtgtttataatagaatgatttatattcctctaggtttatacccagtaatgggattgctaggtcaaatggtatttctgtctttaggtctttgaggaatctcacactgtcttctacaatggttgaaccaatttacactcccaccaacaatgtatagcattcctttttctctgcaaccttgctagtgtctgttattttttgactttttaataatagccattctgactggtgtgagatggtgtgatttgcatttctttaacaatcagtaatgagctttttattttatgattgttgaccacatgtatgtcttcttttgagaagcgtctgttcatgtctttggcctactttttaatggggttgtttattttattttcttgtaaatttgtttaagtttcttacagatgctgaatattagacctttgtcagatgcatagttggtaaaaattgtcttccagtctgtaggttgtctgttgactttgttgatagtttcttttgctgtgcaaaagttcttcagtttaattatattccatttgtccatttttgcttttgttgcaattgcaacaaaattgcaaattttgttttgagaattggtgtcttctcatgaaatttttgcccatttctatatgctcagtggtattgcctaagttgtcttccgaggttttgtagttttgggttttacatttaagtctttaatccatcttgagttaatttttgtgtgtgtataaggaagtggtccagttccaattttctgcatatggctagccagttatcccagcaccatttattgcataagaaattctttccccattgcttgtttgtgtcaggtttgttgatcagatagctgtaggtgtgcagtcctatttctggactctctattctgtttcattggtctatgtgtctgtttttgtatcagtaccatgctgttttggttaccatagctctgtagtatagtttgaagttgggtagtgtgatgcctccagctttgttttgtttgtttgttttttgttttgtttgttttgtttaggattgctttggctattcaggctcttttttggttccatatgaattctaaaatatttttttctagttctgtgaagaacgtcaatggtaatttaatgggaatagcattgaatctgtaaattgctttgggcagtatggccattttagcaatattgattcttccagtccgtgcgcattgagtgtttttccatttgtttgtgtcatctctgatttttgggcagtggtttgtagttctccttatcgagatctttcacctccactgtattcctaggtacttaattctttttgtggcaattgtgaatgggagttagtttgtaatttggctctctgcttgagttttgttggtgtataggagtgctagcaatttttgcacattgattttgtatcctgagactttgctgaagttgcttatcagctcaagaagcttttgggctgaggcagtggggttttctagatacaggatcatgtcatctgcaaacagggataatttgacttcctctcttcctatttggatgccctttactttttttctcttgcctgatttccctggccagaacttcctatactatgttgaatacaagtagtgagagagggcatccttgtcttgtgccacttttcaagggaattgtattagtcagagttctctaaagggacagaactaataggatatatgaatataagaaggggagtttattaggagaattgactcacacgatcacaaggtgaagtcccacaataggccatctgcagctgaggagcaaggaagcaagtctgagtcccaaaacctcaaaagtagggaagctgacaatgcagccttcaatctgcagctgaaggcccaagagtccctggcaaatcactggtgtaagttcaagaatctaaaaactgaaggacttggagtctgaagttcgagagcaggaagcatccagcatgggagaaagagtaagtccagaaggctcagcaagtctgctcattccgctttcttctgcctgctttattctagccatgctggcagctgattagatggtacccacccagattgaaagttgttctgcctctcccagtccactgacttaaatgttaatctcctttggcaacaccctcatagacacacccaggaacaatatattttatccttcaatccaatcacgctgacactgaatattaaccatcacaggaatgcttctagcttttgcccattccatatatcggcagtggatttgtcatatatggctcttattattttaaggtatgttccttcaatgcctagtttattaagagtttttaacatgaagggatgctgattttaattgacagccttttctgcatctgttgagataatcatgtggttcttgtctttagttctgtttatgtgatgaatcacatttattgatttgcatatattgaaccagccttgcgtcccagggatgaagccaacttgattgtggtggataagctttttgatgtgctactgtattcaggttgctagtactttgttgaggatttttgcattgacattcatcaaggatattggcctgaagttttccttttttgtggtatcaaacactgccaggttttggtatcatggtgattctggcctcatagaatgagttagggaggagtccctcttttttaattttttggaatagttttagtaggaatagttccagctcttctttgtacatctagtagaattcagctatgaatctgtctggtcctgggcttttttggttggtaggctatttattactgcctcaatttcagaacttgttattggtctgtttagggattcagtttcctcctggttcagtcctgggatggtgtatgtgtcaggaatttatcaatttcttctagactttctagtttatgtggataaaggtgtttataatattctctgatggtttttctttctatggggtcagcgataccccgtatcttttagatacaccaatcaatcagatttggtgtgtttacataatcccatatttctcagaggttttgttcattctttttcattcttttttgactattcttgtctgcctgtcttatttcagaaagaccgttttcaaactctgagatcctttccttaacttggtctattctgttattaatacttgtgattgcattatgaaattcttgtattatggttttcagctctatcaggttggttacattcttctctatactggctgttttgtccgtcagcctctgcaatgttgtatcacaatttttagcttcttcgcattgggttacaacatgctccattagctcagtgaagtttgtttttattcatattctgaattctacttcggtcatttcagccatctcagcttaagcgcagttctgagccctttctggagaggtgatgtggtcatttggaggaaagaggccactctggctttttgagttttcagtgctcttgcactgattcttcctcatctttgtggacttatctacctttgatctttgaagttgctgacctttggatgggtttttattttttagtttgtttgtttcttttaatagtctagtcagttttccatagggctactgcagttttctggggatccactccagtccctagtcaccttgaattttccagtacctgtagacatcaccaatgaaggctgcgaaacagcaaagctggcagcctgcgcctttctctgggagctccttcccagggagatacagacctgttgccggcctgaatgcacttgtaggagggggctagagaccccagttaggaggtctcacccatttaggaggaacaggatcagagacctgcttaaagaagcagtctagctatgctttcatagagcagctgtgctgtgctgggataccgcttccacccctggtcaacttggactctccaaagcccggagcctggaatggctatgtcaccgaaacagcaaagatggcggcctaactctccctctgggagctctgtctcaggaagttctcaaatctctgtcagcctgagaacatgggcagggtggctggaggccccagtggggagctcctgcccggggaggaggaacagatcagggggccactttaaagaagcagcctggccacattttggtagaacaactgtgctgtgctgggagatcccttttgtttctggtcggtttggactctccaaagttcacaggttggaactgcagagttatccaaacagcaaagatggtggcccttccctcccccaaggaactctgtcccaggtagggggcgacactgttgccagtggttggctggaattctaagccagtgggtcttgtcctttgaggcactgtggaagtggggcctgcggaccatcactgcttagccccctcgattcagccttcttcctaggggtatgtacagaggtccaacctcctgccttgacagagctgcagtcactattgccaggaagtgtggagcctaagtatgtagagctgcgcctctgtgcgtgcctgagtggctgctctgccaagagtccacacagctctgtgtcagaccaaaggccctggtggagtgggtttaggaggagatctcctgactcagggttgcaaagatccatgggagaagcatggtttcccagggtcacacatttgaatactcaccacttccctaggtgggggaggttcccctggctccatgtcgctccagggtgggctgttgtgctgtcttgcttttcttcattctccaggggtcgagttgtttccttgattagtaccaatgcgagtacctggatgtttcagttgaaggggctatatttactcgcccctttggttgctctccatgagagccacgtaccctagctgtttctagtcgtccatcttggcctgaatctaagtaactttaatttgggccataaagaggcaattgaaaaattcccaaagtcacttatttccttgactacacaaaggaattgtggtattgctaagctggattttctaataaagatcaaaatcctgatagaacaaatatttttcaaaatattcattcaataatttttaaagtaccacctcttttatagcatttaaaagagtaaataccccaaaagagtaggtacttaaaatgacagaaaaataaatctcccatgggtacctcctgcctttgacaaccttacagactcacaagggagattaaaacctttgcaagttggccaggtgtggtggctcacgcctgtaatcccaggactttgggaggctgaggcgagcagatcacgaggtcaagagatcgagaccattctggccaacacggtgaaaccccgtctctactaaaaatacaaaaattagctgggcgtggtggcgagtgcctgtagtcccagctactcggggggctgagacaggagaattgcttgaaccagggagtcggaggttgcagtgagccaagattgcgtcactgcactccagcctggcaacagagtgagacaccattgcaaaaaaaaaaaaaaaaaaaaatctgtacaagttttggctagaaattggccaaataggagtaaaagctaatagaaacagaatacaggctgggtgcagtggctcacgcctataattccagcactttgggaggccaaggtgggaagatcactgaaggtcaggagttcaagaccagcgtggccaacatggtgaaaccccatctctacaaaaaatacaaaaattagctgggcatggtagcgagcacttgtaatctcagctacttgggaggctgatgccagagaatcacttgaatccgggagacagaagttgcagtgacctgagatcacaccattgcactacagcctgggtaacagagcgagactgtctcaaaaaaaaagaaagaaggaaacagaatgcagaaagaataacaagggtagaaatttagaaacagtagtagagaatggagaacactggaactgtattggagatacatgtaagggataagtgcaagagagaatagagcagggggaaatgactgatcccaagcccgcagttgaatgttgctgtttccacccccacaaaccattcagtgctgggctttttatgaagacaagtcctggtgctattacagatgatccttggtttgcagtgaggttatgtcccaataagcctatcatatgttgaaaatatcatcatgtagaaaatgcatttaatacacctagactactaaacatcatagcttagcctagcctactttaaatgtgttcagaacacttacattaacctacagttgggcaaaatcatctaacacaaagcttactttataataaagttttgaataacttatgtaattcattgaataagtactgaaatgaaaaacagaatggtttcataccatggtaaagtcaaaaatcctaagtcaaactactgtaagtcagtgacagtctgtgcctaaatgaataaggctggctgttagagctggtcacaagagatagtggctggtgaatggataaagctaagactttagagccagttcaaccagggtttaattcccagtcgctaattatatggcattaggaaagtttcttaatctctctgggcctcagtttccaaatctctaaaatgggatcaataattcttatttttctaacatgtagttagggtcacacctagcctggctttctctttctggtttaatattctttgcatgttgttcataaactttgaaagactgcttagttgagcgtggatggtttttagagccagagacagggtcagatctgaattcaaatacaaccattactacttaatgtataaatttgaggaattcattttatttctatttcttcaattttgtagtgaagagtgaatcaactgaaatgataaaacagtggccttcaagatcatattccctacaatatattttctcacagtctcctatacaacattgcaggctaagcagatattattgatcttttgttttttgagtcttatttttaagagatttattgaataatagtaataattatactaataacttagacttatgtgccaggcttcaaagtaaacatttatgtatattatcttatataattttcacaacaaccctgaagtgtagatacttttataatttccattttatagatgggaagcctgatgcttagaaaattaaataacttgctccaggtgacacagacagtaagtgatgaagctgggatttgaacccagaaaatctgactttagaatctcataagcactatactatactgtcttccatgtgattctgataacttccctaaaggcagctgccccactcccttcccattgctgcaaagcatccagcacagtacccaggccccagcagccacttaacaaatgtgggctctatctctgcagcccatctgccaagtgttagagctaaggcctgatgatatttttgcttgctggagcaaatcagaaaagaaacctctgtaaatgaaaaacttttctaagtcccttcctttataaattgaacagtaactaattcaaatttccagaataatataattttgatattgtcttgaagtttgctgtattttggtttggcttgtatgccataaatatacccagtcgaatttagatgattaggaggtatgattttaaacatatgaaactgtcccctctttatcttctctacactattatattctcttcatgacacatatcaccaccaaccatatgtttgtgtgtttattttctgcaaccccttcagtagtacatgtgctacagtagagaagggacttaatctgttttattccctgctgtatctccagtacctaaaataatatggagtaggtactcaaaaaaatttgttttatggataaaaatgtttgtgtaaattatgggaaactgacatttaaatattatttttctttctagcttggattagaagaacaagaaagactccacctactatggaggtaagactacacaaggaggatatcatttaggagtatatattcccaaggatatacgaagcttcagaaaaactatgatgtattttctcaaagtgttgattttattccatcacagaaaataacttaaaacattttataataaattaatatataaacctatattattaataaaataatatatgataaaataaatgctcatattatggaatataacaaaatttgtataaattttaaagtgaaataataaaaatttaaaacaaaattaaaacactctgtagaaagtctgaacttggagcagtttgcaccaggttatttcccctgggccctgggggttctctgtgccaatactcaagcttttgtggaaaagtttgagaaacactgaatctctttgtcttgtccaaatcatgctcttatgtttcccttaatattatgtatttaaatccatcaagtatccaaagaaactttaaaatacagaattagcaattattttataacagtaattattagttgactttttatttaaaactaaaaaatttgtagtcagtgataaacaataaaaaaacatagaaatgctatggtatatatgttttacaatataatttttatatagattattttataaaaattataattttaattttaaaaatatgtaaagacctctaaagttattttataagaagtaatttcataaaaggagagtctctaaatgcattagtgtactgccttgtttactttttgtctagaggcattccctttcttctactatttaggacttccctcctctcttctgttgcctattctgtcactactacaagccctgatgacaacataaatgggctccggtactcaatccccatttgttgggaagtggagtgctctagagcaggataatgatgatacctcaactggcatgcttatgtttatttgctccatacatttgtcatatactgaacccattaatgttcattcggccagggtctgactgagtacatctcttgacccatttctagctttgtatgttgcttctgccttggcctacttttcgcagacccttctttccaacattgataaaatttggaataaaagctgttttggggggaaaaaataaaaggcaatatgatccaggattcagaagtatgcccagtagtttacagtgaaggatggattgaagagccttctgattctccttctcttggtcataataagagctactgttatcatttgcttcatccatcctcagaactttgaaagccttattcatagaaacattaatatgcaaagtgattaatggaggcaattgcaatagttgggcctcaggcacaacttctgtaaattttaggtaatttcagcacctcaaacaatctctagccagaacacaccaagtccttccatccctgagctcactcttgttaattttgattatccaaaatgagccctcttttgttgcctccctttaagtgtactatcaatcacattgttctttatgctgcttcgtaccctccctaatacacacacacacacacacacacactcttttccttcctcttggccctttccattgtgtttcaggaatttctgtttctttgttagcaaattaccattcaccattaatattttcctggaaactttctctaccacagaacctcaactgaaatccgtctgtgcctgcaagatagtgagttcctttttttccttgaagtaagttgtgctcgctttcccacgccccacataaagaaagtgagttcaactgcttcttgcttccccaaatagtctttgtttgtggacccaagagagtggaggacctttgtaatccatgtgtatttctctgtacctgaccatcatttttatgtttgccaacatccaagccagtctaccttactgatggtcgagattagaacctggaatatggtcttctcctttcaatgctttcccaaattttagctttccagttctttgacttcatccatactagtatccctgcctcaagtgaacaaccacttcattaggcacactttagtttttatcaaacacagttcttaccactgtaacttttacactcttcaaatccaaattctagatacatcatattaagaggaaaaaatttttcttaatgtaaagtaaaacatatatttataaaccgtaacaaaaaaatagcttatttagttattaagctgtgaaattataaggcaaattccacccaggtcaagaaacacaactttgccatctacttcagccccatatatcccatcctaatcacaaccttctctctcttgacaaaagaaaaccttaagccaacttttatagtaatcatttcctctcattttaaatagttttttcacctaaatgtacattatagtttagacttgtccatttcgtaaaaacttcgtatttgttttaaatctttcagtctatcctcttccatttcttttacttccttagaaatttatgtgttaaaatacccagcccagttggcctacagaatttgccacagtctagattttgctgatcttatgttcctggtgcacttcatcatgttcctctgtccactgttttccttccaagttgacaactggatccagaaactagattttttttccagatcttttagtgaatacccaactccaaataaactttctttcatatctcctatatattattgctaaaggttagccagcagccattagaatgtcatttacaacagtattagaaaacatagaatactgtggaatttagtgagcaaaacatgtgcaagatctgtgtactcaaaactacaaaatgttggtaagatacattaaataagacctaaataaatggggagaagtatctgttcatggattggaatgtacaatattgctaatgtattcattcttcccaaactgatccacagtagttcttatgcttttattttgcatctgcatcacctgaaagacttgttaaaacacagattgctggaccccaagcttagagtttttgatccattagttttgaggtagggcctgaatatttgcatttataacatgttgctggatgatgctgatgctgatggttcatagcccatattttgtgaaccactgatttatagatttaataaaatgaatatccagttaaaaccatgtcagacttttttgatagaaatcaacatgctgatttgaaaatatatttggaaatgtaaaagacctagaatagctgaaagcagccatgaaaaaggagatgaaaattaaagggctaatactgtctgactttaagaattactttaaaactatagttatctagacagtatgatactggcattaggatactgggtaaataaatcaatggaaaaaacaaaagtccaaaaagtagatactgtacaaccagttggtttttaacaatgacatcaaaacaacacaattaggaatggaaagtctttttagcaaatggttctggaataacttaatatccatatggggaaaaattgatccctacctcacgtcatacacaaatattaatttaagatggattatagactagacataaaagccaaactattgtgcttctagaagaaaaaaacaatggaatatctttgcaattttgaggtagacaggagacagaacaatctgtaaaggaaaaatacagattaatcagatttaatcagaattaaattctaatgctcattataagagaacattaggaaatcaaaagactaggagaaaataatcatagtacatatatctgacaaaggaattgtatctaggctatataaagaacacctcaactcagtgttataaaaaagaagctaacaaatattgggcagaaatcttgaacaagcactctgtaagacacgttttaagtatatgaaaatatacttagcaacactagtaatcagtggaaccacagtgagataccactacacacccattaaaatggcttaaatttaaaagattgacaacagccatcactggagcacccacaacttttatacagtgctggttggggtgaaaatgatacaatcatgtttgaaaactgacagtttgttataaaatcaaacatacatataccctgtgatcaaacagtaattctcccggccaccttgaaaactgaagggatcaatttttagtcacactttctgggagctctggccaacagtaggtctaacaccttggcatactatgcaaggcttcctgatttgggcccagcccgactttctagctttgtctccttaggctaccctactcttctgtaccctactctaccctactcttcaaggaactccctgctgtttctcaagtttaatgtcttctccttctcccatcaactggcatactcctgcttatgtttaattccttttaaaaggccctttaaaatccttggttgttttcctcacctttttttccctcaacttcttaactgatagagctaatcactactttctcggtataactacactgctgtgtactcctgtataactctttaagttcaatattaaaattctgtgttttatttgtccatatttctaactattagctgtttggcacagggattataacttattcatttgtgtgtcataagcacctaacacagagcctgattcattattggtttcattggccattatagacttaaaaatctcaatactatgtaattacatggtttctgtgagatgggtttgaatttctatcagccaactacaaaataatgttgtaaaagtaaacatatttccaaattgattgttgtctgtattttgttcataggaattcacatttacctgcaggttaccagtgaaggcggtcccttacttaggatagttcagcttaggattttttaacttcatgatggtgaaaaagcaatatgcattcagtagaaactatacttctgagtacccatacagccattctgtttttcactttcaatacagtattcaataaattacatgagatatttaacactttattattaaataggctttgtgttaagataattttgcccaactgtaagctaatgtaagcgttctgagcatgtttaagacaggttaggctaagctataatgtttggtaggttaagtgtatcaaatgcattttgacttaagatattttcaattttgtgatgggtttataaggacataaccccatcataagttgaggagcatctggtaatagttcagcatgtgttcttcagtgttgtataaggtgaattcacatttcacagagctaatgaggtagacttttcctagtcctaactctattccattagaagccacttatagcaaatactttgaaatattgcttcttttttttatactaacacaataggaaaagtgtaaagttttttgtttgaacaagtggttacatttattgccaatttttgacaaattatatggtttattataggtttacaggcagtagaaaaaagttacaatattagagttcagcctacttcatttttaatatacatactccataaaaaagaaagaggagattctagaaacgaatagagaatggagttggagatggtgctgctgttggagatgatactgctgcggtctaaaaaaaggttgggatggctggataggacaacacatcatagtatcttgtttacttgaccatattctcaaatctgggctgcaggctccaaagacttacttttgttcatgtctaaggttgcttggccctaaaggacatcacagtgactaaatgcatgtgaatttgagatggtggccaatccccatgtattaatttacagtaagaaatgaaattggcacagaaaaaaaaaacaggagactgcttggtaaatatgacattggaataaggggagttaagtaaaataaatgtttaattgcctcaggcttaaaatttcatgttgcattcaccttacaacaaggatagtctgacccctagcaatggaaacatttaaagagaattggctacaattttcaattctatctctgtattagaaatagccttacgaattgtaatagaaaaattgccaggtgctggttaagcctccttttcccatggacagtgtttttatggattgccagcatttgtctctgtgattctatttttttctttgcttctcggttctggttgacatatttcctatgccatgacagtagttatactctggtcagatgttactggccctgcagctatttttttgttttatccttttcctatttctgctctggcttatgatgtgttgatcttatagtttaacattcagagaggaatcttatttctggatttttcaggcccatttcagtgttgtctctaaataactggcattcattgagtaagttatctgtgcccaatattactaggttcattttataagttacagaattaaaatgtcttaaaattgccattttatgtatagaatcctacttcctgatgacttaaattgcaaagagtgtatgtatgtatttatggttaaatggacctcccactcctcaccccaaacttcacaatatcacttttagtaacatagtggaaatgaataagaaaattgcagcatgttcatacctgttaaacatcattcattaaaatgaatgaaaaaaaaaacttaagaatgaactggagctgtatgttttaacatggataaatctcagaagcaatgatactgagcaaaaaaaaaaaaaaagcagctacagaagatgtcatacaatataccatttacataaagtttgaaagcaaggaaagtataaagggctttcaagtaaagatagtgggtcaaacatgtaagttcactctcaagtctaatgaaaatgatagtgaaggaatttattttaaaagacataaacccacaaggtcatagaaacgtgagtatgcaaaccatcaataaagttttggaggcaggaaagcagatggacaagaggtaatggatttagtgaaactgagaagaatgaatcctaatctggcaagggagaaatctgagaagtaatccaatttaaaccatagaaccacagaatgctcagtaactggcagtgccagaaaactctgaaagtggagtttaagctcgcactaaaaacaatgacctagttaaaaatccgtttaagaagcaattagatgctaaccaataaatatagaagaaataacagagttggaaaatcaccactattcaagtgataattgggaaaaaattaccagcagatactaaaatcattgagtcaaactctgttggggagcaggctgtttacatggtctaaaggcatttccctacagattacttatcaattacaaaaggggaaaagggacctttctagtagacaaatctgacagataccaccttaactagatggtcagaagttgtactaagtagggcagatttatattatatgtgcttctttctatgatgcactgaggattaaacattattcacatagtattctttttttaatttttgattttgtgggtacttagtaggtgtatatacttagaaggttcttgagatattttgatacgtgcatacaatgcgtaataatcacatcaaggtaaatggggtatttatcacctcaagcatttatcctttccttgtattacaaacaatcttaattatactcttttagttatttgaaatatacaataaattattgactgtagtcactctgttgtactatcaaatactagattttattcattctatctaattatatttttgtgcccattaaccattcccaccccccctaacacccagactacccttcccagcctctggtaatcatccttctactctctatctccataagttcaactcccacaaatgagtgagaacatgtgaaggttatctttctatgcctgccttatttcacttaaaataatgacctccagttctatccatgttgttgcaaatggcaggatctcattcttctttatggctgaatagcacttcactgtgtgtatatatcacattttctttatcagttgatctgttggtggacatttaggttgcttccaagtctgcactatcctgaatggtgctgcagtaaacatgggagtacaggtatctcttcgatattctgatttcctttcctttggataaatatacacacacacacacacacacacacacacacacacacacacacacatatatgcctagcagtagaattgctagatcatatggtagttccatttttagttttttcaggaacctccaaactcttctccatggtggttgtactaatttacattcccaccaacagtgtacaagggttcccttttctccacattttcaccagcatttgttattgcccatctttttgatagaagccattttaactggggtgacgtgatatctcgttgtagttttggtttgcatttctatgatgatcagtgatgttggagcactttttcatatacctgtttgccatttgcatgtcttcttttgggaaatgtctatccagatcttttgctcatgttttaatctgttcattagatttttcctattgagttgtttgagttccttatatattctgattattaatcccttatcatatgggtagtttgcaaatatgttctcccattctgtgagttgtctcttcaccttgttgattgttacttttgctatacagaagctttttaacttgatgtgaccccatttgtgcgtttttgctttgattgcctatgcttgtggggtatttctctttttttaattatgattactattattattattattatactttaagttttatggtacatgtgcacaatgtgcaggttagttacatatgtatacacgtgccatgctggtgcgctgcacccactaactcgtcatctagcattaggtatatctcccaatgctatccctcccccctccccccaccccacaacagtccccagagtgtgatgttgcccttcctgtgtctatgtgttctcattgttcaattcccacctatgagtgagaagatgcggtgtttggttttttgttcttgcgatagtttactgagaatgatgatttccaatttcatccatgtccctacaaaggacatgaactcatcattttttatggctgcatagtgacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattgtaactggtgtgagatggtatttcattgtggttttgatttgcatttctctgatggccagtgatggtgagcattttttcatgaacagacacttctcaaaagaagacatttatgcagcttatggggtatttctcaagaaatctttgctcagtccagtgtcctagagagtttccccaatgttttcctttagaaatttcatagtttgaggtcttaaagtcttcgatccattttggtttgattgctgtttatggtgagagatgggggcctcatttcattcttccacatatagatatccagttttcccagcaccatttattgaagagactgtcctttccctaatatatgttcttgatacctttgttgaaattgagttcactgtagatgtgtggatttgtttctggattctctaatctattccattggcctgtgtgtctgtttatatgccagtaccatactgttttggttactatcactgtatagtgtaatttatgccaggtattgtgattcccccagttttgttctttgtgctcaggatagctttagcaattctgggtcttctgtggttccataataattttagaattttttttctatttctgtgaatgtcattggtattttgataggatttgcattgaatctgtagattgctttgggtaatatggacgtttttaacaatatttattcttccaattcatgaacatataatatccttcccttttgcctgtgtcctcttcattttcttgcatcaatgttttataggtttcattgtacagatctttcacttcttggttaagttaaatcctaggcatttagttttgtttgtagctattgtaaatgggattacttccctgatttcagattgtttgctggtggcatatagaaatgctattgattttgtatgttgattttgtgtactgcaaccttactgaatttgtttatcagttctaacagttttttggtgaagcctttaggtttttccaaatacaagattatattgcctacaaacaaggataatttgacttcttccttttcaatttggatgaccttcatttctttctattgtctgattgctctaactaggacttccaatattatattgaataacaatagtaaaagtgggaattcttgtcatgttttagatcttagaagaaaggctttcactgtttctctattcagtatggttaggctttgtgtccccacccatatctcatcttgaattgtaatccccaggtgtttaggaaaagacctagtaggaaataattggattatgggggttgttttccccatgctgttctcatgatagtgagtaaattctcatgagatctgatggttttataagtggtaacttttcctgtgctgacacacaccctctcttgcctgccaccatgtaagacatccctctttcccttccaccataattgtaagtttcctgaggcctccccagccgtgcagaactgtgagtcaattaaacctcttcttttaataaattacctggtctcaagtatgtctttatcgcagtgtgaaaaatggactaatacaagtatgacactagctgtgggtctgttgtatatggcttttattgtgttgaggtatgttccttctatactcagtgtgttaaaggtttttatcatgaaaggatgttgaattttatcaaatgcttttccagcatcaattgaatgatcatagagttttgtccatccttctgttgatatgatttgcatatgttgaaccatctttgcatccctaggataaatcctacttagtcatgatgaatgatctttttaatatgttgttgaatttggtttgctagtattttgttgaggatttttgcatcagtgttcatcagggatattggcctatagttttcttttcttcttcttcttcttctttttttttttaaatgtatctttgtctgcttttgatatcagacaaagatttggtatattgacctactagagtgagtttggaagtattccctcctccatttttcggactagtttgaggaagattaatatgaattcttcttaaaacgtttggtaaagttcagcagggaagccattggttcctgggcttttctttgctgggagactttattatggtttcaatcttattcttattggtttgttcaggttttggatttctttatggttcaatctcagtaggttgtatgtgtctaggaatttacccatttcttctaggttttccaatgtattggcttatagttgctcatagtagccttcttatgatcttttgaatttctgtgttattgtaatgtctcctttttcacgtcttatttttttgtattttggtcttctgtcttttttcttaatctggctaaaagtttgttgattatgtgtatcttttaaaaatgacttttcttgttgttggtcttttgtattcttcatattgttttcttcaaatttcatttgtttctgctttgatttttattatttcttttcttctactaattttgggtttggtttccttttgcttttgtaattctttaactttcattgtcaggttagttgaagtttttctacttttttggtgtaggctcttatagctataaatttttctctttgtactgctttctctgtatcccataggttttggtatgttgtgtttccattttcatttgtttcaagaaatttttcaatttcccttttaaattcttcattgacccactgatctttcaaggagcatattaatttccatgtgtttgtatagtttccaaaattcctctagctattgatttctagttttattccattgtggtcagagaagatactcgagataatttcaactgttttgaaatttttaagagctgttttgtggcctaacgtatagtctgtccttgagaatgatccatgtgcttaacgagaagcatgtgcattctgcagctgtttgatgaaatattctgtaaatatctattaggcccatttggtctgtagtgcagattaagtccagtgtttctttgttgattttctgtctggatgttctttccagtacttaaagtgggatgttgaagtctccagttatttatttattatttatttatttatttaaaatggggtctcactctgtcacccaggctgcagtgcagtggcatgatcttggctcactgcaacctccacctcctaggcttaagcgatcctcccacctcagccccccaagtagctgggaccacaggtgctcgccactacacacagctaggttttttttgtttgtttttttgtctttttttttgagacagagtctcactctgttgcccaggctggagtgcaggggcatgatctcaggtcactccaagctctgcctcctgggtttacaccattctcctgcctcagcctcctgagtagctgggactacaggcaggtgccaccacgcccggctaattttttgtatttttagtagagactgggtttcaccgtgttagccaagatggtctcaatctcctgacctcatgatccgcccgcctcggcctcccaaagtgctgggattacaggtgtgagccaccgtgcccagcctagtttttttgtattttttgtagtagagacagcgtttctgcatgttgcccaggctggtcttgaactcttgagttcaagatgtgcccaccttggcctcccaaagacctgggattacaggcgtgagccatggctcctgtcctccagttatttttgtattggggtctgtctctttagctctaataatatttgcattatatatgtgagtgctccagagttgggtggatatatatttatagttcttagatcttcttgctgaattgatccctgtatcattatataatgaccttctttatccccccccctttttttttttttgagacagagtctctctctgtcaccaggctagagtgctatggtgccatctcggctcactgcaacctccaactccctggttcaagcaattctcctgcctcagcctctcgagtagctgggattgcaggcatgcaccaccatgcccagctaatttttgtatttttagtagagatggtgtttcaccatgttggccgggatggtctcgatcttctgacctcgtgatccgcccacttcagcctcccaaagtgctgggattacaggcatgagccactgcacccagccctttatctctttttatagtttttgtcttaaaatctattttgtctgatataagtatagctactcctgctcttttttgatttccatttgcataaaatatctttttccatccttttattttcaggctatatgagtctttatacgtggtgtgtttcttgtagacaacagattgttgggtcttgttttttaattcatcagctaatttgtcttttaatagagaattcatgctatttacatttaatgtttttattgataaggacttactcttgacattttgttgtttcatggttgttttgtgggtttctcttccttctttcctttcttcctgtctcccttttagtgaaggggattttctgtggtggttatgttttagtttattctttttttttttttgtatctgttgtatgtttttacatttgaggttaccatggaacttgcaaatactgtcttataacccattactgtaaactgccgacaacttaacactgattgcataaacaaacaggggaagagaaaactaataaaaactgtacactttaacatgtcccctctgtttcttaagttttgttgtttcaatttatatcttactctactgtcttgaaagattattgtagttattatttttgatcagttcatcttttagtctttctcctcatcatatgaatagttcacaaatattacagcaaaattggagttttacaatattctatattattctgtttatttactattactagtgagtttgttaccttcagatgatttgttgttgctcattaacatgcttttctttctgattgaagaactcccttttacattttttgtaggagaggtctggtgttgaaatttcttagctttgtttattttgtaaagtctttatttctccttcatgtttgaaagctattttcgctgggtattctattctaggatgatatggtttggctgtgtccccacccaaatctcatcttgcattgtagttcccataatccccaggtgttgtgggagggacccagtgggaggtaattgcatcataggggtggttacctctgtgctgatctcatgatagtaagtgagttctcacacaatctgatggttttataaggggttttcctccttttgcttgtcacttcttcctgccatcatgtgaagaaggacatgtttgcttccccttccggcatgattgtaagttttctgaggcctccccagccatgctgaactgtgagtcaattaaatctctttcctttagaaattacccattctcaggcatgtctttattagcaacataagaacaactaatacataggattaaagtttttttttttcccttcagtacattaaatgtgtcatgccactctctcctggcacataagatttccactgaaaagtctgctgccaagtgtattggagctccattgtatggtatttcttcttgctacttttaggatcctttctttatccttaacctttgggagtttgattattaaatgtcttgaggtaatcttatatttgggttaaatctgcttggtattctataacctttttatacttgaatattgatatctttctttgggcttgggaagttccttgttattttacctttgaataaactttcttcccctatctttctacctcctatttgagaccagcaactcttagatttgtctttttgaggttattttctagatcatgtaggcatggttccttgttttttattcttttttctcttgtctcctctgactgtatattttcaaataccctgtctttaggctcactaattctttcttctgcttatcatttctgctgttaagagactctgatgcattcttcagtatgtcaattgcatttttcaactcagaatttctgtttgattctttttaattattttaatgtccttgttaaatttatctgatagaatagtgaattcctcctctgtgttatcttgaatttcattgagcttcctcaaaatagctattttgaattctctgtctgaaaggtcacatatctctgtctctctaggattctttactggtgctttatttagttcctttgatgaggttttgttttcctggatggtcttgatgcttgtggacattcatcgggtctgggcattgaagaatttggtatttattgtaatcttcacagtctaggcttgtttgcacctgtccttcttgggaaggctttccaagtatttgaaagcacttgaatgttgtaatctaagtttttagtcactgcatctgtatctgcattagtggggactcaaagcccagtaatgctctggttcttgcagacttgtagaagtattgtcttggtggtcttggataagatttggaagaattctctggattaccaggcaaaggctcttgttgtcttcccttactttctctcaaacagtctctccctccatgttaccaccagtgatgttcactcaaggccctagggctccacagtgagcaggtgatgaagccgggcaggcttgtattcttttcttcagggaggtgagttccttggttccaggtggatctagagatgccaagcaggagccagggcctggagtctagaaccttaggaatctatctgttgctctattctactgtggctgagctggcaccggagccagaagaggaagttcttcccactcttctctcccctttccacaagctaaggagttctccccatggccaccaccaccccaggctcatggcgagtactgccaggctactgctgatgtttatttaaggcccaagagggttcttccatcagtttgtggtggatgctgccaggcctaggactctcccttcagggcagtgggctttcttctggcccagggcaggtccaacattactttccaagagccaaggcctagaatcaaggaccccaggagaccgcttgatgctctacctgactgtggctgaactgctgcctaagatgatttttgattcttatgaaggtgcttttttggtgtgaatagtttttcaatttggtgttcctgcagtgaggatgattaatggaggcttctatttggacctcttgctcccctctcctcttatagtattcttgctaataattcataaccttaatctaaccagaaggaaaaaaaccggaaagaaacaactggaaatcctaaattgggagactctcatttcataaaacaccaggcttgtcatgtcagtgacatgaatgattaaaaaggactgatacatgacagctaaatgtaacatgttatcctagattggagaaaaaactttgctgtaaggaaaagtattgaggtaactggtgaagtttgaagaggaaccttattaaataatagcattatatcaattttaaatctcctagaaaaaaggaaaaggatgctgttatattccctttgtgatatcgtacaacgagacaactgcctcttctctatccatttcaaaactagaaatttactcatgggaaagagaaaatagtccagactatgtagcactgctttcctaatttgagagaagatataccattctgaaaaacagaggaattaaatgaacatgtacatactgaaaatgagacctctagatctttttccctactgggttttcaaatgaagacaaacaggcctttatgctccaggcagagtattagaagattcgtctttgcggactcttaccaaccaagaaaaaggacctgaaacccttattaggttatagtgaaactgagcttgcaacaagcttcacctgtggcatcaaagtttccagctagatttacctaggaacactagacatctgagaaatgaaaaacagagacccatacaaataaatagggtaaaacacttggataaaacagactacttaaaaacttaaaataactgctatcctcagcgattcaagaagttactacagtcatgaaatgagaacttaatgttccaaaataaaaggaatatttaacaaaaaggagtacttggaaaaataaaaatataatagaaatgaaatgtttaactgaagggttagaaccttctattcaatttcctgtaacatagggcagaaagaaacagaaaatagaaaagaaaaattagaggactagtaatactagaagctagaagacagagaagtaacggtgctttcaacattctgacagttctagtctagaattctatacctagttttatgatttaagcttgaatgtaggctaaacacattttagacatgcaaagtctcatagaattatctcctacaaaccctttctcacaaagtgactaaaggagtaaacaaagaaaaagggaggggtgagatccaagaaataaaactgcagcattggcaaagggtactagagtatgaaaggcaaccagtccaggcagagtgaatggagagatttttttccccaaaaacatgaaatacatagagtacctgatacatctgaacataccaagtggggctgaattatcgataagtacatgagaaataaacaaaattcatttatttgcggaaaaaacttgggaaggaaaaggaaaaataatcattttctactacataactcacttgttgacagtgtttactcataatatgtgaatccacaactatactagggtattagggaacacaaagaataaggcaaaccctcattttcaaaaatgagaagttaatatatagtgcctaaaactgaaaaaataactaacagttttaaaatattagttagctattatggagtgtttaagtgcagagcctgctttgtaactgtcagacacttttaaggctccttggtttggcctatactatgaccataaacatcagcttaaagaatataaagtattgcttttgagaagaggcaactattatttgtcataacaagccttttagaatgaaatggccctacaataaaaagatgtataatttttttaagagacagggtcttgctctgttgcccaagctggagtgcagtggcactgtcatagcttactgcagtcttgaactcctgggctcaagagttcctcccacttcagcctcccaagtagctggggctgcaagtgcacactaccatgcctggctaactttttttgattttgtagagatggggtttcactatgttgcctaggtttatctgcaactgttagactcaagcgatcttcccacctcagcctcccatagtgctgggattataggcgtgagccactgtgcccagcccaatgcatatgattgacttttttttaaaaaaaaaagaatgttaaaaagcacatatacaatgatatggatgagcagtggcaatttttttcggcagggtatcagatagcaaatattttagggtttgtgacccaaatggtctctgttgaaactactaagctctgccattgtagtatgaaagcagttatagatggtatgtaaataagtaagtgtggctatatccaataaaacgttatttacagaaacagttggcaggtggatcctagtttgtcaatcctggtaatgatcaatggttttcaaattgggatgcctataccactggatacacaaagacttcctatgggatataccattatgaatagctttaaaaaattaatttcctcattctctctttctatatggagtccttcctaaaaactatctacctgagaactctttctggtctgccagttctcctttctcacttctttcaaaatcatctgtctcccacttttcagaagaaaagcttaccccttttccgtactaaatcttactatggtgtcttgccttgcagtttaaaaatctcccgggcaccacacaaggagacaattggagagtgaatctctcttgagggatagtcctttgagagcaaagcaaagaaagcatcaataaaaattagtgaaggggtaatacattatttcatgcaggcaacaaactcatggccaggctccgtgccttatattatagtttctctgtctacctagctagctagctgtccatttatctatcttaaaattaaaattcacaagtgagaaagttgtcatggggatgaataataacacgtttatttgaattttaaaattaagtcagactttttctgacagatagtaagtcagatttggctggttgagtttgacaatgaggactagccttgccaattaagttatattgttatattctctgtgtattgaataagctgaactgcagctccaaggctttgacaaagatatacttaaagcatgcattcagtatacaataagctagaaaatgcatcctttgtcattacttaagtgtcaactgaaatgtgcaagatggtgcatagtttttcaaaagtctttgaagataaaatgtgcaaaaaacgaagaaaaaacactgctactattatttatggatatatagagatattgtaaaagtatgaaaacattcatgaaaatgatagatgagaaaccgggtagttattatctctggggaaggaaaatgttagggttcacagtcatggagagctttggtcatgtctgtagtgttttatttcttaagttggatggtgggttataggtgtatgttattagttatgtttatttttaacacatgaaatactttattttaaaagaatataccgaaaccttataattacatattttaaaagaacatattgggtccctgatagaaaaacaagttactcaggataaactgaaaaatgggatacttgaaatttgaaaataccaaaagcacttgaggaattgtcacagtaatgtgcatacagaacgaatcagtatagtttagttcttgaaagtccttttaaaagccttaaggcttatatatttgcattactaattcaaatacttatcatcaggcatctggtatatgctcaagagctaacaatttctttgcatgtagacttcttttgtacataccaacctgccctggacactacactagacataacagttaatatatgtctataatttagattctgtttttagtattttttttctatatgaaaattgctctgatactttacattttcagggaaaatacattcatatattgttttcagaaatttgatcttattgcaaatttacacagaagcatgttttcaacaataaagttattctgggatttctggcttccaaagctggaaaggatatatcctgagcttggtcaacatcccatttttttatttacctactagcatttctacctccccaaaggaaaagatgtggttgaatgggttaaccaccatccacaatggaaggtccctgttgggcagttttatgccagtcatttgacctacctcaggcctaaccatttgttcctgcctttgatcaggcaaagaggtagggttgtctgcactcagaggtgcctgaggctctgcaatgcacatctgcaagtgtaactgttgagcacttttgggactctctggcttagccaatactatgatcttacttgatttattttcctttattttattaaaaatttaatataacagtacatttaaaaatttttttaaatagaagtaatagattacctgaaatcctatgtctggctgctacctgaaatcctatgtctggctgcacaactcttaattttagcaagttaatttgcctatgcatacattggtacataattgtaatttttgaaaacttactcttttgtattctgctgtttttacttaactaccgtaataaataaagaaaaacaagcacttgaaacatagtaacaaaacacatggagaccgcttttctctatgtaccttctttgataatgacctctacctctgtgaaaactaagagaatataaaatttatcatacttctttagataaatgtggtaggcagtgatcatgaatcatttgaatgttttgagctcctcagaatctgtactcttacctggtaagctattctgcctctcaaactgtagatgtttatttattaattgtacaagaaatgtttatgctagtttgtgttataaatctttttggttttgaaaacatttattttaggcaggtcttcctaagaagtagtatctccagtttcaaggatcccacctttctcagtctaaaaggacggtttcttacatacttctatacaaagctgaggtctgagtttaagcttattcttagcataattttccctctattttgacctttatctgacttttaaggggcaaaatataaaaggtttttaaaataagttgaatataaataaggtgctattatgaattatttttagatatactcctgctcacgttcttttaagagtcatcaaaacttactaggtgcatattaaaagtatacagaattagttctgaagagttaaccttctgagtcatcattagtcactaagacaagtctcatttaagttttaaaactgggtttagatccagagtgaaaaggggttaaaggagttaaaatgaggttaggtgttttttggtttattttttttatccatacattttttctcagttgtctcaccaaaacaatttatgtttttcctcttattctctccatgctgaagaagtaatgattttctcaatctaaattttaaataaattacttgctgatcacttttatcagataaatttgacatttttttaatgggcggaataatggtgtttaagagaattgtattgatcacattggtgataacccctataggatactaagcaacagttgattgcctctgatcttatatctttaggcatgcctgattttattctcaaatatttatcatgatggtgataaaatactatgcccatatgttagtcctatagtcataaagaattaggcattttatatatttttcttatatacacatgttcattatatttcatgtgttcaaatgtactcaatttccttctcaaatttatattctggtgtcaccatgatacatttatttaccagtattctaaaacatcagtaaatagatgtatctagagcagagtttttgaatctgtgtaatacatttggggctgggaaatcaaattgatgggttacagcttgtttttctttttaatgagctagaaaaacatggaatagaaagtatcagtgtacaaaggcttactgggagtacttattgctttctgaaactcttgttgtagatacacttgcacatatgttttgtttgtgaagttgtggtgtcaaatgtatttcttactgtataggttaattttgtgtcaacttggctagactgtggtacccagatatttggtgaaatactagcctagattttgtgtcaaagtatttttttaagtgagattaatatttaaatcagtatactttgagtgaagcagcttaccctctattaaattagtaggcctcatccaatcagttgaggactttaagggaaaaaaacattccctctaggaggagggaattctgcctgaagactggtttcttttcttttctttccttttcttttcttttttttttctttttttttttgacagtcttgctctgttaccaaggctggaatacagtggcatgatctcagctcactgcaacctctgcctcccaggttcaagcaattcccgtgcctcagcctcccaaaaagctgggattacaggcatgtgccaccacacccagctaatttttgtattttagtagagatgaggttttaccatattggccaggctggtctcaaactcctggcctcaagcaatctacccaccttggcctcaccaaagtgttgggattacaggcatgagccactgcgcccggcctgaagactgctttctgatttcaactctttcctgggtctccagcctgccagcctaccctgcaaatttgagcttggacttgcctttctccataatcatgagagccaattccttacagtcactctctgtttctctggaaaaccttgactaatgcactcactaaaggtcatactcttaaaaagtttgaaaacttactaatcttgagagtcattttttaatctaatgaactggtatataaagtgtttagccagtgcataacaaaatatgataggtgctgttattttactatcatttgtacctgttatttaaagtcaacaagaatcctgatttgatgtgaatttatacagaaataattctgaactctacactcatttaactatcttttgaaaaagattaatttgtgtttatgaatacttctgtggtattttgaaggtttgctttgcagaaattattgtgaaattttcttctatgtttttgtctccccatttgtatggcctaagagccacctctgttttctcatcataatattcaggacaatttaatatatttgaattttttaaactactttcttctgtagtccaagatgattgtaaattctcaatttcagtggaaaaagagacaagcatataaaagtcctgtggcagacacctcttgtgccctacctcacatccttttgtatttttactccagccttgctgcagcaaccagctgctaacaggtgtaacctcattacagctctacagaatatattttgctttcttctctgacactgtggcatgggatgtctgtggggaatcaacttggaagtgtgagagggttaacataccagataaaccttgatacctggtatcaaggggatagaagctaatggataaaagttcctttcctgtccattgagcacatagtccaggtatattcaacatgacttctcagaagttctcagcagggattgggtcccagcacccagagcagtgaccaactccagaacacaccttttattttggctttccctccttccctgtttcatattctccagtatcttgctccccttccctggattacttgttcaacataagccataaaaaattcagaactgttgtctctaacagatatgaactcaaaatgtaaatagtaccaagtacagtcatgtgtcacttgatgacaggtaggtcatttcgtcgtcgtgcaaatatcagagtgtacttagggaaaactagatagtatagcctactacacaccctgtctatatagtatagcccattactcctaggctataaacctgtacagcatgctattgtactgaactgtatgtaggcaactgtaacacaatggtaaatatttgtgtttctaagtatatctaaacagaaaaggcacagtgggaccaccgtcttatatgctattcattgttaactgaaatgtcattgcatagcacgtaactgtaattaaatccaacttactttgtaaccgtagtgcacgttgatcctactggcataaaactgagaaatgaaagacttgtaaatttacatgtacttgtaaaatgtaagtacattatcgcttattgataaatgctgctagcaaattaactcctggagaccttcttttcaaacaagtttattacaattagcaatgaaggtgtaaatgtgaatctaattagtcatttggcttagcctgtttccaggctgatgtcttctttatgtgtttaacctttataaacatattgtatgagaatgaattttaaaaagaagaaaattatgaaatatgccatatgatctgaccctgttattttaggtattttttaaataaagggactctttgtatgtagaaaaaagactggaaggaaacataaatacaaaattataataattatttgggtggtgagttgatttttattttgttgtttatgcgtttttgtattttatgaatttgctacataaagggaacatttttctttaatcagaacaatatttaagttttaaaaaggaaattaagaatgctagctgaatagtttctttttctcagtaactgactgacagatggtgcaaaggacatgacaaagaagaggcccatcataataactacctcatttcaattcagcaaatatttataaagtgctgttgtgctctttttatcagataattaatgctttttgtctttaacatgattgtttatataaattcatttttactctttacttttttccattattctttatatacttaatttctatacctacttctttgaatgggtattgtttctagtttctaaagatttttattcaaatgtcagattatggaaagatttctattttggacatattactctcatgatggttctcaaattttatttttattataacttataaatctttcatcttaaaatttctcttagttactaatatttctcatctttgatctagactgtctagtcctgtgttttccagtaaaatatctactgtattgtacatgtagctattacaatttatttaaaattaaaattaaaaatttagtttcttggtcaccctaccacattgaaatgttcagtagcgatgtagctagtggctaccatattgcacagtacaaattagaacatttccattcatcactgtgttcaattggatagtattcctttagcctcacagtactttttaattctaaactttcttttcattgtacattagttcgttttcacattgctataaagaactactgagactgggtaatttataaagaaaagaggtttaatggacgcacagttccccatagctggggaggcctcaggaaacttaacaatcatgacagaaggcaaaggggaaataaggcacatcttagatggtagcaggagagagagcaaggagggaagtactatacttttaaaccaccagattttgtgagaactcactcacaatcatgagaacagcatggggaaatccatccccatgatccaatcacctcctaccagatccctcccctgacacctgaggattacaattgaacatcagatttgcatgggtacacagtgccacacactgtgtcacattgtttctgtatttcttttttctacattccctttcatactgtattcaattttttaatggaaaatgttaatttctactcaaataattgttaccatttcctctcctaaattcttggatgctttgtagtttccatcactgaatattgtcagctcttttcttatgcactgtatttttttttatcatggcaaagaaattgaaattgtggttctaatagcatctctagaagaatacagtggcaggctctggaagggagaagtaggtagctgggcatgtgtaagggggagtgttactttttatctcaaaatcttttgcatcattcacatttcatgccatgtgcctatagttcttattttaaaaagaataattttttcaagtccatcgaattcaaggtccacatcaataacttggccttaatgtttaggtggtcccacaaataaatttaaaatagaataaaatctacatttaaaactgtgtattgacaaggcagatggtttaaagaaatagagattcccacatcttcagatcaaagtaattaaattcattccccaaaatgaaaggtaagcctgttgccagttggatattaagtatgacagtgttatatatttaaaatttagaaatgactgcttttatttgttataggccaagtcttttgattttgattacctaaataatcttggataactttaaagcctggctaccatagtaataaataacctacacaatataaaacagtaatacagctcaatgtattctgcactaagtgtgccccaagtcctatgcatccaatcatattgttagcatagaaattcaattatacagaaagagaaataatacagtagtaccaaaggaaagatccatttctgagggaaggtgtggaaagatcttctgcttaaaataagtgtcataaatctaggtatttgcttaacttgatttcttttttatttaaaaaaatatgtttttctttcattcgttttcaaagtatgaaaaacatttgggttaaaaattgattgcttttcatctttaatgtatgaagttcttgctatgtagtaataaaattaaatgttttctgatttgcacaactggatataaggtgaaatgttgaaaggaaaataaagtttttgtgacaggtcctgtcttcaaactgtttctagcttttctataattatctgttttgacaatgtctcttcttaaaacaagaaaaaggtttattttagtgaggattaataagcataagttttcagtaattgtctccttcacaaagtcaaactaattgtatgacggattagcaccaagttacatggcagtttatcataaaaacatttcattatgtatgtgttcgttgaaaataatctcactaataagattttctgtagaatgatttccacactttaattaccaaattgatgttgttatcagtaaatttacatcacattgtgatttaaatgtaataatttttaaaagtcagtacgtattttcacaccagaataatacttgctaacaaaatttatttgcgtattggcaaaatacttacatgtaataagtccagtgacatattcagggaagattaatacattccatggattcacctaagaaaacatcacagttgcctctgaatttaagaaggaaaagcactactgaagcagatagagacacaaaaaaacccttcaaaaaaatcaatgaatccaggagctggttttttgaaaagatcaacaaaattgacagaccactagcaagactaatgaagaaaagagagaagaatcaaataaacacaataaaaaataataaaggggatatcaccaccgatcccacagaaatacaaactaccatcagagaatactataaacacctctacgcaaataaactagaaaatctagaagaaatggataaatgcctcaacacatacaccctcccaagactaaaccaggaagaagttgaatctctgaatagaccaataacaggctctgaaattgaggcaataattaatagcttaccgaccaaaaacagtccaggaccagacagattcacagccgaattctaccagaggtacaagaaggagctggtaccattccttctgaaactattccaatcaatagaaaaagaaggaatcctccctaactcattttatgaggccagcatcatcctgataccaaagccggacagagacaaaacaaaaaaagacaattttacaccaatatccctgatgaacattgatgcaaaaatcctcaataaaatactggcaaactgaatcaagcagcacatcaaaaagcttatccaccatgatcaagtgggcttcatccctgggatgcaaggctggttcaacataaatcaatacacataatccagcatacaaacagaaccaatgacaaaacccacatgattatctcaatagatgcagaaaaggccttcaacaaaattcaacaaattttgaattaggtattcaataaatacctctcaatacattaggtattgatgggacgtatctcaaaataataagagctatttatgacaaacccacagccaatatcatactgaatgggcaaaaactggaagcattccctttgaaaactggcacaagacagggatgccttctctcaccactcctattcaacatagtgttggaagttctggccagggcaatcagacaggagaaagaaataaagggtattcagttaggaaaagaggaagtcaaattgtccctgtttgcagatgacatgattgtatatctagaaaaccccattgtctcagcccaaaatctccttaagctgataagcagcttcatcagcaaagtctcaggatataaaatcaatgtgcgaaaatcacaagcattcttatacaccaataacagacaaacagagggccaaatcatgagtgaactcccattcgcaattgcttcaaagagaataaaatagctaggaatccaacttacaagggatgtgaaggacctcttcaaggagaactacaaaccactgctcaatgaaataaaagaagacacaaacaaatggaagaacattccatgcttatggataggaagaatcaatatcatgaaaatggccatactgcccaaggtaatttatagattcaatgccatccccatcaagctaccaatgactttcttcacagaattggaaaaaaactactttaaagttcatatggaaccaaaaaagagcccacattatgaagtcaatcctaagctaaaagaacaaagctggaggcatcacgctacctgacttcaaactatactacaaggctacagtaaccaaaacagcatggtactggtaccaaaacagagatatagaccaacggaacagaacagagccctcagaaataataccacacatctacaactatctgatctttgatgaacctgacaaaaacaagaaatggggaaaggtttccctatttaacaaatggtgctgggaaaactggctagccatatgtagagagctgaaactggattccttccttacaccttatacaaaaattaattcaagatggattaaagacttaaatgttagacctaaaaccacaaaaaccctacaagaaaacctaggcaataccattcaggacataggcatgggcaaggacctcatgtctaaaacacaaaaagcaatggcaacaaaagccaaaattgacaaatgggatctaattaaactaaagagcttctgcacagcaaaagaaactaccatcagagtgaacaggcaacctacagaatgggagaaaacttttgcaatctactcaactgacaaagggctagtatccagaatgtacaaagaactcaaacaaatttacaagaaaaaaacaaccccatcaaaaagtgggcaaagtatatgaacagacacttctcaaaagaagacatttatgcagccaacagacacatgaaaaagtgctcatcatcactggccatcagagaaatgcaaatcaaaaccacagtgagatattatcacaccagttagaatggcgatcattaaaaagtcaggaaacaacaggcgctggagaggatgtggagaaatagaacagttttacactgttggtgggactgtaaactagttcaaccattgtggaagacagtgtggggattcctcagggatctagaactagaaataccatttgacccagccatcccattactggtatatacccaaagaattataaatcatgctactataaagacacatggacatgtatgtttattgcagcactattcacaataacaaagacttggaaccaacccaaatgtccaacaatgatagactggattaagaaaatgtggcacatatacaccatggaatactatgcagccataaaatatgatgagttcatgtcctttttagggacatggatgaaactggaagccatcattctcagcaaactattgcaaggacaaaaaaccaaacaccacatgttctcactcataggtgggaattgaacaatgagaacacttggacacaggaaggggaacatcacacaatggggcctgttgtggggtagggggaggggggagggatagcattaggagatatacctaatgtaaatgatgggttaatgggtgcagcacaccagcatggcacatgtatacatatgtaacaaacctgcacgttgtacacatgtaccctagaacttaaagtataataaaaaaggaaaagtacttataagtaaaaaataatagtagaaaataaatgctattatcatacactatgcaaataaaacccagctttttgttcaacctaggcatgttaaaaagactttctaattctaatattacaagtatccttgagaaaattttccagataagagctgttctaattcctgccacacttaaaagataacttagtataaaagaaaagaaacattctcaagaattattctagaaaacattcatctaatctgaataccacgaagctttttattgccagaatgcaaaggaaccaaccttgatgtcttttaaaaaaatggttttacctagcaaatggtaagacaaacttttagtttgtatctttaactggtacttttcaaggaattgactatcactgttgctgaaacttgtacttaaatatgtaacacaaatatcactttccttgaaatgagttatgaattgccatcccagaggatatcagtagaacccagggtacaagttcccaacttttggggtgctctggcatcacaagactcttcctaaatttgttgtatggcatgtaattcattttgaaaagggaacagtagattttgaaaccatcaaaattcttgagaaacaggatttggatgcactcttggttatcatgaaagcaacattacaggttattgaaccggaagaatttccccagagatcttatataacttgcctgactcacttgccatattgcagtgttcagtcaagcccagtccaagattttctgacaagtctggttcagcaatgcctgacttgatgtgttttttcggagaaggagtcaatgagatttaccttccctccctctaaattacttcttatagtgaagggtttgtttgattcccttaatattcatttgatctctgagaaggaacattgttccagggaaaactagcagtaggccccaaaaaggaagactctaaaatttattcaacaaataacttataaatgcctattctgtgttagatgttggagatatagaggagaatctgcagatggccaagggagtttatgctccagtgagaaagacagacacataacaatacgaaacagtaccagaaatgggacattacaaatgtgaaaacaggttcaaccttctttaggctgaaaactgaaggataaaaaaggaatacacgagagagtagcatgacactaaagccagatactatgatgaaaagattgacaaatttgacaacataagaagtttctactttttgatagttaaaatcctagacaaagttaagccaaagactgaggggaaaagttttaaaatacagaataaagacttctcttttttgtattgacaaagttgtggggaaacaggtattctcattcaccatagatacaggtgtaagttgatgttaacttttttttcttttttttttttttgaggcagggtctcactttctttcccaggctggagtgcagtggaaagatcatagctaacagtaacctcaaactcctaggctcaagcaattcatcctcttcagcctggcacaggccaccacgcccagctaattgtgttgtttttttggggggttttttggtttgttttttatgtttgttgtagagacagggtctcactttgttgcccaaaatggatgttaactctttagagagcaattttccaaatatatgagaaacttttaatgcagcaattccagttctgagaaggtatcctaaagaatgaatggcaaatgtatacaaattttatacaagaatgttgtttgtagtattgtaaaatatgaaccattctaaacattcatctataggggattgaacgaataaattacaatggaatactaactagtatgcagccattatgaaggataatgtacacctatatatattgacacaaaaaagatgtctgaaaaatattgagtgaaaagcagtttatggaatagtattcgtagtatatattttatctataattataaacatgtaaatgggatacactatatttatattataaacacatgtatatgcagggggaagtctataatgattagactttttaacagtggatatgaaattatgagatattttctattttgtagatttctgttgtttacatttctgtatttttttcaagatgtattacttttgcagctaaaagaacagtgatttccattttaagaaagagaaaagaacattctgaaggagcttttaaaagttctgcttttccccttggcaaatatgtactcccacactatttcaagtttcttgtttctttgctaaaccaaaatggcaagcggattaaatgagaagtatatggcaacacagccagtcacctatttacttacattcactagctgtgtgatttgtctatttatagtttgtttcttcctactagaatctaagcttcatgaaagcaggactgtgttttggtccctgccatctctcgaggatttagaacagtacctggctcagagttcatgctcaataatattgagtgattgtgtacatgaataagtgaaagaaagagggcttcagcctaggtcttttggtgggttccttctttacccttgattctccgtctcctttgttcttatttcccagtgatctttttgcttccctcccccacctcctttgagaattctcacctcaatttgtttcttcatattgctgtctccatcactgctggaacatcgctgagcctctctttttctcctgacaccaaacttaaaggaagcctgtctcctgggctaccactgatacccacttgtacttacacctgatggcccaacccttagaattcactctacaaccctaattagtagtctagccttttcagtttctcttagcagaagagatgttagtgtggttcctcccttttacctttccttccttcccataatgttatttcaactggtttcatcagctgctgctctgcttgggaattctactcccttctcagtatagttgtttcgagtagtaactgcttgttagtgctattcacattgcctgaagtggattttattgttattgctgctgtagtgtttgtggtttatctgactgctgtacttctagttggccacaaggtcacattttccaaattcctgctactgtatcactttatatcctaggttatcctcttaatcccaccttctccaatcccataataagaagggaaaagcttgcactgtcttcataatggtggcgggggtgggggcaatagagtcctgagatccattttaagtaaggggcacttgcctatctgccttcccacagtatccttgcctcttttgagaaacaacaccagtagtccttctgagatgtaagcaacctctttccaagttttggtcagtcacaggcactatggatgatgtattgtaacccatcatatttgtatttgttattgtagttgtgctacgctgtgggtaaattccttaatgtgtactagacagggaatataaccaccattatagcactatttctttggggaaaaaaaagtgttttgggtccaaaatagttggttgactttaactttcttaccttaagctattcctaagttaggaagtccttatatgagtggtgatatattttaagccacatacttggtgattgataggtggcaggtacacaaagaaaaatagagaaatattttttcttacttaattttcaaaagtagtaaaccgagtcattttaccacattgatgtttttaaactagtataaatttccaagaatataaataagtttgtatctatcttttctcaattttcagcgttacaaagggaaggggtataagcaatttaaaaaaaggacttcctttattaatgatggaatatgatatattcttgattagctatttaagtttacatttggatttataatacaactgcactatacaaagtcagattatcagtcaacagtgattgccctctcagatggtctactaaaaaggaaaccaattaacagtgagtaaacacagacagagccacattcattcatttcgcaaatatgtgttaagcaccgattatgtgctagacattgttgtaggccctgaattgtgggagacagaaaggcataaagggcaggcaaaaacctattttcatacagccagcataatacatacacttttaccctctgccctagcaatctaagttctagtagaaatctactaaaaattatctggtgaaaatacgtaatttggcataatttatagggctatttgtaatagtagtagtaaatacgtcatagtaaaagagcagaaacaacccaaatatctattagtaagccatgatatagctacacaatggagtcctatgaggctaaaaaggagtgatgaaaatatccttctatagaatgttcgtgatatattgtcaagtaaaaaaagtaagatgaaaaacagttgatagtaccttttatgtaagggtggagaaagagatgcacatgtatttgcttattttataaagaaaaaatgggaggataaacagaaaattaataaaaatgacaggtagagggagggaacagagtagaagagcaaggatggaagctagacttcttttattatatctggtataattttgcctttggaactatatagatgttttacacaatttcaaaatacattaatcccgccaggcgcggtggctcacgcctgtaatcccagcactttgggatgccaaggcggacgggtcacgaggtcaggagatcgagaccatcctggctaacacagtgaaaccccatctctactaaaaatacaaaaaaattagccggacgtggtggcacgtgcctgtagtcccagctacttgggaggctgaggcaggagaatggcatgaacccaggaggcagagcttgcagtgagctgagatcgtgccactgcactccagcctgggtgacagagtgagactctgtctcaaaaaacaaaaacaaaaattaaaagaaattaattccccccccaaaatttttttgaatccctgaaacaaataaacgtgtttatcaagtagatagcagaatcacacaggaaaaaatgatttcacatgactttaagacattgtacatcagtgagtgtattcattatttatccttttttaaaattttaaaaaatgtttgtcttactcttcttactatcattcccaattcagtgagtatattccaaggacaaaaagaaaggaatacaaagaaatcctcaactatatttaataattttcttagcagtaatattggcatttttattttacacacatatttaaaataaatatattaatattctcaggaaccaaagcttatagcataaaagaaattaaataaaaacctacaatattaaatttgaattggaaatgtcattatgaactaatgacatattttttctgaaaaaaaaaaaagcatatttcctacttcggtccactggaaagacctaacagcaatgacagtccagtagcaattaacatctcatctcagactatgaactttttaccattttctattctaaggagccagggctccttagagaaatagctgatgtcaagtctcgggcaggaaatgtacaaggagagtctaggacatctttttacaccagagagcaaagaaaccaagaagattatgtcaaaaggatataggagccaactggaaggggctcccactggccaaagatgggtcaagtttgagcatcaaaaatagaaatactaaccaaaacaattgattgaaacattcaaatatataaatatgagttcattatattaaaacatattaattggtcatgtgtgatctctggaccagaagcatcagaatcacctagtaacttgttagatgtgcacatcaggggccctatcctcagttattgaatcacaaggtagagcccatcaatctgtgttttaataagtttccaggtgattctaaagcataccgaagtttgagaaccactgctctggatataattgccagtttacatgaaatacaagggtaaagaaacatgttagatgataccaccaaggctgtaattagccagaatcacgtgggcaaggctacagaattaatgacctttactaataaatcagtaggattggggtggattgtgtatttttagctgctggccttctcaaactaagtggatataggagcttgagggtctcaccatttggaatgcagatttttacttagccatcttccactatccccatttacagtgtggcacttcaacctagccctcttcttggtccctacatctaagcctgtctttatatatatatatatatatatatatatatatatatatctagggtggattgctttttttctcaccagtatccctgtttgcaaacatttaggattgttccttttctactctgctgaattatttgttgttctatttatttccatctttttatgttgtcatttgctattttagatgacactctgtttatcaaaaaagggctttgagtttttctaatcttggtatctcttttatttaaggggtaggttttcaaaaggagtaggggaaattttgggactcttgaactggaaagtctgtttcccaatttgatttgaccatacaactttttggcatgtcaagcaccttttaatttcctggaaagctagtgtgatctatggaagacttatttgggaagtgtttcctctctctccagtacagtctgcatctgcctccataacctccttcaaacttctctctcaaggtcaccaaatacctctttaatgctaagtccgttgaatatgtctcaattctaaccccacctgcatttcatagagttaactgcctcccgtcttgaatttccttccccttgtggcttctttacttaattttgtgttcccttcaaaccaggatctgagacaaggatttggatacaagtaacttatttgcaaggccacttctaaaagcattagagttgaacagtaagaaagggaaaaaaagaaagtcactaaaaggtgccttaataagctggttaaatgctgtgggcaaacgagctcagttttgccagcagccctctgagagactgcggaacacatcacagagttgttccattgaagagcaaggaagctggggtatttatccaccaatttctcactaaggctcactcctggggagtgttaataactccctggtattttcatcctgcccattatataaggtgaatatggtcctcagaccaagaactgcagaagtttgaagtaagaaacaagcttcatctaaataagctatttagaaagctacagagtaagctgagagaatatggatgaggcatcaatatttactacttttaccaatgccgtttttattatcccctcactttctagaccattctttctcaacatgttgttggttcctgtttttcccttacctcttaaattttggtggtccacatgaagtatctgttcttgacctttggctcttcttctctactatttctctggacaatctcatccttgtcttggcttcagccactacatatacttccagatttccagcactggcctctctcttgagctagacccatggagtcatttattcattcaacaaattatttttcaacacttacataatatgctaaacttgatgcctggaatgttaacagtgaactatacatattcctggcccttggagtttatattctagtcaagccatataaacaaatacataaataataaggattatgagatatgataagtgctacaaagtaaactgggtgttgttcttatgtctggttggaaagatcactttacatagattagccagggaagttctctttaagttattggtcttccctgaagtatgagatttagctagccatgtgaagaactgaaagaaaaagactttccagcagagagctaaaagaggccaagtgaaatacagtgtgtttaaagaacaaagaagctagtgaggttgaagtataataaccaaagcagaaaatgacatgaaatgagattggagaggtcggcagcaattgggtcatttggagccttgttgtgttcttcagaagcagacattgagataaaaggtatttattaggcatccttatgaaaggaagaggaagaaaataggaatggacagaggacaaagtcgaaatgtgatgtaggcccaacaaagcttcagccaatttagtaggaagctctggagcaagtattgcccatcagagtctttgtacatctggttgaaatagctgggcctttatggccctgcctgcctgccttattcagttactggatgtgggctgctctggaaaaccattagaaaggtggctacaagctgtggcacatgctaaaattgttgacagctgcagactgtctgctcacagcattcactgcagctgggaagcaagtccttccttgaagaagggcttatccaaatatctccatatttgccacaggcaagtttggattttgttgcaaggacccatttaaagggttgttagtgagaagtggcatgaaaggtcactctgatttctatgtggacattagatcatagaggaccaaggagacttattaggagtccaagcaagaaatgctattggccatagagataaagagaaatgcacaattcaagataaattttgaaggaagaattgataaaatttagtgctaggtaaatgtaggaggtaaagaaaaataggaatcatttaagtaaatgtatacagttgcgtaagggaaggtgatttagctgctgctggctaaagtgcttcttcccaccatgaggacatcccagtaacagcctcctcccccccagatcgtgcccactggtgtgcatttgatatgtcacagagactactttgagagtatagtaattaacttttaggacttccggttagctggaaggctcctctctatgttcatgaagtagggtgttgccttggagcttgcttttatcttagcatgtgaggaaagggagaccaggccctattgaaacaaggcaaaccttctaggggtcagggaaacactgtagtcaggcagcaggatacctgtatgcaaagccatgtgtgtggcttgctgagaactgtgcaaagagtaataagtagtagaaggaaaatatggtggaggcagaaacttgtttcaagtgtagtctaattgtatggccttaagttagccctctgagcctaaggcatctttggacatatttaatttaacatgtttgttagacatccacctccacccagatagttggctatattattctggagcttggggagcagtcaggcttgaaatgaatttgagcttcttcagcatatgtagacaatatttaaacttgggataagaaatgattactttgagagagaatacagatactccttaacttaccatgaggttatatcccgataaacccattgttaaatcaaaaatacatttaatacacctaacttaccaaattcatagcttagcctagtcgaccttaaacctgctcaggacacttacattagcctgcagttgggcaaaatcatctagtaacacagtacactgtagagtgtggattgtctacccttgtgatcaaagtgatgactgggagctgctgctcaatgccaccacctagcatgatgagaaggtattgtatggcatatcactagcctgggaagagatcagaattcagaatttgaaaatacagtttcaactgaaggcatgtcgcttttgcactgtcataagttgaatcattgtaagtcagggaccgtctgtatagtaaaaaagagggctagaattgagtccttgaagcatttcagtgttctgaagtttggccaagaaggagctaacagtttgataaaaagatatttggatattttacagacaacttaaatttggtatgtttaaagcagaactctttttctgtttcctaccatggttaatggcattatctgttgatagcgacaggaggcagccaaatgcctaggctaataggggcgggtccctggtgaaaccccaccttcaagccaaaaacagcctggaggctgaaagaccaggctgctggtcccagatgaaacctgcaacccagagtgagaacttatgttcctgtttgcctgccctttcctgattaattttttttgaataatgccttttaacaattgaatgttgccttttccaatactccctacagcctgtccctttcccattctgagcccataaaaggctcctgactcagccatattaggggtactttcccactttcggatagggggaccacccctacatcccctctccactgaaagctgtttcatcactcaggaaaactccctgccttgtacactcttcgaatgttagcacatcctcattcttcttaggtgcaggacaagaactcaggaaccagtgtgtaagccagacttggcccaagtgggccgagtaggtgggctgtctcctgcagcaggtagcgtggtcaagcaaggcctgggcagggcatcgccagccagagttcctcagcttgcaaagtgtcactgtcatcactgattagaaacagggattgtcctcatctccttcacctctacatattggtgactaagacctttttcctattgaatatcttaacaatctttttttgtctgtctcaataccattgtcttggttcctgccctaatgattttcttacttgcatttctgcagtggcctgctatccgatttctctgttccagtcttgcacctctccaatctaatttctatagttgccagagtcatcttttttaaaatatgggataaacatataagtctcctgcttatggttgccagatttagcaaacaaaaatacagcatacccagttaaattttaatttcagatgaacaagggataattttacatgtatgtcccatataatttttaggacataaatactaaattatttgatgtttgtatgaaattcaaatttaactgagcatcctgcattttatctggaaatcttgctcttccttcagagcccaaaaatgtttcaccatcactttcagggtgaaacctaaatatcctaacactgcattacaagattcagcatgttctaacccctgtataccatatgaaccactcagtgtcctgaatttgctttgctgctttactccttcatacctctgatcacatgcttactttttcctagaatgcccctctcttcttagttctctggttgattctgattgattgtttaatactgaagtatcaccttctctaaccctccagtccactctggataataactgggacaccagggctgggtgtggtggctcacgcctgtaatcccagcactttgggaggccaaggcgggcggatcacctgagataggagttggagaccaggctgaccaacatggagaaaccccctctctactaaaaatacaaaattagccggacgtggtggcacatgcctgtaatcccagctactctgaaggctgaggcaggagaatcacttgaacctgggaggcggaggttaaagtgagccaagatcacaccattgcactccagcctgggcaaaaacagcgaaactccgtctcaaaaaaaaaaaaattaattaataataataataataattgggacactagcttttcttctgcattctcataacattctttgttttatatgattgcagaatttatcatattataatttaatttttttaaacctgcctctcttccttagattgtgagttctttgagcacagggtaaaagttgtgtcttttaactcaatccttggcacttagtgggctctcagttaatatatgcatgaaccaatcagttagtgaatgggaaagtaggaaaggacccataagcattagccacataattggccattggagcttacccagctcttccctatggtacctcctttgaccatcctctttgttcctcaaagatgcttcataagaataggaactaggttttaatctctgtatccctaggcccttaaattgtaggtgctcagtatatattaaatgaatgaatgaatgaatgaatgaatgaaaaacacatgaatgaataagtatatctttcagggccacagctcctgttgtcccctgcaacaagtcctagagggtgctgcctctgaccatattttttattctctagggcaggctctatatagcctaagttgtagcttctttatgtcttacttcttctcatccaactcttcttccctctctcatcctaggccagaagaattcttttcccccgacagcagctggcacataacagctcaatgaatgttagcaatcattcacagatggagccttttctttcctccagggctcttgcctttctgccatttctttctctctctctgaggccaagcctggaaagccatggggatctgacattgctttttctcccagggattatggtctttcctcttcccacacaagggagcaaggttttctttgtctcccaccagggtagttcaattaaataggactagcattaagtgactctaattattttttattaatgtttaactgctaaatttctttttcaattaaataattgtgtctttatgcttagaggccctttttgcgtatatatgggagttcatttattttagtaaaggaaataccacctgaaaaactgttaatgacttgagctctgtgattagttcattttagtgacattttgagatttaataattaatctggctcaggttcaaagaaagaaaacttaatgccagaaattcctagccagcaaagaatataaacaaaccatacaattgtcccctcaaataacaggaatcattgagatagccttcttgcaattagaaatgttttgaaaaaatgcatgaggaaggttcaagaaagcatgtcaaaacaacaaaactcagtgtacattctcattattgtaattgatcaaaggatgtttgcaatagatttgaatttgaataaattaaatgtgacattgatttggcagaggcgtactagtgattggcaagaacatgtagcaggagcagcttctgctaaagcataactcacttgcctcttgttttattctaatagatttcttagcaacccagtactatcatactaacctaagctctgtcacttatttactctttgggtttctactcccatccaggcaagattaaatttatttttgattactgatctagcaggtgttctcttgggcctaaatacagaataccttttggtgatctatgcacctccctcttttttcttctttctttcgtagatgaaaaagggtgatctaataacttatttcatcctggcagttcaacttgtagaactagaaaatgtagtttaattaaacaacttggcaataaaattcgagctgagacatcactatagcatttgctaggcttgaattgtttctcagcatgttacaaaattaacactgtaaaagaatattcaactctgaacgttttgaaacaacaaattcccattataattttataattatattgaggattgggggctgtgtggtatattctgggaggctactttctgggcatgactatctaatagtaaacaaatgttactggtatggggtcccaaaacatacttcatgccaaatttcacttataatctacataaatcgttttgtagtctatgaaaaacattttaattgactcaaaggcaatgtactcatactttaaaaattttaatatttattaaaataaaaattattcactagtatatatggtttaaattatggaaagaaattagtggagctgtcaaggtcaaatttatgtctggtaagcagtaaaaaatgtatgcatttgggtatatttagtaattgaaatacttttacatctttatcttatgtgtactttgaaaagtatgtctagctccaatagatattaaagatatatgtacatttagcttttgtcacaaatgtaccgctaatgtataattttaaattataactttttataaatccggtttctcattttttatatgtaatataacttgaacttcataaataagctatggttttgttcccacagaagactgaaaaagaacccagttacatgggcctaagactgactcctgagccttaacttgctcttgaaaatagtgaactttctaacaatgaagcactgttgaatttattttaaattatatttagattttgtcttggcatgtgttttgaacttcagtttgaacatagttatatatgatatacttggaattcacaagtacttgaagctaaatggagaccatttataaatactaaactttagaggagcctggagccagaacattaaagatgaaatggcatatttttgtgtgtgtgtgtgtgtgtgtgtgtgtgtgtgtgtgtgtgtgtgtgtgttcaacctgccttttttctacctggattcataacatttttaaagcaaagttctaattccctaataaagggctgagcattaactctattccatttccatgtctatcaatataaaaattattcaaatacttttgaagtctattattatggaattttatgcttaccatgaatattacaccatcagcatcatatatatgtacatataaggtattactgaaacactccttcatagaagaattctcagttgactaggtttgagccttttaaggagaaaaattgggctaagggattgaaatcttgaatgatggtttgaaaacagttattcatttttatttatacacacattacacacaacataaaaaatactagtgacattttacatatcttaaattaataaaaatgggtaatttataatttgcataatttgtatttaccttttcttgttaagtatatgtataataacagataatattcctaaaaaatattttgtatatatacttagatctgcatctaaatatttgattccatttaatagtatagactgaggaatgttcactcccacacctctggtctgagtgtggctccagagaagcagaatggtggatacctgaggttgaaaactctttgggtaacctttgaacctattcagatatctctcagcccttccctttccccaatactcatcaagtaatctaaacttatcttccagtcatgataacttcatcagagagcactggtcatcagctcttagccttccctcagatattagagtgcatttccaaagcccaggtttaaatagctttagttttctttctctctcccaacacatcattgcagagacctctagtatttttctaccatttgttttacctcctctttataattcaaatatccacgcatgttatctaataacttccatagcagtaagtgtatattaaagctgaattccttgcctttatggaaagttaatgtatagtaggattttgcatgagggactgtatgattggagcagaataactacttattatatcatgcctaatatctgtgagtgagctataagtcagcatgttagtagattccatatttaagctttgttttttaaaaaaacaaactttaaatctcttttgtcattactacacatagcaagttgcagcattgaatgcaacaataatacagctaccaaaagggctcttaaccagggctcttagcaaagtaacagcattggaaaggacttgagccacaaccttttgggggcttaagttcacatcactgagtaaatgaatagtgcactataaataaccattaactacattacaaaaacaatgatgagcttgttaaaggcatttagatcttttcgctttttctcttttttaatctaatccttcacaaacaatgataatttatattaaattttgaccagaaaaatatataaattcaaacattaaatacatgcaagttgagcagctcaaattcgaaatccagattgctccaaaatccaaaactttttgagcactattaaggcattcaaaggatttggggatacttaactggtaagtaaaaagcaaatattccaagatccaaaaaattccaaaatcccaaacacttctgttcctaagcatttcagataagggatacttaccctataacaacataaacaactcaagcctaaactaatttgctccagctgaacacccctgaaatgagagagatgctcacagaacattggtcattcataacatatacatttaaggaaagttttgacacaccgattttgatacagctcatgcctttttttaatttgtcagtatggtttctttctcttcttccctgagattggtggagaatgatattcttcaatatttcactccaggagactctttaaatgacccttttagaaggggttgacctcatgcatgactctcaattgtcaactccatgaggttctgcttcaggtggacaagaaggccattgttgatacactgctctatatccctagtcaggggagccaagacagtggtataaaacatggaagctttggtgactagagactttttgttgatgggaataaggaggtaataaggcagagtgttgctaatttgagggctgcacgtggtaacaacagcccttttgtctcaggctgtgcgtctcctgaaccaggttcacaaagcttgagaagtttgcttggcagtatagtcatcactggcctcaaaatccgtattggtattttcaatggacagtgtaacaatgcttctcatgtgctcagggaacttagatttggtggacgtagagttttagggtatccagcacctggcagagtgtccaaacctctggtgtttttcctctgcaatgaagtccttcattctgatcatttccagtgctatttattctacaaggtttccatcttgtatcattttccttcagttgaagtatgtcctttaatttttcttatagtagatatttgtgacaaattcagcttttgtctgaaaatgttcttataataccttcatttttaagatgttttcactggatataggattctaagttgtttctgatgagaactcagtgttatttcttatctttgtcttttgtataagtgtcttttttcctgtgtctagttttaagattttatcattagtatttagcaatttgatttggatgtgccttggttttatgattatcctgcttggggttgttgagcttcttagatctgtgaatttatatttagtcattattttctcttctccttccatgaccacatgtatatcagactgcatagtattgtccaatagctcactgaggctctgttcattttttagcccttttttaaaactctctcttgcttcagtttatgtattttccattgtcttatattcagattcactgttcttctacaaagaagcactcaatttttttatttcataggttgtttttcaccttgaagttatatttggttctttataacagttcccatttctttcctcatgttgattttttttctttaattctttagacatttttatagtaattgtgataaagtccttgtctgttgatttcatcatttctatcatgtgtaggtctacttctgttgactggtttttagtcatcctttcgtcttcacctcttgattacatgatgaacattgaaatattatgtttagtatctcagttgtgttgtcttcctttaaaaaatactgagttttgttctggagggccattaattgacatgtgaaccagcccaaacttttggaagcttttttttttgagacagggtctcactctgttgcccaggctggagtgcagtggtgtgatcttggctcactgcagctttgacctcctgggctcaagtgatcctcccacttcagcctcccgagtagctgggaccacagctgcatgccaccaggcctggctaatttttgtatttttttttctttctttttttttttttttttgtagcaacagggtttcaccatgttgtccaggctggtcatgaactcctggactcaagaaatccacccacctcagcctcccaacgtgctaggattacaggcgtgagccaccacgtacggctagaatcttacttttaagttttgttagagtagatctagagcagtgcagtccaatccaaatttttgcaatgatggaaatgttttataactgtactttccaatatagtggccattagtcatatttggctatgaaatacttgaaatgtggctagtataattcagtaactgaattttttatttaatttaaatggtatgtggctagtgcctactgtattgtacagcataggtctccaataagctgtactctcgtgccagtttagtcctacacctaaggagtgacccttccgggatctttacaatgtctcaggtgttcaacgagctctccctggctggttagaacttgactttttcctagtccagtgcaagctccagcaattttcagcctatagttccccagtattctttagtgagaagttgtccttcctgctttatggagtttcaccgcgcacatggacagcttaatattcagctgaacactcaagtgggttactatgcagatttctaaaacttactctgtgtattctggtactccgcctaacatatcccagcatattccagctttctcaggctccctaaacaaccatctctatctctccataaaccaccatcctctggttgggttcccccaccctgtgtagcaaccagtaatgtgtctccagccagaaagctgggatgatatagggtttatctaatttgttactcattgatgcccttcagggatcacactactgtgctgcctattgtccagtatctgaaaaatgtatttttgtccagttttctagtggtgccatggcaggaggactagcctggtaccagttattccatcttttgtctgaaactagtagattacctcttactaacatctctacccatttcagagagagatgtgtacaagtttgctatgtttattttttaatagaatgaaatcactattttaagatatatttgtaccttctgttgtactatcactgcccagtagccagttctttcccaacctttacaacagcccattgaagaagacaacattatctccatttcacacaacatgaaagtgagacacagggaagttaaataatattcatagagtcacacagctggtaaatggtaaaactgggatttgtattcagtggtctggcttcagagcccaaattctatgccactattgagaaacattcagtgaataacaatgtgaagagtatacatatgagtaatttgaggtataaatatttatacttacatagtcacatataaacaagattcaatttttaaatcaataatgtttggcttacattagaatatggaaaaatctgtaatctgcataaacttttcaatctttaagggaactctagaggttacttaaggggaacaaaaggaagatacttccatttggtattgttggtttattcatttattttttgagacagagtcttgctctgtcacccaggctggagtgcagtggcgtgatctcagctcactgcaacctccacctcccaggttcaagcgattctcatgcctcagcctccagagtagctgggattacaggagtacaccaccacacctggctaatttgtgtatttttagtagagacagggttttgccatgttggccaggctggtatcaaactcctgacctcaagtgatctgcccgctttgacctcccagagcgctgggattacagtcgtgagccaccacactggcccatttggcattgttttataaaagcttactcaccttgtaatacataactatcttaggaaacataatactgttatgagtataagccccattttcagataaactgagactaaaaaagttaagtagctttcttggtgtcacacggctagcaaatggtagatttgggattggaaccctgtctgagtcaaagaattacccatgtggattgtcaccacagtgttattttttttaatgaagaagtgaaatattggaagcaacagtagaggtagttgttaagtaaatcatggtacaatactagtgataaaataacattcagccatcttttttttaaatgttaaagaaaaatatttattggcaacaagataaataagtaaaatgatgaatatttgtttttaaaatacaaacatttatgtgaagaaagatgcccgttcctgctttatccttacacaaacactgaaacatactgttatttgataaacgtatggagatatagggtgatattgttccaaggaattggaaggaaaaatacttgctttttggtagtttgtatttgcaaatagactttcttaaaagtccttaaggtctacaattcctatcctgttttctccacctaactactttcttatcaattccaaatattttcattgttgttgtttgggggtttttttgttttgttttatttgagatggagtcttgctctgtcacctaggttggagtgccgtggtacaatctcagctcactgcaacctccacctcccaggttcaagtgattctcctgcctctcagcctcccgagtagctgggactacaggcatgtgccacaatgcacagctaatttttgtatttttagtagagacagggttttcccatgttggccaggctggtgttgaactcttggcctcaagtgatctgcccgcctcggcctcccaaagtgctaggattacaggcatgagccacagaacctggcccttcaattccaaatatttacaagaccgtatttcctttcataaatgatttatgttctgtttaattttgcctggtaccagttatgtttttggtaccagttttgttttttcagaaaaacaaaaggaaattcttttttaggaaaaactatagtctccatattttttaactctgaaatctttaaccatcttcatatataaaaataattaatatattcagattggcttttcttttgcctcaatagctattataagaaagtcttagaagagtaatgttgaataaagagaaattatgtgaaggcaggagaaacaagaacagatctttgccctccattttcttttcatcaaaaagcatatgcatgtaccaactgtaagactgcaactatagaggtgacataaataaagtaggcaggggcacagcttcaggtgacatgactgatctattatacaaaatccaagcaagctccataccaatttctgagtatcctcttgctgcttgaggtcggttactagtggaagtttaacctggtcctgaacttttcattccgctccaaagaacgaacttccattaagacacagggacttgaatttttgtctacttccactatttccagtatgatattgaggaatttcctttgtgatacatcatcaccttatataagaattctagagggtataggaagaagaaaacctgatttctctactctcaccctcacttggagcaaccatacagaactcgcttactgtggtgattaaactactcatggggaattgctatgtgttgtgaaaattacaagaatatttataaatattgttctttcctgcacatatttgctttgagggagaagtttcattagatgggcccttcttcacatctaaaactaagtcttaacactaaaaccacaaaaacttttccccctttaagtacaaactattattttaaatgttactttaatatcagagcttacctttttaaaggactatacaatcaatattacttgaaattcacttgagaaacagaaaggtgatatcatacatttagatatccagatgttgccctttaagtgacattttttgaaagttttgaaattttaaaaatacttgacagaacttttttttttttggtcagtgttgtcagatattagttacattaacattctaatttcacattacaaataacatattcttaaaaattagataatacaggtaagcaaaaagaacattaaaaaatttcacacatttagaaatgcattgtaaaatcagaaggaatggaccaggcgtggtggctcatgcctgtaatcccagcactttgggaggctgaggcgggcagatcacctgaggtcaggagttcgagaccagcctgaccaacatggagaaaccccgtttctactaaaaatacaaaattagctgggtgtggtggcacatgcctgtaatcccagctactcgggaggctgaggcaggagaatcacttgaacctggaaggtggagattgcggtgagccgaggttgcggtaagccgagatcacaccattgtactccagcctgggcaacaagagcaaaactccgtctcaaaaaaacaaaaaaaaaccaaaacaaacaacaacaacaacaaaacacagaaggaatgaataaagaccaaagatgtaattactgtattgcatttatttttaagatacgtatcttttcaaatattaatatctctgaaactatgtgtggaatttgcctttcttaatgctatagtgatgcttcttaaatgtgatggtcttttattcaaggaaatacagtaacaaaggattgattgtaattttgggtatagatcctcctagatagaattctgaggaacagaactgcattgtacaatctgtttgcacagatttgagaaagtatttccaatagcaaagaacctctctgcaacagtgtctagggcatgccaaaccctgattccattcctatcctcctcctttcctgccataccactccagaagagaaagggaaatattaatagatgaggcttggttctggtactacagagggtgacgttagcattcacacatctgaatggcaaagaaaaaaaaaaaagggtagtcagagcacttctttctcaccagtggaaaagtacagtcactgagttttagggcagaaatcagtgttaagcttaggaaatctttcatagagtgtctcaggcttctgtgtaatatttcacatttgtttgtttcattttttgagtagtaaatatttctactgtggggtgcttcatgtctattatagcataaaatcaggacagaactgtttatgtaacattagtatgtaatcatacagctttttcaaacttatatacatatctgtatattatttaaatgcaaagtatgtatgtatatatttatatgtatataatgtattttatttttattggctatttttataaaaactttttttaactagaaatttaataatttcttccatttatatatacatgcaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagttatttaccttgta

SEQ ID NO: 375 - DNA, 33839 bp, Homo sapiens
taaaagtaattacaaattaagaatttatttataagttttcatctttttagaaataaaaaggcttaaaaaacaaaatggttgcaaaaatggttaagtagttttgttatatcctaattgcttaggtgtgctctgtaaattccaaataagtaaaataatataaaaatacattttcatatctttatagaacaaaaacaaaacattaaatgcttttggattttctttactcctcccacagatgagttcacaaatacaaaaactggtgtacatttatactcaagtacaaatctccaacagccaagtaattatagtttgttctgttatgtgcaaagtagattatttcatatttacttggtatggaaagcagagtacaggctcaatggacaataatcattaaacacagattatgtttaagaaaatgctgttgtaaaaatgtacaatagtacatacaattttggtaattatgcacttcttttaaagtaaatacagcttttagatataaatctttcaaaggttttctttgaagagctgtgaggtgactatttcagatttgatgaacagtaatttgtcagtaaacttctcaaaaaaccaatccaagaaagaattgttttctttttccctccatgtggtcggtttcattcttaaggaaggtctgatgcagtaagaagatgcatttcacaaacctttacacaagtttgtgaactgtcaactaaagacaccacctctgatgtggatggtttcattcaatccatgttcgaccagctttatatcttctagatcgtctttaatgatgctaatcaaatggctaaggccttcctgttgttgtttcaaatgctagaacaaattaagaaacaacatattaatgtattaatttcttaaaactgcaagctagtcacaggaaaaaagactccactttgactattttactagcaacacagtacctagtaagtgctctaaatatagagggcatgcatatttaaacatttgtactacatcttttgctaacagtgaaagacaaactctaaagaacaataaaatcaaacaaatatataatgaacaatatcttccaacaaaaatgttttttagatagctattccttttaccaacttttgataaaggcatgataataaaacagaactcaaaggaggtattcaaatatagatgactagcaaaataacattctgaaaactgagaatattcatgttttgaagtacaaagtacatagtgataatggtggtgatgactacagatgctaacatttttttaagactcctcctcatgggttaaggtgctgttttaacagtactggtattcactcacttaactcatttaaaatccttttgagccccctttggggtaccattatcatctcgacagttaaagaaactacaggtaaataacctgcccaaggtcataaagtagatggtgaaccatgattcaatcccaaaacaatacactgctcataattttaaaaaagacaggtgtttaaattattcccagttttattgcatatatcaactctatttaatacaactatttatttcaatatactggaacctgttaatttattgcaaatacttaaaacaatggaatataattggttatgtgtgtaatatccaagaacctggaagccaaagtagtttttggttgcataaaaccagccatatccattctaacataataaaattggatttgttgatgacatttataatctttatctaaaatcctcagggccatgccaacagtcattagctacctagtatgttccacaaagttcatcatcttcatatattttctttagatacaactgttcattttcattaaaccaatctgcatttatactaatgaaaataagccaaagcagtgtttcccaactttttcacacaatgtgaaaaccctagaaaagtggttggaggttctggccacctcaacctacctccatccagatctcctgagagcttaggggacagatcaataaccaaatgtttataacttacatgcgacatataggcagggaaggtattatctagagcagttgcttctcaaactttaaagtgcatacaaatcattctatgatcttgataaaatgcagattgagtacgtctggagtaaggactgaaattttgcatttctaatgaccttccaggtgcggctactacctacactttaaggagcaaggtctaggaaactttagtgtctctactacctctaaattcatctttttggcgaggagagggataattcacttttttaaacagtggcaaaacaggcataccataaaattttgcctgtaactatttttaagtatacagttcagtggcattaggtacatttatgctgttgtgcaataatcaacactatccactttgtttagaacttttcatcttctcaagttgaaattctgtaccagttaagttcctcccatcccctcctcccctcacaccctggcaaccacctttctactctctattaattggactactaggtacttttcataagtgaaatcataaatatttcccttttatgagtggcttatttcatgaagcataacttcttcaaggtcaaattgcattgtagcatgtgtcagaatttcattcttttttcaaggctgaataatattccattgtgtgtctatatactacattttgtttctctattctttgattgattcttgggttatctccacattttgactattgtgaataaagatgctatgaacatgggtgtacaaatatgttttgagtccctgcttccaacgtacttgggtatatatccagaagtagacctgctagatcatatcgtaattctatctttaattttttgagtaaacactacactgttttccatagaggctgaaccattttacattcccccaacagtgcaagaaagttccaatttctccacattctcactaacacttttcttattaggataatagccatcctaataggtgtgaagtggtgagctcacactttaaataatgcagcctcatgcaacacttacctgcttgatttctcgtaacagatctgcatctatgtaatacctttcttcagatctgactgctccaaaatgattctgcatcctgatttgagacatcaattcatttagtcggccctaaaagttaagactgagtcaaattacaactgccgacgaagacttgtaaaagacaatgttttcttctgaaaggatggtttcaaaaccatctattaaaaatttctatttctctctctgtacattatattcgaaacactaatactagccaaaagaaccatgactgagtttactttagaaaggaagttctaattggagataagaaacacaagtatacaaaattcctgcttgaagattacataactttttgtctgcagatccacctgaaacaaattttagaattatggtcttagaagtggttaccttgaactgagtaggtgcatttagttcaccctgaatcgtatccagctgaactcgcaactgctcttcatcagcctgaatggcataaccactcttcctttgaatttcctgtttgattaggacctatacaaataaaaaccaccaataacaacagaatcatctctttttagttatgcaagtagtagtagtacaattagttactgaaagaaatcagctgaaaatcaaacaacagtagggttcaacagttcaggatttgaattatgtttctgtccattttaactaggcaaaagttatcatataaatacaatgatatagacttaattgttttttttgagacagggtcttgctctgtctcccaggctgaagtgcagtggcgtaaacacagctcactccttgacctctgtggctcaagtgatcctcctgcctcagctcctgagtagctgggaccacaggtgtgcaccaccgcacctggttacattttttaatttttttgtggcggggtgggggggggggtctcactatgtggcccaggctggtcttgaactcctgggcttaattaagtgatcctctagccttggcctcccagagtgctgggtttacaggtgtgagccactttgccaagccaacaattttaaaactatggtatggcttggccgggcgcggtggctcacacctgtaatcccagcactttgggaggacaaggcgggtggatcaagaggtcaggagattgagaccatcctggctaacatgatgaaaccccgtctctactaaaaatacaaaaaattagccggacgttgatggtgcacgcctgtagtcccagctactcgggaggctgaggcaggagaatggcggaaaacccgggaggcagagcttgcagtgagcctagatcgcgccactgcactccagcctgggcaacagagcgagactctgtctcaaaaaacagacaaacaaaaactatggtatggcttaaaagcagtacaaaaaaatagacaacataataccagtttcagacatttactcacagcctttccaaataaagtgttctttaaagatgagtttataatatttaggtctaaaaattatttcttggattttttttgagattacaaaagcaaaatgtacttgttaagaaacaatacgagaatgtaaaagacaaattttctctcatacccccaagacaaatagtgctaactgatgtttattcccctgtacctttctccttgctcatcatacagagagagcacacacacacagatccaaaataaaactaaactgtatatatcactctgtgacatggttcctttttttggttgttgtttttgtttttctgagacgaccttgctttcttgcccaggctggagggcagctcaatgcagcatcgatctcctaggctcaagcaatcctcccacctcagcctcccaagtagctggaattacaggtgctcaccaccatgcctggctaattttttttctttttttttttttttagtagagatgaggtctcccgatgttgcccaggctggtctcaaactcctaaactcaaatgatccttctgcctcggcctcttaaagtgctgggattacaggcgtgggccactgtgccaggctgcttctctttctttccaatttaacaatgcatcgggggaaagggtctaaagcagtggcctctaaaggcagactcttggtttgctgctactctccaagcccagcttactctgttaaaaacagtgcaaatccttccatactctcatccatgctcctataaccatatctttttcataaacacacacatagaccgactgctttttactcatctaagtttttaaaaatggattatataaaattaacaaaattttattatcaatattaaccattaaattttataattaaaataattttattatcaaaatctcatgaaatgccttaagaagtatagctctaatttgttatttttaatggctgtatgctttttaaatgttattaaccaataatcaataattattgtcttgatggatatacattttgttttcacactacaatgccataataaacatttttgtagctttgactctataaacaatgctgtaataaattttgtagctttgacactacaatgctataataaacattttggtgcatatatctatttaactggtatagatctttaacaatgaggctgagttttaaagtatgtacgttttcagttctaaagctgctagattgctttttcaaaatatcctaatgatttagattcataggccacacatcagaataccctttccccacattcctgtcaagaacaggtggtggtggtttaaatttttcccaaccgcatgagtgtaaagggatctctttttttttttttttttttttttccccagatggagttgcactctgtcacccaagctggagtgcagtgccgtgatcttggctcacggcaacctccacctcccaggttcaagcaattctctgcctcagcctcccaagtagctgggattacaggcacctgccaccatgcccagctaatttttgtatttttagtagagtcggggtttcaccatcttcgccaggctggtcttgaactcctgacctcgtgatccacccgcctcggcctcccagagtgctgggattacaggcgtgagccactgcgcccggccaggatctcattttttttctttaatctgcaattcccagattcctagtaaattaaagggaccatcttttaatgactaagaactattttgcatttgctttttctatgaactgcctttacacatcttttgcccaaatttcaattgggttttactgtcaaattataggatctctttgtataatatgaatatgaacactaaatctaaaatgaatgctgtttgcaaaatttccttttcctaaactctatcacatgactattgacaaatggcttctggtatcttttgctacacaattttttatgtggccaatgttggtttatagtttctagctttttgatcaatgtctctcaaatcccaggctgtacatacagctttgaaagtttcttaaagtctttagtccactttatttttatacaatgcaatggtctaattttcttttcttccttatggatagttatactccagcattatttattaaataaacccactgaattgaaataccacctttctcatatattaaattttcagcacacttgcatctatttgtaaattccctactctgttccatgcattgttctgtccaatcccatgcagacactatattgattcaattataagaggtttaaaataggttctgaaatctggtaaagaagtccccttcactatttcttttttgttcctgaacaagctagtctcaaacacttatccttctttataaacttaaagaaattttaatcaaaatttttttagagacagggtctccctatgttgcccaggcaacagagtgcagtggctattcataggcacaatcatagctcactagagcctcaaactcctgggctcaggtgcttctcctgcctcagccttctgagtagctgtgactataggtgccatgtcatcacacccagcttaatctatttttaaaaagctgtaattcatttttaattttgtaaagtgggtattaagtattctcatctaagaatatagtttatctatttgtaaatacctatactttcctcagaaatatattcctattttacagttttgtcaccatagtgaatggaacattttcctatttccagatagtaaaaaggaaagttgatttttgtacttttatatctagccagcttactacattaattctatggtttattcccttgggttttccagatatacaatcatatcagcaaaaatagatcacttaatcatcttcccaatgtttatattatttctttgcttgttttatttatgaaaacctccaagatagcaacaaataatgatgataatattgggtgtccgttgtctagtttctaaatgcgattttagtgttttgccttttggagtatttgctattcatttttggttacagtttctattatatattttcctttaatgtgttgctataataagtcatgttgatagatgtcctgttattaaaaccaaccttgcattcctgaaataaactttacttggtcatagtatattttttaagaaattgataaatagctggattctctttgcttatacttcatttagaatgtggttttttggtccgatttgaggtatactctacatatgacaattcacctgttttaggtgttcagttctatgaatctggcaaatacatacagtcgtgtaaccaccacagtgattaagatacagaatatttccatcaccccaagccccttgtagtcacacttctctcttcatctacagtccctggcaactactaatctgttatctgtccctaattttcttttgtataatgttatataaatagaatcatgccttacacagcctttaagtctggcttttttcacttagcataatttgcatctctttaaaatagctgtttataatttctttttttgagatgctacaaacagaaatgtaaaatggtacagttgctttggaaaacagtttacgtagttcctcaaaaagttaaacatagtgtgcatatgacacagcaatttcactcctaggtttatacccaagagaaatagaagtatatgtccaaacaaacacttgtaaataaattttaatagcaatattattcataatagccaaaaaggagaaccaccaaaatgtccatcaattgagtaaaatgtggtatagccatatgatggaatattcagcaataaatgaataataatcatttattagtacctgaagtactattacatggtacaacacagttgaactttgaaaacattatgctaagtaaaagccagtcacaaaagaccatatatcgttatgattccatttatatgaggtttccagaacaggcaaacccatataggcaaaactggttgcataggactgacagatttgcagtgaaacggggaagtgactgacaatgggtacgggatttgtctgtagggtgacagaaatgttctaaaattgattgtggtaataacggttatacaagtctctgaatatactaaaagccattgaattgtacactttaaatgagtaaatagtatggtatgcaaattatcttaagctgtgaaaaaagaacaaatgaagctgtataaattattcctcaattgtctagaataatcaaaataacactggattagctcttttgtggttagacaaaatttggcaatgaaactatctgtccctaaggcctttttcatgtttcatctttcatttttccaactgtttctgtggtatttgttttcttacttctctgtagattttggtaattttcattttcatagaaaaatcaaaataaaacttcctctgagttccaaatctgttaccctaaagtacatgcagcatcttcttttttttttctccttttttctgagatggagtcttgctctgtagcctaggctggagtgcagtggcgtgatctcggctcactgcaacctccgcctcccaggttcaagcaattctcgtgcctcagcctcccaagtaactggaactacaggcacaagcaaccatgcctggctgatttttttgtattttagtagagatggggtttcaccgtgttgcccaggctggtcttgaactcctgagctcaggcaatccactcacctcggcctcccaaagttctaggattacaagagtgagacactgtgcccggcccatgcagtatcttcttattctgttttgtatatctacggtgatgcctcttttcccactactaattttgtatattttactctgtttttcccttcttccagctgatgagatgcttagtaattttaacggtcttttcaaagaaacagttttttaatttattctttccactattacattttttagtctttcactaatttcacatttatctttctttctttttagtttcttttggcttatcttgatattccttttctaatttaacatgagtactaagttcctttatttttcacatttgatttttttaaatgagaattttttatggctgtaagttttcctctgagtacagattttgctgtttcccactggttctggtatgtaatatttctgttttcatgatagtttataatttcagttgttattattcttttaattcctcctgttaatttggaaattctattgtttttcgaccattatggttacactcctttttctagcactcaaaaaattttctgaactattttatgaaactattttatgaaatttatgagacatcaataatctcacagaagcttcccttgcactaagatgctttatttcttcactgctttccctcaaactgtcactaaaatacgaactttaggatatttttattctcctcactcaaacctatgagacttgttttccaatttcaaagttttactgaaagaattcggtacttgtaatttcacattattctttcattttagtatttttttttctattttaaaaatctatatttagtacattatttcacacacatagtcttataaacactgggggggaaaatccaaattactacctgtaaagttctatgggaaagatccatgagtttcctcttgtattgtgcaattttggctacagatgtagtttgattcttttgtagctcactaatatcttcagatatgatctgtttaaaaaaaaattgggggggggagggttaatcaaatatcacaactatttatcagttacacctgtatggaaattctaatcttgggataagcctgagattcatctctcaaaatataaactctttccctataaatctgtgctttatatttcttccctttttacatacctaaaatttttttaaaagaatcatgcaaagatatctttagagctctaggaaatttagcaatgaggcaatacatagaaaaaataagctgggcgtggtggctcacacctgtaatcccaccactttgggaggacgaggcaggcaaattacttaaggtcaggagttcaagaccagcctggccaacatagtgaaaccccgtctctactaaaaatacaaagaagtagctgggtgtggtggcatgcacctgtaatcccagctacttggaaggctgatgcaggagaatcacttaaacctgggggatggagccgagatcgtgccactgcactccagcctgggcaacagagtgaaactccatctcacagaaacaaaaaacaaaaaacagagtgagactccatcacacacacacacacacacacacacacacacacacggctgggcacagtgggtcactcctgtaatcctagcactttgggaggccaaggcaagaggagtgcttgagaccaggattttgagacaagcttgggcaaaatggcaagaccttgtctctacaaaaaatataaaaaattaaccaggtgtagtgctacatgcctgtaatcccagctccttaggaggctgaggtgggaggatcacttgagcccaggagtttgaggttgcagtgagccgtgatcatgccactgcactccagcatgggcaagagggagagggagagggggagagggggagagggggagagggagagagggggagagagggagagagggagagggagagagggagaagagggagaagagggagagagggggagagagagggagaagagggagagagggggagagggggagagggggagagagggagagagggggagagagggagagggagagagagggagaagagggagaaagggggagagagggagagagggagagagggggagggggagggagagagagagacagagagagagggagagacctatctcaaaaggaaaaaaagaaaacacatacttcagaaataattaaggaatctgaagtaacatggaatacagccaacaaccaggtctgagtggaaaaagttaagatgtgtaagatgatatctagggggtgtcttaatagacaattagccctgtatctaactactgacagcaagtacagtacatttcaacattaactgttacagaatacttggagggagtaatcagagtgcagaggaaaaggaatgatattaattatgcagcaggatacatttttatgcctctggatctttgacttgctgttttacctgactgaaatcccactattctgccttaggaagtcttaaccttacagggtaggttaaaatctcactattttattaaagcatcccaatcagaattaatcccataattgtctctatcataattaatcattctatgccactggcttacatttacatgttacaagaaagaggttaagattgtgcaagacatattttagcacatccacctgcacacatcaccttttacagaaactttccaatgccaggccatgctgaaaggacaaaattaggtggccatgttttatattacaaaacctaggcaatctccccatcccaattttgaaaaatcaccagggtttttagatacaagagtacttacaacattattttctaccagtaataactaaaaaaattagacatgttatcagccacagtatttattaacaaatactaaaaccatctaggaattgatccaagaaagccatctaggaattgatccaagaaagaacgcatgagattttaaaagggaatattttaaaattattttaaaggacataaaagactgcaaggattaaagagacataccacattcatggatgaaatgatttaatattaaaattcaattcccacaaattagtctttgcatttaatgcaattccaaccataattctagcattctgacaaattgattctaaagtttttatggaagaataaagacccataaagacccagaaaactttgaaaagaagaaccaagattagagattcatgctactagatattaagatacactacaaagccataagactaaaaaaatgtggaatgggtgggtataagaacagaccaactggccaatgaaacataagagagggtctagaaatagatcacatatatatatgcaaacagtgtaatttaaattctttgataatcattgaggaatatcatatttttataggcaatattaaaaatatagggctgggcgcagtggctcacgcctgtaatcccagcactttgggaggccaagacgggtggatcacgaggtcaggagatcgagaccatcctggctaacacggtgaaaccccatttctactaaaaatacaaaaaattagccaggcgtggtggtgggcgcctgtagtcctagctacttgggaggctgaggcagaacaatggcgtgaacccaggaggcggagcttgcagtgagccgagattgcgccactgcactccagcctgggcgacagaacgagacccccatctcaaaaaaaaaaaaaaaaaaaaaatggacccactatttagagaaaaataaatctgagttcataccacatactttatataaaggtaaacttcatgatgacaacaaaagactcaaacgtgaaaggttaaactctaaattttttttaatgtaggatactctcagactttggggtgaaaaattatttaagcaaattcccaaaaagaaaatacaaggcaaacatttaatggatatcattacattaaaattaaggatttctcttcaactacagacaccaaagacagaattaacaaagagatgagaaactagaagatatttacaacgttataaacagagactacaatctagagtaaatgattactgaagttcaataaagaaaaaataggaagcccagtggaaacactggccaaagatatgaatgatttcagttctggacaagatggactaagcatatacaaccccaatctctcccatttaatatagctataaaacttggatggaatacacggggcagctatttgggaactctggcaggaagatcaggtaagataggaatttaaagtaccaataaacttgtggtgagtttacccatttttcccctcaggcgtccctagtctggtttcaacccagcctcaaacctggaaatgagcataaatgctgaaagggagctccaagggaagtctgctagttatagtgggaggagatacatcgtattacctagagaaaggtttctcaacttcagcactattaatcttgggtaattccttgttgtgggagtactgttctgtacactgcagaatgtgtgcagcatctgggcctctacacattagacgcctgtagtactccccaaccaagagtctccagacattgccaaatgtgctctgggagacaaaatcaccaccaccaccacaagccactactaagaagtactgctctaagacttgaaataatagattaaaaggaaatgctgaaaaaaaaaaaaaagtccaaataactcaaaagaaagcagaaaagtagaaacaggaatgaaaaacagaggctacaaacacaaaacaaataaatggtaggactaaatccaaactttttgctgtctacaagaatctcgcttcaaatataacaatataggtaggttaaaagcaaaaagatggacaaaggtatgccatacaaacactttttatcaaaagaaaggtagcgtggctatgttaacaccagacaaagacttctgagtgtcttgagtaagtgtccatgaacagatgaatggataaagaaaacatggtgtgtatgtgtacacatatatacacacacaatagaatactatttaatcatgaaaaagaatgaagtgctaccatttgcagcaacatagatgaacttggaagacattttgttaagtgaaataagccacgtgcagaaagataaattctgcatgttctcactcatatgtggaagctaaaaaaagttgatttagtagaagaaaagagtagaatagtggctactagaggtggagaaagagtaggagtagggaactgccaaaggttgcttaacagatacaaaagtacagctggataggaggattaagttccagtgttctatagcactataggtaactataattcacaaccatttattgtgtttcaaatagctataggagtgaatttcccatgataccaacaaatgataaatgtatggggtaatggatatgctaattactttatttgatcattacacactatatccatgtattgaattatcacactatgccccataaatatgtagttatgtatcgattaaaaacaataaaagaaaaggccattagagaagatttaaaacttaccgaggattaagagggatatgatataataataaaaggtaaatttgccaagaaaacacaacaatcctatataacaacagcccttcaaactattaatacatgaagcaaaaactgagaaatgaaaggagaaaaacacaaatccgtaagtgttgctgtagatttcaaatctcttctcaaactagcagacagaaaaaacaacaagaatacagaactgagcaatactatcaaccaactggatctcactgacattaatagaaaacttcacccaaggactgcagaatacacattattttcataggctcctgggttataaaacctcagcaaagttggccgggcgcagtggctcacgcctgtaaccctagcactttcgggaggccgagatgggtggatcacgaggtcaggagatcgagaccatcctggttaacacggtgaaaccccgtctctactaaaaatacaaaaaattagccgggcgtggtggcaggcgcctgtagtcccagctactccggaggctgaggaaggagaatggcgtgaactcaggaggtggagcttgcagcgagcctagatcgcgccactgtgctccagcctgggcgacagagcgagagacgtctcaaaaaaaaaaaaaaaaaaaaaaaaaccttagcaaagttaaaagaattgaaatcatagaaatttctctgacctttaagaatctttaagtatttaattatgaaagtttttttttttttttttttttttttttttttttttgaggagtctcactctgtcgcccaggctggagtgcagtggcacgatttctgttcactgcaacctctgcctcccgggttcaaacaattctcatgcctcagcctcccaagttgctggcattacaggcgtgcaccacgacacccagctaatttttgaattttttagtacagaccaggttttgccaagtcggccaggcttgtcttgaactcctgatctcaagtgatccacccaccctggtctcctaaaaaagtctactttatgaaataaaatattaagtatatttaagcattaattttatcaacatacaataatataccaagacaattatatgtcaacataaaataatcattactataaccttcattttcataaggccccataaataataatatgcaatccctggctgaaactggaaatgacagtctaattaatccactaagacaagaattctaaattcattattatatcaaatcagattcatgtgatttggggacttctatcataaagaaggtagttgtataaaactattaaattgcagtgtatgctacattgtttcctgattaagataaaacagtagcacatatactaaaaagaattaaatgtctataatccctttccctacttccagggccagggaataaaaagctaaatgcttacatctaatctggtttgatgctgcttagtcatctgatcttgaaccttcagtcttcggagaagttccttaaaacccaccattggtacaggaattaacctgaagaaacgcagtgaacaattttcagaccttaagcctattactacaaaatacaagaagtgaaggttttagtaacactcatgtaattttacatcaactttctagggctctaaggcagatctatgactatgagataaccatgttataccaaagagattttattcaacctccctattttacaaatgaggaaatacagttcagtcaaaacattacattattaaatgaaaacgcaaatagaattttccgctcctagttagttctcactatgctatgctgccttaccataatctttttttttcttatttttttctttttgttttggctgaagctttagctggacaataatcaatattttttaaaggccaggaaaatgaaaataaacttgtctcatatgtaagaattataattaatagctcccatgtttgctttcctagtagcaaatattagttcttaaatgaaacaagatgaagacatacttacttttcagaatcagggttatctaccttggcctgttcccagataataggatcaacacctaccacaaataaaaaatattttttctaaaacaattttctatttttataatatgtgtatgacaaaggctttcctaaagcaagaccctatacctagaagctataatgaaaagtgactgtcaaatataatcatggtaaaaatacaaatttttgcagaataaataaagttcaaaaaaagcacagattgaaaggaactatctataacctataggataatagattaacctccagaatatagaaagagttcctatacatcaaaaaggaagacaaaaaaatctagaaaatgggcaaaggacacaaataggtaactcacaaaaaatataaatgtagctaataaacatattaaaaataagtattaatttttaaattaattattttgccatcagtggccagaaaaaataacattcctgttatgaatataaacggtagaactttccctggagggcaatttggcaatatctaacatacataatattgactcaaaaatttcattaccagagatctattctaaagaaatatataccaatgtgttctaagacatgtttacaaggatattgttaattactgtacagtttataatagtaaaaagaaaacaacttagaggtgttaagtaaaggtgtatccatggaatactatgcaatgtttaaatacagtaagatttatcttcatgtattgacatgaaaagtgctaaggaatactgtaaaaaggcaagctgaaggtgtatatggagaatccttttttaaaagatctacatgtaaatatgcttacatttcaaatcacagataaaggattaaacatagtaccataaattgacagtagttacttccggggaaaggaactaaaggtaatctatcacatagtcaatctagttatgccatccagaatattttacagttagaatacattcaggttttacttgaatattcagttaaaatgagataagctagaaaaaaataagccaaaattttactagtaaattacctttgggtagatggattatggactatttttcttcagttcactatttctcaaaatttctattttaacatatacatattagctatataataaaaaactaaatgaatacaaatattcaaaactatttcccaaataagtagatatatgacaagatgatactaattttattagcattaataaccaaccaacacctctgaaatacggggagtgtttagttctaaatctttctttttttttgaactctgtgattctagaaacataccagcaggaggattctgtaaaagctgtttgatctgtgcaggagaaagttctgttctagtcatagaaagggttacaccaagttgctgcaattgtgtttttatattggcttgttcaaaatgggcatatagcgttgtagctggaactcttcttgaagtaccatttggcgaacgctcaacaacataaataacaacttctgtcctgaaggaagaataaccaatttataaaatatggagcacaaaactcatagcgacaaacctcagcatatcatagcatgtgatttcagaagggtttaagttgaattcagaaatggttgttttaggaggcaattaaaatgtttcctttttttttttttttgagcaaggtttgctctgttgcccaggctggagtgcagtggtatcatcactgcagcctcaatgtcccaggcttaagcaattctcccacctcagcctccaagtaactgagagtacagctgcacacccgctacgtttagcttacatgtatgtgtgtctatacataaatatatatgatatatatatatatatatttttaaatttttttgagagacggacactcgctatgttgcctaggctagtctcaaactcctggtctcaagcaatcctcccaccttgacctcccaaagttctgggattacaggtatgatgagctgctgtgcccaactgttttcttcttaaatcttggaaaataagaaagttttacttcatgtaatgttcatttacaaatcaacctaaatgataaagttaaaaagaaccaggtaaataagatagtatttgtttttttttttgagacggagtctctctctgtccctcaggctggagttcagtggctcaatcttggctcactgcaagctccgcctcctgggttcatgccactctcctgcctcagcctccctcgtagctgggactacaggcacctgccaccacgcccggctgattttttttgtatttttagtagagacagggtttcaccgtgtcagccaggatggcctcgatctcctgacctcatgatccgcccgtctcggcctcccaaagtgctgggattacaggcgtgagccaccgtgcccggccaataagataatatttataaaagggtttgcttagttgcaaaatcctatgtaaatgttatttactataggaaattctgttgaaatttatgggctgcttctctgcaattacaaccacaagtaaaatctgttcaattattgcatctcattaataatcattcctccaaatatcctaaaataaatgtcttgccactaacactgagaattatacttaggtcaagggaagtaaagcaataatatttattcatgaatgaacatgaacagtaatgagttaataacattttccaataacatctttatggccctcaatttgcacgcatctatgacaaatggtcccttcctggcctgaatgaaaatctagaaaattattagcatctagtaagttaaaaaatccaaaattttaaaaaaacttttaaataaatgtttttatcaatactgaataatcactagctgagaaaaggcattctgctctgagagttaatttgtgctttagcaacaaaaacattattgatcactcccttaggaccagaaataaatacacagaaataaacagtatatttatgtatacttactgatcatctggcaatgttttagtgccctctacatttacagtaagggtctggtttcctcccaaaactttatgcaatgattctaccaactgttgttgttggcttcgaatctctgtttcttttttgttgaaaactaaaaccactagcccatcttcatctttattactgggcatgcaactataacctactgcctgtggaatgacaaaataaacaatataaaaaatatgtacagatcttaaatcaggtgtttaatattaatagcttaatatctgctaaaatgggaaaaacaacttaatgtctggtaattaagggaataatgattcttcccaccattttgtgccctaggaggtcacaaaattataaagaaaaactattttacccaggaataacattaacctatagagtaagattaacatttcctctttgagagagtaactaaacagctttctcccctaaaaaattttgatattcattattgttggttgtttctgaaccatctgcatgtcattataaaagtgactgcaaaaatcaccaactaattataatttatttcactatacagattctcaacttatgatttttccattttatagggtgtgaaagcaatacgcattcatatatacatacatgtaaaccatacatggaattctgatcttttagtttttattataaaattattattattataagatggacttgatgttagattattctgcccaattgtacactaatgtaagtgttctgagcatgtttaaagtaggctaggctaggctatgatgcttggtaggttaggtgtattaaatgcatttctgaattacaatattttcaattatgatgggtttattgggatgtaacccataataagttgaggagtatctgtatatctgattcatggaatcttaaactaagttttaaatatataaagaagtaatttacaaataaatacttttaaatcacagtaatgacagtcaacttacaaatactataaagaatgtctgtatcactttattggtttatataatacaaaactttatgaaacagggttgttgtttttttacatattaatatgaccaattatacttttctaaataattgctcttttagatagaagccttttatcccttttcaccactcacctgcaacttttaaaaaagaatttaaattaactcaagtgtacattatgcattttaccatgttatacaccaactttattgttatattcaacttatgtctattattgaatacctcttagcgactaaatacatgtatcaaaatttcaactatatgcactcaatatactttttgttagtgatgacacaaagagatgttctgtaataagacaggctgaccactttattcaaggatctgatcctcagccttacagctccaaacacagggttatgtacatattgattaggtttaagagaccaacgtaggccaatataactcctaagaggctgaggtataaactggattgcaatacgtaatttgttatggaaaatgcattaccaaatggacctaaatactctcactggctgataaagagattttctgaagagacaaatgagaaggttgtttggtaggcagggaataagaacacagaaaatgggcaatattgttttaatagctttggggttatacatgccaaggggaatttctgtctgctggttagggtatactctcctggccaatgttaaatgaataccactaaattgtagtttggtgtctcccctttacaggtgccaggcaaaccattctcctgtttacattttttttcttcagttataaatcacattccagtcacaccttccttcattcatattctggtcaccttcaaccacacatatgtatgaaatcacttcaattttataatttctatattttcaaaataaaagtataatcataccatgttcaaggagtaaagatccaagcaattgttatcttgatattaatctaaatatattttctgttatacaaaatcttcaactgaagataaaaatagtattaataataccttaaatcggcaaaagggattttcttgtgtgaattccactggcggaatattattgttgaaatacccttttcctgttccccaaaaggcctgcagttgattccattttgccaaaatagcatctctctcatctcccaacagcgttggagcagaaagagcactcgcagtatttatcagctggttggactgggtaggagcttgtgtaggctgactgaagagaccacctaatgctaaaaatgtacccaaaattagtatttaaaaacaaaacaaaacaaaacttaatccagatcctaggcgtggtaggcaaaataatggccccctccaagatgcccatatcctaatctacagaacctataaatatgttatcttacatagcaaaagggcctttgtagatgtgattaaattaagcatgctgagatagagggttatcctggattatcaggagggactcaacgtaatcataagatcctcaaaagtggaagagtgcgctcagagtcaaacagatctgaagatgctatgctgttggcatatggcaagatggaagagccgcgagccaagaaatgcaggaagactctaaaaactggaaaatgcaagagaatggattctcccttagtgcctctagaagtaacgcagtactgccaggaccttcattttagcacagtgaaacccacttctggacttctaatctccagaaactataaaataataaaattttattgtcttaagccactaagtttgtggtaatttggtatggcagcaataggaaactaacacactaggccaaaccttataacgttaaatttgtttttctaataatatttttttgagacagggtcttactttgttgcctagactggagtgcagtggcaagatcatggctcactgcagcctcaaccttctgggctcaagcaatacccctgcttcatcatcctgagtcgctgggactacaggagtgcaccaatgtgcacctggttaattttttaaaattattttttgtagagacagggtcttactatgtttcccatgctggtctcaaaacttctgagctcaagcgactctcctgcctcagcttcccaaagtgctgggattataggcatgagcaactgtgcccagccctaatgatgttatccaaattaattccattaccagaacacagattgggtccacaatattaaacctacacatgaaagaatggagggagggaggaagggatgcatgtggataaaaaaaagtttgtaaagatgtaggattttttaaaataacctttattgctgttatatttatataataaatacaaattgggggatacaaagtctaaaaatcattgttatatcaaataccagcttactaaacattttcctttctctcattattaaaaaatatatatagtaataacaaatggattaaccatcagtattctaggctaaaactttagatggctgtgtaactttgggcaaatcaacctctctgggataccaatttctctaatggaaagaagggccaagttcttagggcagataaatatgccccaaagtgtgagataagtatgtcatctttcaacaaagcgaggagcaagtctaaggctcagagcttaaggcaaagttatctacctagaatttatttacactatattttctttgtacttaatttcaattaccttttccttagagcaaatgatactaattttccacttatagcagcaataaattttactttaaaataactgtatttcgtgtttcaaagtaaactgatttaaagaaaattcttaaatagtaatacaaatggtatgtagatgaggagaaaacgtgaataccaaaatgacctgagttttaaaacactgtattagatattgtttaagttctctttcagctctaaacattgaaagtaccacaaggtccatggagcttctacagagctagagagaggctcttttactctccagaaaagtattaattcccaaattagtatatataaacattggcaagaactggactagaactcagaacacttgaatcctggtttattataaggtcgctttctatccttgagcaagaaattcctgggctttatcttcctcaacttttacatgagatgaatcaactgtgatctctataccgagacatatgcagtcagcctcccatgctgttgattattcctttggcccccaaagaaaatcttcaccttctgttgaatacacatcctccttgaaagcccttctcccttaaatttcctgacaacacagtctctcttggttttttataaacacattcattcattcattcaccattaattcatacaacaaatatttactgagtacctactaagtgctcagagccaaatactaaagatacagtggtaaacaaggtagacaaggtgcattaaacaaactgaacacatcaaacaaatattaacaattgtgataagtccttcagagaagtacagaggttctgggagtactaaataagggagctgatcaagcctgagagaggggtcaagagaagacagttccattagcacttcagttagggcctaaaggaaggagtcagctaagccatggggtagaggtaaaggccaacagtatgtgtaacatctctgtagagacagagagaggaagatgagtggacaaaagcaataaggaggactaacaatgaggtaggaaaaaactagactggagtgtcacagaagttaaggtctcccactggccaaatgcaacaactgaaacatatttattaaagcccatgcattcaaaatggtaattttataaagtaaagatcaaattttttttaaatcctaactccttggataccattagaaataatgagaccgccaactcctttttacaaaaattgtccattaaaaagaaaaaaaattatcttgcctttactatacaaactgtacatcagggtgatcaagcagtcttggaggatgaagaaaaagttccttttacagaagaaatttcagtgtgatagggaggaaattagaaaatcaccattttgcaactcctaataagataactgattgaggcaatgatcatcaaggaatgaaaccattaggttaaagtagtaagataaagatacgctgtcaccatctgaacctactgatcaatcttagcatcaccaaaagtgagatagcctctcaacgtgacgtgatatgaagcacacagcaccacttgcaaaatgttcttaccaaaaaagcaaacgtcaagtccctaaagcaaactttatttaccacaattatgagagataaagttaaataatattacaaggaagcagaagaaaaatacagaatggggggcatttaacaagacaactggaaaattcatgagggaaaaaacagaatggggaattctctacactaaaaagaacttaagggacatgacaagaaaatgaatgtgtggtccttgtttggatcatgattcaaacaaaccaaataagaaaacgcttttgagacaaatagggaactctggttatagatggggtattagatagtaccaaggaattattgtgggttggaatgaggtacacatttttaaagagagaagtatagtaaagtaagcatgaaatgacacgcttgggatttgctctcaaatacatcagtgatttaaaaaaaggaaaaaggagatggacaataacaagttctgacttttgatgactccagctggtagggttcacatcacttctttttttctttgttagcatttttcataaagaacagtaagtgttcactggatttactgagatgattaatgaccttaacttatttgataaaataaagaaaacagaaaccagattggcgaatagtttgtaaaggggaggagagtggtagctgaagtgaaatgtgggattaaagtagttttgttgttgttgttattactgtttcaagaaaaaataaactttgagttacttaaatgtggatgagaaggtgaagactggggaacggagtacagctagaataatcaacagcacatgcgccctgaaaaggcaggaggttataagatcctgagtcaggtaaaaagaggaaaaggtggatagagggagaaaaaaaatagatttggtggagggaagttgaaggaattgcaataagggattttattttctctttggttttttttttttttttttgagacagagtcttgctctgtcacccaggctggagtccagtggtgcgatctcagctcactgcaacctctgcctatggggttcaagcaattctcatgtctcagcctcccgagtaactgggactacaggtgtgcactaccacgcccatctaatttttgtatttttagtggagatgggtttcaccatgttggccaggctggtctctgacctcaggtgatccgcccacctcagcctcccaaagtgctgggattacagatgtgagccactgcgctcagcccttttttgtcttggaagtagcagtcaaggccatctgctaaaagtaagaacagataaatttgagatttgaagagaataaaggtttaaaattactgctatagaaagcaggagaataagttgaaagtagaaatttcacaggattaccaggcaacattgagacctgaggttggtgatcaagaatttagagaggtattatcccctcttccataatgtgtgatctttctcaagcaatatctacacagacagttgggcttacaaaggcttggggttttttcaggcaaatgtgacacaaaaacaaggaagtttagcatattggcaagagatatagaaatggaaggccatggaatctaagctagttagagtagtgaagacagaaagagctaacagagcagaaagtatcagttgtcgaaagatccaacagtcttctgaaggatcctcgataatccatgctttggcttggaaaggacttctggcggttgtcacaaagtcaaatgtgacttttccccttgattcacaggtattgccaactgagataggaatagctgtgattagtaaaagggagctaataagtatgaggaatacatggacgggcatctctatactgagataggacaagcagtggtcctaacaatgctgctcgctaatttatggtcaaaatcctacttggcttggggataggagatggcagcatttaagtgttagtgtttctaagagttttgttctagtactctcctcttactctggaatcaggtctcctaaattacatcatccatatctaccactttaaatactacttacgttctgatggctttcataaatatatacaactacccaagggacacctcaaactcattatctacccacaaacatctgctcttgctttagtattctggatcttagtgaagagcaagggatccttcagttacgccacccagaagcccaagatacctttatccagtcattcgcttttattgattctacaagttaaatctctctcaaattcacatcctgttttttctctccattcttaactgtcactgccttaattcaggtcttcactatatcttgctcagattttggcaacagcttcaccagatctctgcctccattccaacccacctataatctatctttgtatttctctaagagatacttctaaaaatctgattattttcctgtctacttaatcctacaacagtttagaattgcttaaaggacagctccttagtaaaacatataaggcacgctaataatccaattcatatctatctctccaactctcactactgaccctgaggtcatttatgcattaaaaaaactgcactgatctagttatactggtcccaaaggcattatactctgccataaaccatgccatgttatttcctctgcgtggataccctagaatctccttgactatgagcaaggattgtggtcttcaaccttgtacacccaatgcctgacatacgatatatacaataaatggatattacataacaaaatgagcccctttcaattttaaaatagcaccagattcaaattcccattttcctaaaaaaaccaaatgtaactacagttactcatagttggagagactttatttcaagaaacaaaggaaacacttcacttttgctgttctttccttaactacttaaatatttcatcaaattttgtatttttgcaggattgtagaaaagacgaatgactggaatacttgaaagaataattctgagaatactattctattatcttcatcctactgttaggcaatccttgaaattcatgtttaataagttaataactaatcttcagtgactgagtaggatgaattttagctagtcaatcaagttacttaaaaaaatgaaacagaagtaattttaagaggcatcagattggaaaagtgaaaagagcactagaatgagtagttgaatttgcatccctgtacttcttctagagaggtatacaggtaagtcacaatctctcaggttcctctcttcacccataaaatggggataacaaaagtattatttcacagggttcttgtgagaataagttaatccatacagaacaacccctggaacctactgccataccacctagtaaggatggttagtaaggaagccatcaaagactaataaccagactgtctcaaagggacttgggagccaacttgaaaaggcttgcactggccaaagatgtaacaatttaagcatcaataagaatggtaactgcaatggattaaaaaatagtaactagtttaaaggctgcagtttctgacattaaaaaaaaattggtcatctttggagaatgctagataaccaactctttattctgaaaaccagtaataaagagaaagaatcaaccaaacagatgaagtcaagtttctcctcacagaagtatttcaacaaataaatgaatccaggtggaatggcactatttgtaacccctaatgaattaatggatctaggtaatgatcaccaatggctcaatggctgatcactcaaaaaaaaaagatattatatgtcttctgataaaaaataggcctataaaatagtcttgcaaacaaacaacaaaacaacaaaatatatatatgtacgccccagatctaacccaatcatcaagaaatacagagaacaaaggaatgtgttaaactataccataggcgtgcaatcagaaaagtcttgactaaaaaactctataggataaatgatctgttttcttcaacaaattaaaaaataaaaaagagaggccaggcgcggtggcgcacacctgtaatcccagcactttgggaggccgaggcaggcagatcacgaggtcaggagttccagaccagcctggccaatatggtaaaactccgtctctactaaaaatacaaaaattagctgggcgtggtggtgtgcgcctgtagtcccagctactcaggaggctgaggcagaagtatcgcttgaacctgggaggcggaggttgcagtgagccgaggtcgtgccactgcactccagcctgggcgacagagcaagactccgtctcaaaaaataaaaaataaataaaaaagagagataaaagaggagcctatggagatttaagacaggcaaaaccaaatactgtttacatacttgaatgacaaaatataaagtaagaaaatgatcaccataaaagccaagactgcaggtcctctgatggggaagcaattggtagggaaatgtggtaggcttctgaactggctggccaggaaccatctcctgacatgggcagtgattacaagggtgttaacctttgtaaacttatatataattcattaagctgtacttttgtgcagtttctctatttgttatttttaacaacaaaaatttaaatggaatgatcctaaacacagggaccttataatcctaactgtgccaatcagtgttctccccagttgctatcatatttaaacatgaaaagtaacattcctaatcctttggaatatattaataattcttataaaaagtccactaaagtattctgaatgcactcaataatgtcagctagtatcatcacggttttgtatttgaagctgaaaacctcatacttactagtttgctgctgctgctgtgtattaaatcctccaaatcccagtccagttcccaaaccagtacctaaaccagtactagttcccgttgttgtgccaaaaccagtaccaaatccaaaacctttgttctgagtaccaccaaagagtcctttgaatgaaaaattggaacttcgtaagttaaaaaaaaaaaaaaatctgacctctacttcatttacttctatgaatgacttaagatggcctcttaccagtagtgcctgtgttagttggggcagaaaagctgaatgcagaacctgcagttgtagatgttgtcccaaatcctccaaacccacctaattaaaaaagaacaaaaatagaaaggaagaatcttttgtatatataaaggcaacttctttttaaaattattttataattgctacatataaaatcaaaatatattgatctaatttttcctttccctactttcaagatcaattttttaaaaaactatactaccaatcaagaagtcaaaatgttacaagaaatgaactaagcatttaaaatagaaatatcacaatgtaatatatacccttcaattaaaggggtggttaacagttacagctgagaaaacacattaagcctattgccataattctaaaatgactatgtatgtacttttagaggaggtgttgcaaattcatatgcctagaagatttagactgataacagtaaagagtaaagtagactatgtgtttactgataggtggaactgtttaaaatgaatagttttttagatcagcagttcctaaattccagcagatacaagaaaggtagtttagcagtgtcacatattcccattttttaccccaagagaaacaggaaatctggattttctatgtaaaatttattggtttttggctgggcgcggtggctcatgcctgtaatcccagcactttgggaggccgaggggggtggatcacaaggtcaggagatcgagaccatcctggctaacacggtgaaaccccgtgtctactaaaaatacaaaaaattagccgggcgtggcggcgggcgcctgtagtcccagctactcaggaggctgaggcaggagaatggcgtggacccgggaggtggagcttgcagtgagccaagatcttgccactgtactccagcccgggcgacagggtgagactccgtctcaaaaaaaaaaaaaaaaaaaaaatttattggtttttaaaccctaattcaactacttttttttgcaaggaattcaaatgttttgaaaacagcatgccaaacatatcacattggcagacttgttgccagttagcaaccttggttttggtgaattaatttatgtctaaattaacttatatttctacttagtctctgtcaagactaagtaacttttcaaaggaagcataccaatatacttacctccaaacaacaagaatgtgtttcttgaaggaagagatttgacagataaatggaatgctagccaatctaaaattgttttgttatttttgtaacttattgtcagtcttcagctgattaccaatgtggtatcaaaaagcctttcaagacaaatgtttgaaccattagtgtcgaattatattgcagattttttggaatcttcctttaatctcatttatttctggtatacaacacagattcatcaatattgcaatatagaaaatacaagaagaaaaacatgcaaccattttatattaatcacctcattctgatttggaaaactactcaagagtaagctgcatgttgcatgcaggcacaactaaatattctatttacttgtaggttctactgcagtactgcaaactataaacattttcataaaagtcacccacagtactaagcactgttgtaatttcttttcattattcttcacttccatagaataactatgatataatctgaattggctacgcaatagaaacactagtcagtttctcatcatgctccacaacatcaaaaatgttttagtaatagcagatctgcaagtatacaaaataaaaagtaaacaagaaagtctatcagccctttgctgaaggttaacacatataaaagtagttaaaacatattacattatcataactcaaaacttaacagtgataactccaaatgaacatgaaatcaagcaaataccaacaagtttatttattgttgttgaattatgagctgggtggctttattcagaaacacaaatttcaaagtaagatttctgttttacccagtgccaattttaagcaaacaaggaaaagtaaacacatcaaaggacagtgatatgtgattacttcgaatacatcttaattaaaatgcatcatcttgtctttgaagttttcaaatattcttcgaactgttttcaactcagatgctagggtgataatcacattgcagtaaccagtgaatgaacaaaataacaaacttcccaattaacttttagggagtaaataatgtttatcaaatgcatataattggcatgggcacaagaggcataacgtaagagactatggacgataaattcatatacgagcagctgaagaacaagtttttttctacagtgtcactatgtaaagtacccataaacctattttaaatgtatatatcattattgttttgcaaaatttctaatgagctgcaaacaacccacgtgcatatgaaaatcttcataattatctttttgaatgcaaagacgtctagcttaccttttagaattcgatgctatatcacataaaactaaactgctctctttgagcatttcccaaaattccagcaaagaactggggattctttctataattacaaatcttatagaaattacacatcttatagtatcctaatctgctgagttgaccaaagaaatacattattatcattataacacaagttaaaaaacaaaacaggttactgctgttcgtataagacttgtttctctttggaaacacaaggacaataaaatgaaatctcaatgaaagatgcagaaaaaatgaaaaatgactgcaggagtccaagaatcccaggatgggcttgactggtggtgagtttatactttggaagtcctacctaataattttaaagatctattcaaaattataatccaaatgcttatcatttggaagataagtgcacatttaataaaggaacactgtaacttgcaaaactttcctaaaccacatcttttaaggcagtaaaaacttgatacagatgtttttgattcgagataaggaaataaatttcctttccctattagacaagtaactgttctttcccaaactccaggaaccacaatattcttggactccagctcccaacactggttacacatacaacccgcagtatctacctgcacttgccagactgttaccaaaattgaacggagtcgccgaggtagtagaaacaccgaaattcccaatattaaagttcactgcaggattagcagttaatccgaaacccccaaaattaaacccactggcggtggagttggcagtctcaagcccaccaaatcctgataggcgtgtaggcaaagaaacaaaattttaaaaagggggagagggaaaaagaaaagaaagcaagataaggattagaagaatcagcaggaggtttcacagaagtgaacaaacctggttttgctccaaacagtttaagaaagcagagtgggggtggggtggggcagatggaagaagcatgacggataaaccccacagcgaggaccacagggggccgggggtggaactaagggagtcaatgggcagtgccggtggatccccagccctatcctcgccgagtccggcagcgggaaccacgcaagcgttcccgcccatccaggaggctgaggtgcagaggggagggaggttctcgggcaaggggagagggaagcaacctccaatttctctgagtaggactccccggcagcgggaagcgaaccgctcaagccagggccctgtggaaactcacgcgcggcaagcgagcttctagtgggaccccgagtacccccgtggcctcctcgggtgccgcctcggcccactctgccgccgcccgcccttttccaatgcctctaaagtctccgcgtcggcgggagattccaggatccccaggtcggagagtctcggacagagggggcggaccagacccttccccttcttcccgggtgaaggtctagggggatcactcacccgcgggggccgcggtggctgcagcggtaccggaggtgcccgagggagccccaaaattgaaggccatgtcgcgaaagcaggagaccaagtaggttactcctgcgacgcgcagcgcgctccccttctcagtccggccgggaaaccgccagtcagatcaccgagttccgcctcctttctgacctagcctaagaggcc

SEQ ID NO: 376 - DNA, 55162 bp, Homo sapiens
tttatataaagtggttttttattaatgaaacatttcattgcattaagggtagaaataaacatgtcaagaaccgcatgaagtgaaccaactgtataagctacatgaagagcattctggtcagtattcttgttaacaggcacaagcaatttagtgataatgtccagagggccaaggatgcggaccaccttttgcagaactcatatctcgagcagtttaaattaaaaattagcctcccttaagttaaaaaccccaataggggttagtcgtgtagtgcttgttccacttgaccattagtgatctttctagaacatgaggaaatcaagtctggttagaaaagcctggagctaaaagtggcaaagcccatttcctgtcctgtgctcaactcctaattttccctgagagaagtgagttaagctctctgtcttggtttcttcctctctaagttgaggatcatggtaccagaagcttgcattctgtgatcatgacagtgcttacaatcacaaagcctttgggggtctttctaagataactgccgcaagaaaatgagcatgagaaataattcatcttcaacttaaagccaaataggtgcattcattcctcttaatctataattttgactgtagtttgtagatctgtctcagacttttcagaaggatagtatcaaatgtgatttaaaccaagtaactattaagaatcataaaacaggccaggcccggtggcttacgcctgtaatcccagcactttgggaggctgaggtgggcagatcgcagggtcaggagattgagaccatcctggccaacatggtgaaaccccgtctccactaaaaatacaaaatttagctgggcgtggtggcacgcacctgtagtcccagctacttgggtggctgaggcaggagaattgcttgaacccgggaggcagaggttgcagtgagccgagatcatgccactgtactccagcctggcgacagagtgagactctctcaaaaaaaaaagaatcatgacacaagtatggaagtaatgtttttggtctccctgccagtgtgcaactcagtctaaatgtgtatatcattaactgttatcatttacagtatttaaaatatcctcctcacagatgattatatcctgataataggactaaaccaataagtatgcactagcattgtcaattttattagtatggataagtacatgcataattaagacatgcccaattatctagttaaatgttgataaattctaaaaatgtagatatttagcattattgaagaccaaatatttttgttagtttttttacattttggtgagttggagtatctaaaggttctatcttgattctatagaaaatttgagagtttaatgaattgcctcttcaagaggggaaatatatcacatattgttttagtgtagaaaaaggaaaaattgtcagtaaaacaatttattacctcaatacagggataagaagctatggaaatgaaatctatatttttttcttcatttgcttacattgaaatccagttttaaacaaaaaaaatccttttgaatggttcagttgttaagaaattctataagcactttgtcagctaaatgtataggcttctcaattcaaaatgaatgctgaactttgagaatcaaagaaaatgcccttaaatatgcttgaattctgaacactgtgacatatgatggctcccaattccctgtcttaggttatgctgaaaccaagaagtcctttgaaaagtggtgtctctgcttctggtcctaacagacctttctttaaagtactttgtgcaatattttaaacatccatcattctgtcagcaaaatgattgtcacaggaagtatagggcacacgtttctctattcagtgagtgacagtgagctacaaaacactggaaagaactgaaactgaggaaggaacttgtaaaaagaacttcaaaattaccaagaaggcggctgtcccagaagaaatatctctttagtctaatcagactttctgaaacttatgtgtaacttaggctgtagatagatggatttcccatattcataattttacaaataatcactcaatattagattaattaatacagtaacatatttggcaagggcgactcaggaagaaaaatcagttactcattacattctctcagaagcatcttttcgtagcatgatcattttgactaaaaaaaaaacagttaactatccacaagcatcataactagcaattaattctacatgaaatatctgtactttatcctcaccaacattatttatgcattctcttcgttcacaaaagtacaagttaaaaatccttaggagcttatcactatcaactcatgggtattgccccacccaacccctttcccatttgattctacccagtattttattgcagttggaagactgagttttcctggaagaattatgaactgaagatcagcataaaatgtaatatgttttagaaatcagatgcatttgaatgatatattggatgaagctaccattttaccctgggtcccgaactcttatttacttctgttttgcaagtgaaatggaggaatacaacataaaatggtatatacgcattttgagcacaaagttcggtgaatgaagcatactgaatgaagttagaccagtagcattaacaagtgatgcagagacattttacccacaatagtggtcacaaaattctggagctaccagcacccaacaacaacaaaattactatacaagggtttattaaatacttgctagacacataaaagaacaatttcagagcccacatgattttataaagcttaatggccagccatgtcagcctgctctttaacctctggccagaatgttcctatcacttgccagcgccgtgtctttttccttctttcaacaggcaacaagcctgcaaggaggtggagggtttccccacgtcatcgtccaggtcaggacagctcacacagtttcttcaccaagcaaaggcaatgtttaggttcgaatgaggggtgctctttcatccgctgttccctgaaacacagaagagagaaaacaagttagatgttcatgtcagaaacttctccccagtgtgaaaagtttgggtggggagtgggggcatggaaggaggagagacctataggaaggtggctcatctcactcacctcccctcttgggctgctgcttgttcttgaagattcagcaggcctaacctttccaggaggccttctctgaccactcccaccctcaataccagagcagtacccttctctgtgttgatctggattataaaacttagactctattcaacttgcctccttcctggtttgaaacctactaaggagtagtgtctcagaggtattagttctcaataattccttgcttgttgaatatatgaggaaggttaattgtaggagcagtaattaacatttccatgaggtttcatttgtgcttaagacaatttcaatgactgcataaagtcacactggaagatccacacatagaaatggcaaaatagtttgcctcacagctaattcaggctaaagtgactggcaggggataagagaaataatggaagaatatggaagtcagggaaattcagctaattttactcagatggtttcacgtatttattttctacttcacatttgccttggacacttagttgaggaaactggaggaaaaaaggccactgttgtaaaaaaaaggaagctgcagaaaatttaagaagggcttctacagaaaaggctcattgcaggtattcaggttcctggctgggctgctggtcacttggaaaggcgaacccaactctttatcctagccttccaggaaagtaactacacccatgttccaatcatttattatgcagtgatacctaaatcataggtatcttcggatacatcagggattctttccaagcaggaccctggctgtcttgctctataatcttggagctgttttatcatatttaataatacttaaacctttattgagctcttactatatgctaacactgggccaagtcctttaagtctactatatcatctaatcctcatgaaaaactcataagggaggcttttattatcccattttacagatgaagaaactgaagcacagtttctagggtcgtatagctgttaagtggcagaactgggatttgaactcaggcagtctgacaccaaagatcagatgtgtaactgttatatattcttccttttctttcaggttattgttttcaaagacataaagttaactcccaggggatacatccaaagagattctattccccaaatattagatggtaccttctaaccctccaccttctttgacacacttcctttgcttcccatttggtccagcagtaaaataagcacgaaatcactatgcccagcataaaatcccagaatttatcctaataagccagctgacagcccttcagtgaagtacagttgaattcctcaggtaaagttatccagtaaggaagaagttccttcagccagttctcacctcatccatggatccctgtcctttgcatgcaagccaggtaaaaaccaaaccaaagaacacacccagcgccatgatgatgtagggtatgttggtgatgatcaaagtagtgttaatcatagacttcagtcgactcgccgtctctttatcaatgtgaacactctggagaggcaagaaaatagtattcttgatgactaaacatccagtgtgtaactgttttttgctatatctttcctttgtttaatacaatttgggaatgtcctcctgttagcaaaccaaacatactgaaaatccatttataagtcagagtaatcagaagggacatttattcattaatatcttgtcttctcctgaagacattttttttactcttaaaatagattggaaaaaggaggtaaaatgtattcagaaatattgagacagtatcaccttttgttttatgtcagataattccaattcatccttaaaaatccagctcagcatcacttccttccaaaagttttctctggctacctcaggcctagtcaaaggcctcctccctaagtttccatctcactctctacttccatcattgtccttgcactctgcattgtaactgtttgtcttgcaatggctgtgaagtccctgaaggcaagacttaacctcagtcacctccacactgggtatagcacccagcacacagtaggtgcttgattaatgctggctgattaaatgaataaataaatgaaacactgcaaaaatggtatgtggaaagtataatttctttcttggttacatctatagtaatcaggaccacagccctctacagaaagtgctcagcaaagttgtgggctaactagaattccagagactgctgatagaaggaaatgtactagaataacacttagtgtatgcagagcagaggaattaccacctagtgtaatgagtgaggtatctgaagagcttaattccatagaaataatgagcaacaattctggcctagtttaggcttaatttgcactggaggcctggcatagttgcacacgcctataatcccagcactttgggaggccaaggcaggcggattgcttgagctcaaaagtttgagaccagcctgagcaatgtggtgaaaccacctctctacaaaaaatacaaaaattagctggggctgggcatggtggctcatgactgtaatcccagcactttgggaggccgagatgggcagatcacttgaggtcatgagtttcaacatggtgaaacctcatctctgctaaaaatacaaaaattagccaggggtggtggcgggcgcctgtagtcccagctacttgggaggccgaggcacgagaattgcttgaacccaggaggcagaggttgccgtgagctgagattgggccactgcactccagcctgggcaacagagcaagactccatctcaggaaaaaaaaaaaaaattagccgggcatggtggcacacacctgtagttccagctacttggaaggcagaggtgggaggatcacttgagcccgggaagtcgaggctgcagtgagccaaaatcgcaccactgtagagggtgagagtgagaccttgtctcaaaaaaaaaaaaaaaagaaaagaaagcattttttttcattggaccgagtcagtggattgggttctaagacattttttccaataactggatagagtttcctcctcggtaaaaaggtggtgtggcaacagtctccaatgtcacttccagacttccaggtctaatattttatttttctagagaagagaataatcacgctcttcctaggaggcagcaaaaatacaaggttccactccacacacctggacttaatctagtctttcacaaaaaagcaaattagaagttgggggtggagggacttcaaatatgccactactgaacagaagttggcagaaaagggcccttctgcattttcaaaaagatctttcatgcccctgcccacaaacaggaacatggatgatcaggagcaattgcaaagagatcctataaattggtaaatattgcttgaatttttcctatgaaacgataaaaacctcatcttagaattgtaataacaaacccttaaaagtttgtaaatgtgaataccaatataatgctaaatggagaaaaaagatataaaattgtatctatcgtatgatttcaactatgtaatatcaagaccagaaaatatcaggagttgacatctgaactgcacctgcctctgatagagagggacttatcagtaatttactttttaaatcaatttttaaaaaaatttctaagaattttataaagagcacatgttttataaaatgtaaaacattagattaccttttaaagttgttattggaaaaaattgtacaacacattgagtaaaataaaataaaaatattatcaggctgacacagattttgtgaatagtgattttaatttttctttttcttgctaatctctgttattcaatattctacaaacagcaagtatttttaggaaacacaaaaataataaaaaggagaagtttgccaatcaagaatttattgaagaaaaaaacctgcgttttttttttttccctcaaactgggcggaagcaggagaaactgaggagatataactacagtaaacgtgatatgtgattcagaaaagaatttatcataggtgtcttaaaccagcatggtttcaaagaagggggagacaaagggctagctggcatctatctgagtgtgagctatttccctgcttcaacaatgtctgccaatggctccttttacctgtttctgtttcctacgtgagcagctccccagaagggagttttgcccaaatagtgttcttgagaaggaaaatttctttccatcatttctccaaatcagctctcagacacaggcagattcatgtgaacatttaagtgaaattttctgaggaataacaggttttaaaaatcttttgcccttctgtcataacttacatgtaactacaacagtagacatcataatggattttttctgagtctgaaaacacccgtggctccctccgtctcaggacttacctcattgaggtacatcactgggaaaaccatggttctaatgtctcccgtttcactacaaagacaaaggatgagattgtttcagaaacatcctcatcacaatggcacactttcccggacagacacatttatatgaagattctagtacacttatttcttaaattacccagaatttgctgatttcttagttatctttgcaaacatgtaccccaaaagttagattccagtctgtctagcaattccatgtgctgtacgtttatcaaaacacaagatactgaaggcagattccttaaaatgatgactagtctccttagagtcatcagggaaggctccagtcgacagaacaaaactgtcactcctcagagtgttttgtaactaggccactgaagtactgtctttgcaacaagagccaactgagcatgtaccacgtgccagctctgtgctgggtgtttttgggatattatctcattcaattcctagagtagtcacctacagtaggtattactgtcccaggtttacagatgagaaaattatgactcagagaggcctaggatcaccacaagtaagtgatggagccacaaatgtaattccactttgcttctaagattccagctcttaactactaaattatactgcctcggaaatagatatgcagatgacaaaatgcattcttgtaaaccacctacttcttagaaagagccatgacacctggtattaaatctggcaaattcaatgaggtaaacaagccaagttttatagataaatatattatgcatagttttgcatcctgtttatttcactcaacattatatcataattttctcatatctaaaaaattcccattgaaaagtctgagcaggagattatactttggaatccaaattaagctgcagcatggggaagtaaggctagactcaagagattataactatacaaatgagagctatggctggccccaagtgggatcagtgggaatagagagagaggaagaggaagagactctgtctcaagtctctgagtgatatagtttggatacttgttcccccaaatctcagggtgaaatgtaatccccagtgttggaggtggggcttggtaggcagtgactggatcatgggggtggatttctcatgaatggtttagcaccattcgcttggtgctgtccttgtgatagtgagttatcatgagatctgttatttaaaagtgtgtggcacctcccctcctctctctcttgctcctgctcaccccatgtgacgtgctttattcctgcttctccttctgccatgagcaaaagctccctgaggcatccctagaaactgagcagatgccagcaccatgcttcctgtacagcctacagaactgtaagccaattaaatctctttataaattaaccaatctcaggtatttcctttcctttccctccctccctccccccccccgctttttttttttttcctgagacacagtcttgctctgtcgccagactggagtgcagtgccaccatcttggctcactgtgacctccgactccctggttcaagcgattctcttgcctcagcctcccgaatagctgggattataggcacccaccaccatgcccagctaatttttgtatttttagtagagacgaggtttcaccatgttggccaggatggtcttgatctcctgaccttgtgatccacccaccttggcctcccaaagtgctggattacaggcatgagccactgtacccagccaggtatttctttatagcaacacaagaacagtctaatacaccaagagagtcaaggtgcatgagggaaaggcttagtggagtggataaaagttgactagatagtaaggcttagccaagttacctaaacactctgcttctgtttcctcatctgtaaaatggggataatacaaggttatatgtgaatccacataaggtgctgagaacaatacctgatccatgggaagtactctgtaagtgtatgattaaataaaacaagtaaattccaagaccaaggcacccatgaaaatgctgatcatgccccatccctgaagggcaggggtgagcaggcttagatgaagtaggctgtactcctcctgacatcaaccccaccagacgggcaatggagcaaaactgctgtcccctccatagaaagaagcaaaacttacacaaagtcatctaattttttgacataaatgttgatttggaacctcttggctgcttttaggattattccagtcaactgcaaatcagagaagtgaaaaggaaacattaggatttattaaactgcaaacaactttttcaatagagcaccatttctgtgtagtcctcataaacaaggtgaccattaccatgtgtgacaggcagagtggaaacaagtaaaagtgatccccagaacagaatgagaaccatgggttgtattaggtggctgatagaccagtgtgtctcaaacatgagtatgaatgtaggtccttgggaatcctgttaaaatgcaggctctgattcagtagactggccatttctaacaagctcccaggatgctgccactctgaatagcacagccttagaagggatccaacaggaaggaggcctaaaagatagcctgtcaggtctggatttccaggcagttgtccagagagctaagaagagggtggtggtcactgccagagagtggcatcctagtatagggcccgcctagcgtagccatggggcacagctgcagcacttgtcatccttagggcagctccatctttgcactaaggttataagactgtgttcgtcccttggtgacaagcactgctaacagtttggctgatccaagggaactgatcagctgatggctaagagaaaagggagaaaaccacacacgattttattcaccagagcataagatcactggtttctcagatacaaatgcaatgtatgcagctaagagtgtgaagtacccataaaatactgtgctaaaagaatgttcttgttttttttttttattggtccataatgttcaaattccaaaaatgaagacatggttagcatggtttttgtttttctcgtctatgaatacaggagtaaatgtgtattatacacacacacacacacacacacacgtgtgtatgtctcctctatgtatatctgatacctttacaattaataatataataaactctcaaataacctgtagaaagaagtttgccaaaagtgactgaggttaatatacatattcatatttcaaccaaaatattcctggcagtgaggaagcaaagggacatctttaaccttatcgatctgtgtcccaaggggagaaataaatatatgttgaggtccaaggctagcatcagaagattgaccaggttatatgggtacatcagtagtttccaataactgagttttcactgttgctttttgttaaaggcaggtttgctcgtatttctgctattcaatccacaaaattcagccttctaattacagggctatgagacaatgcctccatcagcactgagctgaatttctcccacttgaatatgtatatgaaagtaaggatatttttaaagaaggctcaggactaaactggtgaacaatgtatagacagaataaaacatatgctcttttaccaggaggaagtatgtactcacaggattaatgtccacaaatgtctcatggtcttcctgatttgggtgcatgccttctatggcagaaacaaacctctcatctgcttggtaaaagtgtgggaaagacataatgatgggtgcacctgcatttgaaggaaaacagaaatgaatgatgctgtttttaaaatctaagctgagctgaatataaaagttcctggccacagcctggttcctaaagaaaaacaaaaaagctacatataaattaacttgggtaggctaaaacaccatcctttacctcctagttcaggatttatacttcattttctgacatctcatttacccccaattttttattccacattatatattgaagttcaggctaaattatttattcttcaacaaatatttactgaagttaaagtataagtgcttcatacacattattttatttaatgctcccaacagcccagtaaagtcagaactattagcctcactttgcatttgaagaaagtgaggttcatagaagttacaaaatttacccagggacagctagccatcaggctatgaaggcagaatactaagtgaatgaagggtgttgtacctcaaagcactagtttcaactacaattctctatcagtaagtggactgactttttatttcttgtcctttttaaaattaaaaaaaaatttttggtggttttttgttttgttttgttttgtttttaccaaagacaggcataatctcagctcactgcagcctccgcctcccaggttcaagcaattctcctgcctcagcctcccaagtagctgggactacaggcatgcaccaccacacccggataatttttttgtatttttagtagagacagcgtttcaccatgttggcaaggctggtcttgaactccttacctcaagtgatctgcccgcctcagcctcccaaagtgctgagattacaggcttgagccaccacacctggcctacataattttttaagagttagcctggttgtgctatacacccagcctctaaccagatcacaaagattctggggtttttcctttcctattcattttaagaaccaaataagtgcttatgtaaatttaaatatatatatatatatatatatatataaccaaatagggaaacaagttactaaaggaaacctattctagatctggctattgaaaagaagagagggacccaacaattgctgccagggaaatacatttttggagaaaggagcttgtcggcaagttatttaaatttgcttacatattcaccagcccatggcttaaggaactcatccctcatctctcacatgcacatgcattttgctgtttactgctgaatagttccacaaaggcatgacttccttctttgtgacctataatgaccttgaaaatgtattttttaaatctgttgagggcttaataggggctactgtcctgagtgttttatatatattatttctaactctcacacaacctcaagaagctataaccacctccattttattaatgagaaaactgatgtctggaaccctccttaataaactttggccaatttaccaacaaatagaataggactcaaacccaatctgcctgactccagaacactcatcctgctatccaaaatgtttccctggagaattcaaaacactggaggataatcctggggagtttcacttcagtccaaattcgggaatacgttaagagggaagaggaaaaggattgtagcaagaagtttaaatgtgtaaagtagaatacttctgttgattctggcatcagcttcttaaggaaacagaatttaataaaaacagcaagagaaaatatatctacatttttgctttgagccagatgcacaccagatgagggggcagggacactgtttcaggactattaccagtaaggcaatgggggagatcacaaccaggaacttgttcccattcacccttggtctttatctccaggtaaagggtaccatgttcccttgcacaatggtccccaaatacctagacgccatctttatggaaatcagctggagtacttgttaaaagtgtagattctggggccctggtatatccaacatgggaccctgggacatacatgcatgtgtgtgcaccatgagtgtgtgtgcacacttgcgcacgtgtgtgtgtatacctatatatatatactatatacatatatattaaaatatagcaaatataagtatatgcaaatatatgcatatttatatataactataaaatttgttaatatactcatatattaacaaatatattaacatatacatacataaatatatacatgtggctgttaaaactagtcttcaagatgaaaaatacttttgtcagttgtatatatatatgtatatatacacatatatatgatatacgtatatataaacaattttttatatatatataatttttttgttttttgagaccaggtctcactctgttgcccaggctggagtgcagtgttgcaatcatagctcactgcagccttgaattcctacgctccagcctcagcctcctgggtatctggaactataggtgtatgctactatgcccagctaatttttaaattttttgttcagatggggtctccctgttgcccatgcaggtctaaattcttggcctcaagtgagcctcctgcttcagcctcctaaagtgttaggattacaggcatgatccaccatgcctcaccaatatatttttaataactctccagataattctgatgtaaagccaggtgtgggggtcactgccctgtcagacaaggatcaggaggtatactgctgacttcagacttattccaaaatgatatcttattctttttttttttttcttttttaaaagatggagtctcgctatgttgcccaggctagaatcaaactgggctcaaacgacccttccaccatagcctcctgagtagctgggtctacaggcacacgccaccatgccaggcctgaaaggagattttaaaatgagatagataagggagcaaaagtgagcacattactattcaggagaaagggactacacagagagctctccagagaaattttaaagaggaattacagcccaagagggaatcacagggcaaatatgagaagaccctgagttccgccagggatctgctcagagggaggagtcgcatcaaaatcacgttccctctctgagccctagtttccccaattataaaaacaggccgctgaatgtctactatctagtaagttcattgtgaataattctgcaacatgtggctgttaaaactactcttcaagatgaagaaaatagttttgtcagttgtgccactgataattctgcctcattcatggaaaggagcagagtagctctgacattaagaaacactgggacatttgtgtcagggtttaaaactaactctgcttcaaaatcactgagaatctttgccatgatacgtactttcttaaaactgagttgtccactttttcttttagcttttttttttttttggtggggaggtgcggaatcactctattgcccaggctggagtgcagcagcacaatcatagcacagtgcaacctcgaactcctgggttcaagcaatctctctgcctcagcctcctgagcagctgtaactacaggtgtgtgccgccacacccagctaattttttaatttttttttttttgtagagacagggtcttgctatgttgcccaggctgatcttgaacccctggcctcaagcaatcctcacatctcggcctctcaaagtgctgggaatacaagcatgagccaccgtgcccagccttagcattgttttgaacatgaaatcagttaatgttttgcatgcattaactacatgtaaatatgtaaagcacttaggacagtgactggcatacatcaggtgcttagtaaacatgagctattattactgttaagacttctaaaccactgtccagaaaaaaaaacacaacatggcattctagaaataaaaagcatcacagaaaagccatgatttttttttaccattcaatagccatgttatgaaacattgttcttgaaagaaactgatctttctattgggctgacaatatattcttttttgtttgttttgttttttagagacagtggtctcgccatgttgcccaggatggacttgagaactcctgggctcaagtgatcatcccacctcagcatccttagtagctgggactgtaggtgtgcgccactacgcccagctacatattctttgttgaactccaatccttctgcattcttgacacccctatcatgtcccctctctgagttcttaccattcttgcagatgctgacattcagaactcctgagcccaggcagtttccctcaggtatacagaagccggcattgtctgacgtattggctaatatttctgcaggaactttataccgaaaggcaggcagtccctgtacactctcatagtcactgaaagtaatatacactgacctgttaggatgtaagaataaaaagtgaatgtggactctggtcagtgtaatctgcccgaaatccgcaagttagcaacagttctcaggtacaacatggccaaaagctcacagggtaagtagaaaggaatgtttggaaggcattctgtcaactcaacgtgtaataaagcagaagatgaattgtagtggaaggtgtttattgtagcaacggtgatatcatccaaacaagaaaaaacaatatgtggtacaaaattaagatgataacatttagaatggagactcacataaaaaagaaataagaggcctctctagacctgcatggacatatgccagtgtggacgggccaccggcaaagccagggaagccagggcacggcagagccaaagctaaggtagaacaggcagcgatggccgtggcctcgtagggtcttaggcacttgaaaagtgtcacattggacagatactttattggaatacacactttgatactcaatccccccctccaagaaaaatcagattccatattttgccccagtcatttatttaaatggagttcaacgtaattctgcctttcattcttactgatttcaaacatagtcccatgtaatatgaccactgcttacactgcatagtgcctaaccactttgatgtacacagtcaccactgagccttcagcccttcctttgaaggctggccggaagagccttctgggcctcactttttcatctctgaaccagagctgttgatacatctctcgcaaggttgtgaataacataggtggtttcactgcacaaaccaaaccacccctacagcattttttaatgaaaaattttaggcaccagaaagagataaaatactctaacaaatacctttgtatctgccacttagacaaataaaaattatattatggatataactgaacctgtctacgtaatgctcttgattccattccttctctgcctcccctgaggaaaccactctgctgaaatatggacaacagtatcttttatttggcttccatgtagagactacctattgactggaagtagaccaggtcagttgatgcttgacagagcatatcatagtaactaagagccaacacttaatattggttactgtgtgatgggccctgggctaagtatttgactaatactaactcatttgtcctcataacaacctctaacatagttaacaatttctatctttgttttacaaataaggaaagtgaggtacagagtggttaagtaatttgcccaaggtcacacagctataagtggtagagccaagattcaaaccaacagtcagaagtctgtgctgtgaaccagtacactatactgtctcgatgtgccatcagcatttatcactgattatgcataaatatccatgcataataagtgtgtctgcatatattcctcatgcttttggtggtcttgcagtgaaagaccttatttttgaaaaagaacttatctttaaagcttttacctgcaaaagtcagatgggaagacataaaggacctcatctttggttattagtgggtgaaaagaatctccatctgttccattaatcatattgcacttgtctgttatccaccagtcaagtgacctataattgataagcacaagaaagagtaaagatgatcacatttgagtttagattctcttaaatggtcaggactttgcaagatttaactggagctgtctatccacagtatcttattcatacacagacacaacagttttaattagatcaagggggagaaaaagtaggtccctggcccaaatcagctttcatagaggcaatggccaaatagcccaaaacatgtggtggtttgaaaagtatttgtgctgtagctactacacatcactcaatgactactaagcaagagtgggacttttcactggcctgtaattcatgcctggccatgataaatctacaaatcactaatatttaatctgtaagatgttttaccaccatcttgatttgtagaataataattacaagactatttacatgtttttatatttttcatccaaaaaaggctaaacacatttttaagcaatgtagaagtagacatgtagtttaaatgaaaactgaaaaaataattccactgataaatcatttgacttacgttttcccattccattccacaatttttgtaaagttaaggtaactgtcttctccagttagaaaaacatagtctccatcattagtcccatttttctgaaaatatgtgaatatgatcatttaaagtaactgtgataattttatgacaacttggctagactatggtgcccagttgtttggtcaaacactagcccagatggtgtggtgaaggtattttgtaggtgtgattaatatctacaatccgttaactttaagggaggttaccctcaataatgagtggctgggccccctccaatctgttcaaagccttacaagcaaaaacagaggtttcttagaggaggaattctcctcaagactgcaacatcgaaattctgcctggatttccaggttgcagcccaccctacagatttcaaactcaagaccacatcatcaacttttacctgagtttccagctgctggcctgctctatggatttcagacttaccagctcccataatcacataagccaattccataatataaatttctttctctccctctttctcatctctacatatacaccctcttgattcagtttctctggcaaccctaactgatacagtaactaaaaaatttaatcttcatctaactgtcctactagggcctaactgctacacaagactgaaccaggaccagaaaatagtgactattttgctaaatactatattaaccatattattattttatggttttaaaaagtaggagctcaattttaaaatgggcaaaggatttgaagagacatttctgaaaagaaaatatactaatggccagagagcacataaaaacatgttcagcatcattagtcattagggaaatgcaaatcaaaaccacaatgagataccacttcacacccactaggagggcaattaaaaaaaaaaaaaagaaaaatagtaagcgttggtgaggatgtggagaaattggaacctttatacattgctagcaggaatataaaaatgttgcagtcactgcagaaaacagtttgtcagttcttaacaaagttaaacagaattcataggactccaaaattccacacctatgtatatactcaagagaattccacttcaaggtatatacccaatgttcatataaaagcttgtatgaacaaatattcatagcagcacttctaataatagccaagaaggaacacaacccaaatgtccatcaactgataaatggataagcaaaatgtggtatatctacacaacggaatattcctcagttataaaaaggaatggaacactgatacatgctacaacatggatgaaccctgacaacattacactaaatttaaaaagcagacacagaagggcatatattatatgactccatttatatgagatgtccagaatatgcaaattcacagagccagaaagtagattagtggttgccagggcctgggagagtaagacaggaataggagtgactgctaagagagtatgcagtttcttttttgggataatgaaaatgttctggaattagcagtaatggttgcacaaccttgtgactatactaaggactactgaattgtacattttaaaatggtaaatgttatagtaagtgaattatttctcaataataacaaatttaaaagcctaagtccaggaccaggaccaattataccagaatagctacactggaagaagacggtattaatatagccctattttcaattaaggtttcttcaattgtatattctctccaagttatacttcttaagggcacatacagacactacattcctaaaattctttatttgggcatgtagctatgatttctcagaaatagcacaggtagtagctcctctataataataggagtgaacaattgttgagtataatattcctggctctgttctaaaatttttgcatgaatcatctcatgaaatcctcacaaccacataagatagtgtggctatcagtctggtgaattcaatgatgtaaaaacaaaaaaagtgagttatataatgcaaattatctgagaaacagtgagatattagcaacaagatctacttggctgatggattgaagccactgggaacaaaagggcctcgagggaacctttgcataatatctctcagtaggaggctctcctgaaattatttctagaagggaggttcagtcagggcttgacaggaaatctgtgcttcctctggtcctgtgaagctgtattcctctgagacaggaccctctagggaactcctgcctggtctgcttctcccgaatgatgcattcagagttggtgaggccctacttttaggactcctgtctctcacacatataattttttaaaacttgctcacaattctattttaacaatttctacgttttatataaccttgaaggcccagggacacaattattgctgtttgccataaaaactggaatgctacaggattacatgaagagggtaagactcttgaacaggcagagccagaaaacagctacaaatttaaagctgaggagacccatcacaatcccagagcacacccctaatctaatcctcttcctggggttattttatcttttaccaacttcccaactatccactgcactccagggtttttgtttttgtttttgtttttgttttttttttggcttttttagacagagtcttgctctgtcaccctggctggagtacagtggtgtaatttcagctcactgcaacctctgcctcctgggttcatgcaacttacctgcctcagtctcctgagtaggtgagattacaggtgtacatcaccacagctggctaatttttgtatttttagtagagatagagttttgccatgttggccaggctggtctcaaagtcttaacctcaaatgatccacccacctcggtctcccaaagtcctggaattacaggcattagccaccgcacccggcctcaagttttttttctttccaaaaaacactccatttttcacacactctataagataacttaactctaggcaatttctagaagaaactcaaagttaatctggcttggggtgccccaacccactgtcagctaaaaaaagaggttctgaaaagaaaaatctacttacctcatagaataggccaaaatagggagagatatcgggcctgaaaacatggataagggacaagatttcatctttgtagccccagagcaattcgtcaactgtgtgagtcacaaagagcttctgctgataggctttcaacatggcctcgatgatctccctgaggaagtgcacctgggaccactctatgacagtctgcggagcagaggtatattaagacagcagcatcccctccaaagcacctccatccactctctcctactaccccatagcaaagggggttggaaatataaatgtaaaggttgagattaaatagctgaaaaatcaggcagtgagctcctttctggctgcatatggaagacaaagcctcttctctgtcctttcccagtactgcattttgtaagtgtaatatttacaaagagaccatttgcaggctctgagttatccagacaccacaaaaggggaaaagctcttgtaaacatgtgggcatctttggccacaaggtggcgctaccttccgcctaagcagggccagaggctcattataaacccgacctacacccctgggactaggtggcagggacctcatactgtctaggtcctgggtccatcatcagtgtccagctgcatatggagcggtcacctaggggttagggtgggagagtcggcaggggttggtgtaggtgaattagaatgtttactgggccagcccaggaacagtggttcacgcctggagtccctggccgacacaggaggatccctggagcccaggaggtagaagcttcagtgagctgtgatggagccactgactgcactccagcctgggcgacagagcaagaccctgtctcaaaaaaaattaataataaataaattaatttaatttaaaaaaaaagaaagtctcatgggtctcagtatagaatagatgtagaataggtgtcgttattaggtagaattaccattataaacagagcccactgaaatcacagtaggctgccagtctattgatttctggtgtcaatttatgaattttgagagtataaaatccaacataaaaatctgaagtaagaaatggtatacaaatttcattgctagaatttctgaatgaaaacaaggggcaaataaacatttttaaaattattagctaccaaaaaatcctaggggcatatttatttgcacaattgctaatcctgaacacccaggaagaaattatgaaaacaaatcctaaaatctgaattttgtcatcatttgaaaagaccttatttgatacatcttagaaaaaagtccaagatgtactttaaagaaaagaaaagaagtatttttctttttatatatgtatatttcaacataacttaatggctcctaaatgtaaaatcataaagagcattaacttagctttttcctttcttccaaaatccaacttaatggtattaaaatgcctacttaccaatacaggaatatttaatgttctaattaagtcaattttagggtctccaacagattggtctcgttcaaaaacataggccttgttgctaacagcagatattgttgttccattatctccaaattgaatatttgctttgtttctgagttccctaaaagaaagaaaagggttttatttgaaaatagacaccactttaataagcaagacttttcctttctttcagcatccaagttatattttcaatataacattcccaatataacattatatagagactgcagctactaagccttaaaaagctggagatcgaagctataatgtgggaaggaaacgaggcctaggatagagtcttctcaaaaactttgttttccttcttttcttccctgattagggaggtgcaatagttgagggtcaccttgaccgggaatcaaagccgatgaactctctcctgggttatggtttggtcctgaagtattttcaaaattttcagtttggttcacagatttagtttgaatttcaatttgtttaccaatgtcttcttgtttctacattgaattaaattgaaattttattttaaaaaataatgcccaaggcttagtaaattacaggagttcactcctgtttctttttttgagatagggtctcgctctgttgcccaggctggagtgcagtggcatgactacagctcactgcagcctcagcctcctgggctcaaacaatcctcccacctcagcctcccaagtagctagaagtacagaagcatgccaccacacccagctaattgttttatttttttgtagagatgaggtcttactatgctacccaggctggtcttgaactcctggactcaagtgatcctcctgcctcgaccttccaaaatgctggcattacaggcatgagctaccacacccggtctctgtttctgatatacagcacagtttggttcaagttagagcccccaaatgaagcattagaaagttcttagaaagcgcctggtgccagggctgggcctagagtcagtgtgagtgatgtaagaggtgcctaaacaagtagtaatcaagataaatagtttaatgcactatttattaaaaccaaaatttatgccaaaaatttatgatgaacaaaattttaaataaaaacagaatctgatcttttgttcatcaaatgcctcacactagccctagccctagccctgcctggtacatagtaggtgttcaataaattccagtgacttttgtttctttccctttgcttatctttccttcttcctaaaccagctagggttattatgtctgacatggtagccactagtcacatgtgactactgagtacttaaactgtggctaactggaattgagatttgctgtaagtgtaaaatatatacagaatttcaaaaacagtgccaacctttttttatattgattatatattgaaatgatgctatttcagttataatgggtaaaattaaaatatattatcaaaattaattttacctgcttccttctactttttaaaaaatgtggctactagaaaatcttaaaatcttaaattacacatgtggttcatgtaatatttctattgaacagagctaatttaagagcacaggttaggaaggcattggccagctgggctacccacacctcctctgaggcctttcccaaccatagcagcacagggatttttctcacccacctgtggatgtccgtacatgtctttagcattcaattagaaacttctgagtgacatcatttagattgtgaaattatcatgtagcctcaggtagactgcaagcaagctgaaggctgaaactggtacgtaaaaatgcgcctcggtgatgatggagttatgtcccagtaaacccatcataagttgaaaacatcgtaagttgaaagtttgtttttgattcaacaacttagtatctttccaatttacaatgggtttatctggatgtaactctatcgtcattggaggggcatgccaaatacatcactttcacacaatcgcgaagtcaaaacatcattcaagttgaaccatcataagtcaaggactgtctgtatattgtatctctttatacctcttaaatcccttctagactttaaaataaaaacagatgagaaaataaatgcattcatatagatgcatacaaatagatgagtctttgtatcttctccagtagaaaaaacaaaccatttttttctgtgctctcatactgtaacaacttacacagaagacttctaagacttctgagacttctggtcaccaagaagtgtgtggcgttttctctgcaccaataattctgcagtgtcctccaattcaattcaattctgatactttctacttggacatagcatcagattctacaggttgagactgccttccacctcctatgccaatcaaaagccccaggctgttttacctgtgcttctgaactaatggctataaattggggttcccatccccctgtgcttgggctcaattaatttgctagaacagcccagagtactcagggaaacacttacattttattataaaggatattacaaagtatacagatgaagagatgcactgggcaaggtgtaggggaaggagctcagaacttccatgccctctgcaggctcgctactctccaggaacctccccatgtttggttctctggaaactctccaaattcagtccttttggttttttatggaagctacattacataggcatgattgattaaatcactggccatttgtgatcaacccaactttcagcccctctcccctcctgggaggttggggggtggggctgaaagtcccaaccctctaatcctgtcctcttctttcaggaccagctcccatccaggagccatagaggctgccagtcatcagtcaattcactagcatacaaaaagacacttatcacttaagcgattccaaggatcttaggagctgtatgccaggaaatggaggaagactaaatatatatttcatcatatcacatgtctatatcctatactctgtcaagtgtatagaaggaagcatacttcctatcacatatacacatatcacacatcatatcacactaagcaccaagctatgcccactaatcctataaatagctgacccttgcatagctcttcaaagagtttaacccacattattttattttatttaatccttacaagtatgtagtacaaatacagcatgtagtattgccccacttcacagctggggacacagagcacaggcagaagagtgagaacttgatcccaagtctttctcattagcacaaggtgctcctctctctgtatgagacaacctctcctaacaggtacctaagaaacgcctgtaggatgaaaccagctaatgcctctaacaaatgcctctaaccaaagccaaatctaatgataaattacatgcccttccagtttacaaagaatatatttaaaaatttgatagacacttccgtgttaaaccacttacacagcttgaagttcagtgtttgcagtggacttttcatttgttagacaaccattccgctttctgctggtaatagccctgatttgctttcctctcttgtattgtacagctgtgtaagaccatcagtcaaggttgctatgggacctgagctcaaccaattcctttcctctggcctctgaatcctgagcacagtgcctcaagatagaaaacacagtaaaagaaccaggcgtggtgacatgtacctgtagtgtcagctacttgggaggctaaggtgggaggatggcttgagcccaggagtttgacgttacagtgagctatgatcatgccactgcattccagcatgagcaacagagcaagactttgtctctaccaaaaaaaaaaaaaattttaatttaaaaacaagaaaactcagtaaaagacaggattcctcccagtggcagacacatgatgtgatgatcaatacactctcgtgacctggatctttaaagctgccctgcatcctgcttttgtcttccaagctgctttccttgattctgttaacctactttatagccttcaaatagattcccgttttacttaaattagccagaggtagtttattttgcttataaccaaagacccttcacttagaaatcattaactccacctttttatagataaggatatgtggattcaggaccaatcgaaagtgtcagggccaggtttagaatcctggtgacctcacctctcattcagggtattccttgattttacacagaggttaattcacagtaatttattggaatatggaggaggagaggaaatttcaaagccaaacttttgtgtaagccaaggctggtgcctgcagagaggggcatattgatcagttactgtcctacaagatcaaagaagaccaaatgaactttcagaaatacaaagaagagtttgaaaaaacaaaacaaaaacaacaacaaaaaacaaatcaaattttcagcctaggcaattaatcaaggaactatacttaaaagtgcccggcatggtccctggtatttagtagatgctaatgaatctcagactatagtataacatttgtgcattactatgacggtccttgtcattaagacaaggttcagttatgctccatgaactatttaatcaggcaggaaaattcatggttggttttagaaataattttagaaacaatagactgagataaggagtggaaatcaaaaggaataattttaattaggtggaaaattaacatcggtatatctaattcctcagaggtgtttgataaattggatgcgtataatactatcatagtatcgttatctttcagtcatattggttccttcattcacctaatcctctgttgagaattactattaagaagtgattgggcatacactggatacaaactagactgagatctggctggtagggttaacattcaaccctggtttcatcttactcactgcttctgtgcctcagtttcctcatctgtaaaatggaggtaataacgtactcaccttgtagggttgttgtgagaatgaaatccacataaatccagttacaacactacctggcacacctgctgcttaggagggattagctactgataccatgtgcaacggcttgtgctaagctcttgagatggtgtgacattaagtcctggttctggtcctccaagaatccacagtagagcatgggagactgccttcagaggccacctccttcacagtaaacgcactgtgggcatacagaggagggagggatggcaactggaaggggactcctgcaaaagacacttttgcttgattctggaaagagtgggcttctgcaggtgggagggtgaagggggtgttccaacagaggcagcggtggggcgaaggtgggcagcaagcatgaaagcattcccatgtggggagtgagaaagctgtggtcctggaggaggaggacacgctttaaaagaccatcacagatccaggcgaggctggggtgatgaacacatcaacgtgaaaggagtactgaagtcctagggtgaccacagagaagagggaaagcaaggggagccagccaaaggcacaggctgaggagcctctacccttaactttgagtacgctgcccgctcaggtaactgaaggcagcaacctgtagatacaaagcaggatactgagaagaagtggtaagagcagggtcgggagaagactcacccgcttgttgacagtgtgcaagaaacagtttcactccttaagatggaaatatctccctggtctccctgtccccaggcagtgacccataggctcacgtaggcaattcacctaatgtaccacgtgcatttaaaactcacacatacctggtcacaaccttttgtgcatgataagatggtgtgagagatctttttctatttttttttacttctgagcagtttaaggattttttttttcaaaatctgtttctattttggcaaaacaaatacagttttagctaccaatctaaaaacactatcagagaaaagcgaggcaagtttagaaaaaaggagaaagcattctcctataataatggaaacaatgatcacggtgttcctaaattttttgttgtctctttatgttaaaaaaatttcttatacagcttggctcagacacggttaaagaactaaagggttaataggacagaattagacagtataaacaaaattcctgcctttgctaaattgcaaggaagacacttagatcctgaagaaattaaatgtggaaaaacagaactataagaaaatcgacttgaacatcaaaccattgaagggagtaagacttttaaagctcagacctgatagaaatgttgaaaaagaatagacttgactacaacacattttaaaaattgacaaggtaaacaatggaaaagcagttgccccaaatgaaacataaaaggttcacagagtgccatgaacactccagaacccagataagcaaatggacaaaggacaagaactaaaagtgtggaaacacaactggctggcaaacatgaggagaacattcaacccacgaggtaaccagaggagaaaatgaaaacggatctacatgttcaggaaaggaacagttaagtgtagtaatacatttactctattaaatataatcatcattaaaattcatttgtatgaagaccaaaatataacattgaaaaatcctatgctataacattaggtgaataaaaaatatgtatattttgtatatgtacatgcatatgtacatagtatgataaccatctaaaactcatccatggaaaaatggccaagaagatatccactaaaatgttagttagcattggttatttttgagacagtgaagccatggattagtagtttttgttcaaaactttactgcattttcaagttgatctttagtgattatatatatggaacacatatatatgtgtaatttttataatataaaatatagtctacactcttaaagataatgctgtatatattatatatgttgattatatttgaaaatccagtattacttgttatcaatgaataataaaataacttaagatctagcccttacatctttttaaataatacaagcctaaaatagaaatgaataatccaaacagcaaaactaagaaaccccaaaataagatatttcacgggatactgtaaatttagtaaatacttcttagaaatacgcaaattaattggaagtgcccttagacaaattgttttcttttttaattcttgaaatgttaaatggtaggcaaaatagaaaaaggtatctgacaagataaaaaataaacctcaaaaaggctgcagaagccatgggataccacaactttgatacaaattttatacaaatatgtccctgagcaaaaggatcatgaggccaatgagccttgtattcacagacccattccagggctgctcaatctgcagctttacaaaaatgtaaataatacacttcattccttaaaccagactgactggctgttatcaacatttggaatgcccatcatctttttccaaaaacattactattctgaactccccagtatgtgaaaggtttgggaaatgtgccactgtaaatcctgtgtcagatgagttaggccctccacagtcttgcttggcccttccccatctcagaggtttcccaccaccacaccaatctgtactaactggcgaaaggggctacatgccctccccttcctttgccccaggccccctggcatacaattgatggagtcagctgactcagttgggagaaaacactggagcagaagcttctggaatgttctgtcttatccagcctaaacaatagcatcataaagccacaagtgacagaaatcaaatccagtgaatgaccgcaaaaggcacatgtagagactaacaggccccatagaaggtttggacagctccctaaaaagccatgtttttctacaaatcccagatctcacgacccactcagccctgtaaggagctcttagcagcctgcactgcacatatgcatattcctaacaaagccattcattttcagggcctgattcccctttcttgaacctatatttgggtttcctgaactaagtcctatggttccggctattaggtgggtgcaaagtaactgcgttttttgtcattacttttaaatactttttaataattgtgtcctatagtgttagtttttccatgtgtcctatgaatttaaaccacagttgaagatgtttaatttacatattccacaaatattcattaaatagtagacagtcagagaccaaaggacttggtcactgcaccccatggagcttccagtacattgggaagaaagacagatacctaagccaattattaaaatgcaattagtcactgtcataatggatgcacatatttattagtctgttctcatgctgctaataaggacatacctgagactgagtcatttataaaggaaagaggtttaattgactcacagctcagcatggctggggaggcctcaggaaacttacagtcatggcagaaggggacacaaacacgtcctttttcacgtggcagcagcaaggagaagtgcccagcaaaagggtttttgtttgtctgttgttgttgttgttgttgttgtttgagacaaagtcttgctcggtcgcccaggctggcattcggtggcgtgatctcagctcactgcaacctctgcctccggggttcaagtgattctcctgccttagccggtgtgtgccaccacacccagctaatttttttttctttttgtatttttagtagagacagggtttcattatgttggccacattggtcttaaactcctgacctcaagtgatctgcctaccttgacttcccaaagcactgggaatataggcatcagccaccacacccaaccaaaagggttttttaaaaagtcccttataaaaccatcagatctcgtgagaactaactcagtatcaagagaacagcatgagggtagctgcccccgtgattaaattacccccctgggtccctcccatgacatgtggggattatggaaactacaattcaagctgagatttggctggtggggacacaaccaaaccacatcaacataccactttacaagtgctataaagtggtatacttgacacttttttttttttttttgagatgggggtcttaccctgttacccaggctggagtgcagtggtgcaatctcagctcactgcaacctccacctcccaggttcaagcgatgctcccacctcagcctcccacgtagctggggccacaggcacatgccaccacgcctggctaattttttgtatttttgttaaagacggagttttgctatgttgcccagcctagtctcgaactcctaagctcaagtgatctgcccacctcaaccccccaaaatgctgggattataggtgtgagccaccgtgcccagtctacttgacattttaaataagatgtaacagggagagtatccgaagtcaggcaagtctcaggaggagacagcatttgcactaagtaagatgtgaaggtcaagagaggtagcgctgaggaattcattcttgactgaagcaacagcatgaatactggcaaggcagtgtgtctggggagcttataaatcatgggagtggccaagcatggtggctcacgcctgtagtcccagcactttgggaggccaaggcgggtggatcacttgagaccaggagttcgagaccagcctggtcaacatggtgaaaccttgtctctactaaaaatacaaaaaattagccaggcgtggtggccgtgcctgtaatcccagctacgggggaggctgaggcagaagaatcacttgaacctgggagacaaaggttgcagtgagccaagatcgcgccactgcactccagcctgggagacagaatgagactctgtctcaaaaacaaacaaacaaacaaacaaacaaacaaaaaatcatgggagtatggttggaattatgctgtctaatagggtagccactagacacatgtggctattgcacattcaaaatgtggctagtctgaaatgaaatgttctataagtgtaaaatgcacacaggatttcaaagacagtataaaaaaagattgtaaagtatctcattaataattctaaatattgctaacatgttggaatgacactattttggatagtttgcagagtctccatcacatcttaaggaatttcatttaaaaataacaacaacaacaaacaatgggacacttagatactgatcctggttcaacttctaattattgccagtgggagagcttaaaatacaaactttctctacccagtacacagtgtttcatcaggcatagaacacatacaaaatggctttttaaaatgaggacccaagtattttcttagatttcttcatatagcaacagggttcatctttataattctacatattgacttgtacagactaaaacaattaatctacgaagaccaataatatagttttggtgtcccctcaaaatctcatgttgaaatatgatccccaatgttgtaggtggggcctggtaggtgtttgggtcatgggaaggattcctcatggcttagtgctgtcctcgagatagtgagttctcacgagatctggctgttgtaaagtgtggcacctctcccctctcttgctcctgctctggccatgtgacatgcctgctccccctctcttacttccaccatgattataagtttcctgaggcctccccagaagccaagcagatgccagcatcatgcttcctgtagaacctgtggaactataggccaattaaacctcttttttaagtaaattacccagtctcaggtctctccctctttcttttctttcttctctctctttctctctctctcccctccctccctccctccctccctgtctttctttctttcttctttttttttgagacagggccttgctctgtcacccaggctggagtatagtggcatgttctcggctcactgcaacctctgcctcccaggttcaagcaattctcctgccttagcctcctgactagctgggaatacaggtgggcaccaccatgccaggctaatctttgtatgtttagtagaggtggggttttgctgtgttagccagactggtcccaaactcctgacctcaagtgatccacccaccttggcctcccaaagtgctaggattacaggtatgagccaccatgcccaggaaggttatttctttatagcaatgtaagaacaacctaatttagaaaattggtactgagagtcaaatattgctataaagatagctggaaaatgtggaagcagctttgaaactgggtaatgggcagagaagggaagagtttggagggctcagaagaagacaagaagatgagggaaagtttgcaatgtcttaaagactgattaaatgatcgtgaccaaattgctgacagtgacatggacagtgaagttcaggctgaaaaggtctcagatggaaatgaggaacttattgggactggagcaaagttcacatgtgttatgccttagcaaagatcttggctgcattgtgttcacaccccagggatctgtggaagtttgaacttgagagtgatgatttaggatatctggcagagatttctaggcagcaaagcattcaagatgtcgcctggctgcttctaacagcctacactcagatgtgggagtaaaaaaatgacttaaagttggaccttatttttaaaagggaagcagaacatagaggtttggaaaatttgcaacctggccatgtggcagagaaagaaaagcatttccgcagtctgggcaacatagggagactctgtctcaaaaaaaaaaaaagttaaaaattagccaggcatggtggcacttgcctgtagtcctagatacttgggaggctgaggcagggggaacccttgagcccaggaggtcaaggctgcagtgagccatgatcatgccaccgcactctagcctggcaacagagaccctgtctcaaaaacaaaacaaaacaaaatatttttgtggggagataaattcaagcaggctgtagagcaaccattgctaaaacgatttgcataactaaaaagaagccaagtgctgagagtcaagacaatgggtaaaaggccttgaaaacatttcagagatctctgagacagccccttccatcacaggccctgagacctaagaggactgagtggtttcagggaccaggccaggggcactacttccctgtgctgtttcccacatcccagccactccagctccagacatggctcaaaggggctcaggtacagttcaggccactcctctggagggtgcaagccataagctttggcagcttccatgtgatgttaagcctgcaggaacacagagtgcaagagtgaaggaagcttggcatcctccacctagatttcagatgatgtatgagaaagcctaagtgccccagcagaagcctgctccaagggcagagccctcaagagaaactctactagggcagtgaggaggggaaatgcggagctgaaggctccacaaagagtccccactgaggcactgcctagtggagctgtgggaagaaggccaccgtccttgagacaccagaatggtagagccaccatcagcttgcaatctcagcataaaaaagctactgaggcggagctgcctaaggccttgggagcccaccccttgcaccagtgtgctctggatgtgagacacggagtcaaagaagatgattttggagctttatgatttaataactgccctgttgggtttcagacttgcttggggcctgtagcccctttcttatggccaatttctcccttctcaaatgggaatgtttgcccaatgctgatacacccattgtatcttgaaaggaaataacttgtttgattttacaggcttataggtagaaggaattcatttctagatgagacctgggacttaggacttttgagttaatgctggaatgagttaagactttgggggactattgagaagggatgattatattttaacatgtgagaaggacatgaaatttggaggccaggggtggaatgatatagtttggatgtcccctccaaatctcatgttgaactgtaatcttcagtgttggaggtagggccaggtgggagctgtttgggtcataggggaggatccctcaaggtttggtgctgtcctcacaacagtgggtgacttctcacgagatcttgttgttgtaaaagtgtggcacctcctcaccccttgctcctgctttcaccatgtaacgtgcctgctcctgctttgccttctgccatgagtaaaagctccttgaggcttccccagaagccgagcagagccagtgtgccatgtgtgtacagcctgcagaaccatgagccaattaaacctcttttctttataaattacccagtctcaggtatttcttcatagcaatgcaaaaatagcctaatccaactaatagtaagagcaaacacttaagtatcactaattatgtgctaggcactagtctaagcactttatacatgactcattgactcaatctttgtaaaaaccatgtggaggaggtcctatttttatccccattttatagataaggaaatggaagcacagagaactagtaagttgcagaggcgggaatcaaaatgggtcatctgactccagagtcagagcatgagcacccaaggcaggaactaggatttttatctctgaattcccaccactgagaatagtactgattcatagcacatgaatcagtcagcaataatttattgagcaatcgattacaacagaattgtcaggcatttttatcattcagcagttttgaaaaagaaagatcttgttgtctgcttcctctattaatttgttttctaacctggtaaggagagactttattggaaagattattgtatgggagagggaggaggtattgtaatagggaaaaggggaacattgcaacagagaaaatgctctgattcaagcgtctccctctactaatcgtttaaaaatgattaaagggatcctgattccccagtgtttggaattggtggtcaccagcaaagactctaacagcctctgctacttgcttattgcttatacgcaggataggtggagaaaaggagcgggtaagaaacagaaagatctgtctcagacaaaagtaaattctggaactgctttaaaactagttatgtggggaatggaaatggagggaggccctaaaagtcacttaagaatatcaagcagtagccaggcatggtggtgctcacgcctgtaatcccaacactgtgggaggctgaggcgggagaatcacctgagcccaggagttcaagaccagcctgggcaatatagcaagacctcatctctacaaaaaaaattatctgggtgtggtggtgaacacttgcaatcccagctactagggaggttgaggcaggaggatcacttgagcccaggagttggaggtggcagtgagctatgactgctctactgcactccagcctgggcaacaaagccagaccttgtctcttaaaaaaataaaataaaataaaataagaatatcaaggggcaaccttaaaagggtcagggtaaggagtaacccttcatggtttaataatcacagtctgccaactcaggaggaaaccgctgcacttcaaaacacaacacgctgagacttggcccagtctacaaagccattctctgctgaggtttcacacacacatacaaaacatcagcagcgtttcagacaatgaaatcagaaagtgtgctcccacacagccctggagccttgctcctgggaagaggcaaggactcaggccatattggggtcactctgtatttctttcaagacaggaggtggtcaagacttacctgtaggtgtatggccccacttcttccacccgaggggtctcccctctgaggatctcctctggattggtgacattgaagaaatagaactgagtatacacaggcagagggggcttctcccaggagtcaaatgcctcagtaccattccttaacacaattttctaggaaaaaaccaaaaggagatttacaaaaatgtaaggcaatagttggctttaaacccaagaagcagaggaagggacgccccctattctgacctcctagatcactattttaatcatttcacaggcattcaactgcagtctcctgagaacagggccatatcttacaccaatagagcccacagttctaataagtcagagaaggccttcgataaatatttgtaaaggggccgggcccagtggcccaacactctgggaggccaaggcgggcagatcacttgaggtcaagagttcgtgcttggtcaacatggtgaaaccccgtctctactaaaaatacaaaaatcagccaggtgtggtggtgcgtgcctgtaatcctggctagtcgggaggctgaggcagtagacttgcttgaacctgggaggtggaggttgcagtgagccaagatcgtgccactgcactccagcctgggttacagagcaagactctgtctcaaaataaattaactagttaattaattaataattgtaaaggaagggtactaaagacagcacttgggcagaagcatgaagcatagtgtttccaaaacctagggcacagattgagtgcctaaagggcctgctggctttgttatttttgaagattccatggatggtgtatcttctgtagaagttaagcaattctgaaaagcaccatacactcccagtttgcccagatgagagaataacaaggggaagggcccaagaaggccagttttggtcctttttcaagtcaaaccacatccatccctaccgcctccaccaccaggggctttaaatgtattttcttattggatccccaaaaaccctaaaatggaactgcctatccccgtttcaaaaaccaggaggcctagcctcactgaggttagctgacaatggagactgcactctgcacacaatccctcctgcactttccacccctgttctgtgttacaggatgaataatgccccccatactctaaattcctaagctgaagtcctaacccccaatacctcacaatgtgcctgtatttggagtcggggtctttaaagagctgatgaaggttaaatgaggtcatgagggtaggccctgctaataggaccggtgtcctaactggaggaggaaactgggacacagacaagcacagagggaaggccacgtgaaaacacgcagaactgacagccctctacaagccaagaagacaggcctcagaagaaaccaactctgccaataccttgatctcagacttctagcatccagaactatgagacaaatttctgttgcttaagccacccagtctgttgtattcattcgggaagccctagcaaattaatacaccatgactcccctaagggtgaagtattctccctgcctcactgacttcaggctaggccaagtgactagatttgaccaacaggatgtgggtggaatggcaatgtatcaatttggagctaaggccttaagatgcatggcaagtttctatctgccaccttgaagttgccacccttggaaaagagaagagcaggccacaggtagctgctgatccttcagcctaggttctaaaacggagatgtgtagactagtcctaaagcggaccagaagcctggagtccagcctcgttccactgagccagctgagctggctgcacacccacatattattgttataagcaacgagactggggagttacttgttactcaccgtggcagtagaggcctgataaatacagcgcctgaggttaacagaaacctaacacctggtattcccaacagtcctctatctgttaatggagaaaagccttgtatttttactgtaaaaacggctgaaatacaaaaataatataaaagcacagactgcaaataaacaaaccaaaatgtgaactttgagtgtcgagaatttgtatcagttataattcaggtccggattaggaggagtcttccactcactgttgcttttgtttggatttttacaccagaaataaattacttctgtaagcagaaaaaaaaatgttcccttatctttttttttaagtgaaaatctaagaaactcagattctgtagcatgttatggatagaccctaaggcaaggagaaggaatggacacaaagagaactcacttcatcttggctttcctctgttctagcaaaacaaaggcgagcctgatgctgcctcagctgcggtctgctctgctgcaaaggcccaggagcagccgcccccactctcgactccaccgcacttctcttcctattactgtcaggacagttgagtgagcactctgtattcctgcctaatttttcctgacaagcatcatagtgtgtgaagtttccagtgagaaaggacttgagatctcatttatttgttcatgtgaagaaaatcacctcagaattaggaaccctgaaagaatcagcaaacataaatgaacagatggctaacctccctggtttatcttgctgggctggcatccagcttttaggcaaccataaatccaaagacaagtggaagggtttccagaaagaaggggttaccagaaagaagggtaaacctggctgttctgacatgcgtaaacagtgtgacttgaacttgttcctccaactttcaggatagaaataaacatttagtacatttgacttcttaatgaaacaaagcaaatgaaaaacaagaacaataaaaactgtccttggcagcatgccagagtcataaccaacccagaccatgttacagctggggcttctcctctgtctccctccacccccacagcccttctctgcctggccacttcttagttgagtcaccagcactcagacaaatcctcatagccccttttactcccttcaaatcttgccctcaagagtggtggcttttcctgctgctttcatatgtctcttttcctccaccttacaagttggatgtttgtcaggaaaccctctgtcaatcccagagtagatcacgtgctggagagtgagtgagtgtgtgtgtgtgtgtgtgtgtgtgtgtgtgtgctcatgcgaatgcactaagtaggaagagagatggggaatgagagaacagagggaagttgtaaatacagctgctaacatttctaaaacagtgtgtctttatttttattttctcactttcagctcagagaatggcagttactattcagttaccattactgccacgccagctgcaatctactgtgagtctgctaaagtcaggtgctatgctaggggctttataatgtaccttatctctgagttttacactgacactacaaaataaaaatccccattttgcagacaaagaaatggtggcactggctgtcccaagtcacaaagccagtaaatgaaatcaaatctgaccaagtccaggagtgcagatttactcacccatccagcagctgccaccccatggcaccctgagggtagagttgccagatttagcaaataaaacctgggatacccagttaaatttgtatttcagataaacaacaaataattttataatataattatgtcccaaatattgcatgggctacatcaaaaatgtttttattcataggagatgcatgctgaaggatttaggaacaaagtgtgtgatatctacaacttacttcaaataattcaagaaaaagtgcatcagagagataaatatggcaggacattaacaactgatacatcggactgaaccgaaatatcacacgagacagactcatactaaaatgttatttgttatctgaaattcaaatttaactggttgtcctgtattttattttatttggcaactctagcccagagggacagtgaaactatggagaagccataagttggactctgaactctcagggtttcctcgagtgttacccgtgccatctggaggaaaggaaactagggcagctgcgtgaggtcactgtcagctcctagtaaggagcccacaggtgaggaaccgaaaaagggagagttcaactctagagtttccaggcagccgcgcagccccagtatgctaatgggtccaaagaaagcacctcaacctcctgccacaagatggcccagagagggctctgttttgacttaaacttttaatttctgccccttctatttctgatcctcagggcattcaagtgtgcactcccaggagcttgctcggcaaaggaaggcctgagaaactaacaaataataacctcagcctcaagaccgcggactgtctggcacaggaagttattcattccgccagatacaacgagctagtgtccccctcaaaggcgccctttgccagtctgaacagaaagccatggcttgggaacaactgatcttcctcaccgagggttctgctgtggtgatgacagccaccagacaaaccttgtaatcagctgagtcttcttagttacactaaatgaaaaagcaacataaggccttaaatcagttttacagtgtgactctggatattaagagtggcactgtggagtcacaatataactgttgcttattagttttaaccaagacgaacataatgaatttttccacgcacaatactgtggcactaccactaaaacaaaatactggaaaattatcaagttctatggtgaattcacagtgtcaacagctaaattaataattggactaaaaaacatacttttcagttaatcacccaatatgtacctactgagagctttctatgtgcccggactatgccctgcaaacaggcataggccctgtctgtaagaagaaatttagctaaggacacaaaaccaacatgcatgtaacagggagtgaaaaattatgtgcaagactcagtaattcagcctaacaaacagcttatgcctgaaattatttagatccttccagtagcatggatctgtgataaaattcccccatctaaacatctcacaggctgctccaagacaacatgaccaaaatggactcatgattttctcccctagttgatcactaagtcctgctgatttcacctcctcctcttccccatttctaccccaaggcacatttcatcattggcttggactgtgacaatactgtatgtaggctcctaactggtctccctctctccagcctttttcctttcaaatgcttcatccatctcaggcttcagagaagcctgtcaaaagtgcctaagggaacagatactccacccctgctcaaaggataaagtccacagtccttgacctgttgtgatctgatgcaactgcgtcacctgtcgctgtcttttcctggtaggcactttatgcaccagtaacacgcaaccatctactgttacctagcacccaccacacaagttctcagccagtgccttggcctgagtcactcaccgcccttcacccagaagtctctgcagggcccttatcacctggttcacttctacttgggcttcagggctcaattcagaagtgccatctctcagaaggcccctctgaactatgtgttttctctctgctttcatgaaacttcacaagttttataaggaaaatgtgttcattagtctttagtgtcagattgggtctgatactaagaactgtatctttttcatggatccccagcacataacatggtttctggcacagaagggacacaataaataattaatgaagaaacagatgataccgcagcgtagagcacaacgctgtgccaggcattcatcttctgctgtttacccagttcttcttggtaaaatcttcaatgtggcaaaatgccgcatattctaaataatatgtaagaaaggtgatctgaataaataaaaagtctgaatttcagtactgcagaatcaagaagagacagtaactttcttagctgcaaatattatttttcaaggagacattttggcctcctttcataaatggttaagactagtttggaattagcagggtctatttttatgcataattaatatgccaaaggcacacaaacattagttctaagtctgttagatctgtctttagcaattttggttttaatgaattttttataacatcctttttcatagcaagtatagcataggattttcacaaccttaaaactgatgaaactctttcattctttccacaaatattaacttagcaattcctttgtgctaagccactgttctaggtattggagatataatggtagacaagatctcctaccttctcattttattggtgaattctaaaaactccttgatataacaaggaacaaactagacttgtaagcaataaaacatcacatttatctaagggaaaaatacctagatattatgataaattatcaatctacagaaatttctatattcatattagaagagatgtttaaagtagcagataacattactacaaatgtgcagaaaaagtcatgtgttgcctccaatttctattcacaaatgatgctactgattgttgttactttattttttatttattcagttacttatttattttttgagagggagtctcattctgttgcccaggctggagtgcagtggcatgactcggctcaccacaacctccgcctcccgggttcaagcgattctcctgcctcagcctctcgagtagctgggattacaggcacacatgaccacacctggctaattttgtatttttagtagagaaagggcttcaccatgttagtcaggctgatcttgaactcctgatctcaggtgatctgcccacctcagcctcccaaagtgttgagattacaggtgtgagccaccgtgcccagcctgttgttactttaaatcaggtaaatgctactccatccattccctacccattccattatatttgtcacagaaaatttggacaatgaagaaagtaaaaggaacaaaatttaaatcccctgtaatccacactatcgctgttaacatatgggtttatttccctctggtctagtcatatatatgtgtattttaaacaaaattgagatcatatgtattgtatcattttttgactcatcttttataaacgattatccttgttattaaataggttttgaaactgttattttaatgtctgtatactaatccactgtattagtatatttaaaaaaatatactaaatcagtttatttaatcattcttttactataggacatttgtgttgctttcatgctgaagtaaatgttcttgaatatatttgtccaaattagtgaataattttgttttctttttttgagacagagtcttgcttttgtcactcaggctggaatgcagtggtgcaatcttggctcactgcaacttttgactgtcatgcctcagccactggagtagctgggattacaggtgcacaccactacacccagctactttttgtatttttagtagagatggggtttaaccatgtgggccaggctggtctctaactcctggcctcaagtgatccacctacctcggcctcccaaagtgctgggactacaggcatgaggcaccacacctggcccaaatcagtgaataatttcttagaatagactcctagattgggattattgggtctagagacaaaaagttttcatgaactcatcagcctttaaatatcaacaagttgctccagaaagcagtgtatgagcaaccatttcagcatatccatcccaatattggtgtttaaggttttcagaaatctttgcttcctcagtagtggcaaaatagcatcttcttgtttgaacttgcatttcttgaattactggagaagcataacagtttttaccatgtatgaagtgagactgttttaaaacaaaagtaaaagaatcttcaaccagcataagcttccatttgggtacacagaaggctggtcagagacagaactgagaacaacctctctgagctgtgtgtagtgaacatggagtcgctggccaggctgacacctgacctgcagatgaaggaacagatgcaggctggattagcttgactgctgaacactgacatgacttaatacagccacaacccaagtcagcctaacagcaatcttttgggaaggcaacaccatgagagtggtgaaaccagctgtcctgatgtaagccacttccaagtgataaaaataagcactcagggaatccattaggctttcacgggaatcagtaatacctttaaggaaagtttcgggattcgagagcactactggttgttctttaaggtcagtaaagtgctacttcataattaaacacaacttaagcatccatgttgccatctgcacagtctaaattcatccagagataatgcagaccaacttggagaacttgccctaattgtgtatggatggtatattggcctaattgtatactggactccagattaataaaactcatcaaatggcaaaacaccaattgatttgctttgttttttaaaattgctccctgaaacgaagcaaacccaacccagactcatgcagtaatttaagtaatttccactgtttacataaaagaaagaaactgccattaacattctactcttattccctgaccttattttaactcagtaaaaatgtattggcattcatttatttatgtcactgttgcttaactcattttcattttgcaactgtcataattttaactaatgagctctgatagttcagattcaaatgtagctcatgggtgaactgtactttgtttataaattacatacaggacaatatggtggaatgacaatcccaaaaaacctcctgctacaaaatacccactaacttatttttgaaagtttctaggtgattacaaatgtacagccaagtttgagaactgatgacctaaagggaaaaaaagcagctaccgatagaaacttaaacatagaaccaggtgaaaattgggagcgggaggggaatatatatatacatatatggggagtggggaggcgggtgagaaagaggagtttcagatgtgaataaataagaaataaggccacggaaacaaggcccacattctgtgtgtaacttgcacagccagtctcattattttgcaacctgtttggttgtgattatatctctcaaaattgaaataagtaatattttcattacctacctatttctatgtctcctcttccactactgttgattatcagaagtacagtgttaaaagaaaatatccttaaaatgggaattgtgggcgctgggaggactggtgagatgttagtcaaaggacacaaaatttcagtttgatataaacaaattcaagagatctaatgtacatcatggtgatcacagtggataacaatatattgggccaggcacagtggctcacgcctgtaatcccagcactttaggaggcaaaggtgggaggattgcttaagctcaggaatttgagaccagcctgggcaacacagcaagaccccatctctacaaaaaaatatttaaaaattagcctggcatggtgcacacctgtagttccagcaactttagagtttaaggcaggaggatggcttgaacccaggaggtcaaggctgcagtgagccatggtagtggcactgtactccagcctgggtgacagagagaagccctatctcaaaacaaaaacaaaaacaaaaacaaaaataaaataaaataaaaccccaaaatattgtatatttgaaaaatgctgagattagattttgtgttcttaccacaaaacaaagataagtaattgaggtaaggtgtatgttaaacagcttgatttagccatttcactatgtatatctatatgtatatctctctcaaaacatcatgttgcatgccctaaatatgtacaattttgacttgtcaattaaaaaatgaattttaaaaaatgggacttgtgatgagtgattacattagtgtaacaatggcactctgcctcacactgtctctggaaagtgtgtaaaattcagatgctgaaggggccagatggctagggcaaatgagtgacacaggccatgggtttgtacatttgtttgcatgtcaaaccccagcagcaatattcatttctacagagaaacatgccctcccccatttctgttaaacacatgatcctctcaagctatctttcattttccttcttttggtaaggagtgtcagatatagagaaacatttctctactctaagaaacacaacagcacatgcacaacaacggataccttcactgggccttgggagccaataagggcgcaaaggacggtgggtgctgtggtctgaatgtttatgtcccctcaaaactcctttgttgatatccttacccccaaggtggtgagattaggaggtggggcctttggaggtgattaggtcacgagcgtagaaccctctcgaatgggattagttctcataaaaggtaccccagagagctcatttgccatgtgaggttagagtgagaagaccataatctatgaggcagtggaccctcaccataccccaaatctgccggggccttgatcttggacttcctagcctccagaactgtaagaaataaatttctgttgtttataagccacccagtctatgctattttgtgacagcagcctgaatggactaagacagtgggaaacagggaaggcaggtctcttctaagggtcagcctcttttctgccgagacagctaccacacagaacttggtatgacgagtaccaaagaacatccacatgtttcaagagaagctggaaatctggaccaatacgtgaagtttccagattttaaaggtataaatcattcatgagacaaacatgtgaccactggcctacagagtgaggcaaaatgtgagactaaacaacaaaatgcaaacaaaatcatttccaaagaaattattttctctattcatccaagtaacacttactgaccatctattttgaataagacattgcatttggcagtaagaaaagacacaaaactaaatacgacaggacatctaccttcaaagagagctttcatactagattaaaataccaaattacgtcatatgggttgaaaatccccgcagggctgaggccagaagggaattactgagtaattcaattatggagatatgaatgctcttgtctactttgatcagcactcggggaaagacaagagattgtggaactggaattactgatggcccaaactcctatttttaacactggactcacaggaaagccaaaaggacacagtaaatcaaagacacaccaagcaaaatcctggttgtttgaaaacattaacaagatagcttccaaactggccttacaggaatataaaacagggatattatgtatttttaaaaatattctaaaaaaataattaaatgaaaactagatcaacagttctcaaagtgtgatctcaggacccctggggagcccgaagaccttcttaggaggcgcccacaaggtcaaaactattttaatactaaggtatcatttgcgtttttaattctattatttctctgagtgtagagtggagtcttccagaggttacgtgatatataatgatgtcatattggaatatgtgcttgtgtagtcttctgttttaaacatttctcaaaaatacatatcagtttcaatttctaatattgtaactatcaataggtatggaaacataagttctttggggtcctcaataatttttaagaatatgaggggcccaggagtttaaattggattataaaatctgcaagggtagagactgcctcttgtttagtgttatatccatagctcttagcacactgccttgcaaatggtacacactcagtaaatatttgtcaaatgaaagaatgactgccaaagcatgtacccaaaagtgcatttagatatagaaagcaaacacctaaagtggtctttatttttccttggttgttttttccagttaccagcttggattaaaaatggtcccttccttagtgtatagtgtatagatagtgcatatcttgatgatatggccaggaatgtctagtaacttggccaacatcctatgttttcatcaatgagcttataattccacctcctgattcttcctgggaaataagcaaatgtctggcagaacagatggcccctctgctgtggcctgacagaatgaaatcttggatttatttaacaataaagcaaagtagtttccacaggcaggaatcttcccctcctcaccaaataatatttcctttaatgtaaacttgcagattaatagtaattataagtagtaatctcctcagtcagaattaccatcttaaggaatgaagacatggtctaaaataatcactatacaaatataaacaccttttttaaaaatgcatattcccaaaattgcagattacgatcccacagcaacctgcctccagtaatggattttatgataagcactttaacctgagttctgttcctaatgagtctgattcagcaagtctgggatggggtctggtattttctaaatctttgtaagtgatttagatgcatctcctagagtctaggggctatgctgacaactgttagcctactatattgtcttaatcattaataaggaatgcactcatagtcaacatgaattagtaagacactaaaataaacttaatatgattttgatatcacaagatcgtgtttctaaaagccaggaaagaatttggataattttgcttaggagttagagaatcttgcaaggaaattaacgacactgcctccgtttacagtgctatagtttcttcctgtgctgagccaatcacattgctccgttataaacttggaaaagagaaactaggagatgaagcatgtctatgagaggtcaacagctggaaagtcacactgaggcggggctgagcaagcccggatgagtacagagccaggctgagtaaacagaggaagcctgttggtggagaaagcagaggaaaaagtgggaggcagagtgtgcctgcttcctgctgactttccactttcggttgtcctctcaggaggccttactgtgccgtggttcttgccctttgatttctatgagcttccccttccagatttacagaaacaaaaaaaagaatcctctcttgccagagctagtttgagtaggcctcaactccttaagagagccaagaagcgggatacattgtggtctgtaaggacaatgtagcatgagaggtgagggatggccatagaatttattgtccaaagcagaaatcttttggaggaaagggggtgttagtgattacaccagcacaacaggtacacagaaaccatgtaggactattccaggcaaatgggatgtatggtcatccttgagatgggaaaagtgggttcaggatcagaaggctagctggcacgctctctccttccctctccatttgactttagataagtcacttctattccaagagcctcaatttccttgaccgtaagataacagatttaagatatctttacaggtttttttctgatcaagaaaaatctcagactaagataagtcttctttgaatagaggcaactcaggagatgaggtagatatgcaagaaggagccttttaaaatgatatatagctgaatgcctttacatacacatcaataaagatgttttgctgatttgactttaaaaaacaagatcccatagtcaccaatcaaagcaatctggttatcagtgattacattttacttctttttttatttttatttttattttttttgagacagagtcttgctctgtcgcccaggctggagttcaagggagccatcttggctcactgcaacctccgcctcccggattcaagcgattctcctgcctcagcctcccgagtagctgggactacaggcacctgccaccatgcctagctaatttctgtatttttagtagagacagggtttcaccatattggccaggctggtctcgaactcccgaccttgtgatccacccgattcagcctcccaaagtgttaggataacaggcgtgagccaccacgcctggcctatattttacttcttgaggaatcggtagaacagctccagagtttctatggctcccaaaagaaaccagctggtactgacttgcccagagcctcaggtccagatgaaggggaagtgtatttgtcctgttcattgcatctctgagacctaatgctacagtcctgccttgacctgtgaagaggaagtcaaaggtgtaaacagtctcccactggttcccttgccatcccatcccttgttggccagccctgactgtggccagttctgcatccctattactgggagacagtcaacctgccagcacgtctgcagagattaggagcgcaaacttaatattctgaactgcatagctgctcttaaaggtcatgggatctcagaagtttggagctaagaggaaccatagcttgtataataagtttcaattcacagatgacaaatatagctaaagacataacaactgttaacgttcaggcattgtgcgaggcattgtgctgggtgctttatagatatcatattatttcattcttgtgacaactctgagttaagtattcttatccttattgttcctattttcaaaatgaggatccttaggatttgagggattaaataacttgccactgtgcttgttcagcttagtccaagaaatccttagggacagaaaaaaaatgtttgattcagttctgctgattctcaggacactcttctttctattaaaatgatcacaggcgagtgaagaggcatttaatatgtatctcaggcactgtgctaggtgtcaaggcagttcactgggataccagatgaaatgtaacgtaaactcctgcctttccaggcctaagggaggaaaaggaactgctgggtctctgcaaagctctctcttcatgaaggcccaaacgcttgtaaggaaatgccttattaatgctcacaatatcccctaggaagagggtgtgggaaaaagagaagtactattatgcctctcttgcaaatgagaaaattgaagcagaaacaattacaggccttgcccaatacgaggcagtcaccactgaggccaaaaatgaaacaaaattgtcttggttccttccacgatattcactggccaaaattaaaagtctctcttcagttacctctggtcactgcagggttcaaggacaattatcatttgagacaactttttggataggaattctcttactaagcttcccacacctactcatttgaatttcatcccttttccctcttccctttttgacatagacaagtcggggcatagacaatcttcaaatgaaaaaacaaagaactggaaatatcagagtagattatattataactacattagaatcaagttatgaatgaattctcccatagtaatactagtggcaataaagatgactgccacatattgattacctattctgtgcctgatactatgctaagtgctttatacttggtcctacaataatacacatgcagagacaaatccaggttttgtgggtcctgaagcttatacaatttgaagggtccttcttaagaaaaaagaaaatttgggatatagaatgaggtacagggcttcgcaagggtctgtgcaagtgagagacccaaagcttaactttgcgagtttcatggtaaatgcatcactgtgcccaagttagctaacagctcatatccccagttttacaagcaatgaaattgaggaccaagtaagttatttgacgtaagtcataaagcttatactggcaaggataggatttgaacatatggaatctgactccaaatctcacgtattttctttgtgtggcttctaataaaaataaagttgctatcacctattaagcactaactatatcccagaaagatcacaccttaaggttataagaattatttgacaaagcagatgtgatcgttagtccttattatccctatttacagatggggaaaacatgaatcaagtaagattaaacagcccacggtcaccgagctgggacatagtggaagctaggtttcatgcccaggagtgtaacatcctcaatctttcccactgtcccatgctacctaccaccctacaggtaatccaggaaaaagcagaatagcgatgtgtgacttacctctaatgacaacagtatttccacacctgcccactgaaactagccctgtcctttagtttcatacaatacaccgtgcagtcctccttagctgggattgagcagctctgaaagtccacttccctgtactattacttatcagaacagagtccattcctcatggagaaaaacacttggaaatatcaacacaaactcaggccccagccaagttgccttacagccaccccctcacccagagaaatggagacacacagagaatctaagggctggctatatgggaaccacggggaagatcactcatcctatagggctccttgaaacagcctttcaaggccatataagaaaactcacatatttactataattggattgctttactctagtcacccaaagcaagagtttacatcctcaaacacagctcaccatggatttggacatggacaggagtggagaaaggattcagtttcttttttccttgaacatgattgctcaaaggaaactgaccctcgagacgctcagacagtgggccttgtcttcccttggcaatgtgaactttaaaaattacattatgctttgccatggtgctttttgaaaaactgcctttaactgccagatttcaggtactcacttaattacttttggaaactcagttaaaggaagatatccattgccacctggaataaaatagctttactgactggagagtgcagtgattcaaagtagactaggcctgggcttttttatctggccgcagcaagtgcagaccagtgggagaaatgaagcgtgcagttatggatgctaacaagaaaggctgctgctccagtgattatttttcttttttaaggaaaaaatgatcccagtaattctcttttgttcctcttttgacacagcttggtggatgtgggggaaagggcagatgaaatgaccagtgaaatcaaaagatgaagtcttcttaaaggactggctctccagcccaatcatctagaggaagagacaagttcagattcttgtagggtatctaaatgcatctgtgcctgaaaattatggccgtttgagaaaaacaagaattcatggtgagacaaagcaacacagactgttggtacaagatacaaagccactaagtcagcgttcagcaaagactgatggatgaattgtcacccagcctaaaggactggcccagctaccaactgcccctgcccagcccaagagggcaagaacacaatagaccgcacacccacgtctcatccccaggcgcacaccacttcaaaggctacagcaagcagacaacataacctgcctcttctgcggtgtctttcattcagttctgtttcttcatgaagtgggaaggaaacaagtttgggcccacctgagattggggtgtagacggaaggagtggggagagatgcaaacgacagaacacaaccgaaggcctttttaaaagtcaggatccatagccttacttatcactgtaaagggaacagagtcggctccatccttcctcatccttctttaaccctcgcctaccaagccctggaagacagggacgcaagaagagctctagcgcggagggtctgcctgagtgctggtctttcccatacaagatgtagcagcagggatgggagggtgagctggacgactccacaacacacacacagcccgccccgcctcaccttctcgatactctggtctacagccttctggaagacccgggccaccagcagcgtgacgctggtcaccagcaggagcagggacaacgtccccgccgtgtagaagcagcatcggcccattctgtgcgccgctcacgggccgggccgggccgcacccgccagggatccaactgcaaggagggaggagccgccgcagaggcgtcgaagacccgggacccttcggcgccacgcccacgccctcccggcgcacggttcgtgcgcgcagctctgggctccgcggcctggcgagcgcggccccgggtgcaccgggcggatggggccgcggagggacgggcccggactcggtttcggtttccttcgccgggcagccgtggcgcccgcctagcgcagctcgggagagtgcagggagcgcgcagggacgtgacgttcgcgggccgggctcgccgcaaccccgcgaggcaaccgccggcgactgc

SEQ ID NO: 377 - DNA, 55162 bp, Homo sapiens; identical to SEQ ID NO: 376

SEQ ID NO: 378 - DNA, 35028 bp, Homo sapiens
tctggctaacagaattttattgttaaatcacagaaactttagtgcaaaacaaaaatcacgaagtccatttaatagcaacttcatgtcctgctggctttgcttgctgtctcctggcaaccagaagtggacagaagcgtgggtgcccaagtgggccacagacagcttccaacccccacaccccagcatccaatccacacccagcagacccttcggcatgccgccctctaccaggaagccagaggcctaggagctcgccatccatatttatttgaaaaggtcaaaaggagcatctatgagacaagggaggggtgcaggctgaagcagcgcctcaacagccagggacatgtaggcaacacgagcaggcacagcgcggccaccactgtccacacgctcacacaagccaggcccgcagggccttcggagagctagcaggttacattcaggcagatggccctcttcccacccaaacccacagaaccccaaacaaggcatcaccaggaaagacacgggaaagccaaatcacagttgaaccagggacagagaacccttggccccactgatgtcccaagccaccagcagctgcttccaaaatccctatgctattacagtgggaattacatcatttaaaaagcctgattattccaggcttctaatctttcatataaaactgcctttgttttgctgctttgttcaactgagaggcccaggaaagcggggagggtccctgatcagggcaggaggccacctcagaagcccaggcccaccagtgcccaagcacatgtcagggctcagaacaaggcctcaaccaagagggttgatggcctccagtcaagaaactgtggctcatgccagcagagctctctcctcctccagcaggcgccatgcaagggcaggctaaaagacctccagtgcatcaacatccatctagcagagagaaaaggggcactgaagcagctatgtctgccaggggctaggggctcccttgcagacagcaatgctacaataaaggacacagaaatgggggaggtgggggagccctatttttataacaaagtcaaacagatctgtgcgttcattcccccagacacacaagtagaaaaaaaccaatgctgtggtttctgccaagatggaatattcctcctcctagttccacacatggcgtttgcaatgctcgacagcctggtaggagagaggaagctgagtttagtcttcggatgaaaaactccgttcccggcccatcaatgtatcagatatcaccccaaaacaggacctgttctcttgtcctaggtcagctggatggcaccagatgctgaagacccaggacaggatctcacttaaaaacagggaacacgtggccatcagagttttgggaacttctaaggcacgagtccagagcagcagatgcctgcagcagtttgcagatgagtacccacgcaggcagggctcaggacccttcatctacctgcacccggcacccagcgtcctgctagcagcctgcacactaactcccaggcagaacctccttgcctgagttaggctacacaccagctcgggccttgagaagcaggcccacatttccccaggacagcagcagaaccagctgtggggtggggctggcggtggagatgggctggagcctagctggaggaaagagctggacatggccagaatgggggccccctgcccctccctgcagtggtccgaaatgacacaaccgccactgacatggtcacagggaagcccggtgaggaaggaaaagttgcacaaagcaacattaagtaacagggaccgaaccaaacatccccacccagggaagcagcacaagtcacccaactggtggctgccaggccaggccagggccacagtgccctagggctgctgggcaggggccagttctcagggccttgagtgaggactcgggcccggcttcagcaagggcaaacatgttcccgggggacaggacctgggcaaagctctgggcaatgaatcccacagaccttgtacaatccctggagtgaccttgtacaagtctgacactgtcacaagggaaatgaagacaaaagcaacaaagcagaagcaaaaaaatactaaaaaaaataaataaataaaatccaccccacccttcactacaagagtgtagttcaccctgtcttttctaggggaccatgagtaagcctaaccacctctctgggcctcagctttctgataacataaaagcagggtggagagttgatcactgggttcccattaaagcaggattctcacacaggctaccccagggcaagacaggctggtgacactgtctgctgagctactcacattgcactgggctgctgtctctgtgttctggcaccagtagcttgggccccatatacacttctcagttcccaacaagggcttatgggccgaggggcaggctccaattttctatatggtgagaaaaggaaagaagaaagggggagaatgagagctgcccgatgtatcgctttcaaaactaagaaaacagtttccagaaggagctaggatcacagctccaccacgctctttcagaacatcagggttgctgaggaaagcgatggggcttggggggctggctccctaccttcttggctctcccgcagcagaacccagagactccaccccacggccaagtctcagagcaacccttccgggtctctgcagccccccaggttacagctgcccgagaggaccacaccacccagtgaggctcaccaagcacacgaaggaaggatccatcacctccaccaggatctcgatcagcacgggctcgtactctgccacaaactgatcacactataaaggaaagtggggacacaggtccagctctgggggtgtccgagcatagtggggcacaaaaggccaggcaggccctggatacactgttccctgagagctcctggcattcccagcccactgggtcctggggcctccctttccagacaccctatctacatttggcctctctacttcaggttgcttcccccagtggctcatcttaagccaacaaatcacctccaagtaaaacttcattggactccatgcccggaggcagaaacagctggttttccatcaaaatgtaccccagccttggcatacttcatcaggttctgccatgctggcctaccgcagcccagcccggggcgtacctgcttctggtaagggtctggcaggaagctgcagcctttctcaagagcagccaggatctcctgcttggtgctgtttttctccaggttgcgatccaaataacccaccagcttcttgcacacttcgcagaagccaccgtcctttggctgagtcacgtgaactacataagagggcagcgggctcaacgctggcagggccctcccagacccaagaggggcaccatcctctcccgcaccacacccagcgctcaccggtcagtgcaggcagccgcgtgccagagcagaggtgcagcatgctgcacaccagctcagggctgacctcctccagcaggatggacaggatggagctgccgtacgtgtccaccacctcctggcactcttccgacagggacttcggcagcttcgagcacattttgtcaaaagcgtcgagtatttctttctgaaacacacgagaggatcgtgtgagaagacgggaggccggacaagggttgggggacattctgaaaatactaacatggccaggaaatgagtcaatggtgggtgccgtttccacccacaaaaaactaccaaactacaaagcagggcaatggtgtccacctccccggacccccgccagcctagaggtcccactggtgaggattgccttccacgagatggggacatggctgtacacatgtcaaggctgggccaagccctctctcctgtgggactttcccactgggacattcaggctcgggggggcaggagaggccctccctctgccaggaggacagcatacctcagtcttgttgttgtcaatcagcttggtcacctccttcaccaggaattcacacacctcacagtaaacatcagactttgctgggacctcgtgcttctgtggaaagagtagaaggagagtactttcaatgctgggactcacagcccttggtcttgctcccctaaaggaaaggggacacagagaccagggtgggttagcacatcaagggccactgcctcctgaattccaaatggcgtgtggcttctaatatccaagttaattccctatttttacattcacccccttccccaatcctctaccacccccacctccccctaaccccaccaaaacaaaacccaggaattcacagttcaggagacagaaagtcccttccccaccccgaagagctgtcctgatgatgtgttcggttacaatcatttcatcattcagggttcattttggggaggaggatgaaggaccaaaagcaaagtgaggggctcactatcggtccactatctagaagacagaatgttgaacacacttcaggtctgctcgtgtgtctcccatgtctcattagcacttgagaatgctcttctggaacccacctttaataaggcaatactgttacagaggatgttctgtggcaatggaaatgttctctatctctgctgtccactataagctccagctacctgtgcactgagcacctgcaatgtggctggtgtagccaaggggctgaatttttaattttgctccatggtatttcattaaaatttaagtagtcacatgtggttggagtgcgagctataactcttcactttctctggccgtcactttggtcagcaggctggagctgaggagcacccggtggagaggaaggcaagaagcagtgcttcctggattccagctgacacttcggcctggcccctgggtcacacactctgcacatgcagagaggagacagcagagagagaccaacagctggcagtcaagtgccgtgggatgttctagaacaagaagcgtgtacatgtgccacgtgttaaggcatcacacagcccaggccttgaagaactagaatgtaagccccacgggcacaatgacatcatctgttcaccacagcccctaacatgctgcctgacccataataaatgccaaatacaaatttattatgggatgaagtagtctaatcttcaccaagtgaggtgttttagttaaataaaatagacacccacatgtacttagtatacaggctgcaggcccagtgaggcttccgtacactctgaggggtgtgctgggaacatccagtctgtcagggccacaggatggggaaggacccagacagtgcatgtgagaaggtgaggctgaagccaggcactgcaaagtcacctttgaatggcatgctgaaaatacacaggctaatgatcccacgaacattagggtttacaaccaaggaaataaaatgttttcaaaagaactcagggtcgggggctgcattagtataggggataggataaaccagtgatcacaaactcaaagacctttaggagccaggcagggaaccgaaagaaacaagtgactcgtaagatgtgatgtgacacagcagggagtagtgtggcattgcacagccctgaccaggacacaaagtgacaccaggtaccttaatgggctccaccagttccagggcagggatgacattcttggaggccactttggcggggaccagagtctgcatgggcatctctttcacctcatcacagaacccaaccagcgcacagatctccttgggttgctgaagagagcacagaacaaccagtcagcagcaagcctacgcccactgctcctcagtcccaatccagccagaggacagggagctggacagcaccctgggcccaggtcaaggctacctccctctccccctcccacaacggggcagattccagtttccatgttaaagggctcgtgtctgaagcagtgcatatgtgccagttacatctcggggaggagaccacacaaagctcctaaggaacatcaaacagagtctccatccagggccaccacgagggagactccccagcaccttccacatctccaaggacacctggtctgttctagaatgtgtcttttcaggtcactctaggtaggaactaagctatgcttttttctagagggggaactaccatgcccataaactaacagaaagccaaatgtgttagaaataaaaccacaccagatttttcagcggcaggaccatttaaaatgatgcattaaggggaaatgctggctttttaaaaaaccacattctatgttcaagctgcacacagtgcacatgaaaacccaacccgccaaatggatgaatcattttaagccacaaggtctccagattgatcccctttcaccatttagacaccaaacacagagcactagatagtctagacatcctgaccatgacactctgatggccaagagtgagacaagtgtatagactctgtatattgtggaaataaatgcaaccagcaactagctctgagcctgagtgcatttgccttccagcaccaaaccctaaagcagcaggaacaaaagtgctaaaaacaggacctgttaagggaaaagagctagaccatgactatggctcatcttgttttaatatcaagaaggttcgagaattaataagaccgggggagtctgaaaagtatatcccaaataccctgtctctgccacaccttaagaatgaaaaataaataaataaataaataaataataagaacgcagctgaagatacagcaagctttttagaaaaaaaaaaaagacgccaatattcaggaggtatagggctgcttctgcctcgatcagctttgttccaactccttgaggaggcctaggtaaaaattcaggtatttcaaccaaagtcctctcccattagacttcaaaataccttcaaaaaaagctccaatgctaatcctagcagatggatgccaacgctcagaggtggcagtgttcaggacggccccgaaggacactggctcagagcaagtatggactgggcatttggttcttgtagcatgccatctgatgtggctctagatcccaaaggaccctgttacccagaggggcagaagccacaatcaagagattgtttccaattctctggatccaacagccaggaacagtctgctggctgtctgcaaatgtttgctcatgcagcagaagcatttctgtgtttatgaaaaacagcactaaagacatgcaatgcctacttgcgttgtgacagacacaaggtgccctggggaagccagacctacactggacttcctaactggcctacgttgaaggaggctgaggcacctcctgggccacccatggttccccattgtcacactggtggcctgcatgtacgtatgctgtatgtggactgtgaccagagcacaaggctctgctggcttcattttactggaccccgaaggggagatgagacccccaaaacctcaagggctgaattacaggggagagatgcagaagccctccccagcctattaacagagagggagcctgcctctcgtaaccattccttgtatctgtcagagctaatcatgccatacccaaaaaaaaaaaaagcaaagtaactagaggaagcagcagaccactactgcaagcagattccccgacacatacctgatcctgctgttgaacaaaaaaacaggaaatcggaggtgaaaataagagaaaggaaaggacacaacagttaagaaaaattaaaacaacaatcaagcagttaaccaggtgtaaggatgtcccaagaggttcaggggaaatgctcttgcaatcagatcttagcaacctaccttgttcctgctatcttgcggacaagggggccctgaaagctttcctggccctgcagggatagaccatttgggggctgtcctgctctgtgtgcaccatctccaggtcttacacactaaatcacactcaaaacactgtgtagcaagagccccagaaaatgcttgatgaagggtctccatactcaggagcccacactggccccgggcccacaaggctttcccacaggttagtgaccagcagcaccacagaacaagacacagggctgcccaagtaaggggggtaagggatccctgaggggtaagggatcctagggcaatctactgcaggtggccaaatggcagcctggaaggccaatttaacaatgtatccaaagcctcatgcttccattcagcagttccagctttagttctctataataaggggaaaggcagggatatgcatatatgtatgcatttggctataaggatattcatcttcccaaaggcaaacctgaaaacaacctagatacatccggccaccggggaccaattatgtaaattctcttctatgtacacaggtgattattctgcaagcatttagtcatttgtacaagaatattcaatggccaacatatttttaggcaaaaaatgcaaactacaaagtacaaggtagtatatatgaacccgttgatatattctgaaactccaaatgatttttgtgtgggaagtattgtccatattttcaacacatttctacacagtataacttttataatgagaaaaatattttaagttagctatgaggaagtacttcacgagattaaatcccgtcaatgcttatctttacctacttcaggtgcatgtctctgtaagctgccttttaactgtttttagaacatggtagggtgtgagtaataatcccaaataaactactcctcctcagcttgcttgagtggttacagcaggtcagagagtcaatctttcaggctccttggccataagatctggctgcaactactcaactgtgctgctgtagcacaaaacaggcgtcgctgtgttccaaaaaaataccctttaagtacaaaacatgatgggccagtttgctgacccctggatcagagaacaaactcaaacgctggtatgtcaatctcaagtagtcagaaagcatgacagacagggaaaaggtgccccccacccactcagccctgccaatcagatctaaggaggcagtgcccgttcccaacgtgagcaggccgccctgctctgcgtggactagcgagctcatttcctgaatgggtattcttgattctaatgaaggaatgccccctgccacctgaatgcatccaaagccagctcaggagttaccagctcaagcagcagcttcagcggacgctgctgccatgcacgggacaaactccgggaggcagtattcccccgactcaggtggcaacacagccattctcaggcctggcttagttagagagcacttgacttctacagatcccagggttaaagccagacctagaaacctgatggctggcctgaacgggcagaggcaaacaaattgccaggaagccaccagggcagtcctgggatcaagatgcttcagcctgcctctcccgtaacaggggaggtactgagattgcaagtggagagtctcctagccagaggggtcgatttagcccaattcagcactctaaggtaaaaaagggaaactaaaccatataattttcaaaattcctagaaatgacgaaacctgaaaaacaaagaaaaatgctaacaaggggcctccgtgccacctaccatgtgcatcatcatctggatagcaatttcagaatactggctgatatagttcttgcactgaggagagagaaacagattgctaaacaaatcactgcaacaatgcaccaaaacccaaccaacaaaaaccccccagcatttccaacagtgtcaactggtgactatcaagcaagtttctaaagtagaattttatgaatgtctgctctgggccagctttaataagatgaaaatgacaatttggttactctatcatttataggaaatgtgtgcaaaagacgttttgaaaatgtttcttaagggaccttaaagattccaccctcctgtctcctttatcttataacctcacgtgccccaggatcacacagcaactattcagtggcaatttggagagaaggcagctaggagatacactgcttaggaactggagcttacctttcaaagccatttacacaatctcagatggcattataaagcttaaatccagtagagtcaagttataatgatttttaactgcttattttcagacaatctagatacttccagtagactccacagaattgctccttgtatttggggagcttctacagagagaggaccaaaggtaacatgatacagcctctcagagagggttcaactgggaaacctgtttaaatggtgttatgcaaagacacttaaaatgaggctacaggattcctaggctttcaaaatgaatgaatgttcacctgattaacattcctaacggaaagtcagagagaaaccctcagctgggcgtggtggctcactcctgtaatcccagctacttgggaggctgagaagaggattgtttgagcccaggaggtaaaggctgcagtgagctatgattgtgccaccgcactccagcctgggtgacagagctaaaccctgtctcaagaaaaaaaaaaaaatggagaaggcctcatctcctagagccggccactccacccaaaaagcctcgctagatcccaaaggacagagtaattacaaccagcttctcagctgccagtctagcaggtttcttcagttgtcaggtactaaaaatggcattttggttttacacatccacctgagtgtgattaataatcttggaatagggtcccagaatgaaacgatctaagtaaggggccaagaaaatgagtttctgagcccacaggactaagggaggcttccaggtgaaccatggtcagcgaccatgcttgctgcaggagcacagctggaattctcagtgtcacatacattagccaagctttcaaaaatggggtaaatggccgggcgcggtggctcacgcctgtaatcccagcactttgggaggccgaggcaggcggatcatgaggtcaggagatcgagaccatcctggctaacacagtgaaaccccgtctccactaaaaaatacaaaaataattagccgggcatggtggcgggcacttgtagtcccagctactcaggaggctgaggcaggagaatggcgtgaacccgggaggcggagcttgcagtgagccgagatcgcgccactgcatttcagcctgggcgacagagcgagactccgtctcaaaaaagaaaaaaaaaaaagaaaagaaaagaaaaaaatggggtaaaggccgggcgcagagactcacgcctgtaatcctagcactttgggaggctgaagcgggcagatcacttgagatcaggagtttgagaccagcctgacaaacacggtgaaaccccatctctactaaaaatacaaaaattagctgggcgtgattgcacacacctgtaatcccagctactcgggaggctaaggcaggagaatccctggaacccatgaggtagaggttgcagtgagctgagatcacgccactgcactccagcctgggcaacagagcaacactcagtctcaaaaaaaaaaaaaaaaaatgggggcaaaaagtatttctacagtgttcctaatacacagggtgcctggcaggaaacaaaatcttcccagaaacagtctcctactttttgttcccagttttgttacatatccagatgccattaaccaaaatagattcaagtctgcactacctattcaagctgctttctgggaaaaaagagaaggatgttgtctgaacgccctactccagcctccacagcccaactcccaggcccagaacatccccaatgcacaaggacacaaggctcactatgtcggccatgccagggcccaggcggtcacactcctccttgacatgttccaccaaggcctggacaaaggtggagttggtccgtacagcagtctggatgtcagtcaccatctgaatgcagtcctggcaaacgtccccattatcctacagaagaggcagttaggtttgcaacttaagaggactcaaattcctaggaaaacgtccttatatactcagggctgcagcattagggggcacttgctgaccagttcctaagatgctttacaggctctcaaattactgataggcttaaaatcgattaagtgttcattatagtaacagtatggtataaaaagggggtttagtataaataaaaaggttggccaggcacagtggctcacacctgtaatcccagcactttgggaagccgaggcaggcagatcgcttgaacccaggagtttgagaccagtctgagcaacatggcaaaacaaaaaatacaaaaattagccaggtgtggtggtgtgcatttgtactcccagctacttaggaggctaaggtgggaggatcacttaagcctcagaggttgaggctgcagtgaaccatgatcacaccactgcactccagcttgggtgacagaacgagaccctgtctcaaaaataaaagaagtaaatttttttaaaggggattaatctttgcatattttaaatatcccattctttagaaacttcatggtacaaccatttaaaggctggctcatgtgactgcagagtcacgcacagggataagccccagtttaagaaccacacgtgccctctctgtccctttggtctctcatctccagtgcaaccaaaaatgggtcctcagtggccagcccgttgtcttacctttggctggggcttgctgcgggggccgtcctgagggtagaggaggagagggatgttggccatgaagggggccaccacctcagtcatgtccagctctgggatcttattggactccagctgcttctggtgattcagctctgctaggtgcttctggagagactcgcagaggttgagagcagagcacacctccccaggacggctctggtgggatggaaagaagtcctgctgaaaatcctctccccaggggaaaataagacaggccatctagtgcctctgaattagtccctctctttaaatcccttaaaagaaacacaaacctgttgtctaaattcaaactgctcagcataccaagaatgacaaaattacccaatccgagtgcctaaccacacagtggcccctaagcttcctcaattctcctattaggcaatgatgcagtttggctgtgtccccacccaaatctcatcttgaactgtagctgccatagtccccacgtgtcatgtgagggacctagtgggaggtaactgaatcacgggggcgggttttcccatgctgtttagtgatagtaagtctcatgatctgatggttttataaagggcagttcccctgcacatgctctcttgcctgctgccatgtaagatgtggctttgctcctccttcaccttccaccatgattttgaggcccccccagccacgtggaactgtgagtccattaaacctttttttctttttttataaattacccagtctcgggtatgtctttattagtagcatgaaaacggactaatacaggcttcctaaatgttacctctttcccctcagctcttctttaaaggaacaggaggccaggcgcagtggctcacacctgtaatcccagcactttgtgaggccgaggcgggcggatcgcctgaggtcaggagttcaagaccaccctggccaatgtggtaaaaccccatctctacaaaaatacaaaaattagccgggcatgatggtgggtgcctgtgatcccagctacttgggaggctgagatgggagaatcacttgaacccggaaggcagaggtgctgtcagtcaagatcgcgccattgcactccaggctgggcgacagagtgagactcagtctcaaaaaaataaataaataaataaataaaggaataggagcttcttgctggaggagaagagtcagcaattctaagtcacttccccacaaaatgagctaacacgatggctttcaacaccttccatatgctgatggctcccaagtgtttaacttctgtaatcatgcccaccctgcagacatctcaaacttacccctcattctatcctgcccaactagctccattttagcaaataactccacctttatcttctcagaaaccagggagacatttatagctcttcctctcctatacatccccctcatgagcaagtccagtccatttaatcctccaaaagagaatctgcatctgccatttccactgtccacatcacatctcactcacaaagcaatgacctcctgagggtcctgtcagcttccggacttgcagcttccctcaatgggacctagacctagaccaaaccctttgacaaatgcccttacaatcatgacactccaaggctgcacttgcaatccttgaagatggcctaggaggctgtgtatgacacaacccctgccttcctcaccagaaccttggtcctgtcttgggaaagtcctgccccactggccctcttcagttacttaaacacctcttctttgtcaaggcctttccaaattccacaaagctagctccgtgttctttgctaaaaacccagtctgtgacacagggtttgtgtctgtgtacaatacatacttgatgaatgaaagaccccaatacattccctgaattattccttgattataagttcacagaaataaattcacagaagtgaggttttgtgcctgctcaaaggggtcagttaaagattggacatgatgtatccaactcacatctctgaaggttatgccggtttacattccttcagcagtccgaccagtccccagcagccgcaccctcgctaaccccagggcaagttacatacagagtggcctgctgtgccaaaggagctattctggatgtcaaattgtagcaaaatgctgttgaggaattccagagctaagaacagactttccattttaatcaatctactctgggccactgcctctcctgggccccagaagcaccttcaaggaaaagcctattccccatcacttaccatttctcctttaatgatgtccaggatgacagggaggtaggagtccactatctccttgcatgaagcagacatgttcggtttcggaagccagtcacaggtcttctccaagtaaacaaggatctcctcctacgagaggacaccagggtcagaatcacgataggctttcctccctggaaataaatgggctgaaggcaagaggccctcaatagctcccagaaaaaccaagcctggaaaacagccagccctcagggaaaaggacttggccatgttacctatggctctattaggtcaatcaggcaaaagcagacatgagcattcaaaatgaaaatccctggacctgcagtctcgcaggcacagggaattctaagcagagatggccaaaatggacctaggtattagtggcatgcaatacaacatctcaattaactttgggcatttagtcccggggtcagcaaagtaggcccttcagcttatttctgtacaacccagaactcaaggaatggtgtttacattctttttacatttttaaaaagagactgtgtgacagggacagtatacggctcatataccctaaaatcttttctccttgatcctttgtggaagacatttgccaccctcaggcctacaccattcctctttagacacccggaatcacagctctcttaggaaccagtgcacgtgcccgtggctcaagcaccatccccactcaccgccgctcacctcagtggcattgtccttcagcatatcaccagctgcggtgacaacgtctttgcatatgtcgcagggaagggatttctaagagaaagaatacgagaaatttgtatttgcaggacacaaattcacaccccacacagctggaactccccatggccttttcgctattctctctaaccagggatatgatcatgaccgcgctcctgtcacatcctggttctccaccctgcatgagcagcgctggggcacggcagggagggaagaggtgtgactcaccagaacacactgtgagttacaggacacagaacctttgctcatacccacacagcaccccatgtggcacaggtcaatttcacatcaatgctcacaacacctctgaggaaactgaggctcaggtgaaatcagagtcacatcagtatggcagagaggtgggtgggacagagaaacaaacgccccacccacctctgaaggcacacccacactgaaccgttcacctgcgcatcccctgcctcccaggcatgttaacaaggcaagaccacaccaaagccaatcttctgattggcaccaaggcccccacctggaccagaggccatggaaattctaattggttcctgcggcccttggggaagaatgcccaggctcccttcttgatgtcaactgactttccatccatggagaagaaacatgtctgggtgagactgaggaacacctatgaacttagctgcatttagagaaaccaacttgaacctagtcaggctaatacagtcatcctttggtatctgagggggtatcaattccaggacccccatggacacccaaaccccaggatgctcaagttccacagacagccctcaacatttgtggaaacagagggtcaagggtactgtgcatggaaccatatcaagagagggccgggccgggcgtggtggctcacttgggaggccgaggcgggcagatcacgaggtcaggagttcgagaccagcctgaccagcatgttgaaaaccccatctctactaaaaatacaaaaattagccgggcatggtggcgtacacctataatcccagctacttggcaggctgaggcagaagaattgcttgaacccgggaggcggaggttgcagtgagccaagatcgtgccactgcactccagcctaggcaacagagtgagagtccatctcaaaaaaaaaaaaaaacaaaaaacaaaaacagaaggccgggccatgacaagaccagccaatcaagttttaaagtccttacgggacacacattaaacctggaaacaggaagtagtattaaaaacaagattgaaggcaaattagaaaccaaatctgaaagtagtttcaggccagtcgtggtagcccacgcctgtaatcacagcactatgggaggcaggaggatgaccttagcccaggagttcaagaccagcctgggcaacatggtaaaaacactatctctacaaaaaatacaaaaattagccaggcatactggtccacatctgtggttccagtactcaggaggctgaggtgggaggattgcttgagcctaggaggttgaggctgcagtgagccatgattgtgccactgcactccagcctaggtgacagagccagaccctgcctccaaaaaaaagggcaagtatggccacagaaggcagttttccagtgaataattcacaaactgtttctaaaagaatggtgctaagctttcttctcttactgaaggagcagtagtggccactgacaagttttttagaacccaaagtccactcagtcaaacacagcccgtaccacatgatggccggcacagccccaagtgagcccagggcagcagctctgtgttgagctggcatggtcagcagagcatctcctgagagggcttgggaccgtgaggaacacacccatggcttgtcgccttagaccatgccccacattaatacgctacatttagcattatttagatgaaaaatcagtgctagcttcctcagtgtggttacagctggaaaccaattttaaatggcaactgcactccaggatctcaatcagcagtttgcctgtttgagaggagtgaggagagaacaaaatatgaaacaggcagaaagtacctgaaaagctcagcatttactttttggagtgagtgaccaaggatagagccgcgcccatgtgcccagtggtgggaatgggcactgccaacccactggcctcttatctaaggtgagaagtgggatctgcacagaggcccagaggcagcatggggcaggcacctggagccgcaggcatgggggacctcatcctgtctgccacaagaaaccaggtagcctcaggagagtgaaaccttaacctctctgagcctccatctcctctgctgtaaaatgggtacattcaccaataggtcctgcctcccacacagagtcacagtgagaagtaaacaaaacaaggcaagaaaaagtgctctgtcaatatggcagtgagttacagctgttctaaggggacccaagaggagtgctgcggctgggactggagggcagcggcactcaccactgttggcttgttccaaacggtctgcaggcagtgcttcactgccccgcagtcggacgccgtcttcacattctggcaccacactgccgagcccctggtgcattctttcagtccaaggaccgggccggctagagctaaaatgaaaaccaacgtgaggaggtggcccattttgtagcaaaccaggtcgacctgacttatttccccagggctgagggcgactgtccttgagctggactctgctactcagcccctcaccaagctgtatgggacaccagccacacagatacacgcctgtcccggtcaagaagctggcttgtctgtcacagggctagaagggactcatgtatctggttcacgttcatcctctctagctacctttaaacagtatcagggagtatcagaactttaaccttaaaatgtttccataagtaataaggtatcatcataaccttaaaatgtttccataagtaacaaaagaaaccataggagaaaagactaacaaattcaaatacagggaagattttgacttctgtaaaatggataacaactgtagaatgaagggtttttttaaaaaagaaaaacaggctgggcacggtggctcacgcctataatcccagcactttgggaggccaaggtgggtggatcacgacgtcaggagatcaagaccatcctggctaacacagtgaaaccccatctctactaaaaatacaaaaaaaaacaattagccaggtgtggtggcgggcgcctgtagttccagctactcgggaggctgaggcaggagaatggcgtgaatccgggaggcggagctggcagtgagcctgggtgacagagcgagactccgtttcaaaaaataaataaataaataaataaataaataaaataaaaattaaaattaaaaaaaattcatacccttataacataaaacaatggccagctgccggtggctcatgcctataatctcagcactttgagaggccgaggtggggtcagttgagtccaggagttcgagaccagcctgggcaacatggcaaaacctcatctctacaaaaaattagccgggcatggtagcacgcacctgtgatcccagctactcgagagactgaggtgggaggatagcttgagcccaggaggcagaggttgtagtgagccgagatctcaccactgcactccagcggtgagctaccatacctagccctaaaaatattttataaactgccttgagagtgcctatgtttcttaaaacaggtccttgattttagaaccaaaaaaatggggaaaaaaatcctcagattcacatctcacttctagcccaattatttagctaggaaacaagagattacatcggactacacatagaggatggtggcatgagggtcaaactccaacaggcatctcagtagggttgaacaaacttttgctgcaatagatacttgacccaagtctgagacagaaaaaaaaaaaaaaaaaacaaaacacaatcacctgagaaacacacttagaacctcaggaatcttgctgtatgctgcttccctctgtaagccaattctacatacgtgtgtaacacacataggaaacacgtgttgtataggtcagtacgtgttcttcctccaggagagggtaaggaatgaactgctttctttcattactacctccacaagctactcacacaaagactgagtcccacaaagctcgagtcagatcaccttcaccccttcagacacaagcaaatgaattattcatctgctgcccagattatagccttccctgtcccctgggagcaaaatcacaaacacgtccagttcgcaacctcaaccaagctggccacattccagaggctgctggtttggactctagtttccaggggaaaacatgtgccagatgcaaatcagtaccaagctccccagatggctcacaaaagcttagttagcccgcagtgtagccaagcatggctggcgccagcctcagttataaatctcaggggagcggtggaggggaggcagaattgagtcatgagggtaagggctctggggactgtgcggtcacagagacagcacaaataggaaccccagacctgatgactcccaccacaccctagcaggccctgggcccctaggactctgaaaaggacccatgatgacaccatgatacactgcctagccctacctccaaatcaagatgaacaggaggctaccaaatgagtctctaggcagaggaaggcagagtgatacacagggaagccagaagaggatgggctcagacctcaggagaccagagccaagacagaggagtcaccaccaaaagcaggggcaagtgaccagcacccccgattcttaaaaatgctcatccagtgtaatgtccacccagctactttctccagccctctcagcagggaactagctacagctgaccaaaatctagagtgtttccggaacacaacacactctcacaggcccatgtgagaatactttgtaggctgcctacttcctctaggaatgtgaaacaataatcgttttccatgatgactttgttacttgttttggtccggccaacctggactgaaaataatcttgggcagccccttgtatctgaaactggcccagctaatacaaactgactgtcacttcccaatccatgacctactgaatggcagcaggcctcttcctcagatctggaggcaaaaagatacgcatggtggagaattcggtacgcctataaagtcaagttccagcgtaaaacagatttccgtggacacaggaagtaacacgtaaattccaactcctagaaagtgccttcttagcaagacacccccttctacctccaaccacaagccaaacataaaggtgcatgttacaaaaacagcctgtggtatgcaacggattccatctcccaggatgaacgacatgatgacatacgttcatagactgcgtgtcctcagggcaggcaccactgggtggtgctggggagctcccagccgccaagaggtgcaaagcccactcccagagcagatctcctaagaggggatcaaacagtgggtcagaaccttttggggacatggatccctttcccagaaactttattacacacacatttctcctagcacttgaggaacttctcaggtcccagctgtggattaatcataaagctctacaggcaagggtggtttttctccacacaagcaggtaaacaacccagctgaaggcatggctaccagctccactgactgcgcagagcccgaggccctcaggccaaagaacaaatgaacagtcacgattttctttaccccaaagagcaggaggaacagacatctaagtaatggtgtgtgatcccacgcatcggtgggaatgggagcggcaaggcaatgctaacggagccttcctcaaaacgaaattggaattggcacctgcaagatggtgacagaaaaggctggctacgtggagagggagtggggaattccagaacattccaaaggagtccagttctctgtggggaagggaagaaactgtcctgtcttttcaggagcgaagccaagggaagtagcggcagccaggctgcaaaggcagacagatctcaggtgcttgggggaatggtctcacctgccccacacaccctaaggtgagggctcaaccccgtgggcgatactgcaggaagcttcagggatttctgggagggacaggacaggcaagctcatgtgtgggtctcaaccacccaggcacaaggtggcagaactgaagaggaggtgggagataccaatgtcaggcacctaactggaaggcgaattcaaaaacgtccacatgagaaatggaagcagcaagagccaagagaggctaacacagagtccaagagaacaagatgggcaaatggcactaacagggttccatgagaagttgtgcagactcaaagggaaaacagaacagcaagggccaatagcaccaggagagacacgcccatgagcaacgtgagctgctcagcagaggccagggaggggagggcctggggccccacccagagagtcccctggaggactggggatgagtgacgggagaaggaatgtttcagagacacgcggtcatctccaaggagggggagaatcccgtacaccttccaccagggtgtggagctggtatgagtggctccagaccacagatctctgaacaatgggtgcaaggaagcagaccacagctccaggtaaagaatgcatttaacatccacccaggggcataaaaagagaacggattagctggacgtggtggtgcacgcctcagtagtcccagctaccaaggaggctgaggtgggaggatcgattgagcccaggaggcggaggttgcactccagtgccccagcaccactgcactccagcctgggcaataaagccagagcctgtctcagaaaaaaaagagagaatgagtggcatcattaggtgatgacctcaccaacagtggaagcaaacaagcagaaacaaaatgcataacttatgagcaattctatataagagggatcctttcagtggtgggctgaactaaaagagctccgaggagctccaagtcttcactctaacaaggcagataacattttcagcatttataactaataaataaacactacccaaaaacactttctcgtgagttatttctcaaaacatgtggccagcaaagcctttaatctctattctcatcctcccacaccctacccccaaataccagcttccttctctgaggcagtatgctgaactccaaaaaagttcttagaatgtttgacctcctaaagatttccaattaaatgtgtcataaagacatgaacagcactcggggcaaattgagcacttcacttcttagttcaagggcctggcaagacagcttggaacaacgggctcttttttttttcttttgagacagagtcttgctcttgtcgcccaggctggagtgcagtggcacgatctcggcttactgcagcctccacttcccgggttcaagcgattctcctgcctcagcctcccaactagctgagattataggcgcctgccaccatgcccagctaatttttgtatttttagtagagacagggttttgccgtgttggccaggctggtttcgaactcctgacctcgtgatccacccgcctcggcctcccaaagtgctaggattacaagcgtgagccaccatgcttggccccacaatgggacttttttaaagacatagatttcagggccatgtgcggtggctcatgcctgtaaccccagtactttgggaagctgaggcaggagaatcattttgagctcacaaatcaagaccagcctggcaacacgacaaaaccccatttctacaaaaaatacaaaaattagctgggtgtggtggcaggtgcctgtaatcccagctactcaggaggctgaggcaggagaatcgcttgaactcaggaggcagaggttgtagtaagccgagatcacgccactgcactcctgcctgggcgacagagcgagactccatcaaaaataagaaaaacaaataagccattattattctatgtatttgttgtttacagtcaaacctaagcccaactaatatacatacttaatcaacgacctcgcttacagaaaggtctcccaacaagtgtttcctggcttaccccagtgaggataccgaaaagcccagtacacaacataatcaccaaagattttctgaagcaatcttaaaatgacaggacaacatttcctagaatgtgataaaacaatcagtctcattattttagccatacaacatatgcttttccttttaaatattttagtaacatgctaagtacaatttgaatctagctaccagaaaaaaaaaaaagaggtaacagaaaatgcatgcagcctcccagtgctgacaatcagagcctacattccacagggcagcagatctgctgcctgggtaaggcggcaccatggcaacaggcaggttgctaggaaaccaagagaggataacccctggaggagcggcttctaccgcagggcatttctcagaggaattcatgcacttccatcccctaagagcaggagataatgcaatgcactcaacactagctactcaaacagctattgccacaaatatcttctatggcaaagagcacttgtctcttcctcatagataatcctgcctttggaaaacagtctgcagagcagaataaaaacacagctcactgaatcattcagaatagtatacgctcagaggtagtctcccttgatttggaggagttaaggtccaagagtcctcatatcacataagaaatcagtggcaataaagctcttaagctcactaggctgacatcccatcacctctggcctcaaagtgttaagacaaaggtcctttcttccctgcttctcctctgctgctacagcctcgcttcttaattttccttacaagccagatgattccagggcaggacattatctacacggagaaggcaacagagtcctcagggaaattaccttgtgcagtaatgactgaggctggggacaagaatgcaatcttctcagattgtatgcaatggaggcttaattaatttggggacaattcctaactagttcattcaagggtactgtagtccaataaaaactcctaacaaagcttttcttccaaagcatcaacatatcaggtgatgatcaaagaagaacttagatcaccttagataagattacatggtaatccatgactgaaaaactagcccttggcaggactatccagattccagccaagtgagcaagtggaggcaggggtcagaggcgggctctgcatggctccccatcctcgagaaagctccactgcagatccagcatgctgcaccgcagttggcacaggcacccacacaaactggtgctggctcccacactgagcattgctgaccagctgcgtggtctctgcacatttgcagaagataatcatatgctgaaaaaggtttcatgcaaacctcattaaagaaattcagtattctgaacctgtctcatctactgtttactaacttaaaagttccagatatatgtgagtctactataaatgtcacttttggcttccttcagttagtactttataggaatactgccttcacttgaaatctaaaatgttcagaccacagcatgggtcacgggaggatatcagactggcccagaattccgattcagttgctttcaccacagagggctgttatgagaattaaatgaattaatgttcaataaaaagcaaaacgggccaggcacagtggctcccatctgtaatccaagcaccgtgggaggcagaggcaggcagatcacctaagccctggagttcaagaccagcctgggcaacatagtgaaaccccatttctactaaaaatacaaaaaatggccaggtgcagtggctcacgcctgtaattccagcactttgggaggccgaggcgagtggattacttgaggtcaggagttcgagaccagcctggccaacacagtgaaacctggtctctactacatatatatatattagccaggcatggtggcacacacctgtggtcccagctactcaagaggctgaggcaggagaatcacttgaacctgcaaggcagaggttgcagtgagccgagatcaagccactgcactccaacctgggtgacagagtgagactccgtcttaaaaaaaaaaaaaaagcagaacatctccgcatgggttagctattataatttctgtagtttctgcaaatcatctaaaccagtggttctcaaagtgtggtccaaaacgccgagcatcccagggactctttcagggggtgagggcaaaatcctcatgataaaaccaagacatcagttgccattttgctcattcacaaaagtccagttgagtttctgcggaggcatgtgacatgacattgcaacagactgaatgcccaagcagctaataatccagccaggtgttaaaaggattgcaaaaatgtaaaacaggctgctcactaaatatttgtgttttggaaaatattttttcattaaaaatataatacatacaataaatatatatatgttaacatgtaatggtttatcaatatttcaaagcattaatttttaaacactgacagtttaacttataagatgttaaatattgatagatacagcccacgtaaacacaagctctttggggtcctcaataactaattagtatatagggatcctgcaaccaaaagtttgagagcctccaagctaaacatctggagaacaaccaacttctgaaaccaaaagtgggagggataatttcctcaacttatagctgcttcccttttcagatttacctcaaatcagagccaccatgaacatctaaattatattagacttccctgtacctatcacctacatagaaccctccccaaaaggtgtgggaggggcaggtcccaaactatcatcaactattataaaagtcaacacttcatttgcgcccaaagtcactcttaatttcataactcctaaaaacaatttcttaaaattaatttcagaaaaataaaagataatattctatctaatcatgacaaagactcggcactatgaagcaatgaagtttcaggcacactagcctacacttccacagctgaagtctacctggctacacctcctggcactcatcaatgctaagcacctgttatgtgccaaaactgccgcacatgctgcagacacagcaagcgatcaagacaacacacacatcacaacgccaggtagcggtgagtgctacaaataaagcaaggtggggtggggcagctatttcaggcacatcagtggggaactctgataaggcaacatcaagcagggacccgaatgcacagagaggaagccccatgggttacccagggaggaagatgttccagagaggtggaattcaaaatggaaaatctctgagcaccaagaaggaaggggccagaaggctggacagcaggccagacagaagagagggggaggagctgagaggtggccaatcaccaggtgacaggcgaccttgcggacacacttgagttttattcctagtgctataggaagccacatggccctctggtatcaatgcctgaaaaagagacttactcgtacagaacagcatcccatcacagctactgagagagtcataagtaacgtgacaaatactggccaaaagaactttctctgcgtcttcttcaatcttagtcatgacgtttccactcatgtaaataattttttaaaggcagtatctgtccaaatgtggccagaatttacaatttttacatttgcaagtctcattagaattcacctagcagtttattagacgtcgatgtccatcaatagggattaaaaagacacatccatacaatgaaatactcagctgggaagtgggaagagattaaggagacctgacagccaagggcaatgtggcatactgggttggacccaggaaccaaaaaatgagattagtggaaaaactggtaaaaatccaaataaagtttgcaatctagatactgacagtgtcctgatattaattacttgcttttggcaaatgtaccatggttatacaacacgttaacagtaggggaagctgggggaagggtatacaggaactcagtatactacctttgtaacttttctgtaaatctaacattatctcaaattttaaaatttaagtacatctatctgtgttagcatgaaattacctctaggatatattgtttaagaaaacaagaagaaatgcaaatgaaaccactaagtcattttactcctatcaaattagcaaaattgaaagttttaacaatatcaaatgttaacaagggcatgcagtaactggaaactgaatacgttatggaatggcaactgccaagatcatttgagagcacttctacaattgttagttactccacaactcagcaattctgctcttagacatatgccctagataaatgttttccatgtacacaaggagacatgtacgagaatttttacagaagcaggctgtaatagaaaaaactagaaattatctaaatgtctatcactagaacagaaatgatacaggccaggctcagtggcttatgcctctaatcccagcactttggggggctgaggtgggcagaacacctgaggtcaggagtttgagaccagcctggccaacatggtgaaaccctgtgtgtactaaaaatacaaacgttagccaggcatggtggcgtgcacccataatcccagctactcgggaggctgagacaggagaatcacttgaactcaggaggtggaggttgcagtgagccaagatcacaccactgcactccagcctgggcaacagagcaagactctgtgtcaaaaaaagaaattacataaatggaatactatattgtagtgaaaatgaaatagacctacatatttttgtagggggctttccagtaaaaaccagaaagccttctagacaaattctaaaagacataacagtaatctatacattttcaacatagaaaaacctccctagcaaaacaaaaaactaacctaacaatatacagtggtccctccttaaccatagcttccttttctaccgttgcagttacccacggtcaaatgtggtttgaaaatgtattcccacagtcaaatgtggtctgaaaatgtatcctgagaaagaccacattcacataatttttattatatattgttttaattgttctgtattactagttgttgttaatcccttactgtgcctaatttataaactaaactttatcacaggtatgtatgcataagataaaacatacatatataaataagatttggtcccacccacagcttctggcaacccctgagggtcttggaacataacccccaaggataaagagaaagactatttattggatacaatatttgcaaaatgtttaaaatatccaaaacaatactctatacacactgctgaagcttccagtcacatgtatggaaggaaaaagacctaacggggaggaaaaacaagtccaggaaggtggctctctacgggggcagctgggttatcaggttccatttcttaacctgggtgttgcgtacacatgtttatgataatcacttttccacttttcaaatgtttcacaatttaaggagcaacaagcaaaacagtcagtagaatatactactatttgtgttaaaaagaaaaaaggcagaaggaactcacacatgggatgtacctctgcaagcttctaagggagctgctaccaggctgtttggggagggcctggggacagcagtggcagggacaaaccttgtactctatactccattctactgactgacctggcttcccacgtccatctattatctactctaaacagctcgcctccatttacgaatggggaaaccgaactagggggctggaacagacaacctcaggtccaggattagtgacaacagatctagacccaagcattcgggttaccaggaaccagctctgatctgctgggctgctctgatgtcaagatcccctggcagctaaacctagtttggctacctagactatgaactgcctgccaactccctcctaactgctgtctacctaccctggcttgttttcctgactcactaattatacccagcatgtatgtttttaataagtcaatttaattttgttaaagtcacaacgtcctttgaaattaaagacgccaaaggaaatcacaaaatcaagggcagaaaataggccgctgtgctgttggggacaaagatattgacaatacattacttttattagtggtacagcaacaaagaatactaactaagcccttttctgtattaacctaatttattaaagctaaacagcaacccagtgaaatagatgagtaatgccactttacaaatgatgaaatacgggagagtttaagcaacttgcccaaggtcgtacggctactgtcagcaatgagataatgtgaaacttccactccacattatcatcttgtcccaacatacaaaattacaaatgccacaaagttatttttttggaacttcatgtaataaaaaataaagcaattagtacttttgcaacagccaaaatcttcatcccaatcactgtatttatcatcattgttttaaagcccttaaaaaaaaaaaaaaaaaagccaggtgcggcgactcacgcctgtaatcccaacactttgggaggccgaggcagacagatcacttgaggtcaggagtttgagaccagcctggctaacatggcaaaaccctttctctactaaaaatacaaaaattagccaggcatggtggcaggtgcctgcaatcccagctatcagctacctgggaggctgaggtatgagaatcacttaaacccgggaggtggaggttgcagtgagctgagatggtgccactgcactccagcctgggcaacagagtaagaccctgtctcaaaaaaaaaaaaaaaaaaaaaaaaaggcaagcagggcaatgtaattctaattagtactctctttcattgatctgaagaatatccagaccctccttcctggtggcagaaccaaaaaggagccagaaagcaaggcttacagcctggtagccagtaacctagaatctctgctagaagctgcctccaaagctgccatgcacacctgtctaagtggctttggtcttggccttgagaacttcctaagcatgcctcattaggtgctgttcccagccagcaacaccccgccctacccttccacttccccacagctgcctggacatcccatggtctcactcaccaagaaaatggaagaccaagttctcctttccctcatctacaaaatgccacaccaatcaatccaacacacttcaactctcatagtttgttctcaaaacaacctgtcagggccgggtgcggtggctcacacctgtaatcccagcactttgggaggccgaggcaggcggattacttgaggtcaggagttcaagaccagcctggccaacatggtgaaaccccatctctactaaaatacaaaaaattacctcccatttacccgagtgttcagggaagagggtcctttggtcaactaaatattgtggttaaccataagcccatatataccagaggtggattttataggcatggtggtgggcacctataatcctagctactcgggaggcagaggtgggaaaatcgcttgaacccggaaggcggaagtggcagtgagccgagatcgcgccactgcacaccagcctggggacagagcaagactcccatctcaataacaacctgtcaggcttctccctttcggatgcctctctctcacaagagagagctgctctcctttctcctttcttctgcctattaaactttctgctccaaaaaaaaaaaaaagaaacaaaacaacctgtcaaatgtacttcaaggacttgacaaatcactgatttgttaaaacaaacccttctttcttcaggaattatactcttattttcacagaataaaactgatttactattaataaacaggagatttatccaaaatccctgacaggccaagacctgaagttcctactgatattcagcaggccaggctataaattcacatgttattgaaagaatatatataacaccttctagcatccccagaaaacataactgtcttagcgtggtgtagacaacattcagcaggctagccaccacacagctgacagctatcagggcatctaagcttcagggagcacctgccacatcccaggcaccatccctcatgccttacacctagctgatgaacacgctcctttttccaccagaggactcacctaacagcaataccctccatgatcccatttgtaaaagatcgaaactgcagccttcacatctatggtgttcaaaggttaacaatgtttccttcggggcaagtgggacagggcagtgaatgggtgaacaggggcctctggatgctactgcactgctccccaacctcgggggctgctcactttgtggtaattcatcaagttgtctacttaatcgtccacgtatgtaacttacactaagtttttaaaagttaagaggtccatgtggacagagggatatggaaaaagcgagcactgtggagtcttgggttctggtcctggcatccccagtaaatggtctatgatttgggagagtcacctctgggcacctccaggtcttcattccttacaaaggggtcagattacatgctctccaattctctcatggtgccatggctttgctttcgcttttaggtggggaaaaaggaggggcagctggatgggcagaaaagtaactcaaaagcaagtgtctctaccaccaggacatcactgaaacacaaaatacaaagcccatcccgattcagggtggcattctgtactacgacagtgtcacgaagaaagttctaagtgcctctcgggcagcagacaatggctgcagtcaccaggcactttcactaacaaaactcattatcatgtctagaaattttaggagtaacattttcacaatatcacaaaggggccagagctgtgaaggccagggagcattcaaacactgttatcagcactgactttggcctaatcctaaaggtaggacagcaaagttaaaccaaggccattacaatacctcccatttacccgagtgttcacggaagagggtcccttggttaactaaatattgtggttaaccataagcccatatataccagaggtggattttatatttcccgagacacgattgagtcccttttgggtgatgtgaatgaatcagaactcttaagggtcttgtgaggagtgactcaacgtcaacaagaacaatggataatgtaaaaagaaagaaaaaaaattgccctgaatcagtataaaaaatttagagaccagcattagtttattatacagaccatggaataactgcagtataagcttgagtataaaatcaaaatgatttttttataagcagatcatctttcattgtgtacaagtaaaacaaatttaagagcttcgtatagggtcaagatacattcttgagagctgctgaaagctaactcatttcttcggttttgcatcaaccctgtcatccactttgttactttttattaaaatttgggtagctaggttaaaaatggcagccagcccttaaactacatatagttactaaaaaacagacattgtggtgggggctgggtgcggtgtctcacgcctgtaatcccagaactttgggaggctgaggcgggagaatggcttgaacccggaaggcggaggttgcagttagccgagactacgccattgcaccactccggcctgggcaacaacagcgaaactccgtctcaaaaaacaaacaaacaaacaaaacaaacaaacaaaaaaaaaacggccaatagcgtgcaagactttcttttctctttttctttttttcacaggtggggtcttgctatgttgcccaggctggtctccaactcctaggctcaagcgatcctcccacctcggtgtcccaatgtgctgggattacaggcataagccaccgcacccagatgcaagacatttcaaagcaagtgaaatgaggaccccatggcaaaataactggaccagaaaaccctatatcgccttcaatacctatgagaattaagctccgattttttttagcttgcccaaattcctatctaaggggtgtaggaatcataccctacaaaccataaactctcatcagatgggttttatttgaccccatatatcgtgacttactttccaatctgactctggcataacattttataagacaaggaaaaaaaaatcaaaatatctaaccccaaaatatatttccttgccataccttgaaattgccctgcaaagtctcttgtgggaaaaatccacattctatagagaatcccctttcccctatgttttccttccttcctctccagatccaggagataatcaactaagagccagtcaccctttcatttccatagaaatattttacaacgtgctcgctctcttagtcggctacctgagagcttcctctgcacaataaaacttggtctccacaatcctttatcttaacttgaatactttctttctattgattctaggttttcagataaactcaaccaattatcaactagaaaatgtttaaatttacctatggcctggaagccccccgccgctttgagttgtttcgcccttctgaaccaaaccaacgtatttcttaaatgtatttgattgatgtctcgtgcctcccgaaaatatgtaaaacccagctgtatcccaaccaccttaggcacatgttctcaggacctcctgagggctgtgtcacgggccatggtcactcatatttgcctcagaataaatctcaaaatatttttacagagtttgactcgttttgtcaacacctagaatccagagtaaatacatatgcaaacgtcaatatagatgatacacatgtgcttcctgcagcttcgctacccttacaaacaggcaactgaagccaacggccaaagtgtcctgcgggacggggctccagcccacctcgatcacgtgcgcccagcacaggcacaacacagctgcccaaggggtcaccctacaagactcacccacccccacagtgggaagcgcagcctgagggaaggcctcggggccccagccgcgcaggaacccactcgagccccgaaggagatgctgcccagggcctgggccgtcctcccgggggcattttcgcagcccgccccccgcagcccccagccgcccagagaaagccagagaaagccagcgaacgcgcctgcgcagtgcgcgcgcccccttgccaactagggcagggggagcagaggggccaggcccggcacagcccattctggggcagatggacgctgcgaggcacctcctccccaggatgagggtcccagggcttacccgcgcccaggaggctggccaggaggaagagggcgtacatagcgccgtctgactccgcagtctgcaatgcggagcgtcagctgatcccccgcagatataaatctgccctgccccaaagccgtccagagcgcaggcgctaacccc

SEQ ID NO: 379 - DNA, 35028 bp, Homo sapiens; identical to SEQ ID NO: 378

SEQ ID NO: 380 - DNA, 35028 bp, Homo sapiens; identical to SEQ ID NO: 378
